United States Patent 12,275,987 (EGG-TYPE CHICKEN WHOLE-GENOME SNP CHIP AND USE THEREOF) - sequence listing, part 3

SEQ ID NO: 29120 - DNA, 121 bp, Artificial Sequence
  Synthesized
  misc_feature (61): n=c or g
tgtacacagcaaaaagcagtgataaaagggaatgaaggtggttatctgctggagcctattnaacagatgagtagcacagaggagccaactgtttaattttctcatcttatgccttaaacat

SEQ ID NO: 29121 - DNA, 121 bp, Artificial Sequence
  Synthesized
  misc_feature (61): n=t or c
agtgatgttattccttttataaagctgaattactcttgtaaattaacatttgtcttttaanaggtacattcccttaacatgtattgatttaagtggactcaactgtatttcaagtaaagat

SEQ ID NO: 29122 - DNA, 121 bp, Artificial Sequence
  Synthesized
  misc_feature (61): n=t or c
ccaggagctgggtagcaacactttcggtgaaagccttcaagagaacacccacccaaattcngcacagagtgcacttcatgacacgatctgttctgttgtaggttgtactgaagttgtgaca

SEQ ID NO: 29123 - DNA, 121 bp, Artificial Sequence
  Synthesized
  misc_feature (61): n=t or c
agcagaaaattttatatcagtgggtatctaatggtactttaatggtacttaatggtaattnaagcacacagattcctggcaaaactatgacctccctagcagttaaaaatattgctcttag

SEQ ID NO: 29124 - DNA, 121 bp, Artificial Sequence
  Synthesized
  misc_feature (61): n=a or g
gtagggccgtatgcacaggacagctgcgcgtcaggggcaccttgagatgggcaggaaagcnctccttggtgggggattcaggagctgtacatgaaagtaacagcactgagacagcacagac

SEQ ID NO: 29125 - DNA, 121 bp, Artificial Sequence
  Synthesized
  misc_feature (61): n=a or g
attggttggaataaagttaaaatatagcttcaagaaaaagagtaacatttccttatctacnaggagctttttcttcatatgcctcagtattgtctctcacatacagaagactggaattggc

SEQ ID NO: 29126 - DNA, 121 bp, Artificial Sequence
  Synthesized
  misc_feature (61): n=c or g
gatatgtacaatgctctatcagagagaggatgtacccagaggaagttgctcaggctcacanacctatgttaaatgttacctttttccagcagtgcctgcacatggatggcagtcaccacga

SEQ ID NO: 29127 - DNA, 121 bp, Artificial Sequence
  Synthesized
  misc_feature (61): n=t or c
gatagatagagctgagtaggataataccgatgaaattattctgtgcccaattagaaatctnagaatgatcttacatactgttctgcaacacagtaacagagaaaaaaaagtaatccaagca

SEQ ID NO: 29128 - DNA, 121 bp, Artificial Sequence
  Synthesized
  misc_feature (61): n=a or g
cttggccgaggggggggggggggggggggggggggggggcagggtgagtgggggagggganatcggcgaggagactgctgcatgctggccaaggaccctgtacaaggaacaaggcagtcac

SEQ ID NO: 29129 - DNA, 121 bp, Artificial Sequence
  Synthesized
  misc_feature (61): n=a or c
ggtgattgacagataacttgtagggcataggagtgatgctgaggagggcacagatgttatntttaatgactgaccagcaggatgcagtgagctataagagacactgccttacaatggcatc

SEQ ID NO: 29130 - DNA, 121 bp, Artificial Sequence
  Synthesized
  misc_feature (61): n=t or c
tctagaatgggctaaaagtgtgcaaaaaagagagtgagatgggaagaatctggaaaaatcnatagctcctttattgcattaaacccacagaagtctcttcactgttgggaaaaaatgaaga

SEQ ID NO: 29131 - DNA, 121 bp, Artificial Sequence
  Synthesized
  misc_feature (61): n=t or c
tgcactaacgtctataatatacagcttagagagttcaggtattctgaacaatatatcatanggggcatattcaaatgcatactctttctcaaagctgtatctcctatgctttgcatatttt

SEQ ID NO: 29132 - DNA, 121 bp, Artificial Sequence
  Synthesized
  misc_feature (61): n=a or g
acatggatacagtgctttccaaactgttgaatttgaaactggctgaacagaagagtttccnaagttagcatgtctatcaaggtggcttacaattttagtttaagacttgtgaaaaacacac

SEQ ID NO: 29133 - DNA, 121 bp, Artificial Sequence
  Synthesized
  misc_feature (61): n=t or c
cccaaggcaaaaggtgttgaatttgatgtgtttacaatcacaatcttgctgtcatcaccangatcagtgaggagtaaacactgagcaatggtgcacaaacactgagctggcagcactgtct

SEQ ID NO: 29134 - DNA, 121 bp, Artificial Sequence
  Synthesized
  misc_feature (61): n=a or g
ggaaagtcaaggtcctttgaaatgaggttccattcccataagggcaacaaaaagctcagcncatggtagcttgaattgttaaagctccttgctaaattttatttggtgccctcttttgaaa

SEQ ID NO: 29135 - DNA, 121 bp, Artificial Sequence
  Synthesized
  misc_feature (61): n=a or g
tttttttctattcaagacccagtcaaaaatgtggtatttgatgttttggtagcatattgcntgaacagaaatacttttctgcttggatacgtgccatcataactcttcattgtgcagcttc

SEQ ID NO: 29136 - DNA, 121 bp, Artificial Sequence
  Synthesized
  misc_feature (61): n=t or g
caccttagcatatgaggactgctggttgcaatattatagcttcgtacaagcacagcaggtngtgtctgcctgtaccttttccctcccccagcacacccaccctacagccggcttaattagc

SEQ ID NO: 29137 - DNA, 121 bp, Artificial Sequence
  Synthesized
  misc_feature (61): n=t or c
ccagctagagaagcaagtctgagtcacggccacaagacttcatccctcaagtcaatgcatnttggatacagggcaatggttctgactttggatactcctaccacagcctggtagtgcctac

SEQ ID NO: 29138 - DNA, 121 bp, Artificial Sequence
  Synthesized
  misc_feature (61): n=t or c
tgatcaactgatgaattctatttgaaaagctctaggttagtctggggaaaggatgcatttntgtgaatgctctggaagatgcctgaaaaggataggttttttattacatttcgaaagttct

SEQ ID NO: 29139 - DNA, 121 bp, Artificial Sequence
  Synthesized
  misc_feature (61): n=a or c
gttgtacttgtgaaaagttacatactgtgcttcactagcagtctagttcctcttccaaagntgagtctgtctgtgtttcctgaatatacacagtcaaaatctcccttacaaaaacaaacaa

SEQ ID NO: 29140 - DNA, 121 bp, Artificial Sequence
  Synthesized
  misc_feature (61): n=a or g
aagcatacagacacaagcttaactttgctcatgaagaaatcattttaaatacaatagcatntacagctatccaagcagcctagagttcacaatatcaggattttcagtagcgtaccaataa

SEQ ID NO: 29141 - DNA, 121 bp, Artificial Sequence
  Synthesized
  misc_feature (61): n=a or g
ctccctggggctgtatgggtgaatcaggtgttaacccaccagctgctctttcctctcactnggttctccttctgcacctgcatgggctttttctgagcagcagcaaaggtgtgaaagcgtg

SEQ ID NO: 29142 - DNA, 121 bp, Artificial Sequence
  Synthesized
  misc_feature (61): n=t or g
tgccaatatgctctcccctgcctgcagccaccttgcacatcccaagagttccaatgtaatngtttctttgggtatcttccagctacagtagggactcataagctgatgggcaatgtcccag

SEQ ID NO: 29143 - DNA, 121 bp, Artificial Sequence
  Synthesized
  misc_feature (61): n=a or g
acggatgttcttgcagttttttgccctgcttttcagagcgctacgctgtgcccaccgtttnttctgcagggcttgttaagattaatgggtgggaattgagaaaggtgaccgaatgagtatt

SEQ ID NO: 29144 - DNA, 121 bp, Artificial Sequence
  Synthesized
  misc_feature (61): n=a or g
aaggagagaaacaaagaggcactccccacatcagtgtggggaaaactgcaccccaagagcncacgtcctgctgaattaacagtggatgcagctgtacatcacaggactggcaagacaagca

SEQ ID NO: 29145 - DNA, 121 bp, Artificial Sequence
  Synthesized
  misc_feature (61): n=t or c
gtgaaaatgggaaatatgtaactttgtatgcatgcactttttatcctgctagagagcgtgnccttctatattagatgctggataatagaaaaacatcagaaatctctagactgtccgttcc

SEQ ID NO: 29146 - DNA, 121 bp, Artificial Sequence
  Synthesized
  misc_feature (61): n=a or g
gtctgaatattctgtttgcagtatggcagccatgcaaggcattgtgttggtgctctgctgncagaggaggcagagctacaagttgccacactctgaaacaagaaaaaggatgaaggttctg

SEQ ID NO: 29147 - DNA, 121 bp, Artificial Sequence
  Synthesized
  misc_feature (61): n=t or c
acagctcgtgcagcaggatgtgcaaaggagaggggttcatgtggggctttgcaaagagacnctagagcatcatgttctgtacatttcttacatcttctgtacatttgtaccattgtctacc

SEQ ID NO: 29148 - DNA, 121 bp, Artificial Sequence
  Synthesized
  misc_feature (61): n=c or g
gagtagaggcaatggaatctaccctaatggcatggagaccaagaagggatgagggacgtgnaacttcccaagcaatgtgctgccctggacatcatcctctgtgagccaatacaaggtgcta

SEQ ID NO: 29149 - DNA, 121 bp, Artificial Sequence
  Synthesized
  misc_feature (61): n=a or c
tatgcaaactaaatctactctcaggagaagaatgatttccgtttcccctccagcacccacngctgcacacacctgttgaaggaatcatcaatcaagtcccgtttggcctttttggaggtgg

SEQ ID NO: 29150 - DNA, 121 bp, Artificial Sequence
  Synthesized
  misc_feature (61): n=t or c
ttcacctgctgctcgaaggaaggatactaatgctgctctggaatggtttgctgaatgtacntgaaaatggatctctaacgtgtgcgttgcatctctccattgtggttaacaacaccaatac

SEQ ID NO: 29151 - DNA, 121 bp, Artificial Sequence
  Synthesized
  misc_feature (61): n=t or c
tgattcacctccagataccttttatagtatcccactactcttttctggaggctgaggctcncgtaccttcatttctacacaaacactgagcgggagcagaagcaagctgtttatcttgata

SEQ ID NO: 29152 - DNA, 121 bp, Artificial Sequence
  Synthesized
  misc_feature (61): n=t or c
caccttggtgcacggccacaagcaaagggacaaagtagagattcatttccacagtaacaantgtagagcctctatatacttatagcctcccacatacatcctgaagaggaaaagataacat

SEQ ID NO: 29153 - DNA, 121 bp, Artificial Sequence
  Synthesized
  misc_feature (61): n=c or g
cacttgttttttctctgctgagggggaggtcaaacctatctactctaggtacttctctctnaatctcctgcagttctaaaatggctgtttacgaattggacatgcttggaaatctttgtga

SEQ ID NO: 29154 - DNA, 121 bp, Artificial Sequence
  Synthesized
  misc_feature (61): n=t or c
catctgcacctcccatcccaaatctcctcgcggggctgcaatggacaccttgcttcaaccngtagtccataatttcatcagggaatgtcaggtggcttggggtgagagttgcctgtaaaaa

SEQ ID NO: 29155 - DNA, 121 bp, Artificial Sequence
  Synthesized
  misc_feature (61): n=a or c
ggccttcgctgtggacgtggacaaagagccatcaggagctgtgagcagcagcctttcaggncaagcctgctggaaactcgcagctcagtcccaaaacaaggccgtctttgtggaccttcag

SEQ ID NO: 29156 - DNA, 121 bp, Artificial Sequence
  Synthesized
  misc_feature (61): n=t or c
aataggagatattagagtctttaaatatatatttctttcacagttacagaataagtataangatggggcagtgggattctgagacatacataaaaataataacaaaaatacatattttttt

SEQ ID NO: 29157 - DNA, 121 bp, Artificial Sequence
  Synthesized
  misc_feature (61): n=t or g
ttttaaggtagcacctggggcataatttttatggattccaatctcttagacccacagcccnctctttttatgtcagctttcagcagctgctaccatcttattgagcttcgccatcccatgg

SEQ ID NO: 29158 - DNA, 121 bp, Artificial Sequence
  Synthesized
  misc_feature (61): n=a or g
tatatcatgaaggactgttattatgttaaagccataaatattttcccaaagactttgaatntcaaagcttattttatgttagtaggtcgtgttattgttatttggcgctcaaggctgctgt

SEQ ID NO: 29159 - DNA, 121 bp, Artificial Sequence
  Synthesized
  misc_feature (61): n=t or c
tgtcagattttgaatggttataacttgtgactgtaaatttgccgataaatggtaaatcagngtgaccttcatccgaaagaaattaagagtattacctaaagcttgggttactttaaccatg

SEQ ID NO: 29160 - DNA, 121 bp, Artificial Sequence
  Synthesized
  misc_feature (61): n=a or g
ctgttgtgcagagctgttgtgcagagctgttgtgcagagctgttgtgcagagctgttgccntaaggctgatgaagacgggaacactctaaagaaaagcacctggaatgccctgataggtag

SEQ ID NO: 29161 - DNA, 121 bp, Artificial Sequence
  Synthesized
  misc_feature (61): n=a or g
tccattaagtttaagtttacggggaaaattatggaattttgaccaggctgatgtacttacnatgcctttaatttcccccaggactaagctgatagatacttatctggttctaacattgatt

SEQ ID NO: 29162 - DNA, 121 bp, Artificial Sequence
  Synthesized
  misc_feature (61): n=t or c
cttaagagcatcacagcttatatgttaaagcattgatgtttgctttaaattaatgtgaatntgaacttgtttgtgtagtccttttggaggtgtatcactggaagagaagggtgttgttttt

SEQ ID NO: 29163 - DNA, 121 bp, Artificial Sequence
  Synthesized
  misc_feature (61): n=t or c
aaatgaaaacgacgactccctgtcctgtttcggtcagtgtaactactgatcccagtaaacncaactcttccgggtccgaacggctgacattcagattattaactctaactcccatacgtaa

SEQ ID NO: 29164 - DNA, 121 bp, Artificial Sequence
  Synthesized
  misc_feature (61): n=a or g
acagatgagcctccagcaatattctcataaataaaaccgagttgcctatcaggtacagttntttggtactgaagagttcagcaacaggaccttaaaactatgagaggggcagaaagtctga

SEQ ID NO: 29165 - DNA, 121 bp, Artificial Sequence
  Synthesized
  misc_feature (61): n=a or g
caccataaatatttcttcctagaatagtgatcttctgtgctgcacattcctgtgacaactncagtctccccatgtgatacaatgcagcttctcaatatgcatgtactatgccatgcataat

SEQ ID NO: 29166 - DNA, 121 bp, Artificial Sequence
  Synthesized
  misc_feature (61): n=a or c
gtgttctttgagtccacttgaaaactcagctgtcatggtatcggtttccacaatacactcnaaaaactttccctattcccccccaggacatccttttcgttttagtcatatgcttagttag

SEQ ID NO: 29167 - DNA, 121 bp, Artificial Sequence
  Synthesized
  misc_feature (61): n=a or c
ttagggacattatacagagttgcttcttacacaaacagatatttacatatggcactggtanatatatagctgcaatttctataagcaattagactctgaggtcacccttctgggaggtgac

SEQ ID NO: 29168 - DNA, 121 bp, Artificial Sequence
  Synthesized
  misc_feature (61): n=t or c
agcagctccctccagaaagaagcggaggaagaaacaggtgagctgtctcacagaactgagntctgcttctgagctgatggatgaccagctacccaggatgtgtagtcctaacacttcctga

SEQ ID NO: 29169 - DNA, 121 bp, Artificial Sequence
  Synthesized
  misc_feature (61): n=a or c
cacctacttccccatttaatcattaatacccacttctaagtatcatctaacttctgatccncacctgcaaactaactaactccagttattaagtcctatcccaacattggtcctgaccctc

SEQ ID NO: 29170 - DNA, 121 bp, Artificial Sequence
  Synthesized
  misc_feature (61): n=a or t
ttcgccttccctctgttatcatttcagtgaggcagcaagcagcacatgagatgtttgcagncaagacagagcagtttctctctgctgctccttccttctcacatttttcctgcattcaggt

SEQ ID NO: 29171 - DNA, 121 bp, Artificial Sequence
  Synthesized
  misc_feature (61): n=a or g
agctacagtaaatactatagttgttgaggagtagcactcagaatttatctggaaagggacnttgtggtttggtgctactgcccatctcttgttcaactcagtggactcttgagtttatttg

SEQ ID NO: 29172 - DNA, 121 bp, Artificial Sequence
  Synthesized
  misc_feature (61): n=t or g
ttttatgaggtgtatatgtgatacaaaggggaacaaagaccatcaaaataaactacggtantctggatctggaggtagcaataagctgctggatagtgtcacaactcgtctatcttttcac

SEQ ID NO: 29173 - DNA, 121 bp, Artificial Sequence
  Synthesized
  misc_feature (61): n=a or c
gcagctctccattaccaaaacctttccatgtaaacccaatacaaacacacaccattctagngggatgaatatacttaccacacttacttcagtcagctcatttctcaagtaactagtgcag

SEQ ID NO: 29174 - DNA, 121 bp, Artificial Sequence
  Synthesized
  misc_feature (61): n=a or g
tccttctccattaggagactggaaccaagaccgccgtgtgaattgcaaaccggtctggctncacccttgcaaagctccacgtagaatgggcagcctgtcctcacccagcggagagcgctcg

SEQ ID NO: 29175 - DNA, 121 bp, Artificial Sequence
  Synthesized
  misc_feature (61): n=t or c
tcagagtgtaattgcacagccttctatgaactattcaatctgagataatcatcaagggtcngatgaagtcagatgagttggatcaatttctttagcttctcacatttcctttaatttatac

SEQ ID NO: 29176 - DNA, 121 bp, Artificial Sequence
  Synthesized
  misc_feature (61): n=a or g
cccaaccagcactcctgttgtgtgtaaacccgacttcgttatttatgagagtcggtgtctntgggacgtaacggtcaccaattaatatccgcagtgcctcagggtgttttttatctgtgta

SEQ ID NO: 29177 - DNA, 121 bp, Artificial Sequence
  Synthesized
  misc_feature (61): n=t or c
atctgtttctgaaatgggtttgataatgggcataaaatactacagggtttgcaaacactgngttgtgtttgctgaacatgaaacatgagggacactttgtccgggcacatagtgacagggt

SEQ ID NO: 29178 - DNA, 121 bp, Artificial Sequence
  Synthesized
  misc_feature (61): n=t or c
gcaggtggcccacctccgtgctcatgtgctcattcatactggggagaagccatacccctgngagatctgtggcacacgtttccggcacctgcagaccctcaaaagccaccttcgaatccac

SEQ ID NO: 29179 - DNA, 121 bp, Artificial Sequence
  Synthesized
  misc_feature (61): n=t or c
ggtaacatttgtcctgacgaaagggaaaggtctcacctggattcaaccatgcagatcatcnttgagatatccatccaactagaaaatgaaattaatttcaagactgttctcccatccagag

SEQ ID NO: 29180 - DNA, 121 bp, Artificial Sequence
  Synthesized
  misc_feature (61): n=a or c
ttcgaacactgcatttaggagcacattctagattttctctgtagctgttttatcccaaacncaaccgaagtaagtgaaggcgtacagaacatggcagatacctctaacctatgttcttttg

SEQ ID NO: 29181 - DNA, 121 bp, Artificial Sequence
  Synthesized
  misc_feature (61): n=t or c
ctggccaaaaagttcttggtgaggtgggatagggctagttttcactgctctggaatagatncatggtgtggctgaattgccatctttcaaatctccatttttcccttcatattttattcct

SEQ ID NO: 29182 - DNA, 121 bp, Artificial Sequence
  Synthesized
  misc_feature (61): n=t or g
cagtctattctctcttctggcaacagcagtgaattaatttggtatgaaatcatcaggaaanaaatttagccatattttttcaagttgctgtgcagtccttgtcattatgcagtcccttatt

SEQ ID NO: 29183 - DNA, 121 bp, Artificial Sequence
  Synthesized
  misc_feature (61): n=t or c
cccacattctttttcatcagttttctcactcccgctacttaaaatgtctcatcttatttgnctgaaaaccattcacagccagcaacccagagattgcgtactcttggcctccactggaaaa

SEQ ID NO: 29184 - DNA, 121 bp, Artificial Sequence
  Synthesized
  misc_feature (61): n=a or g
tccccaccctcacttctcagcccttcctgaaaaccagctggggctcagcaccaccatcagntagtcacaaataagaggacctcagtggttttgtaagaaacatcttgctgttgccaaaaac

SEQ ID NO: 29185 - DNA, 121 bp, Artificial Sequence
  Synthesized
  misc_feature (61): n=c or g
tagttctggcaaaattttatggacttttggtgatgtgtggtttattatatctttagaactntcatttcagcaatgtcattctacctgaaggcagtaggatatttttcacttgtgcttgtgt

SEQ ID NO: 29186 - DNA, 121 bp, Artificial Sequence
  Synthesized
  misc_feature (61): n=a or c
atcgacacctatgctatggctgaagcagcagacagacacccatctctgccagcctgcagcncccgtggttcctacctgttatgtaccagctcagccatcagtttgaggacaggtgtcgtgc

SEQ ID NO: 29187 - DNA, 121 bp, Artificial Sequence
  Synthesized
  misc_feature (61): n=t or c
atctttcactaggaatagtgcttgtactatcagatgctgttaaagtatttatgtttttcgncctcaagaaatgttcatcttcccttactgtgtcccccaggttggatttgttttgttcagc

SEQ ID NO: 29188 - DNA, 121 bp, Artificial Sequence
  Synthesized
  misc_feature (61): n=t or c
catcccagcatggtgcgcaaaggtccgatatggatcgtgtgccatatccagtacaatgaangctttctttctgtctttgctggactctgaaactcttttgctttacttctctttggcgctg

SEQ ID NO: 29189 - DNA, 121 bp, Artificial Sequence
  Synthesized
  misc_feature (61): n=a or c
cccagttggatgaacagatctgttcgtttctctagtaatcaggaacttcttacactggtantattcagctgcatcttagaccaaattctcaatagagaagtttgaccaaacagtcacattg

SEQ ID NO: 29190 - DNA, 121 bp, Artificial Sequence
  Synthesized
  misc_feature (61): n=t or g
atatggctccattttcatatgctaaagtgataaaaatgccaagtgaatagagataacctgncaagtgtgtacaagtgaaagtagagttatagtgagtaaaccaggaattcaaatgaaatat

SEQ ID NO: 29191 - DNA, 121 bp, Artificial Sequence
  Synthesized
  misc_feature (61): n=t or g
tgtctacatatcagtattacgctgtataacatttaaatatgcattttgtgtggaatactcngttttcagagagcttgtttattaaggaaaaaaatccatcagactttgtaggctgacagcc

SEQ ID NO: 29192 - DNA, 121 bp, Artificial Sequence
  Synthesized
  misc_feature (61): n=a or g
gcacagagataaagctcgaggtctggcggctgctgacggaatcagtgtcagtctgtatacnttcctatttcaaaatgccataacacaagactagcatctctgggccatgataatccatgga

SEQ ID NO: 29193 - DNA, 121 bp, Artificial Sequence
  Synthesized
  misc_feature (61): n=a or g
atctctccccttcacaaaaatagagtcaatccaatgaaacaaaagggaaaatgaagtaacntattcgtgtcaatcccagaacggccccatttagaataaaaatatgaaaaatatttaacag

SEQ ID NO: 29194 - DNA, 121 bp, Artificial Sequence
  Synthesized
  misc_feature (61): n=a or g
acagctgtagcagagaggaggttgccaaaatcccacgctgcggtctgtgattccaggtagnacgcagcaactttctggaagcgtggtgggacaataaaatgtgttaaaggcacagcactgg

SEQ ID NO: 29195 - DNA, 121 bp, Artificial Sequence
  Synthesized
  misc_feature (61): n=a or t
tcagaggttcagagagattcgtgcattgattcctcaatggtaaaataagctccgccaatgntttttctggaattctacctggtcatcactaatttctcacaaaatacatctgtgtcatcct

SEQ ID NO: 29196 - DNA, 121 bp, Artificial Sequence
  Synthesized
  misc_feature (61): n=a or c
tttggactaggagctctgggtttgctgcacgacgtcacgtgcttatgttacacttgtgctnatcacaaaaatttaactgagagacattactcctttcaaaagagtgtgcctaacactgacc

SEQ ID NO: 29197 - DNA, 121 bp, Artificial Sequence
  Synthesized
  misc_feature (61): n=t or c
tggtgactattacctaattaagacctttcaggttttccaaaattttgcatatgtctgtatngtcatggatggtaaatgttttatactagaacaccaacactgggcattagagatgatgtgt

SEQ ID NO: 29198 - DNA, 121 bp, Artificial Sequence
  Synthesized
  misc_feature (61): n=t or c
ataagagccaggagaccagctcaagtcaagctctctttctttcttaataaatacaaatccnaagtggtcccattttgaacatagtaacctaattttgttggagagctgtgcaaaaaggcta

SEQ ID NO: 29199 - DNA, 121 bp, Artificial Sequence
  Synthesized
  misc_feature (61): n=t or c
ggaggaaacacttcacagttatgtataaacactgactgcatattagtcattgtagacaggnaaatgtataaaacaaaacagcatctctggattatgacaactatggctattccagacatat

SEQ ID NO: 29200 - DNA, 121 bp, Artificial Sequence
  Synthesized
  misc_feature (61): n=a or g
tatattagttttatgcaaacagaattcctctgactgttcaagcacaggaacttgagcttcngcagcaccaagcttttctcctgcctgctgtagcaacccatgcgaggattctgtattcagt

SEQ ID NO: 29201 - DNA, 121 bp, Artificial Sequence
  Synthesized
  misc_feature (61): n=a or t
ctcctttatcattttgcttgtggtaacgtgcaagtagtgtggtcagcactcctcttgcatntcttatgcagcagcactgggcaagccattttcatagaatcatggaatcatttgagttgga

SEQ ID NO: 29202 - DNA, 121 bp, Artificial Sequence
  Synthesized
  misc_feature (61): n=t or c
acaaatgggtgctctaatacttaatagaacctgtgggcttactgcatgggaacttcataangtgtggggttgtttccagccccaagtcagcaggcgtgttgctgaggtggctcaggcagtt

SEQ ID NO: 29203 - DNA, 121 bp, Artificial Sequence
  Synthesized
  misc_feature (61): n=a or g
tgctagttggattatttaatccaatgaagttgtgactagtctaagcgtcctcacacacgcngcatacaaccatcttcaaaagacacattaaggtatactgaatcctattttaaaaactcca

SEQ ID NO: 29204 - DNA, 121 bp, Artificial Sequence
  Synthesized
  misc_feature (61): n=t or c
gtaattgctgcatgcttcttgaagaataaaagggaaaaaattaaaaccttcatttttcccnacccacacatttctcttcgctcacagatcccagccctcagattgcccctccctctgcaaa

SEQ ID NO: 29205 - DNA, 121 bp, Artificial Sequence
  Synthesized
  misc_feature (61): n=a or g
gtgtgttcacagattactcatgtgtttatgaacaatggcaacgagatcccaatttgtctcngtgaccttttgaagcgagggcttcaaatgaagcagcacagtggctgtctgcatttggctc

SEQ ID NO: 29206 - DNA, 121 bp, Artificial Sequence
  Synthesized
  misc_feature (61): n=t or c
gttgttggttcccagctcaactggctacaatggttcctgttttctagagctctgagcttcnagcagttgaggatgcaaataaatcactttctaatctgttctgtgatgtagaaatgacacc

SEQ ID NO: 29207 - DNA, 121 bp, Artificial Sequence
  Synthesized
  misc_feature (61): n=t or c
ggaggcatctggatgacagtggggacacctgggtcccatccaatgtgcacatctgtgtccnatgccatatggacacctggatgacattgggaatggccaggtcccgccccactgaagacat

SEQ ID NO: 29208 - DNA, 121 bp, Artificial Sequence
  Synthesized
  misc_feature (61): n=a or g
agttggggaagaagaacctgtcaggggttgttgtctgggctcagtgccacgtcctgtgccncacagcctctatcagccgttagagagtcctcacctgatcctatacaccaccacctggctg

SEQ ID NO: 29209 - DNA, 121 bp, Artificial Sequence
  Synthesized
  misc_feature (61): n=t or c
agagaatatgaaattagtttcattggattgccatcaccacttgccttgacccatttttacnagggctccatgttctgttgttctgtagttcactgtcatgtctaaaatatttgttcccttc

SEQ ID NO: 29210 - DNA, 121 bp, Artificial Sequence
  Synthesized
  misc_feature (61): n=a or c
tggttgggggcttccatagggcaggaagtgatgcaggcttcatcagctaaataaaaacttnatttacaaaagggggcaacaagatggtgtcttcttttgttactttattcttgttttctaa

SEQ ID NO: 29211 - DNA, 121 bp, Artificial Sequence
  Synthesized
  misc_feature (61): n=t or c
gagtacgggctgggttgttcttggagtcaaaagaggttgttccacagtagcagaaggaggnatggatttcctctggatttagatgtccacagggtagtcatttgtatctgagagagtcacc

SEQ ID NO: 29212 - DNA, 121 bp, Artificial Sequence
  Synthesized
  misc_feature (61): n=a or c
tctgtccactatcctctgttctcagtatgaatcaaaacattgtgagggaggcagacctctnctagtttgcaaatatcggtgggaattttgatcagaaattctcagttcagttctttaactg

SEQ ID NO: 29213 - DNA, 121 bp, Artificial Sequence
  Synthesized
  misc_feature (61): n=t or c
aggcgaagaccccaaagtcgaagggttcgcgacagcactatccagagagaactgcagcacnggagcggaggcacagtgccctgttggaatgatgccacacatggcgatgttgcgctatgtg

SEQ ID NO: 29214 - DNA, 121 bp, Artificial Sequence
  Synthesized
  misc_feature (61): n=t or c
tttgttttgcattctacaatatggaatagttctatcctagccaaaacattttcagtcagantgtcttgtgttcctttatccttgcttcttcaccagaaataacttcaaattggaaactgaa

SEQ ID NO: 29215 - DNA, 121 bp, Artificial Sequence
  Synthesized
  misc_feature (61): n=a or g
ctgcatgaaactttatagacactgtaatgcattatttttaatgattcccctgcctacttcnggctatggaaaccaagaggagcttccctagtttcctggcggtgcgttagcaccgatacct

SEQ ID NO: 29216 - DNA, 121 bp, Artificial Sequence
  Synthesized
  misc_feature (61): n=a or g
tcctacagcttcacgccacactctgcatggagttctatttcagagaggccatttctgagcncattcagcatcccttcctaacaatcctgttttcaactcattcagagactaatcattgcat

SEQ ID NO: 29217 - DNA, 121 bp, Artificial Sequence
  Synthesized
  misc_feature (61): n=a or g
aagaagttcataccaacgcagttcagaaagaagctttgttctaattatgtttgtataggtncatactacaactgagtagcatcaagctatttgccatatgcttgtctgatttctcctacca

SEQ ID NO: 29218 - DNA, 121 bp, Artificial Sequence
  Synthesized
  misc_feature (61): n=a or g
tggatgtaaaacagaatttcctcaaactaaaataaacttatcatgctggaagtcttgcacnataacaaaagaacagtatagagcaactcccctgtagatgccataagaagattttcagctg

SEQ ID NO: 29219 - DNA, 121 bp, Artificial Sequence
  Synthesized
  misc_feature (61): n=c or g
tgttgtgaagcctccgccgctgagctttgaagtggcaacacagatctttccctgagatganatcgtgaattggaaagttgttgagtaactgaggagtgaggggtccgacacaagccgtaaa

SEQ ID NO: 29220 - DNA, 121 bp, Artificial Sequence
  Synthesized
  misc_feature (61): n=a or g
agagagattcaaatcacaaaagctacataatggtctcaaatgaggggaatcaccaattagnagtgttcttgatgcatctttcttcagcttacatccccacagaaggaagaacaaagcccaa

SEQ ID NO: 29221 - DNA, 121 bp, Artificial Sequence
  Synthesized
  misc_feature (61): n=a or g
gggaaaaaataaggtcagtgggagtatgacttagaattgtagtatttttggtatggtattntgcctgtttttcattacatgcattttaggtggaaaggaaagaaacaaaagaaaagcaaac

SEQ ID NO: 29222 - DNA, 121 bp, Artificial Sequence
  Synthesized
  misc_feature (61): n=a or g
aatacaaattttctgaaatctctgccaaaactatagttggcgagcaaacaatactgatganttgatactctgcttccttggaggccaaaaatacctttctcatgatgtaatcatggatttt

SEQ ID NO: 29223 - DNA, 121 bp, Artificial Sequence
  Synthesized
  misc_feature (61): n=a or g
tattctacttccaagtgctttggagacttctgtgctggaagcactctgcatcacttctaantgttacaatcaaagtacagatgctttgtaatagggtattaccacagaaaacagaggacta

SEQ ID NO: 29224 - DNA, 121 bp, Artificial Sequence
  Synthesized
  misc_feature (61): n=t or c
tgtttctggttgtcacagtgatcacgctgtccctctgttttcagggcctgtaactccacantggcaactaacttggaagtgttggaaagacgagatgtcttcctggtggagaggtcgtggt

SEQ ID NO: 29225 - DNA, 121 bp, Artificial Sequence
  Synthesized
  misc_feature (61): n=a or t
gtgtcattaatgtacctttttatctgtaaaagtgtagtgcagtgaggcaccataagccatngataacacgtgacttttatatttctatttggaagaactgagttgtgcttggaactatgcc

SEQ ID NO: 29226 - DNA, 121 bp, Artificial Sequence
  Synthesized
  misc_feature (61): n=c or g
gcttggattacttgcctaaagaattttgcagaactgcatcaagtggtacatcatacaagantaactgtggaagtaaatacctgagaaaaattaggcttcaaagagttttggtagagcaaag

SEQ ID NO: 29227 - DNA, 121 bp, Artificial Sequence
  Synthesized
  misc_feature (61): n=a or g
tgcaattctggctgttttcaagaaagctggtttaaactaggagataggatagtcaagaaantgacagctgtgtctgactattatctgaagagtatagtttggttatcttaacaaaatgaat

SEQ ID NO: 29228 - DNA, 121 bp, Artificial Sequence
  Synthesized
  misc_feature (61): n=t or c
catcagcgcgatccaggttgtttcaggagttcacttggcttattgactgccgttcccttcngccaccaccaaagattaaaacacaaaagtaagcctctaatgccgacttatcagactctta

SEQ ID NO: 29229 - DNA, 121 bp, Artificial Sequence
  Synthesized
  misc_feature (61): n=a or c
cagagcagaggatgctgtgggggattccgacctcctctgtcttcgcaggcaaaagtccttnctttagcaccaaagctctggcttatgggggaaacacctggccctcctggtgcagttgctg

SEQ ID NO: 29230 - DNA, 121 bp, Artificial Sequence
  Synthesized
  misc_feature (61): n=t or c
ctcagaggaattaacacaactttttgtaccattttaattaaattgatttttaaagccacancttagggcctattttaaacaacgttctatcaactttggtgaagatgttttaccacctaag

SEQ ID NO: 29231 - DNA, 121 bp, Artificial Sequence
  Synthesized
  misc_feature (61): n=a or g
tcatttttccctgtgagactttggtttttaaatgctgaaaacagcttttgtttccatcgcntttggcaaccaaaacttcagaatgacaagtttctagaaacttaacattcttagcagtatg

SEQ ID NO: 29232 - DNA, 121 bp, Artificial Sequence
  Synthesized
  misc_feature (61): n=c or g
tcagccatgtgctgaaatgtttgcttattactaaaatgtgttaagcgtgacatcattattntaaaatgagccacagaaatataaaatgcactgtgatattgcaaactgagtacagtttgat

SEQ ID NO: 29233 - DNA, 121 bp, Artificial Sequence
  Synthesized
  misc_feature (61): n=a or g
gcaggccatggaagcagaaacagacccatctcaaaatgcccacttcctagcaggataagcnatgcctcacactacccccagaccacacagaggaaccatcattcctgcatcaccattacaa

SEQ ID NO: 29234 - DNA, 121 bp, Artificial Sequence
  Synthesized
  misc_feature (61): n=t or c
ggcagctacttgttgctgaagacttctgagtgagagcgcgtggttttcctttcctttaggnaacagcaggtgtatgagtatgatccagttggtggaatcagttcaaatatgcttgctaaat

SEQ ID NO: 29235 - DNA, 121 bp, Artificial Sequence
  Synthesized
  misc_feature (61): n=t or c
atggtaaagaatcagaggtgatctcttatgtcaagtctggaattctctggaggaggtgcanagtcatactcagagcatttgtccacttcatggcagccttacttcttacaacagcctttct

SEQ ID NO: 29236 - DNA, 121 bp, Artificial Sequence
  Synthesized
  misc_feature (61): n=t or g
gctgcaaactgacagccttttcttcctggaggctttaggctgctgatgtctggagtaacgnttaggatctgaagggaccgaaatcccggagtccgcgtgcggtttggaggtagaatcaggc

SEQ ID NO: 29237 - DNA, 121 bp, Artificial Sequence
  Synthesized
  misc_feature (61): n=t or c
aaaatagcagcctgtaggatcttcgtagttagtgcctttctgtaacagaattcactccacngccactgtcctcttgtaggcatacatccacttttcttcctgtggtaacgcacaccttagc

SEQ ID NO: 29238 - DNA, 121 bp, Artificial Sequence
  Synthesized
  misc_feature (61): n=t or c
tggtacttccatttttaggtgttaaagggagatcgggttgtgaacacctccaaatttgagngctgatactgaagctgtcttttgtctttttcctttacagtatgttgtagtcactgtttgc

SEQ ID NO: 29239 - DNA, 121 bp, Artificial Sequence
  Synthesized
  misc_feature (61): n=t or c
gaaggattttgtcctgtatctgtaaagcacctgtgtcttgagcaggactggatggcagggntgttgcctaggttccaccacttctttccactggctaaaaactggaatggcaaattggtca

SEQ ID NO: 29240 - DNA, 121 bp, Artificial Sequence
  Synthesized
  misc_feature (61): n=a or g
cctgccctgctgtctgtcctcagcacaacttctgtcagaggctgtcctaggcagagccccntttctcccattgtgagggagggcaggatttgttggcagcctatgttccagtctgacttca

SEQ ID NO: 29241 - DNA, 121 bp, Artificial Sequence
  Synthesized
  misc_feature (61): n=a or c
aaagagaccttcttccccatttgtttgtggttggctcccttatgggggccctttgccgtgnttctagccatgaacatacttgtaagcatgttctcagaagagatttggcatcaagaaaaaa

SEQ ID NO: 29242 - DNA, 121 bp, Artificial Sequence
  Synthesized
  misc_feature (61): n=t or c
agcaggacaaatatgattgccagaagaaaactaaaaagcagtttaaactaagaaatgatanaagttccaatccttatccactcagtgagggtcactgcaggcagtcagcagagtctttggc

SEQ ID NO: 29243 - DNA, 121 bp, Artificial Sequence
  Synthesized
  misc_feature (61): n=t or c
atcaatattttgatcttcctggtgacatgaataccaattttaaccctatgaaaatacttangtactcttcccatctgagttgaccattatgtttgttcctagatctgaaacagactggcat

SEQ ID NO: 29244 - DNA, 121 bp, Artificial Sequence
  Synthesized
  misc_feature (61): n=a or c
ttcacatttcatgttttatattttatagtgttcctttgaagaagaactaaataaatgtttnttggatcttaccaacccagataccttaatgaaactacaaagtataactagaaaaatggag

SEQ ID NO: 29245 - DNA, 121 bp, Artificial Sequence
  Synthesized
  misc_feature (61): n=t or c
cagtgtcactgcaccctctctgtaagcatagcaatccaataccagaaagatgatgatcagnagagatcagctgaaatgtctgaccagcccaaaaagtttcaagtcatgcatttgcctgtgt

SEQ ID NO: 29246 - DNA, 121 bp, Artificial Sequence
  Synthesized
  misc_feature (61): n=t or c
caggctcttcacgccttttgtcttaacacagatattctggtcttttgcagagattaagggnaccttgtctcactcataaatctttccaacatgttattttgaatgtacccatattcagtta

SEQ ID NO: 29247 - DNA, 121 bp, Artificial Sequence
  Synthesized
  misc_feature (61): n=t or c
attctttcctgcaacgatgtcttatgtgaaataggcaagatcctttaagacaccatcactnataaataatttataagcctcaattccatcacttcgcagggtgtcacctttggacagaatg

SEQ ID NO: 29248 - DNA, 121 bp, Artificial Sequence
  Synthesized
  misc_feature (61): n=t or c
gagcaacgtaagagaaaataacaaaaagaaatgatagatgccagacaagttttctccctcngtgaatctctcatctcattgtctctcctgtaaaagtttaacaaaactcacaatgattgag

SEQ ID NO: 29249 - DNA, 121 bp, Artificial Sequence
  Synthesized
  misc_feature (61): n=t or c
ggcagatttgctttcaggttgtgtcattcattcttctccatagacatccacgcacatcccnagtcctctcatgcatcctgctgctagagcatgtcctgtgctggaacccagtttgttgctc

SEQ ID NO: 29250 - DNA, 121 bp, Artificial Sequence
  Synthesized
  misc_feature (61): n=t or c
ctgagagatctgcttggggatgagggagggaggaatatgtaggagatgcagattgaagagngttagctagacagatgaatatggtgagaaatcaaataagaactacccaggccatctccca

SEQ ID NO: 29251 - DNA, 121 bp, Artificial Sequence
  Synthesized
  misc_feature (61): n=c or g
gctgctgcatggtggcagttccatgattcgtggagattgttgaaagaaaatgacgaaaagnatcttttgatttcatgaagtattgtgtgcgtttctgacaagaccatattgccaaacagac

SEQ ID NO: 29252 - DNA, 121 bp, Artificial Sequence
  Synthesized
  misc_feature (61): n=c or g
ttcaacactctacagcttaaggacttctcaaggcagatattttatcttttgtgcttggtanacaataatggctattttgccattaatttttctaattgtttttctcagtgaaaaagaacaa

SEQ ID NO: 29253 - DNA, 121 bp, Artificial Sequence
  Synthesized
  misc_feature (61): n=a or g
tgcttatttgaaatacaaatacagacagaacgcagaagggagaaagacaatggggtttttnttttggaatttatccagggagaataaatctattttaacaactgaaaatatgacttgtact

SEQ ID NO: 29254 - DNA, 121 bp, Artificial Sequence
  Synthesized
  misc_feature (61): n=t or c
cttgtctgctgtcagggatggatgtctgtgcatctgcctaggcagaagtgactgttagctnctctgccccattttcttttctcctccattctttccatctgggaaactggaaaagagaact

SEQ ID NO: 29255 - DNA, 121 bp, Artificial Sequence
  Synthesized
  misc_feature (61): n=a or t
aataacgtgtaatcgtcatccttgcatgtggtttatgtcatgctatctacatccagtactncctggagaaatataaagatgtaactttagaatgaacttcccctgtcatgatcagtctttt

SEQ ID NO: 29256 - DNA, 121 bp, Artificial Sequence
  Synthesized
  misc_feature (61): n=t or c
aaaaatatcttggcatggcaatgctatataatacttgaagcctgatatgacacaaaataangtctggagacgctgccctggagacgtgcctttcattggctctgcatttgatccccagtat

SEQ ID NO: 29257 - DNA, 121 bp, Artificial Sequence
  Synthesized
  misc_feature (61): n=a or g
gagcatattaatgtgggatttatgttcttgtcaagtttaagttgtgaaaacaattagggcntgtacagtaataaaattcactatttgattatattggtgtttttcttgtggtggagtctat

SEQ ID NO: 29258 - DNA, 121 bp, Artificial Sequence
  Synthesized
  misc_feature (61): n=a or g
tcttctgaacagggctcctgacatcaaattgcagagagaatgcaattcaaagaaaggtaanctatttgacttgaatgcaagtctacccagggcttccctagcattaaaaaaatacttcagt

SEQ ID NO: 29259 - DNA, 121 bp, Artificial Sequence
  Synthesized
  misc_feature (61): n=a or g
tgtcaagggaccaggaatcaacagacccaaggtacatgggatatttcagctgttgatactncagaagataggggaaatctacctcacagattagacacatacacaataaaagatgtgggag

SEQ ID NO: 29260 - DNA, 121 bp, Artificial Sequence
  Synthesized
  misc_feature (61): n=t or c
ggcaaaaacagcaagatgaaattgcaaagttaccattatactacaactgagctctcaactnagtgcaacaacctcaagcatttaaatatatttgctcataaactccacagtcaataaggct

SEQ ID NO: 29261 - DNA, 121 bp, Artificial Sequence
  Synthesized
  misc_feature (61): n=t or c
tgatcaacccatcccctgtcaatgtctaagctagtggaatggctatttatacattctctgnagtgtaactaggaaacagtgtcccagtcttgctttttaatatcttatttcttaacttagc

SEQ ID NO: 29262 - DNA, 121 bp, Artificial Sequence
  Synthesized
  misc_feature (61): n=t or c
gaaaagaaggaaatgtgtgtgcaaaggggccgtgccattgcagtgctattgcagcagtctnggcttgctggtcccatggaaaggctgagaacaacgtgagctcttgctttgctttcacgtg

SEQ ID NO: 29263 - DNA, 121 bp, Artificial Sequence
  Synthesized
  misc_feature (61): n=a or g
aataaaaacgatgaggtaataacttccatgtttatcaattcttcatgttttcaggagtggnttaaatgctgcagattgtaggctcaaagctgcaactgcatattttcaggtacaggattaa

SEQ ID NO: 29264 - DNA, 121 bp, Artificial Sequence
  Synthesized
  misc_feature (61): n=t or c
tgtaagaagagcatgagaatgtctgttagaggctagacccatggatttctagggagagccncaaaatcagctggctgcgttgtgaccctccactggacagcttttctagcaggcagtactc

SEQ ID NO: 29265 - DNA, 121 bp, Artificial Sequence
  Synthesized
  misc_feature (61): n=t or c
ctgagaaatatagatgtttaacttgccggtcccgactgacagcagctgtgacagctccaanccagcagaacccaaggacactttgccatacagtgcaatgtttaagcatgtttgattctga

SEQ ID NO: 29266 - DNA, 121 bp, Artificial Sequence
  Synthesized
  misc_feature (61): n=t or g
aaatactttggtagtagattaagctccagagcaatgaaaacatttaaaaaagagcacaaancctgcaagtgtccaaatgagggaccagaaactctgctttaagctccaggagggggtttat

SEQ ID NO: 29267 - DNA, 121 bp, Artificial Sequence
  Synthesized
  misc_feature (61): n=t or c
gagctgattgctctcccactggaatgagtggcaaagctgtctcctattcatgcagggtctntaatgctggggccgtcgtgctgttttctccccttagcatttggatatgcgacacaaatac

SEQ ID NO: 29268 - DNA, 121 bp, Artificial Sequence
  Synthesized
  misc_feature (61): n=t or c
gataaatgtcttattcataaggttcattaagcagctgcagtaaagaaattttggaaacttnaagtgtctcaagccataaacagaccttaaaatatgcttttgtctttggaaaaaaattctt

SEQ ID NO: 29269 - DNA, 121 bp, Artificial Sequence
  Synthesized
  misc_feature (61): n=t or c
ggcagaaaaccagagcaggagacccgcagcagcaaacaactgcatgcactgacataaatancagtgtttaattcagagctggcgttcaagtagtgacgtaatctcttatctccagtgctgc

SEQ ID NO: 29270 - DNA, 121 bp, Artificial Sequence
  Synthesized
  misc_feature (61): n=t or c
agagatcgcatctccaaagcatgttgctcttgactagtacctctaggtactgctataatgnaaaaagagattaagtaattatatatgttgcttatattcatgtttgtgcttgtagagatgt

SEQ ID NO: 29271 - DNA, 121 bp, Artificial Sequence
  Synthesized
  misc_feature (61): n=a or g
gattgacgtagtttctcacatgtaatgctgtggcctgttttacagctgaaaggtcagaatngaagggtcagggatagggaaagcgaaaccaaactgtttatcatctgtaacagctacgtga

SEQ ID NO: 29272 - DNA, 121 bp, Artificial Sequence
  Synthesized
  misc_feature (61): n=a or g
caacctctgcctgaagaagcccctggccttgatgctaaagggacatgctgtatttgttgcnttttgctacacttcctggaatatcccctgctgggtgctatccccaccagtttcctgcagt

SEQ ID NO: 29273 - DNA, 121 bp, Artificial Sequence
  Synthesized
  misc_feature (61): n=t or c
cactctaacatgaaagaagaatgccaaaagccatagcaaccaccaggtcacacctccaggngatgggacgcactcatctgcccacgtgttgcaatggatgtggccagcactgcaaagcaca

SEQ ID NO: 29274 - DNA, 121 bp, Artificial Sequence
  Synthesized
  misc_feature (61): n=a or c
ctgctggctcacatcaaattaaatattcactgaagcaccagctttgcagagaaaaggcagngttcttcacgaggagataatatttggaagcagaagtgtctactggactccaggaagctga

SEQ ID NO: 29275 - DNA, 121 bp, Artificial Sequence
  Synthesized
  misc_feature (61): n=t or c
aactcaatcaccaaggcatatgtgatataggaggagagtttgcagcagggcagaagggagnggggaaggaaatgggtatagtatgcaaggaaagaagacaagaatgaggatgctctgatgt

SEQ ID NO: 29276 - DNA, 121 bp, Artificial Sequence
  Synthesized
  misc_feature (61): n=t or c
aatagcatgtgctttgttctgagctatggaaaggaaaaatataggtcacttctggatacgngttacttaaactaaaatatcaaataatttatatatttttaagtacataaaatcctatcac

SEQ ID NO: 29277 - DNA, 121 bp, Artificial Sequence
  Synthesized
  misc_feature (61): n=t or c
tgaagcctccacatccaagtgggatttaagagctaaaactaacaaaccatctcttcatganacaggaaaccgagctaacttgcttttcaggtaagtcagggcaaatctatgactaacagat

SEQ ID NO: 29278 - DNA, 121 bp, Artificial Sequence
  Synthesized
  misc_feature (61): n=t or c
attacaagatcagccaggtcattccctctgttgctcacggcttgaaatgatatggcctcanactgccaagatccagtgataagatctgaaagcaacacagggaagaagatttggaaaactg

SEQ ID NO: 29279 - DNA, 121 bp, Artificial Sequence
  Synthesized
  misc_feature (61): n=a or c
cattatcttgaccaacagtggaagctgatcaccacgtgcagaatgggaatggaaggtttgnttagttaaggattgttttgctgttgctgactttctgtcttgctgatgtatttcaatttgt

SEQ ID NO: 29280 - DNA, 121 bp, Artificial Sequence
  Synthesized
  misc_feature (61): n=a or g
gccctgagcaagagttaggacaggctgagaactgagtcaggaaaagaagctttgggtcatntccacaggaagcactggggtgcatctaattccacatcatcacaccctacttactgctgct

SEQ ID NO: 29281 - DNA, 121 bp, Artificial Sequence
  Synthesized
  misc_feature (61): n=a or c
aagccagaaatagtctgtatagagtgagtcagcagactcaattcattttcaagacctcaantgtaataaaaatcacctgatgtaatcaaaacaatgaagctgcctatgtctttgtttcata

SEQ ID NO: 29282 - DNA, 121 bp, Artificial Sequence
  Synthesized
  misc_feature (61): n=t or c
tttgcccaggggtttcttccgatgcagggaaataattattagaactcaacgctacagagcnagcaaaatcaatagggataaatatttccttccacaaataaaagggaattcttttggctct

SEQ ID NO: 29283 - DNA, 121 bp, Artificial Sequence
  Synthesized
  misc_feature (61): n=t or c
ctctgcagtgctgccagccctgcaggaagcttggaacaagtactgctgccttcctcaccangggaaggcattcacggatttgggttctcattctgagcagcaaaaagtgagctttcacatg

SEQ ID NO: 29284 - DNA, 121 bp, Artificial Sequence
  Synthesized
  misc_feature (61): n=a or g
cctaacacagtgctaagaagtattcagaaactatggtgacggtggcataataatgtgaacngaatggaatacaaactctttttttcttaagtttgtagatccaaatttgagagaatgaata

SEQ ID NO: 29285 - DNA, 121 bp, Artificial Sequence
  Synthesized
  misc_feature (61): n=t or c
gtattgctgtcagagcattgcactttgtatgctgcctatgcaatgccttcactgatcttantgaactaaaataaatccatgcctagctcatgtttgagataattttgggaattgctggtga

SEQ ID NO: 29286 - DNA, 121 bp, Artificial Sequence
  Synthesized
  misc_feature (61): n=a or g
ctgccaacctttgctggtctgtgatgctgtgataacgcaagcatccgcttggaaagtggcntttgcagcattgaagatgtttttgcctatgcagtttgagagaatcacaccatctttctgc

SEQ ID NO: 29287 - DNA, 121 bp, Artificial Sequence
  Synthesized
  misc_feature (61): n=a or t
tggccaggagctgctcgctctgtgtaggacgagtgctgatgtctcctggtctctaagatangtaccttgggcaaacaaacatgaaacaaaaccctcactgttaaattcagtgtttcacttc

SEQ ID NO: 29288 - DNA, 121 bp, Artificial Sequence
  Synthesized
  misc_feature (61): n=c or g
aaacactacctggagaagggaaaattagctgtcagcaagggttcttataaataccagaagnaaatcaaacttccaggagtggaaggggatacatgggaggaaacaaagaacaaagcaagaa

SEQ ID NO: 29289 - DNA, 121 bp, Artificial Sequence
  Synthesized
  misc_feature (61): n=a or g
ctgacatccaggccaaaccaaggaaagggttgcagcatgcagaagagaggtagcaccaacntggggatgtgctcgctgtatgaagcactcgttctgcacgtagcttgtgtgaggcctttcc

SEQ ID NO: 29290 - DNA, 121 bp, Artificial Sequence
  Synthesized
  misc_feature (61): n=a or t
gagtgtgctgcatcctgggatggagcctctcctgccaagcctggcccttcaggcttccaanacgaggaagggtgtttatagccttgccagggcactaacatatgtgtcataaacctgatcc

SEQ ID NO: 29291 - DNA, 121 bp, Artificial Sequence
  Synthesized
  misc_feature (61): n=a or t
ccatagtgttaatggacagtagaaagtgtgcttgcagtttcccagagggagatcttgttcntccgagctttgatagtagttcagtagacaggagcttaccaagtgcaagattacaatagca

SEQ ID NO: 29292 - DNA, 121 bp, Artificial Sequence
  Synthesized
  misc_feature (61): n=t or c
atcccgtttgtcctgcttgtaagcatcaccgctgagctggtgcttcccagttcaatgctcngctcactgaaataagagttactttggacagcggtgtcctccctttgggcaggccagctct

SEQ ID NO: 29293 - DNA, 121 bp, Artificial Sequence
  Synthesized
  misc_feature (61): n=c or g
aagtatttgcctctaacacagcgggaccctaagaagattacatgtttagaacctaacagantttgtgttacgttcaactgatttctcggcagtcgagggttcacaaatcctacttctttca

SEQ ID NO: 29294 - DNA, 121 bp, Artificial Sequence
  Synthesized
  misc_feature (61): n=a or g
agcagcacgcatttcctttactgctcttcacagaaaggctgaagtgactcccaaccactancaatgcatccagggatttcaaaggtgaaattgaaatgtaaagtgggcaaatggcctaaat

SEQ ID NO: 29295 - DNA, 121 bp, Artificial Sequence
  Synthesized
  misc_feature (61): n=t or c
gagatgcatttgtttctggctgagggtgcaagcagtgggaccccggacctctgggggaacnaaactgcgggaattctatagacctgggaaagaaggttttggttttgtttctttttacaaa

SEQ ID NO: 29296 - DNA, 121 bp, Artificial Sequence
  Synthesized
  misc_feature (61): n=t or c
tcccagctgaggtgccttcctgtagccccccaggaggatgtctttggggatgtctgtccangccgtgcttctttcggctgtgccaagcacttctttcttgcaggatgaaaccaaggcagat

SEQ ID NO: 29297 - DNA, 121 bp, Artificial Sequence
  Synthesized
  misc_feature (61): n=t or g
agtgcaggtagctacagggctagcaattaggaataacttgtgtcaccagcgtgcatatcanacttgggtagtctcccttggccaactgctacaggtcacaaaagacagaactcaaggccac

SEQ ID NO: 29298 - DNA, 121 bp, Artificial Sequence
  Synthesized
  misc_feature (61): n=t or c
taatataatatttgcatattattgtaacacgcctcataaggaatattaaaaatactcaganagacctgtgaactacatattacaggatcccacagtatcccttgtattgcataaaaaatac

SEQ ID NO: 29299 - DNA, 121 bp, Artificial Sequence
  Synthesized
  misc_feature (61): n=t or c
caaagcactcaagaaatcttggtgatgcatattaagattgcctgaaaatttaaaggggatngtaaaaaaataactggagatgatgaaaaatacttggaaagtattcttttgatgcttactg

SEQ ID NO: 29300 - DNA, 121 bp, Artificial Sequence
  Synthesized
  misc_feature (61): n=a or g
ctttatttttttttcaggtaatggctttctccgtcctacaattaaatttcaagttgtacangtcatttttagcagatgagagaatacaaggaaatactcttcagcttccagtaatgcactg

SEQ ID NO: 29301 - DNA, 121 bp, Artificial Sequence
  Synthesized
  misc_feature (61): n=a or g
taacagcaagtggtgcaaagccagtgagctgctggatctgatggatactgtccagtatgancagctggcagcatcagcatgaggcaaaggacaagggagtcttcaggattagaagcaaaag

SEQ ID NO: 29302 - DNA, 121 bp, Artificial Sequence
  Synthesized
  misc_feature (61): n=t or c
ctttttccttttgaagaaaggagataagtggagagaggacaggtttcaagtcttttaagcntcattggaaagtgaaggcaggtgtcctcagcaactaatctaccagtggttggcaagggtt

SEQ ID NO: 29303 - DNA, 121 bp, Artificial Sequence
  Synthesized
  misc_feature (61): n=t or c
ctcatttcctgaaagagataggcagtaaaatcttagtttttaaaagcagcggttgcaaagnggtaaccatagcgctcaagcagaaagtcattagaagctcactgaaggaggaaggaatgat

SEQ ID NO: 29304 - DNA, 121 bp, Artificial Sequence
  Synthesized
  misc_feature (61): n=t or g
ttataaactaattgcaccattttgtagtaagcactagagtctggctcctaaacacaggganaacaaagaaaactttagagtagggcagtgctgccagcactcagtggagcccggggctcac

SEQ ID NO: 29305 - DNA, 121 bp, Artificial Sequence
  Synthesized
  misc_feature (61): n=t or c
aatgccatctcgtggttaaaagctgtatgtaacgactgcaggtaaacatctctccattttnattgcaaaacaccacttatgcagaaatgagttattcctacatgacctttccaactgtata

SEQ ID NO: 29306 - DNA, 121 bp, Artificial Sequence
  Synthesized
  misc_feature (61): n=t or c
ggaggaccctagatccacccctccttaggctcatttaaaggctaacctccaaaggaagaangtctcttggataaagactacttccttagaaggagtgttctatggtcagagaccctcatca

SEQ ID NO: 29307 - DNA, 121 bp, Artificial Sequence
  Synthesized
  misc_feature (61): n=a or g
aacctaatcctcaaactaaagaatctgcctttgtgtcagtatagaggtaaaggatgcttanagtgaacataatccaatggtgtcggtagcacccagtgatgtgtttctgctctatggatag

SEQ ID NO: 29308 - DNA, 121 bp, Artificial Sequence
  Synthesized
  misc_feature (61): n=t or c
gccattgggatggacagtttgctgccaggggttactcgtttcaaactggcaatagctgccntctttggagagcttttcctcttaactcccagcctttggtttgaccacagtcttcctcagc

SEQ ID NO: 29309 - DNA, 121 bp, Artificial Sequence
  Synthesized
  misc_feature (61): n=a or t
ctagccttcaaatgtaaggagttcaaccataattctgctcactctggaaaaaaaatctttnataaagggttttctatactgagttaacaatactctcttactgttctctctagataggaaa

SEQ ID NO: 29310 - DNA, 121 bp, Artificial Sequence
  Synthesized
  misc_feature (61): n=t or c
gagccccacactgcagcaatcccgcacggactgcggcgagcaactttccagcagccagcantgcttcccttagccaaataataaccacagctcccactgggcgtgggagatggcttcgagt

SEQ ID NO: 29311 - DNA, 121 bp, Artificial Sequence
  Synthesized
  misc_feature (61): n=t or c
ctcatggctgagatgaaccagggctgtgatgaaccagggctcccatcaccatgaaagtgcncaggatcaagcatagctaaatccattcccagtgccacattgttgagggatggctccacag

SEQ ID NO: 29312 - DNA, 121 bp, Artificial Sequence
  Synthesized
  misc_feature (61): n=c or g
tctattttaaatcactaattaatttaatgcataagttaggcatttcatgagattgcaatanatcgggaacatgtttttcttctttctgcatctataaactctgttaaaatacattgccaac

SEQ ID NO: 29313 - DNA, 121 bp, Artificial Sequence
  Synthesized
  misc_feature (61): n=t or c
aaagcaaacacagaaatgtcagaaaggaggtcacagttatgactccgcagaaactgcacangagaaacagcttataagatcatatataattcttccccacaagtgactgacagtacaaaat

SEQ ID NO: 29314 - DNA, 121 bp, Artificial Sequence
  Synthesized
  misc_feature (61): n=a or g
caatctgagttgctttcttgcttttgctgattattgaacttcaaattgaaaaagatattcncagcacccaattcctgttaaaattaacatgaatggcacatgcaaataacaacacctatcc

SEQ ID NO: 29315 - DNA, 121 bp, Artificial Sequence
  Synthesized
  misc_feature (61): n=a or c
tttgtaaaggatgtgttgcatgctctgggatattacacagggatgacagataaagtaattnatcttctttgctgttggcctcatctagttattggatacggctgttttcagagtacggaat

SEQ ID NO: 29316 - DNA, 121 bp, Artificial Sequence
  Synthesized
  misc_feature (61): n=a or g
gtgatgcccacacacgactctgcccccaaatacacagatcctgtcccttgtcttatgcacntatggagagatctgaaattgattccatctcccacaggcatggcttcatcctacacttctt

SEQ ID NO: 29317 - DNA, 121 bp, Artificial Sequence
  Synthesized
  misc_feature (61): n=t or c
gctctttcatagaattgtggaataatttaggctggaatggacctcaggtagcctcttgtcnaatctgttgcttaaaacagggccagttgtgagatccagtttgctcctccttatacagtac

SEQ ID NO: 29318 - DNA, 121 bp, Artificial Sequence
  Synthesized
  misc_feature (61): n=a or g
ttgaaatctattggaaaaaacatagaggtgaggttgacagtatataaaatggcaataattnctagatccctctggtatttttaagtaaatgaacagagttttgctgtgaggctgaacaacc

SEQ ID NO: 29319 - DNA, 121 bp, Artificial Sequence
  Synthesized
  misc_feature (61): n=a or c
tgactttagcccctcacacgcattaactgggtgcattttgcatgaccgctggggcaatccncagccagtgcctggagagtataaatggtccttcgtagctacccggggcaagggtggaggc

SEQ ID NO: 29320 - DNA, 121 bp, Artificial Sequence
  Synthesized
  misc_feature (61): n=t or c
atggatgtaaggaaaacagaacagctttcttatttaccaggaatctgccactaaggaaatnactgggtgttacaaaactgtgttgttgtagacatactacccaagccaatacccgctgaag

SEQ ID NO: 29321 - DNA, 121 bp, Artificial Sequence
  Synthesized
  misc_feature (61): n=t or c
ctctgctgacagcactgcaggtacagagttgtggccaaactgtggagctcagttaagtggngaaggagtgaaatacctgtgagacagcaaaagtctaagaaaataagcgttgttcgtatga

SEQ ID NO: 29322 - DNA, 121 bp, Artificial Sequence
  Synthesized
  misc_feature (61): n=t or c
aaggtgcaaaaggagcaaccactcagggcacgaagtccccatttctaccttcctcctctangccatgggacagaagggacccggcaatccgccatgggcagagggtcttgttgcacaggag

SEQ ID NO: 29323 - DNA, 121 bp, Artificial Sequence
  Synthesized
  misc_feature (61): n=t or c
ccaataacatctccagttctctgaagtccttattgataatcctcaggcttctctcaagganttcactgctgacagcttgaactatcaatacaggataacgatcagagtggcaaatcagact

SEQ ID NO: 29324 - DNA, 121 bp, Artificial Sequence
  Synthesized
  misc_feature (61): n=a or t
gagaagtaaaaagacccacgttatgttgaaaaggacaatgcttaaaatagatctcttccancttgggatctcccagcttaattcattctttcctatcttctgttccctttcagccatataa

SEQ ID NO: 29325 - DNA, 121 bp, Artificial Sequence
  Synthesized
  misc_feature (61): n=t or c
tacttttatttgcttttacactagctgacgtttgctgtacttactgctgtagtatacttcnatttctgtggtggtgtcataaataagttgttgctcattgtggacaaagctttacaagaca

SEQ ID NO: 29326 - DNA, 121 bp, Artificial Sequence
  Synthesized
  misc_feature (61): n=t or g
gctggcaacactgggctccaaagggatttcccaacgccaggttggacatgctgtagagatncagcctggagaacagcagaggggaaaactcacgctgtaccacacttctggtcctgccagg

SEQ ID NO: 29327 - DNA, 121 bp, Artificial Sequence
  Synthesized
  misc_feature (61): n=a or g
gaacgactcctaaatgtatttgagagctgaagttctcccttgatgctgaaacagggggagntgtaacagatcagcacggagcttctcgtagagctcccagcaggggaggagtttgtttgct

SEQ ID NO: 29328 - DNA, 121 bp, Artificial Sequence
  Synthesized
  misc_feature (61): n=a or g
attccctaagctaaagacaagcgaagtctgtttgacagagattggttaactcacaaactgnaagaacacacaagtggaactgaccgcataaatcagagaataaatgaaagaaaggctgttg

SEQ ID NO: 29329 - DNA, 121 bp, Artificial Sequence
  Synthesized
  misc_feature (61): n=a or t
catgtagttgtgtttgactgctggtagatggatttggaaaacatctgggataagcagaagnattttttcttcaaaaccaatgctctgtgctaattattgcttacctcattgtctgattcca

SEQ ID NO: 29330 - DNA, 121 bp, Artificial Sequence
  Synthesized
  misc_feature (61): n=a or g
tgttctgatttgagagagagaggcatcacgttttccacacagcctgtgtaaaaagatgtgnctatctagtaggagcacactcaagctgttaggtttttatccccataatttcaagggcatg

SEQ ID NO: 29331 - DNA, 121 bp, Artificial Sequence
  Synthesized
  misc_feature (61): n=t or c
atacatttgctttcaacctccacaagaacatcaggaagcagagcaagacacgggtccccangatactccagttctgcaggctgggaagatgtttctcctcaagaagacctgcccccacggg

SEQ ID NO: 29332 - DNA, 121 bp, Artificial Sequence
  Synthesized
  misc_feature (61): n=a or g
aatatctagtttcaaaataggaaagaaatgacacaatgagtagtgccataaaaaccatacntcatcgcacagtatattactcaaatggcacagatcttaatagtcacatgcattttgactg

SEQ ID NO: 29333 - DNA, 121 bp, Artificial Sequence
  Synthesized
  misc_feature (61): n=t or c
tggcatccagggaccagaccatggttaagcagacctaagtgctgcagctgcagtttaacangtttctcttcagacctacctccacatactttacctcgtgctctggcatagtgtatgcttt

SEQ ID NO: 29334 - DNA, 121 bp, Artificial Sequence
  Synthesized
  misc_feature (61): n=t or g
cgccgaagcctggaagagataaaagcagatttcacagggttttgcaacattgcaggatggnaccagcccatattcctgcttcccttccaaagacctgtagcaacaggccaggccagtagca

SEQ ID NO: 29335 - DNA, 121 bp, Artificial Sequence
  Synthesized
  misc_feature (61): n=a or g
ttttgttttgcttttaacttttcctgcatttgtcattgtaacaatatctgcaagacctctnggtgattagaaatggcattaagtcctcattctcctctcttttacccaccactggcgtgag

SEQ ID NO: 29336 - DNA, 121 bp, Artificial Sequence
  Synthesized
  misc_feature (61): n=a or g
gctgctgttttgatatgagcgtacacgtgtgtgttaagcacagtttaacttatatataagngacagttaggaaataccagagccaaacactcagacatgtttttcattcaagttccaagtc

SEQ ID NO: 29337 - DNA, 121 bp, Artificial Sequence
  Synthesized
  misc_feature (61): n=a or t
caggggaacaatatcttaacgttttggaatgaagtagcagacatgaaaaagtattttggcngtatttctgataaacattgattctgtattcaaatattgctgttacaaggttgaaacctga

SEQ ID NO: 29338 - DNA, 121 bp, Artificial Sequence
  Synthesized
  misc_feature (61): n=t or g
actcataggttgtggtaatgacaggggtattgctcacttgctgccatcacagattaagcanatttaacttgagaaagatgaacttaattttttgccctttagaaatggagcaggatagcga

SEQ ID NO: 29339 - DNA, 121 bp, Artificial Sequence
  Synthesized
  misc_feature (61): n=a or g
tctaattctaataagttctgttggaatttatttttgtatttttatttccagcttggagtcntgagtgctttaataaaacttcatgtttatgcagcatctttcagctggatttcttttttaa

SEQ ID NO: 29340 - DNA, 121 bp, Artificial Sequence
  Synthesized
  misc_feature (61): n=a or g
ccaccttgagtcaggcctgatgccaataggtgctgtgtacccagcaagcagtgatagcagnctattctgctcctgaaaacttgaaggcaaagaaaaagatctaatataaaaatattatctt

SEQ ID NO: 29341 - DNA, 121 bp, Artificial Sequence
  Synthesized
  misc_feature (61): n=a or g
aacatacttccatcctaaaacctccaatgaccctcaaagcaacgcaaggaaagagaaaccnagttatgccctgcatcctcccaaacgcatgcagagctgcaggaggacgactcagggcacc

SEQ ID NO: 29342 - DNA, 121 bp, Artificial Sequence
  Synthesized
  misc_feature (61): n=a or g
agcattacagagtcacttgtacacatgcttcttctgggtcttaccagccaagcagccttangctaagatttgggtttgtttaatgcagtcttttattgtgattgaatccgtttggtctgat

SEQ ID NO: 29343 - DNA, 121 bp, Artificial Sequence
  Synthesized
  misc_feature (61): n=t or c
ctgcatgccgccgctccacatcgggatgtctcagccagcagcaaagagcccaaagcccttnggagtaacaccttcattatcaaaaccattgcaattaaccccagagaggagctgtcagatt

SEQ ID NO: 29344 - DNA, 121 bp, Artificial Sequence
  Synthesized
  misc_feature (61): n=a or g
tgcttttctgaagcagagctccaagtagctcatcgctccacacaagcagccacagatgacncgtgaaggcaacatcaatactgcgtttaaagctgtatgtatttgacattcataaaagttc

SEQ ID NO: 29345 - DNA, 121 bp, Artificial Sequence
  Synthesized
  misc_feature (61): n=a or g
cagctgatgaaaaccttgaagcttcagcaacactacagaatctcctgagtgccatgtattnctcatagagagcagtggaaaagctcagagttgatccgaagattgaacaacatctccaatt

SEQ ID NO: 29346 - DNA, 121 bp, Artificial Sequence
  Synthesized
  misc_feature (61): n=t or c
acactgcagaacttgcagaagcatcttcttagggaactatgcattgtacatggtacatccnttctgctgaaagagaaaatcagaaaaaggtcctgaatatcaatttagaagcagcggcttt

SEQ ID NO: 29347 - DNA, 121 bp, Artificial Sequence
  Synthesized
  misc_feature (61): n=t or c
agctttgaactgacctgcaagtcagaagttaataggtatgtgaagaaactgcttgagcacnacacagttcagaagtctaaatcacattttaatttcaactgttcacgtaagcctgtccagt

SEQ ID NO: 29348 - DNA, 121 bp, Artificial Sequence
  Synthesized
  misc_feature (61): n=t or g
cagataggagagtgaacaggaggctcacaatgtgaagaagaatctatcttgaaacaaaaanacttttagggttacaagtaataattaaataagaatagcaagaaaagggatgctcacagtg

SEQ ID NO: 29349 - DNA, 121 bp, Artificial Sequence
  Synthesized
  misc_feature (61): n=a or g
gcctctacctggggatagataaaccagtttagagcatataaagaactgtaatcaccatccngaactggcatcgcgacccaagcccatttctgtgctgccccccgacccaggacatcgattc

SEQ ID NO: 29350 - DNA, 121 bp, Artificial Sequence
  Synthesized
  misc_feature (61): n=a or g
tcttagaggaaagtgtcatgtcagaatgactcaacagtccatagagccacagagctgaaangcttagctctgcaagagctagtgtgtgacatttagcaacagaaagaaacttcctttgcag

SEQ ID NO: 29351 - DNA, 121 bp, Artificial Sequence
  Synthesized
  misc_feature (61): n=a or g
aggtaaaggtagttctgtgctggaccaatctgccatgatttgtactgattatttgtccacnaaatgcgctaaaatgcactacttccatctgttcagttttctaacatctgtgaaatgaatt

SEQ ID NO: 29352 - DNA, 121 bp, Artificial Sequence
  Synthesized
  misc_feature (61): n=a or c
gtaaagccaggtgagaaaacattccagacctaaagaagaaaatcccaaaaaacagatacanaagtataaatctgagatgcatgtaaattgaagtaacaaatgagacaaataagcatacaga

SEQ ID NO: 29353 - DNA, 121 bp, Artificial Sequence
  Synthesized
  misc_feature (61): n=t or c
tggcatggggatgaagaaatacaaactgttcattcaagccaacttttttaccgtaaggtangtgtaaccgacacgcacaatttgcttcttttctcaccatcttctctgttaccagacacca

SEQ ID NO: 29354 - DNA, 121 bp, Artificial Sequence
  Synthesized
  misc_feature (61): n=a or g
tgaagtggcacatcccagccatgctctcacctcaccactgccatcacctgcgtgtgctccntgttctccgtgggcgctgcttttgaaggtgcagcaacagcaccttcccaagaaccaacac

SEQ ID NO: 29355 - DNA, 121 bp, Artificial Sequence
  Synthesized
  misc_feature (61): n=c or g
tgacaggaacagtttctaaaggcttaagatatttcttgtctcttgttgaaattttcagatntctaccatctactttataatgaccatattttaattctgatgagaaaattaagcctggcaa

SEQ ID NO: 29356 - DNA, 121 bp, Artificial Sequence
  Synthesized
  misc_feature (61): n=a or t
atgtcctattcctatgataaactaggtatcacaacagcttcttctaccttttccacacatntagccacattaggaactccagattccttccagagcttcttgtaactgtaaagagtatctc

SEQ ID NO: 29357 - DNA, 121 bp, Artificial Sequence
  Synthesized
  misc_feature (61): n=a or g
gggtcattttcctttggggtaattccagtaaagggtaaaagaaatacaagcagaatgaaanccaaagtccacatccctgctgtcacaagtgactgtcagttgagatcagtttctcctgtag

SEQ ID NO: 29358 - DNA, 121 bp, Artificial Sequence
  Synthesized
  misc_feature (61): n=t or g
tctaggcaccacgcttctggtttaggagggcaatggaaagcctgttctcctaacctcactnttaggagaggtttgatactgacatggtgtttcagtatcaaaccactctcaacaggcatac

SEQ ID NO: 29359 - DNA, 121 bp, Artificial Sequence
  Synthesized
  misc_feature (61): n=a or g
agacatgcaagaccacaaatcactgagaaggtacatttccagtttactgtgggcacaggantttgagaataagaaatgttgcctaatattttaagaccctttctgaagacattaaatcact

SEQ ID NO: 29360 - DNA, 121 bp, Artificial Sequence
  Synthesized
  misc_feature (61): n=a or g
tttcccctacaacagatgaagcaatggactcacctgtgagcaaattctcactgccctgagncacgatgcctctgcaaccagttctgcagtgggacaattctgaatacctactgcagtcgga

SEQ ID NO: 29361 - DNA, 121 bp, Artificial Sequence
  Synthesized
  misc_feature (61): n=a or g
aatatctaatacagaaaaaagatgaataggaatatttaattgccatattaaaccataaatnatcattaaggggctgatcaacaaaaagattttgctttcatatgttctatctctcaaaagg

SEQ ID NO: 29362 - DNA, 121 bp, Artificial Sequence
  Synthesized
  misc_feature (61): n=c or g
gtcttttccaatataaatgattctgtgattctaaaagcaagctcttcaaaagctactcttnagtgtctgttttaagccacttgtgctttttctgttttagtttgtggttgttgttgcgtgc

SEQ ID NO: 29363 - DNA, 121 bp, Artificial Sequence
  Synthesized
  misc_feature (61): n=c or g
ctgcatgtactggacactccctggatttcaatgaatacaagacagcaaagtgaagcttctntcacaacattattgcatttgcctctaacatgcatatttctccccttggggataaaaacgg

SEQ ID NO: 29364 - DNA, 121 bp, Artificial Sequence
  Synthesized
  misc_feature (61): n=a or g
tctctaccgagatacagaattaggagtaagtcagctttaatgcttgtagcaaaataaatcntctctttcactatgtttaactgtgggcaaatatgcttaactgtgggcaaaatatatatct

SEQ ID NO: 29365 - DNA, 121 bp, Artificial Sequence
  Synthesized
  misc_feature (61): n=a or g
aaaacatgaatttttaagaccgggtagtgagagcaagaggaaggcgtgaaattagattagngtctctaaacacaaactctgacttccccgtgcctgtccaaaacggcgttcaggcttctcc

SEQ ID NO: 29366 - DNA, 121 bp, Artificial Sequence
  Synthesized
  misc_feature (61): n=t or c
ggcactagaaatccttatcttgtagctgtcagaaggatgttacgtgcttcctctatcgaangtgatcagaaaaacatctgagttgagtgaaacttggagtatgtttctttagactattgtt

SEQ ID NO: 29367 - DNA, 121 bp, Artificial Sequence
  Synthesized
  misc_feature (61): n=a or g
gaagtgttgcagaacagcgggcaggatgactaactagctacgagttgattaattattacantttgtgagaaagataatgaataagctgataaagagtcctgatgctgtaaagaaacaatta

SEQ ID NO: 29368 - DNA, 121 bp, Artificial Sequence
  Synthesized
  misc_feature (61): n=a or c
taaatcaccctccagcctcaccccaatcttagaagtgttctgcctgtcttaatggctatgnaggcttaacagatatgaaatatcccaatggagcagttgtttactcgttcaaaacagtttc

SEQ ID NO: 29369 - DNA, 121 bp, Artificial Sequence
  Synthesized
  misc_feature (61): n=t or c
cttgcctgcaggaacgtgtcccatcctgaagaagctgattaaggtaagcatgcagaagganggtgacactgatacttcagcatcaggaagcaagaggagaaaatctattgaactttctgta

SEQ ID NO: 29370 - DNA, 121 bp, Artificial Sequence
  Synthesized
  misc_feature (61): n=a or g
tgcatggtgctggtgctcagcccatgtaaaagtggctccaactgccatgtgcttgctctgngaagtgaaggcattgctgcctttctgcacttcagaatatatatatatatcacagaatcat

SEQ ID NO: 29371 - DNA, 121 bp, Artificial Sequence
  Synthesized
  misc_feature (61): n=t or c
catctttcctttggttcatattggtcacaatgatgaaacaattgaaaggagaaaaggtcanagcaaagcaatgaactttctgtgctttttagtgcaataaaagtttcctaatgtattagca

SEQ ID NO: 29372 - DNA, 121 bp, Artificial Sequence
  Synthesized
  misc_feature (61): n=a or c
ctttctgtatttttaatccagtgcctgcttccttacaatgcaatgacaaaaatcagctccnttaatctcttgagtgatctgctcttgtggttttccacttacgattacgtaacagcctaaa

SEQ ID NO: 29373 - DNA, 121 bp, Artificial Sequence
  Synthesized
  misc_feature (61): n=t or c
agtggaagggtgcacatgtgggcttgtcatcagtgaacacatgaacagaaatgtcagcagngtgatttcctagtgagcatatcttaatttagtaaggcaactttgataaaagagattatta

SEQ ID NO: 29374 - DNA, 121 bp, Artificial Sequence
  Synthesized
  misc_feature (61): n=t or c
aaagcgtaagatattcattaggtacattttatcagctgttgctgaaagtaacgtgcagaanaagatcacctacaaataaatatatgagacgagtgcagtgctctaagaatgggatttaaga

SEQ ID NO: 29375 - DNA, 121 bp, Artificial Sequence
  Synthesized
  misc_feature (61): n=a or g
caaaataatattcaaaacttaggatctgctgccaattttttctatgaactaaatttctcantgtttttttactggtttctgaaacagctatcaaagacatatgctaacattttaaaaataa

SEQ ID NO: 29376 - DNA, 121 bp, Artificial Sequence
  Synthesized
  misc_feature (61): n=t or c
gggagcagatgatacagtgaaactctgggaatgcttcattacaaaataatgcttgtaattntatttgtgaaagaatcttgacataacttaaaggactttgtactgaaaatatgatttagtt

SEQ ID NO: 29377 - DNA, 121 bp, Artificial Sequence
  Synthesized
  misc_feature (61): n=c or g
gtgtactagaccacatgtaagaaaagtctgacattcagaagggtcaaggaaaagacagganctgcaaggaacggcctctcctgacttatgctgtttttttaattgagtttgaattgaggaa

SEQ ID NO: 29378 - DNA, 121 bp, Artificial Sequence
  Synthesized
  misc_feature (61): n=t or c
actgttaatacagaacttgatttggcaaagcacttccatatttacttaatttttaagcacnttggtgaggcttagaattcaagaaagcttttacttatgagatttggtaggtctgtattat

SEQ ID NO: 29379 - DNA, 121 bp, Artificial Sequence
  Synthesized
  misc_feature (61): n=a or g
aaaagaggggctaggagcagaggcaagaagaaataataacaagaaaaaatataactgtatntgttgtgcttagtaaagatttagtcaactagatcagcctatcttaaggagttaagaagtc

SEQ ID NO: 29380 - DNA, 121 bp, Artificial Sequence
  Synthesized
  misc_feature (61): n=a or g
gagttcctgctgcccattcattaaaggcatgaagttccactgttttccatccactggggcnactgtttgtcttaaaattcctatcaacagaggaaagaagggcaaatatacgaggaaaata

SEQ ID NO: 29381 - DNA, 121 bp, Artificial Sequence
  Synthesized
  misc_feature (61): n=t or c
ctcatttctgcgtgtcaccctgaaaggcaggatttagatctgttgcggtgtggctgagttnattccttaaaaaaaacaggaaagcacaactgcagtgctgtcctcattgatatgaatctac

SEQ ID NO: 29382 - DNA, 121 bp, Artificial Sequence
  Synthesized
  misc_feature (61): n=t or c
gtaacatgttttttgatttctatgtctttcgtcatctgtttgaaatctaacctggtggctntgctgtgtcaggtgagcagattctctgtggtattgagttgttagggtctcaggttgaaaa

SEQ ID NO: 29383 - DNA, 121 bp, Artificial Sequence
  Synthesized
  misc_feature (61): n=c or g
actttttatgattttgtctttttgcatatctccatttttgtttcagtgaacatggagcttncagtttaggaaatgctataaatttcagtgggataaactgagctttgaagttaaatatgtt

SEQ ID NO: 29384 - DNA, 121 bp, Artificial Sequence
  Synthesized
  misc_feature (61): n=a or g
aaccttcagataaaatttcacagttatgcatccatacataatgggaactaagaaaatgttnagatggaccaatattttaattatctggaattgataattcaagctactgacgcaatatgct

SEQ ID NO: 29385 - DNA, 121 bp, Artificial Sequence
  Synthesized
  misc_feature (61): n=a or g
tgatacttctgtgtccaaagtagaacgaggccattccgcagttcgacgtaaacgtattaantccttgaagtgctatagaaatcaaatttgaaacaatagttacatatttttaagactgagc

SEQ ID NO: 29386 - DNA, 121 bp, Artificial Sequence
  Synthesized
  misc_feature (61): n=t or c
cactgtgcctatgctcttcttagtgcttccagctgtccattcatgcctctggttcttaccntcaccagcaaaggaataagtgctatttgttagaacattcttcagttgaaggtattctcac

SEQ ID NO: 29387 - DNA, 121 bp, Artificial Sequence
  Synthesized
  misc_feature (61): n=a or g
tatgcacataacattgacctatggcaatatttctaacttctatcagagctgtaagcagaantacagaaccatgctaaaagaaatgttattttttttcttcactagaagcagatatagctat

SEQ ID NO: 29388 - DNA, 121 bp, Artificial Sequence
  Synthesized
  misc_feature (61): n=t or c
atgtataattaataaaatatatttcttccataaattcttttctgaagaaatctttggaacntgctttagacacctccttttgtttctttagggttattttggaaataagtagttttcatct

SEQ ID NO: 29389 - DNA, 121 bp, Artificial Sequence
  Synthesized
  misc_feature (61): n=t or c
tctgtttctcactttttactaaaccaaacaaatagcaagttccatagcagccatgcttaangcctcaataacagtggtaattccttttgcatcagttgatgcaaaaaaaaaaaaaaaaaaa

SEQ ID NO: 29390 - DNA, 121 bp, Artificial Sequence
  Synthesized
  misc_feature (61): n=t or c
aaaagcctctgcggctcttcagtgccatcagcattcccactcaattcaaacagacttcccngagcacattacattacagctgcataaaatgcatcttttcttccttgttcccattaaacac

SEQ ID NO: 29391 - DNA, 121 bp, Artificial Sequence
  Synthesized
  misc_feature (61): n=a or t
ccattttctaggcgcctaaaaatcacttgtttgagcatattctgatatttttccagaatcnggttgcattgatagctatttaactctttggttgttctttttccattgtcttttccaagtt

SEQ ID NO: 29392 - DNA, 121 bp, Artificial Sequence
  Synthesized
  misc_feature (61): n=a or c
catctatagttaatgctatctgtggatgagtgtttgttagtgtaacaagttgaggtatttntttatgtatctttcatcaagacaaaatttagtggtgtttgcttttgagtaaattatgcat

SEQ ID NO: 29393 - DNA, 121 bp, Artificial Sequence
  Synthesized
  misc_feature (61): n=a or g
accaatgcatcagagtcatctctgtctctgctgtgggtctcctctgcttgaagggcagtcnattggctccagctgcagacctgcttcacatcactgacacaactgcatgcaaagccagcac

SEQ ID NO: 29394 - DNA, 121 bp, Artificial Sequence
  Synthesized
  misc_feature (61): n=t or c
tggcactgaaacaggctgaagcaatgttttgcatcaggtcagcaaccacagtgaaaatttntgacctttgcagactttaggaatagcaggcctctgagaccggaagaaatggaagagtcat

SEQ ID NO: 29395 - DNA, 121 bp, Artificial Sequence
  Synthesized
  misc_feature (61): n=a or c
gtacaaggaaaataagctgaggttcatacagatactaaattaatttggatttacacatgcntgttgtacagaaacagtataggtgacagtggaagttcatacatgcttggaggtgcctttg

SEQ ID NO: 29396 - DNA, 121 bp, Artificial Sequence
  Synthesized
  misc_feature (61): n=a or g
gtggcattggattctgtcagctgttgtggtacctgggagatactttccagttttcccacancctcttggtgagacagaaaatggccttttgcaacatctttcctggaaaaaaatctttact

SEQ ID NO: 29397 - DNA, 121 bp, Artificial Sequence
  Synthesized
  misc_feature (61): n=t or c
aacatgcagtgctgagtgcgacagcctgggtgtaattagaaaagtgcaggagagatctacngtttctcccaagctttctccttgcatacagtgacagatctccaaatgccatagccatggt

SEQ ID NO: 29398 - DNA, 121 bp, Artificial Sequence
  Synthesized
  misc_feature (61): n=t or c
gaggagtaggctgggagcagcagcccaccatgcttcaggaggaactattaaatgtctgtanacgatcttgggagagaagagcccaggcagctcgtgctgtgggaaaggatctggagctgtg

SEQ ID NO: 29399 - DNA, 121 bp, Artificial Sequence
  Synthesized
  misc_feature (61): n=a or g
gctcatcacccagggatggtacccacctgggtttgttcccttggatctctttcaaattccntttctcttgaatgatgtaaatattttttaagccagaaagacctgttgcttcaaagcatct

SEQ ID NO: 29400 - DNA, 121 bp, Artificial Sequence
  Synthesized
  misc_feature (61): n=c or g
agcaattttgagtaattaatgttcctttattttgcctagaagccctgacttcagcattctntgaagacgggatccttctagctggggctacacaatgcagattagcccaatgagaagacga

SEQ ID NO: 29401 - DNA, 121 bp, Artificial Sequence
  Synthesized
  misc_feature (61): n=a or g
ggaaattacaagaagttattttaaacagaatgtttcaagtttggctaaatgtggggcctgnactctcacctgtatccagacttgctgcccctatacacaggaggcagcagcatataatccc

SEQ ID NO: 29402 - DNA, 121 bp, Artificial Sequence
  Synthesized
  misc_feature (61): n=a or c
ctgaaaggaaaggtttctgtaacttgttttgcagggcatcagcactcatgtttgctaaaancatttactgatgaattcaaatgacttaacttaatagcctttcaattaatgttcagtaatg

SEQ ID NO: 29403 - DNA, 121 bp, Artificial Sequence
  Synthesized
  misc_feature (61): n=t or c
catcaagatgattacatacaattaaagttgaatgatatgctttcctgcgaaaaaaaaatcnagtctcgtgtttttctgtcgttcttatcttctttcttttacacttacaggtgtttgcctc

SEQ ID NO: 29404 - DNA, 121 bp, Artificial Sequence
  Synthesized
  misc_feature (61): n=t or c
gatttaggactgtataatttttaagactgtacagttctgtacccttcaggtgccaaaggtncctactgacagttcagtagcatgaaatggcagttcaggaacagttatcttgtttattttg

SEQ ID NO: 29405 - DNA, 121 bp, Artificial Sequence
  Synthesized
  misc_feature (61): n=a or g
gaatacatcagctgtcctaatgcagctctcttccatccaccctggcctcaacaaccatgtnttaggagttggccttcaaaccagaggctgaagaagtggttgtgtagctcgggcttccttc

SEQ ID NO: 29406 - DNA, 121 bp, Artificial Sequence
  Synthesized
  misc_feature (61): n=t or c
agcccttctagcactgtatctactagacttagggttcttctctttaaacttctggtaaatnctttgctcttttttcttcatccgcttcgcttagggttgtatttatccccagagttaaagc

SEQ ID NO: 29407 - DNA, 121 bp, Artificial Sequence
  Synthesized
  misc_feature (61): n=a or t
cagcctgtgagatcatccaggctttcctgatggatatctggatcccctttgttactgacantgcttctcaactttaggtcaccaggatagtttattttcccccttctaccttttgtatctt

SEQ ID NO: 29408 - DNA, 121 bp, Artificial Sequence
  Synthesized
  misc_feature (61): n=a or g
acctgcaatcctggttgggaggcagtagcatctggcatttagtttgattcatccagagctngaaaaaggcctttggatatcacacacagatgtgtgcacatctgtgcatgtacacacaagt

SEQ ID NO: 29409 - DNA, 121 bp, Artificial Sequence
  Synthesized
  misc_feature (61): n=t or c
cacaaacaaggatactgtaggggtgcattagcagcctgctgcttgcattcagctgactatngtgttgccttgctgccaatatatgcttgccaaatccagtaaccacattttataaaccagt

SEQ ID NO: 29410 - DNA, 121 bp, Artificial Sequence
  Synthesized
  misc_feature (61): n=a or g
aaaaatgcaatgggatttctggaagataggatgtgctgggggtaaggtttgcagcgcaagntcctaccccaacaccaagcggtacctgcgatctcctcggtgctgttggcacacatatcca

SEQ ID NO: 29411 - DNA, 121 bp, Artificial Sequence
  Synthesized
  misc_feature (61): n=t or c
tttctttttttttccacagaaaattacactaatgagttttgtcacacagagcttctccttngacagaaaatttcagctattttaatctggaaacaaatacctgagaacccagaaggcttag

SEQ ID NO: 29412 - DNA, 121 bp, Artificial Sequence
  Synthesized
  misc_feature (61): n=t or c
ctctgatctgaagttcatgttacatcacagtcgagtaaatgacagtgattcacaggaaacnggttttcaattagttttcagaagcagtctgttcgattatagcttgcttagtgtttctaag

SEQ ID NO: 29413 - DNA, 121 bp, Artificial Sequence
  Synthesized
  misc_feature (61): n=a or c
cacagagtgcctccctcgtggtctgcccatgctgatgtacagcagatgacactttgccagnccacttttgcactgtgggctgtcacttcatgtagtgggattgtttttctgtttggtagag

SEQ ID NO: 29414 - DNA, 121 bp, Artificial Sequence
  Synthesized
  misc_feature (61): n=a or g
ttaaaaataatgcgtaagattgtaatgttctcaggcaaacaaaacaagttgcttagcaaancagaaacgacgtttgcatcaacttactgtaccttgtagttgtagggtttgttagaaaaga

SEQ ID NO: 29415 - DNA, 121 bp, Artificial Sequence
  Synthesized
  misc_feature (61): n=t or c
tttcataaagatagcatagtgtcatgcaaagatgccagtgcccttctgagctaagacatgnaatacgtgtataaacaaaaggatcatctctatttgacaacacaaattgttcatgttgtta

SEQ ID NO: 29416 - DNA, 121 bp, Artificial Sequence
  Synthesized
  misc_feature (61): n=t or c
aaaatatagcttcattttcatgctacctttaacacaaaactccatgggagctgagaacatnagattcacacagttctcagccacactgaatattgagtcctcccttacctctgaaagatgt

SEQ ID NO: 29417 - DNA, 121 bp, Artificial Sequence
  Synthesized
  misc_feature (61): n=a or t
ctacacagtcctcctagacttgagtgaaagaaccaggtatctcatattcacaatcattatntccttcttggagactgaagataacattctcccagtcacaagagttgtatatgtacctgaa

SEQ ID NO: 29418 - DNA, 121 bp, Artificial Sequence
  Synthesized
  misc_feature (61): n=t or c
atattagttatacacacctttatttgttgttacttatatgtgcaaaaacacttacaaatangaaatctatatttgccaagaataaacactgtttcactgtaagacttcagtttgctattct

SEQ ID NO: 29419 - DNA, 121 bp, Artificial Sequence
  Synthesized
  misc_feature (61): n=a or g
ggtaagaaggtggatttgtctactgttcttttgtcctctcttcttttctagagacagatancgtccttttaggattagtggagacttcttaacgctggtgagaaatgaaattaatatgacg

SEQ ID NO: 29420 - DNA, 121 bp, Artificial Sequence
  Synthesized
  misc_feature (61): n=t or c
ataagaggcatgctcatacatctatacaaatgactttctaaagtgctcttcaatattaagncatccgggacatgatgctatgtgtatttgaagtaaaagaaatccaaaagtctgttctgat

SEQ ID NO: 29421 - DNA, 121 bp, Artificial Sequence
  Synthesized
  misc_feature (61): n=a or g
tcccatctctccttcccgcagcttgctttggagagcttggtcatgtgcatggacttgagcnctcctttcttaccagggaggcaagggtctgccgtggcttggcatctggtcactgacacaa

SEQ ID NO: 29422 - DNA, 121 bp, Artificial Sequence
  Synthesized
  misc_feature (61): n=t or c
agggagtgagtcccagcgttgcatttggactttcttgccttgactccttgctttggtgcancttgtgcttcacagccacgaggagacgtgcagtgctgacgttcaggtcagaccaccctgg

SEQ ID NO: 29423 - DNA, 121 bp, Artificial Sequence
  Synthesized
  misc_feature (61): n=a or c
tatttgaagggaataaacaataagggcattttgagccctatttgagcacagggagtggganagtacgtaaaaatgaggtaactgataaaaaggagaccagataaactgctttaagtctata

SEQ ID NO: 29424 - DNA, 121 bp, Artificial Sequence
  Synthesized
  misc_feature (61): n=t or c
cagcttttgagctcaaagtggagctttattctctttcctccgcatttttacacactacttnctgggcaaatcaacagcagctcagttcctctgagaggggatgtgagtgcttacatttaca

SEQ ID NO: 29425 - DNA, 121 bp, Artificial Sequence
  Synthesized
  misc_feature (61): n=a or g
cttcagggaagaggatctgttggccagatgagagaatcctgatggatttatgagaatctcntgtatcagactgaccaatttcacatttggaattattagctcatttttatagtaaaaaaga

SEQ ID NO: 29426 - DNA, 121 bp, Artificial Sequence
  Synthesized
  misc_feature (61): n=t or c
gttgctcttccatttagatatgttttctattatttttaagcacagctaaggttaactggangcagccatgacttagattttttcataatatgcagtttctaaaagcctagtgtcgctcagc

SEQ ID NO: 29427 - DNA, 121 bp, Artificial Sequence
  Synthesized
  misc_feature (61): n=a or g
ctgatgttaagcaaaaaagtatggattagatattattacaccattacctcttagttgaatnatgaaagaatcatatgaggtgttttgcatactacaatccgaacaaatgcaaataatgctt

SEQ ID NO: 29428 - DNA, 121 bp, Artificial Sequence
  Synthesized
  misc_feature (61): n=a or c
gtctgttgaagtcataagaacccaccgtgctgtcagcggttaactattacagctgactctnccagcaccagctggcattcctccccaaagtgctatctaattcattacacaccggacagtt

SEQ ID NO: 29429 - DNA, 121 bp, Artificial Sequence
  Synthesized
  misc_feature (61): n=t or c
aaaggtagccttgtgttctgccacagtctcaccttggtctgtcatatcaaatcagcctacntgatttatgcagaggcaatgaatgaaggactagttgcatgggacaggaacgcaggcaggt

SEQ ID NO: 29430 - DNA, 121 bp, Artificial Sequence
  Synthesized
  misc_feature (61): n=a or g
aatccaaatcaacagctatatttttggaacagctttgtttctgaagctttttgttgcgcanaattctcatctgggatagggctaacatcccatgagatgggttaccatgtgttgtggtttg

SEQ ID NO: 29431 - DNA, 121 bp, Artificial Sequence
  Synthesized
  misc_feature (61): n=t or c
gaatttggtctctagatgcccactgcctggcagaaaatgttctccatagctattgtcccantagagaagtaaaataaaaatggtagtggaagggaacagcattgcttaatacaaatagtat

SEQ ID NO: 29432 - DNA, 121 bp, Artificial Sequence
  Synthesized
  misc_feature (61): n=t or c
acccggtgatggagcctttcaaaggttctgttccttgtgtctgagctcccagtctcccttncccatccttcacccctggctcacagtgaccccaaaacttctcccttctgctccacgctcc

SEQ ID NO: 29433 - DNA, 121 bp, Artificial Sequence
  Synthesized
  misc_feature (61): n=a or c
gtacagctggttctcaaaagcattgccaacaaatcctttttttcagaagtccttactatcngtatatctggacaggaaaaagttagcaatatgccagagacataatttcaggccacattgg

SEQ ID NO: 29434 - DNA, 121 bp, Artificial Sequence
  Synthesized
  misc_feature (61): n=a or g
acatgagtctagatgcaaaggctgtcacacctgtttgtggcaatgactgttcagaggtgantgccagtgtagtgtagtgaattgaaattctgagtactgccagcttggtttggaaaaagaa

SEQ ID NO: 29435 - DNA, 121 bp, Artificial Sequence
  Synthesized
  misc_feature (61): n=t or c
gacaatcactagacatacagtactgctgataatcttaaaaggtcttgaataactaatacanaaaatttacacttccttgttatgaaaagaatgtcgctgccaacccaaacaagattttcca

SEQ ID NO: 29436 - DNA, 121 bp, Artificial Sequence
  Synthesized
  misc_feature (61): n=t or c
gtgcaattttgaggtgtaacagctctcatgtgacaaccactgcatgctgtaggttcaccangattgagctcacttttccagagaagacagaaacctgaagaacaagtcaaagggtggggaa

SEQ ID NO: 29437 - DNA, 121 bp, Artificial Sequence
  Synthesized
  misc_feature (61): n=t or c
cacttgccatggattttttagtgcactccagtttaccgttggccttcctggtctcaagagngcactcctgactcaaggccaacttgctgtccccaagtccttttcctcagagctcttttta

SEQ ID NO: 29438 - DNA, 121 bp, Artificial Sequence
  Synthesized
  misc_feature (61): n=a or c
cagtttcatttcacaacacatccattttgtaagcccatatttttatgttcctcacagaagnagagattcatggagggcaagtagaggcttgaggggttttggaagtttgtctggttgaagg

SEQ ID NO: 29439 - DNA, 121 bp, Artificial Sequence
  Synthesized
  misc_feature (61): n=t or c
tggggacaaactcatcatgagaaagaacttttattcagctttgaaagcagcactttggctnggaacaatgtccaacatcaaaataatgagtgcgtgttactgctgacagtcctggagacaa

SEQ ID NO: 29440 - DNA, 121 bp, Artificial Sequence
  Synthesized
  misc_feature (61): n=t or g
ttcattcaggtgaaaaataatggaactggtataggaagaacccatctggtctgatactaancagaaactaagggaaggatggtattctgaggcatgttttggatttgctcctcttcatccc

SEQ ID NO: 29441 - DNA, 121 bp, Artificial Sequence
  Synthesized
  misc_feature (61): n=t or c
accatggttgttatgttttattttcccattagtgatctatctctgccttgagccactctcntggagagattaaactttttttacccttctcatatctcatatggttttaagctgagtaatc

SEQ ID NO: 29442 - DNA, 121 bp, Artificial Sequence
  Synthesized
  misc_feature (61): n=a or g
gcactgttgcctacgctaaggaaggaggcaaatgatgatggtgctactgcctactccagcnggaggaccactggtgagagggcagtagtgactgaagaggaatgaggggaactccttcaat

SEQ ID NO: 29443 - DNA, 121 bp, Artificial Sequence
  Synthesized
  misc_feature (61): n=t or c
tacatagaaagatacatgacagagaaaaaagacaaccttcatcactatatgggtcacttanataattaatttaaatcaagaggattaatgtgggtcactcatctttaataacaggcaagtg

SEQ ID NO: 29444 - DNA, 121 bp, Artificial Sequence
  Synthesized
  misc_feature (61): n=a or t
tctataagtatgtcatactgaagcaccttgggtaatgtggtttagcgccctcaaacagtgngagtaagagataaaagcaaatccaacctcacagtagacaagactaatgatgaaacaggat

SEQ ID NO: 29445 - DNA, 121 bp, Artificial Sequence
  Synthesized
  misc_feature (61): n=a or g
aaaaaaaccaaacaaacactagtattccactttgagtaaaagaggttgatgtccctctcantgagatgcttctcaataagactgtgtgtaggcacatattgagtaaggtttgtccatatca

SEQ ID NO: 29446 - DNA, 121 bp, Artificial Sequence
  Synthesized
  misc_feature (61): n=a or g
tcagagccctcagtcagttcttatcagactgattgtgaacagcttactgcacttctcaacnctctttcaacagaccaaacacctgcagctgtgcccaaagacattactgtgcacagccctg

SEQ ID NO: 29447 - DNA, 121 bp, Artificial Sequence
  Synthesized
  misc_feature (61): n=t or c
ttgagctacaatacagttacatttggtagagcgtcttcttaggatttaaaaatatgctcantcatatgaatgaatggtaacttctgatggcataggtgatctctaaacagatattcatttc

SEQ ID NO: 29448 - DNA, 121 bp, Artificial Sequence
  Synthesized
  misc_feature (61): n=a or g
agacagcaagtgcccctatgtgataaagctagcatctttctttccgctggttcatgagtgnaagggctttgagccattattaaatcaaatcgtatcctttgctatggcctgtcactgtctt

SEQ ID NO: 29449 - DNA, 121 bp, Artificial Sequence
  Synthesized
  misc_feature (61): n=a or g
actgaatgaaagtgggtaagctagttgtctgcattgaacgggagaacagacatgtctttcntgttaccagtagcatttgaaatagtcagaaattagtgcaaaaatgtttaactctgctaca

SEQ ID NO: 29450 - DNA, 121 bp, Artificial Sequence
  Synthesized
  misc_feature (61): n=t or c
cacagcacaaattatttcatggatgagatgctgtcatcactgccacgcagccggagtgcangatctacatggttcgcccctcctcaagcccatccaatttaatcctgctttagtccagttg

SEQ ID NO: 29451 - DNA, 121 bp, Artificial Sequence
  Synthesized
  misc_feature (61): n=t or g
attgtgcatttatacacatgcactcctatatgtacagagcgcacacagacaaatgcaaggngcatgagaatgggtgtgtaagtcggcaaactttgtaaatggaaatatttaaatattgtgc

SEQ ID NO: 29452 - DNA, 121 bp, Artificial Sequence
  Synthesized
  misc_feature (61): n=a or c
ctttaagaatcccttctaactcaaatgattctgtgattttattcaacatatcagtaccttnaaaatagcagttcttaacccaaaatgcacacttcaatgcgtatagagtcatttaagctgg

SEQ ID NO: 29453 - DNA, 121 bp, Artificial Sequence
  Synthesized
  misc_feature (61): n=a or t
ttgaaaatacatcagcagctaaatttccatttaatattttttgctaatgtttgaaaacatnatcttataagcaactcgaagtcccattcagactgttaaaaagtgtttgttttaaaattaa

SEQ ID NO: 29454 - DNA, 121 bp, Artificial Sequence
  Synthesized
  misc_feature (61): n=t or c
cttgagctaggaaaacatttaaatgcatacaactccttttcctgggaaatgaaggcaccanattcattgtgttagctgacccgctgatttctctactgagagtgggtatgacagtgtgagg

SEQ ID NO: 29455 - DNA, 121 bp, Artificial Sequence
  Synthesized
  misc_feature (61): n=t or c
ttgaaatcagggcaaactcttgaaatagtacccaatcagccaatactacaaatgcacctcncacccatacaaaaaacaacacacagtcattaacaaaactcccatctgcagaaggaagtaa

SEQ ID NO: 29456 - DNA, 121 bp, Artificial Sequence
  Synthesized
  misc_feature (61): n=a or c
tgatctatgaatttctgtggcctgtggaatcaataagctggagagcactagcatgtatctngctctatagtcttctccatgttttctacaaaagaatatagagatgtactttcagctgtgc

SEQ ID NO: 29457 - DNA, 121 bp, Artificial Sequence
  Synthesized
  misc_feature (61): n=a or g
ttaaacagtcctactctaatttagacatttgttgcatgcagaaaacgtggaaaaagagaanccaggagtatttctggtggtctcctcagtgccacttgctggcaaatagtgaagcacagag

SEQ ID NO: 29458 - DNA, 121 bp, Artificial Sequence
  Synthesized
  misc_feature (61): n=t or c
tctatctctggcagctttgcctagctcaaaaaacccataggacaaattcacagaagtctanggataaagtcagagtaaaagagtaaagctaccaaatctgtaaagcaaatattaccgtggt

SEQ ID NO: 29459 - DNA, 121 bp, Artificial Sequence
  Synthesized
  misc_feature (61): n=a or t
tccatacgaggcgcagagccaagaaaacagatgagcttctttagaaagagagctacatgtnaattcctaggtacacttgagatgacctgcaatactttttcctaggcagaatagtattatc

SEQ ID NO: 29460 - DNA, 121 bp, Artificial Sequence
  Synthesized
  misc_feature (61): n=t or g
aaggatcaggtgagatcatcactggaggtttatgaatattctctgtttccttatactttgngattttctggatcatgtatatataggggtggagcaaaatgttcacttctttgaaacacag

SEQ ID NO: 29461 - DNA, 121 bp, Artificial Sequence
  Synthesized
  misc_feature (61): n=a or g
aatgatacagaactgtagaattagaaggaattcacagatgccactgcctttgctttggagnagcagttgttctttttaaccaaatgtatactttttttcattgctccttaacaaaacgtgg

SEQ ID NO: 29462 - DNA, 121 bp, Artificial Sequence
  Synthesized
  misc_feature (61): n=t or c
acattctcattcatcctacatagattaagaatacaatttctttttcagttgcattcctttntattgttctgtatgatttttgggatatcaggaacccctgatggaaggaaatattgtatct

SEQ ID NO: 29463 - DNA, 121 bp, Artificial Sequence
  Synthesized
  misc_feature (61): n=a or g
atacctgctttgttccacatttactttggcttgcaaatgctagattacttgagtaataagncagtactagtattgaaatacctgacttacaattatgtggtatactgaattagaaagtgag

SEQ ID NO: 29464 - DNA, 121 bp, Artificial Sequence
  Synthesized
  misc_feature (61): n=t or c
gccactcttcctgttttgacaagaagccagcctgctcgagggtggccttttgattgttctngtatgaaagagtgggagaaagagcttgtcttagaagtagctgtttaaagtatttttataa

SEQ ID NO: 29465 - DNA, 121 bp, Artificial Sequence
  Synthesized
  misc_feature (61): n=t or c
gtaccagaagacctggattttaatacactattccaaaggttgatattggtgatgggctcantggacatataactaattactggaggtaagaaagtagcatgctaccaagtattacactttt

SEQ ID NO: 29466 - DNA, 121 bp, Artificial Sequence
  Synthesized
  misc_feature (61): n=t or c
taaatattaaaaaaaaatcaatcacaaatgtctgagccacagcatatgataactgttctanatgatatatacattccatataatatgtgctacctaatagattattaaccagacataaaat

SEQ ID NO: 29467 - DNA, 121 bp, Artificial Sequence
  Synthesized
  misc_feature (61): n=a or t
gaactaaaactgcagcatgagcgatgctgtctgaagtccaccttgagacagaactgcaagntgcacctacagcccacaataacagagggcactgctcctctggccacctcaaaacacagag

SEQ ID NO: 29468 - DNA, 121 bp, Artificial Sequence
  Synthesized
  misc_feature (61): n=t or c
acatgacctcagattttatgtttgtcattaacgtgtgcttaggttcatcagaaggtagctnctgtgctagtaggctaatagctaaaaggctatattttgtgagactgagttaaattaacta

SEQ ID NO: 29469 - DNA, 121 bp, Artificial Sequence
  Synthesized
  misc_feature (61): n=c or g
agtctattctttagagggaagtcagaagagaactccatcttgttcaggaaaaggccttctntgactcagattccttctgctgcaacttccgaatcagttccagtaagttcatctgtaaagt

SEQ ID NO: 29470 - DNA, 121 bp, Artificial Sequence
  Synthesized
  misc_feature (61): n=a or g
ggtggcatatttaattttagctattgaactaaattctttttctcccctagagcaagaggtnaatcagaacccaacagctcttagtttctccatttccctgaccctatggagagttatccca

SEQ ID NO: 29471 - DNA, 121 bp, Artificial Sequence
  Synthesized
  misc_feature (61): n=t or g
cacgctcagcagcatcagagctaccttgtgcaagcagaaaggtgtgaggtaccagcaagtncatgggacaaggggatgatgagagcttagactattgcgatgtaaaactgatgaagagcta

SEQ ID NO: 29472 - DNA, 121 bp, Artificial Sequence
  Synthesized
  misc_feature (61): n=a or g
gtgagaagaggaaggagaaatgctaacacaagcacagattgttttaccatcttgaatgagnctgtcacctattgatcactacgtttgtcttaggtgttgctaactggagttcacaagaacc

SEQ ID NO: 29473 - DNA, 121 bp, Artificial Sequence
  Synthesized
  misc_feature (61): n=t or c
caagaaagtgataagtaagctgttagttataaaaccagtttttccttcacttaaccagccngaaacttattctaaggcataagtactggcagcattattttagaattaagtatctgagatg

SEQ ID NO: 29474 - DNA, 121 bp, Artificial Sequence
  Synthesized
  misc_feature (61): n=t or c
ggtaagcacttagtgtgaagaatttggataagtctcaattttaaaacattaccagtgattntgataacacttgcaaacttcagtaaaccacataagagataagcagtaaagtctcagtcat

SEQ ID NO: 29475 - DNA, 121 bp, Artificial Sequence
  Synthesized
  misc_feature (61): n=t or c
ccaatccaatgtatcagaggaggtggctgcagataggaaagaattagcgtagctgtactgntgtagtagagtgcacagttagctcttaaaccagctactgaaaccttcaaaatgctctgtt

SEQ ID NO: 29476 - DNA, 121 bp, Artificial Sequence
  Synthesized
  misc_feature (61): n=a or g
acttctattttaagtcaacttgcagctgttttaacagcattttgtccccgtccatctcccngcattgcatgggtgcgtggcgctgggctgggagcagcgtggggacgtggcacagctggct

SEQ ID NO: 29477 - DNA, 121 bp, Artificial Sequence
  Synthesized
  misc_feature (61): n=t or c
gcctccaagtgagcgctgaaattttcttgggactcctttgcacatagcagtgcctcaagantgacaaataggccagggctccagctgcagtcagggctcctggatgctgaaatgcagactg

SEQ ID NO: 29478 - DNA, 121 bp, Artificial Sequence
  Synthesized
  misc_feature (61): n=a or g
gcagttctggatctgttgctctgaactgatgagatttgaggtgtatgttgatggataagcntgaagatttctgaaaactcgtggaagctatggggaattctgttctcttaatacctcaccc

SEQ ID NO: 29479 - DNA, 121 bp, Artificial Sequence
  Synthesized
  misc_feature (61): n=a or g
ttatatttagagaaggaccacaacttttgccatttacggccactgagcgcagcaagcaatnccgaatgcaaacacactgtaaacatcttccatattgtgaacttctgttggctcttcagat

SEQ ID NO: 29480 - DNA, 121 bp, Artificial Sequence
  Synthesized
  misc_feature (61): n=t or g
ttttttcaaaccccagaccacacaaagacatttcaactggtcaaagcttagaaatttgaanaggaagtcctcgggaccaaagaaaatagcactccttccagaagaaactatggtgagtcta

SEQ ID NO: 29481 - DNA, 121 bp, Artificial Sequence
  Synthesized
  misc_feature (61): n=a or g
actgtgccaggtgcagtcgtacttttggtttgtaatccagataaattcttggagccctgcngatacatgcttctgtgtggtgtatatactgatttccctacaattattagaaggctgaaat

SEQ ID NO: 29482 - DNA, 121 bp, Artificial Sequence
  Synthesized
  misc_feature (61): n=t or c
tatgtatcatcctcttagacatcagtgtaacttcttgtgtgttagaggttcttcactgttngtatgtacagaacagccctgatcccagcaaccacttctttcatttcatgtctgggatcca

SEQ ID NO: 29483 - DNA, 121 bp, Artificial Sequence
  Synthesized
  misc_feature (61): n=a or g
tgcacatgaagaagcccttttacatagaaatcctttccactgcttgtgagtctgtaggagngaaagggagggagaataagctccattccctgtttactgagttcctcatagcactgcagat

SEQ ID NO: 29484 - DNA, 121 bp, Artificial Sequence
  Synthesized
  misc_feature (61): n=t or c
gaaaaaggtagggattgtattgtttaagtactgactctgggaacacctactgggcaaatgntgcagcatacctagagaggtacctgtgaatcagatgcggattagtctacggaagtaatga

SEQ ID NO: 29485 - DNA, 121 bp, Artificial Sequence
  Synthesized
  misc_feature (61): n=t or c
ttttccaaattaaaaaatgacttcaagacagccattctatttaaatgagttttaaggcagnagtaaaatttctcacaccagttttctactcaaatatattgtgagattcatgaaaaagttc

SEQ ID NO: 29486 - DNA, 121 bp, Artificial Sequence
  Synthesized
  misc_feature (61): n=a or g
cttgaatcgtttccattttactcagaaacaaatcgtctcactaaagttcactgctacaatnaagtcactgtaagttggcattccattcgttgtcgctttgttgtccagtatccaaagaacc

SEQ ID NO: 29487 - DNA, 121 bp, Artificial Sequence
  Synthesized
  misc_feature (61): n=a or c
ttcagagaccatatggtatagatgatccttgtgctgttttctatctctggggctggagttnctgctgagccacactcaacactgcatcaaccccttgtgacaggccttgcagctgctccaa

SEQ ID NO: 29488 - DNA, 121 bp, Artificial Sequence
  Synthesized
  misc_feature (61): n=a or c
cacaaccttattcacgaccttttggttgtgtctacacagaactcacgcagttaaatcattnaaatcatgcagcttattagcaagagattacaggttcttttagattgtcagtgaataattc

SEQ ID NO: 29489 - DNA, 121 bp, Artificial Sequence
  Synthesized
  misc_feature (61): n=a or c
gaagtggtcagtcttgaaaataaaggatgactacatttgtaaagaagactccaactttaancaagttatggaggcctgtaggtaggcaacagacattcctttatgttttttttcttgcttt

SEQ ID NO: 29490 - DNA, 121 bp, Artificial Sequence
  Synthesized
  misc_feature (61): n=t or c
caaaccctacagggcctttgctgagtgccagacccaggtcagacaagttgaaacaagttanggcacacgcaaatgcttttcttcctcaaatctcaaaggaagtgtgtccacgtgctgagct

SEQ ID NO: 29491 - DNA, 121 bp, Artificial Sequence
  Synthesized
  misc_feature (61): n=t or g
tgaagaactgtcactattcagttcctctcttgcatcttcagtgttggttaagagtaagganctttgactggatttgaagtgaattccatcttttccctgtaacacatctccgctttatatg

SEQ ID NO: 29492 - DNA, 121 bp, Artificial Sequence
  Synthesized
  misc_feature (61): n=a or t
catacatactacatgtcaggtacccagcagagaacacagtcctcctggtgtggtctcactnctaatgagcagagacagtaagtgtcctctgtttgccttgtctgtaatgaggatttgccac

SEQ ID NO: 29493 - DNA, 121 bp, Artificial Sequence
  Synthesized
  misc_feature (61): n=t or c
ttgcagaacctgcatgcgtggcaggagaacacagggttgtgagggagtccaggttgtgatngaggcagcctgactagtagttggatgtaactatgtctagggacattcaagatcaatattc

SEQ ID NO: 29494 - DNA, 121 bp, Artificial Sequence
  Synthesized
  misc_feature (61): n=a or t
tattatattagtgcttgtaggtttcctgcatgcctaactcacagctaaataggattaaggnttttctctctttagaattctgctgactacttgcgcttattttttgtttttggttattcaa

SEQ ID NO: 29495 - DNA, 121 bp, Artificial Sequence
  Synthesized
  misc_feature (61): n=a or t
ctgcagtgctgcaaagagcagcctgggtgcagcaggcttagagaatgtgatgcttgtttcngaagttgaggttgtctgtgtgtttaaatggtagtgggcaggatggggggtagaagcagca

SEQ ID NO: 29496 - DNA, 121 bp, Artificial Sequence
  Synthesized
  misc_feature (61): n=a or g
ccgtatttaaagtggttgtcctgcactgggacagcacaacgctgtactttgtaaattcacnctgcagccagggatggatctgaagctttgctagcatctcatcgcaaacccagtatgctca

SEQ ID NO: 29497 - DNA, 121 bp, Artificial Sequence
  Synthesized
  misc_feature (61): n=a or g
ccccccagttttggtatgcatgtagagtagtttatgctaagtgactcctcttgatcctacntgcttcctaactgcagaggaagaaaaggtcccataattagcctgctgggaaatacaagga

SEQ ID NO: 29498 - DNA, 121 bp, Artificial Sequence
  Synthesized
  misc_feature (61): n=t or c
attgaagattatgattgaatataggtcctgagatgcaggaatactgcatactgtacacagnagtaatgctgtatgcagtcagaaatattaagctatccacagtatttagagaaataagcaa

SEQ ID NO: 29499 - DNA, 121 bp, Artificial Sequence
  Synthesized
  misc_feature (61): n=a or g
attctccactcagtcactttttacttttcttcttccaccttggcctctttcatctaccacngcctttgtgaactgtgcactctgatctgtttttttttttctttttcatctttattagctc

SEQ ID NO: 29500 - DNA, 121 bp, Artificial Sequence
  Synthesized
  misc_feature (61): n=a or g
tgtgaaaggaccggagaacaaatcagaagctcattatgccactttgcaaatccatcatgtncattcattgtgaatagagtgtggaatgccagttcctcaaattaaaaagaatattaacaaa

SEQ ID NO: 29501 - DNA, 121 bp, Artificial Sequence
  Synthesized
  misc_feature (61): n=a or g
gccagcattgaagaagtggatgcaatgcagtgtgagataggagggactttggagctaactntgagagcacagtgatgtgcccaagggccagaaggaaataaaaggcacacctgagaagtac

SEQ ID NO: 29502 - DNA, 121 bp, Artificial Sequence
  Synthesized
  misc_feature (61): n=a or g
ttggaggtttggcaggatgtgctcaccttgagagtgaaatttgctgctttctccaactttngctgagttatagttgcttgaaaaccttccagtagcacttgctcaggagggtgacgttgcc

SEQ ID NO: 29503 - DNA, 121 bp, Artificial Sequence
  Synthesized
  misc_feature (61): n=t or c
ggtgaaaaactcccatttgtgtcatcaccagagactccagccctggtaaataatgataaantgtgagcagtgtcatgaggtgaaaatcaaggagagaaatagtgccttaaagaggagctgc

SEQ ID NO: 29504 - DNA, 121 bp, Artificial Sequence
  Synthesized
  misc_feature (61): n=t or c
tctccaactgctactacgctgaaatacacagcagcaagaattcccatatcgttctcctttncctctagccacctgtcacaggcttcttcttacacaaaaactaccattagtatccaggatg

SEQ ID NO: 29505 - DNA, 121 bp, Artificial Sequence
  Synthesized
  misc_feature (61): n=a or g
cttcctttatcgttcatttattcatttccttttctctcttatttttgtttccagtcaggcntgtatgcagaagtactgggttatatttagatcgaaccgtacctctggagtcagaaatctc

SEQ ID NO: 29506 - DNA, 121 bp, Artificial Sequence
  Synthesized
  misc_feature (61): n=a or g
gaggtctgaaggacaaaagatatcagaagaagatgggtcatttggtttgttcagccctgangagactgagggaaggccacacggtggcccataggttcctccaaagcagggcagaggggca

SEQ ID NO: 29507 - DNA, 121 bp, Artificial Sequence
  Synthesized
  misc_feature (61): n=t or c
gcctaattctcctgtcagaggaagtgcattgttgctcatgcatttcttccataccttttcncattccctcctcactcccaaattctgttctactctttcttagttggataccttgtgtgtc

SEQ ID NO: 29508 - DNA, 121 bp, Artificial Sequence
  Synthesized
  misc_feature (61): n=a or g
atttgcaaaaatacaggtggtatttcacctccccaggagaagaaattccttctgtggtgtnaagaggagatgtgaaagaggtatggttaaatgtgtttctccatgtacagttagcatctgg

SEQ ID NO: 29509 - DNA, 121 bp, Artificial Sequence
  Synthesized
  misc_feature (61): n=c or g
caagtctggtgtaagattaacaaatcagactcaggtgagtttacaggtgtgtgtgttttcnctgtgatgaatcttgatgctaactgtaacaagtgcatacctcaccagtgacaaacagttc

SEQ ID NO: 29510 - DNA, 121 bp, Artificial Sequence
  Synthesized
  misc_feature (61): n=c or g
agatatgcagcttgggcagtgagtgataaaaataaaacattaaaaaatcaccaccatgtanagtgcaagatagggcaaattcagtgtcagatgagctgattccttattatccacatcttgt

SEQ ID NO: 29511 - DNA, 121 bp, Artificial Sequence
  Synthesized
  misc_feature (61): n=t or g
agtgacaaagatcccaatttcccctggcagcagaagaaccctgcagacatagagacaaaangctaggctggagattgcggtcttctctgctctgcaaatttgtgacgtagacacagacaca

SEQ ID NO: 29512 - DNA, 121 bp, Artificial Sequence
  Synthesized
  misc_feature (61): n=a or g
ctcagcaaagtatttgttttgcaacaggaatactcataatttgaaaactaacatgctgacntccgagttatcccccggtgttccactctgcagtcatgtggtaggaaggaaggactctaaa

SEQ ID NO: 29513 - DNA, 121 bp, Artificial Sequence
  Synthesized
  misc_feature (61): n=c or g
tttttgctactataactgttagtagcttactaaccctttttagttattgggcagaaattgntgtattttcctttgatactagattttttttattttagcaatctttattaagtaatggcat

SEQ ID NO: 29514 - DNA, 121 bp, Artificial Sequence
  Synthesized
  misc_feature (61): n=t or c
aaaagacaatgcaggctatcaacctccccagtatgcaatattaagctcacccatttagccngtactgcatcaagtaaattggtagaaaaaacaaaggaatctttttgctctgcccaacttc

SEQ ID NO: 29515 - DNA, 121 bp, Artificial Sequence
  Synthesized
  misc_feature (61): n=a or g
ctcatgttagttgcccgagtcctttagtggatgtagtttttagtaatattcgcaacacacngatttatagtcgcatttattccggaggaatctaatcacagcattgctttagcaaatgtag

SEQ ID NO: 29516 - DNA, 121 bp, Artificial Sequence
  Synthesized
  misc_feature (61): n=a or g
cagtcttgggtaacatactctctggtatgcatggatgtggattaattgttggaattcagtnccaggttacctgggaggtatctctagtgctatttgtactcatagcttttttgcacattta

SEQ ID NO: 29517 - DNA, 121 bp, Artificial Sequence
  Synthesized
  misc_feature (61): n=a or g
caagctacatacttgacagttagattgcagctgaaacagagacttgagaaccataattttngtttacagacctaaattccttccaagagctattatcagatgcctagacctgtgctttaaa

SEQ ID NO: 29518 - DNA, 121 bp, Artificial Sequence
  Synthesized
  misc_feature (61): n=a or g
cacacgcatgctggtttgcagaacaacagagtgcagctcctggtttgtgcaggaagcagcnatgctccccgtggtctgttttgcatcagcatgccgtggggtgagcccttcagctccacaa

SEQ ID NO: 29519 - DNA, 121 bp, Artificial Sequence
  Synthesized
  misc_feature (61): n=t or c
aaatgggcttttttttttctaaattaagtggttatacaagggctatagtaaccactgttancataactgatatttctcagatctgacagagtcatttccagctgagatgtgagaggttatt

SEQ ID NO: 29520 - DNA, 121 bp, Artificial Sequence
  Synthesized
  misc_feature (61): n=a or c
agtacttttatagcttgttggcagagtaatgagagagaggaaacatctagatcctgttcanttttagattttcttgacagttgtgtaaatatgagtaggaaacgggagaaggtggagcagg

SEQ ID NO: 29521 - DNA, 121 bp, Artificial Sequence
  Synthesized
  misc_feature (61): n=a or c
taaatgtatagttatgttcataaatgtatgtcaaagcagtcaaatgcttgactaaatattngaccttgatgcgcatacaaaatttccattactgttaataggagaaaatgtggatgtatta

SEQ ID NO: 29522 - DNA, 121 bp, Artificial Sequence
  Synthesized
  misc_feature (61): n=t or c
ctcacctagtagtacctacagaagaggctcttcaagtctgggatgttatcaagaggcatcnagaagttcccacacatgctgactactctgagaataggaagcaagctgcacaatgcgttca

SEQ ID NO: 29523 - DNA, 121 bp, Artificial Sequence
  Synthesized
  misc_feature (61): n=a or g
aaatatttctattttctagctctatttttttgcatagcaaagatttcctgaagtcttcacnttattatgaccaaaaccaggcagaatgcaatcttagctaatccactcctccaggcaatag

SEQ ID NO: 29524 - DNA, 121 bp, Artificial Sequence
  Synthesized
  misc_feature (61): n=a or g
ctggcagctatttgagcaagcggtggatgtgctttctcctcccagccaaaggagtgagccntggttttggcacaggcttctcctagagcatggtggggagggcaggtcttgaggtgctgct

SEQ ID NO: 29525 - DNA, 121 bp, Artificial Sequence
  Synthesized
  misc_feature (61): n=a or g
gataaggtttatacagattgtaaactctaatctccacgagcagaggtcaaaatacaaaccnttgtactgcatcgtcatgcaggaaggattttggatagtgggtgtatatgctcgaagctgt

SEQ ID NO: 29526 - DNA, 121 bp, Artificial Sequence
  Synthesized
  misc_feature (61): n=t or g
aagcacaggaggagaaaattaaccatattttgcctaaagtataaccaatttgtgaccaatntatggaaagcaatcagctctacgtggcagaaactccaggccagctttgttccaaagcaca

SEQ ID NO: 29527 - DNA, 121 bp, Artificial Sequence
  Synthesized
  misc_feature (61): n=a or g
tgggatctgctgagcatgggttccgtttgggatgggatccattcggggtaggaaccatttnggatgggatccaacggggatgggatccatttgacatggtgtccattagggatgggatccg

SEQ ID NO: 29528 - DNA, 121 bp, Artificial Sequence
  Synthesized
  misc_feature (61): n=a or g
gtggttatgtccaagttccatattgacatctcatgctatattccaggctcttacaaaaatnaaactgagggcacgtgaattgtactgttttaacttgatattttatgttaatatttttgat

SEQ ID NO: 29529 - DNA, 121 bp, Artificial Sequence
  Synthesized
  misc_feature (61): n=a or g
ggggcgaggggggggaatgggaaagagtattcaaagtcccccagaaaaatatactttagtntatctgtgatgctgatgtatatttaaccaatatattaaaaagtgataccagagcagtact

SEQ ID NO: 29530 - DNA, 121 bp, Artificial Sequence
  Synthesized
  misc_feature (61): n=a or c
gtcttcaggcacttctaccaattgctacaactaagcaattatagagtggccttgcaatcanatctgtcagctccctcaaaaatcatcagcaccccaccagggccaatggacttctgtgtgt

SEQ ID NO: 29531 - DNA, 121 bp, Artificial Sequence
  Synthesized
  misc_feature (61): n=t or c
gtgttcagcatagacttgggcacatcaggcagagctggtccctttggggaacaacctaagnaaatttaccctcctaaccatttggagacagtttgtcctgctcggtacagtccaacacagt

SEQ ID NO: 29532 - DNA, 121 bp, Artificial Sequence
  Synthesized
  misc_feature (61): n=t or c
ttaaaatacttcattttactaaagatatgtagacctcatagtgcttggatataataattantgcattggagagttcaaaaaatactgtttccttcatggcagtaagtttgatttcttgttt

SEQ ID NO: 29533 - DNA, 121 bp, Artificial Sequence
  Synthesized
  misc_feature (61): n=t or g
tagtttttcttctgtgaatactcctgctttgtatctacagtaggacggaagatctcttgtnctatgaaggtattttctgtattgcataacagtcctggaatttcctgaaatgtaccttgaa

SEQ ID NO: 29534 - DNA, 121 bp, Artificial Sequence
  Synthesized
  misc_feature (61): n=a or g
tgctatccgaaggattcaagctacttttgcactgcatcacctacaccagtgttcaaacctnctcagctgtgtcccagaaatcaggtgctggagggctgcaaaggaaggacacccaaactgt

SEQ ID NO: 29535 - DNA, 121 bp, Artificial Sequence
  Synthesized
  misc_feature (61): n=a or t
cttagttcagtgctcaggccttctgaacagtgggagaatcacttaaattctgtttgtatcntgtccctgtctgtaaaatgaattaagtgggggatgagtggcctcatttaggaagctgatt

SEQ ID NO: 29536 - DNA, 121 bp, Artificial Sequence
  Synthesized
  misc_feature (61): n=a or g
agtgtttgtggtatactttgtattcggttttcttcagctagggtagaaaactaaagtagcntttgcttttgctactgatatttctatgtgctttgaagaaagcagatgataatgttaggtt

SEQ ID NO: 29537 - DNA, 121 bp, Artificial Sequence
  Synthesized
  misc_feature (61): n=t or c
tgacatcctcattttccttttcatatgccttctgagccccagtcagagtgataattaaacngctaaaatgcaataaaatatgctgcctgtaaagtgtctccaaccagaaactgagatctct

SEQ ID NO: 29538 - DNA, 121 bp, Artificial Sequence
  Synthesized
  misc_feature (61): n=a or c
tttggctatttccaacattaccaccatgccctgtaacttcatcagataatgccacaaaacncagtttgcacataaacagaaatgtttccctaacgtaacagcaaatcattccttttcagtc

SEQ ID NO: 29539 - DNA, 121 bp, Artificial Sequence
  Synthesized
  misc_feature (61): n=t or c
ttgctatagccctgcatgatcctgtccttactgggcacatatgtgcaatacgacaaatggnttaatacaattcttttcccattctatttccttttataaatcactgctttttaatttaaaa

SEQ ID NO: 29540 - DNA, 121 bp, Artificial Sequence
  Synthesized
  misc_feature (61): n=t or c
tactcgagggctgcctttccaaatgcagcagttgaaactttgaatccagattttgaagagncagacttactgctgttcaagataagaatacaatcaataaccctgacattctcctccacac

SEQ ID NO: 29541 - DNA, 121 bp, Artificial Sequence
  Synthesized
  misc_feature (61): n=c or g
acatttgatcacatttgaaaatacttcaactatactgtctatataaaggtgataggcttantctctgcagaggtggttataaatttggtcttcattccgtgtaccagtttggaagaatctg

SEQ ID NO: 29542 - DNA, 121 bp, Artificial Sequence
  Synthesized
  misc_feature (61): n=t or g
gcaggctaaagaaatactttggggattgcattcattgctcatcttcctctgcatgacaagnatggggttttttttcacattctgggaaatgaggaaaaagcatgtcacaggatttgtgctg

SEQ ID NO: 29543 - DNA, 121 bp, Artificial Sequence
  Synthesized
  misc_feature (61): n=c or g
gagcagacatgtggaacacttatttctgggttctgttgaatgaaaatgctgcttctttctnttgtcatcctgagaggtgcagtgcaggaatatcacagaaccactaaggttggaaaagagt

SEQ ID NO: 29544 - DNA, 121 bp, Artificial Sequence
  Synthesized
  misc_feature (61): n=a or g
acctaaaaaggtatttcaccttcatcagaactctgcagatccccaatgcacttcagtgtcncattaattatgttagtcactctaacaaatctggtgtctctgatgttcctctcaaagtcac

SEQ ID NO: 29545 - DNA, 121 bp, Artificial Sequence
  Synthesized
  misc_feature (61): n=a or g
cgatggagtggggtgagggatgcaggatgagagatgcaggatgtgggatgccctgtattgntgatgctcatgtagtgatggcccaaaggtccaaaggcagtgctcctcctgccttcctata

SEQ ID NO: 29546 - DNA, 121 bp, Artificial Sequence
  Synthesized
  misc_feature (61): n=t or c
gacagaatatctaatagccactgaggtttttcaacttcgcaacgttgtctttggagagggnagtgttgttttacagacagggagcagaagcacaaagcaaccaaagtaattagaattcaca

SEQ ID NO: 29547 - DNA, 121 bp, Artificial Sequence
  Synthesized
  misc_feature (61): n=a or g
tcttctttaaattaatattgttctcagtagtgttgccagtgcaagattgaggtgtttttanaaatgtcaagattcaggtagttttcatctcacaaagacttggatacttcaacttgcaggt

SEQ ID NO: 29548 - DNA, 121 bp, Artificial Sequence
  Synthesized
  misc_feature (61): n=t or c
aagagcacagtcctctcttgaagaaggacaggcctatgagtgctgacccagcccgatccanctttcagtcctgcctggtgccacatcagctgctcaggaaggcccaggtcaatgttcctca

SEQ ID NO: 29549 - DNA, 121 bp, Artificial Sequence
  Synthesized
  misc_feature (61): n=a or g
cagtaaacccttctgcactacaactccaccacttggtgcattcagtttgcagtgagaaacnttcagagcaaggactgcttatttctgcatggaggatctgtaccttatccacttattgttt

SEQ ID NO: 29550 - DNA, 121 bp, Artificial Sequence
  Synthesized
  misc_feature (61): n=a or g
tcataagcagccatacccttgagctgggagcttccatacgtaacttttgcagatgatcatngaagttccctagtctgagggcttacttaaatgccaagtaagaagaggaagaaaaaaaaga

SEQ ID NO: 29551 - DNA, 121 bp, Artificial Sequence
  Synthesized
  misc_feature (61): n=a or c
caaatagcttaacctcatttgacttgtgcttactgagggtggctcttccacttcagcagcntgaaccacagacggagcccctgttttttgcagtggttctgttgggttttccgggaaacaa

SEQ ID NO: 29552 - DNA, 121 bp, Artificial Sequence
  Synthesized
  misc_feature (61): n=a or g
atacaaatctcattttttagggctgtcatgacattttggcatctgcactgatttttgaacntttgtggctggtgatcatggtttaacatgtttatcttatctttgaagtcactgtggctag

SEQ ID NO: 29553 - DNA, 121 bp, Artificial Sequence
  Synthesized
  misc_feature (61): n=a or g
atttactcaaggtaattaaaagacccacaggtcccatagaatccatatacttctttgtctntgaacctcaaaagcttttgacatacctctgcaaaacctctagcagcagtgtaatgcttat

SEQ ID NO: 29554 - DNA, 121 bp, Artificial Sequence
  Synthesized
  misc_feature (61): n=a or g
gattacgaattcacattttcttcagagattcatccgaaaagttgaaagagtttaagaaacncaaagctcagctgtatgactcagtgtgcattcattactaggagctttgtgttacctgcag

SEQ ID NO: 29555 - DNA, 121 bp, Artificial Sequence
  Synthesized
  misc_feature (61): n=t or c
ctcttggagagaacaaacaccacctttgtgatttcacatctcaggcctccagctgtgatgncctgggcttctttaatatacacaggatttacagagataggtacgcataccttttagacag

SEQ ID NO: 29556 - DNA, 121 bp, Artificial Sequence
  Synthesized
  misc_feature (61): n=a or g
ccttacttctgcctatgtgataggcattcattaactgcaaggagtttttcagatgagaagnagccttcaaatctctagtttaacactgggaaaaaaaaagtgttttgttacacaacgctga

SEQ ID NO: 29557 - DNA, 121 bp, Artificial Sequence
  Synthesized
  misc_feature (61): n=a or c
aatactggagttaagatcctttatgctaaaaatagtaaaagcataagtaatgactataggnaaatagttggcttacagcaagattagacaaaccttagggttatgaaggtaatgaataccc

SEQ ID NO: 29558 - DNA, 121 bp, Artificial Sequence
  Synthesized
  misc_feature (61): n=t or c
gatagtttgcattatggagatgaagaatgttttcctgaggtgacaggaaggtgtgtttctncctgctagcacctggtgtgctgttagcacagccaagtgggtacagaagaatttgagaagg

SEQ ID NO: 29559 - DNA, 121 bp, Artificial Sequence
  Synthesized
  misc_feature (61): n=a or g
aataagttaagcctttcaaagagaggttgaatgccttgaggcagaacaaaggccaggtgcnggatcagtataaatcagcattgctttattgttccccgataagggccaacagaagaaggcg

SEQ ID NO: 29560 - DNA, 121 bp, Artificial Sequence
  Synthesized
  misc_feature (61): n=t or c
tgtgtttgtttccagtgcacacatactataaatccccatcgtaccttacccttagcccccnatcttcatccgccgctgcagtggaaaaggagagagagaaattacattttcataaaggaag

SEQ ID NO: 29561 - DNA, 121 bp, Artificial Sequence
  Synthesized
  misc_feature (61): n=t or c
tctgtcattaatagggcacactaaaaaaatacgactgttgtgcctatgaaacttagaccangtggtttcatcaattcggactccccataaatgaatgaaaagcatttattgtgttaactta

SEQ ID NO: 29562 - DNA, 121 bp, Artificial Sequence
  Synthesized
  misc_feature (61): n=t or c
ggcagcaggagccgataacaccgtggccagtctccaagttggagcactcagtgatgtgcangcacagcttggctggtttgtggagcccctgtcactgtcccattgccctgtcgtgatggag

SEQ ID NO: 29563 - DNA, 121 bp, Artificial Sequence
  Synthesized
  misc_feature (61): n=a or g
gtctcttaggtcagagcttttgaggagataacaaatggggggttgtctttcttatgactgngtctcccacagttcttatttctgcaactattgacagccgtcttggccattagtttaaccc

SEQ ID NO: 29564 - DNA, 121 bp, Artificial Sequence
  Synthesized
  misc_feature (61): n=c or g
caatattttcagtgtgcaaaagaaaggtcttttcctctctgagtgccttttcttcctaaancatttgactgttccttaggattgtgcttaatgcttgcatcttttgttttggaacagaatt

SEQ ID NO: 29565 - DNA, 121 bp, Artificial Sequence
  Synthesized
  misc_feature (61): n=a or g
ggtctaaagtagttggtgattagtgatttttctttcactcgcttaaaaagttaaagatacntttgctgttttcttctgctcttggcctacactttgagcgtgggtcttggccctatctggc

SEQ ID NO: 29566 - DNA, 121 bp, Artificial Sequence
  Synthesized
  misc_feature (61): n=t or c
tgatgcatagagcatgaatgtcccgatggaatagcagctgctactggggcttgtgacatgncaaagagtcacccttgtggtaggcagtcattactccacagcaaatacagcaggttgcctg

SEQ ID NO: 29567 - DNA, 121 bp, Artificial Sequence
  Synthesized
  misc_feature (61): n=t or c
tatgatggattagctgggagagaaaatgtctctctctaaatacatatatgcatcccaggtnccctaaatgccagaaatgctgcaagtgaatatctaaatgactataataatcgctgcagat

SEQ ID NO: 29568 - DNA, 121 bp, Artificial Sequence
  Synthesized
  misc_feature (61): n=a or g
gatgtgtgaaacgaggcgagctgcagacctggaggctcttccttgtgccgtaattacaagnccacaggtaggactgagcaaacagctttcacttgaattgcagcacacttgtgtcatgccc

SEQ ID NO: 29569 - DNA, 121 bp, Artificial Sequence
  Synthesized
  misc_feature (61): n=a or g
tcagaaaacacaaagttcagtgctagaaactaaattgtatctcaaagcaggcatggaggtnacagtgttgaaaagggacaaacacaaatctgtaggcaaagctgccattaggtcatactca

SEQ ID NO: 29570 - DNA, 121 bp, Artificial Sequence
  Synthesized
  misc_feature (61): n=t or c
cacggttttacagtatgtgcttatttcgataccttttctctctttgtttcagattcagcantctgtgttgcaaatattatatcacctgctatgacacaggatacaggtactactaacctca

SEQ ID NO: 29571 - DNA, 121 bp, Artificial Sequence
  Synthesized
  misc_feature (61): n=a or g
cgctgttggttttcctgaacagaggaaacatgtacaaagcaaaaggaaaattgcggtcccnttggggtttctgagcagatgtaaatggcacagaggtcttggcaggatttcctgagtttgg

SEQ ID NO: 29572 - DNA, 121 bp, Artificial Sequence
  Synthesized
  misc_feature (61): n=t or c
gatctgtgcagcccctctagaaactgaggacaagaaatggtagttacaaactttatatagntgttattaaaaaataacgggggctctcagtacggaaaaataatacatatgaatggaatgc

SEQ ID NO: 29573 - DNA, 121 bp, Artificial Sequence
  Synthesized
  misc_feature (61): n=a or t
tcagtcttgtcctttacagagtgtttcagctttatggttcagtttgttttaggtagttccncatacacatattgatgataaatattttcagtttgattttgcttctaagtgactctcctga

SEQ ID NO: 29574 - DNA, 121 bp, Artificial Sequence
  Synthesized
  misc_feature (61): n=t or g
atccagtgtatgaacagcaataaattactgtcttggataacacacccactgagtgcaggantctgcaccctgcaaagcgaggagctatgagtgtgtgcagttggtcatgccaaagggtcac

SEQ ID NO: 29575 - DNA, 121 bp, Artificial Sequence
  Synthesized
  misc_feature (61): n=a or c
aaagtttggttgccatttaggattattgacttgtgctagcccatggttagaattgtgagancactatttgtgctgccttctcatcaaccttttcttctcaaaagattgtttgactcttgtc

SEQ ID NO: 29576 - DNA, 121 bp, Artificial Sequence
  Synthesized
  misc_feature (61): n=t or c
atcataacattatgacatgcaccatcttgccctggtatgaagtatgtcattaccctttgtntcatctcaatcctcctccgcagacctgggttcagcttctttaacttgaactctaggtgat

SEQ ID NO: 29577 - DNA, 121 bp, Artificial Sequence
  Synthesized
  misc_feature (61): n=t or c
tggatttcagtttctagcatttatacaagaacatgaggcaaatagttctgggttagaccangggtctgtctggtttattatcctgtttccagtaatgtctaataacagaaaagtaggaaaa

SEQ ID NO: 29578 - DNA, 121 bp, Artificial Sequence
  Synthesized
  misc_feature (61): n=t or c
ggaaacaacaccagccagcccctgcacacccacccacctgcaatgggcattgcacacattnagagactgctgtctgtcttcttcaccctttgctttttcaataaaacactttttttttata

SEQ ID NO: 29579 - DNA, 121 bp, Artificial Sequence
  Synthesized
  misc_feature (61): n=a or g
aagagtggaaaggccatcttcctttcaaagaatggggacaagatgaaacacagaatctcanttggatagattttgtttctgtcccagttaatttaagcagcatgttcagctggaattagtg

SEQ ID NO: 29580 - DNA, 121 bp, Artificial Sequence
  Synthesized
  misc_feature (61): n=c or g
agcctcacctcgagcactttgtgcagttggggcaccataatgcaagaaggatatgaagctnttagagagcaaccaaaggggggctatgaagatggtgaagggtctggagggcgaggggtat

SEQ ID NO: 29581 - DNA, 121 bp, Artificial Sequence
  Synthesized
  misc_feature (61): n=t or c
tgacaagagccggattttacacagtgggaatttgttgcaactttaactcttcacatagctngtggtcaccggagtaggatcttccagtaacaagtttctttcatggagtggagaacaaatg

SEQ ID NO: 29582 - DNA, 121 bp, Artificial Sequence
  Synthesized
  misc_feature (61): n=a or c
ggaaatgtgatccttcagcacacttctgtaggcaagaggatcactataatacttaaacatntgaataaaataatgctaacaggttgtggtgtagttacattacaattgtgctgtgcaaagt

SEQ ID NO: 29583 - DNA, 121 bp, Artificial Sequence
  Synthesized
  misc_feature (61): n=a or g
attgtgtgccctcctgcccagggacagtgtgtgctgtcaccctttggggaaatcccacctncgttcaacaccactgctcagacttttattgctcactgttgtctcactccttcattattaa

SEQ ID NO: 29584 - DNA, 121 bp, Artificial Sequence
  Synthesized
  misc_feature (61): n=a or g
attgatggaagaagtgtaaagagagtgcaaagctgcccagggaacaatgacagggaaaggntgtgagtttgagctccttttatatggtcttgtgctctcatgcactgcagatgctcatttc

SEQ ID NO: 29585 - DNA, 121 bp, Artificial Sequence
  Synthesized
  misc_feature (61): n=a or g
atgtggaacatcttcttgaccttccttccacctcatagagaaggcaagcattggttattcngtggtctttctgagttgctctgcactggggctgggctgtgcagctagacaggggagcaaa

SEQ ID NO: 29586 - DNA, 121 bp, Artificial Sequence
  Synthesized
  misc_feature (61): n=a or g
agtgtttggtgttgatggggagaaacctttttaaaaaagcaaaagtaattgttatggccantcaactctccttgtgtttcttaatagttatgacattacaacactgttgcactctctttcc

SEQ ID NO: 29587 - DNA, 121 bp, Artificial Sequence
  Synthesized
  misc_feature (61): n=t or g
aaaaaagaaaaaaaaagtgataaaaaatgaatcattaattatcttagaccaacataaattnctaatgactttgcatcccttagacctctgaccttattatgtcagggcaaaatacaaataa

SEQ ID NO: 29588 - DNA, 121 bp, Artificial Sequence
  Synthesized
  misc_feature (61): n=t or g
cataggctagctcagcaacagttgaaccggacagggcacctaaaagaagtgttgcttaganaattattctgaatggaagcatgggatgtaaccacaataaataaataaaataagaaaaaag

SEQ ID NO: 29589 - DNA, 121 bp, Artificial Sequence
  Synthesized
  misc_feature (61): n=a or c
actgaaactgtacatataaactaatatgaatgaggatgggcctggaagaaggcctagcacngtttgacaaaatgtgcttgtcagtctagaaagggatgaagagaggagaacagaatggatg

SEQ ID NO: 29590 - DNA, 121 bp, Artificial Sequence
  Synthesized
  misc_feature (61): n=a or g
caggcagatcagggacactgtgctgcgctgtgagtaccctacagtctgtaccatggggatngaaccttacctctgtccccagacatccctcagtgggccatgggaaggggttggatcccca

SEQ ID NO: 29591 - DNA, 121 bp, Artificial Sequence
  Synthesized
  misc_feature (61): n=a or g
tgtcaaacattttgcttagaaagagttaaattctctctgcttaatttccacttgtggcccntattgcttttctctctacttgttccaaacaacttgcagtggtacaacaggaatcatcacg

SEQ ID NO: 29592 - DNA, 121 bp, Artificial Sequence
  Synthesized
  misc_feature (61): n=c or g
aattacatacactttttagagaaataaacttgtttaaaactgcatttgtcaatataacaanccacaataaagcctagatttactcttatcttgaaatgattcagactcacagaacggacca

SEQ ID NO: 29593 - DNA, 121 bp, Artificial Sequence
  Synthesized
  misc_feature (61): n=t or c
tatagaccatcaggctggcactaagtacatgtgtgcatactgggaaaggatgctaggttantttcactccactcttctcctggaaggagctattatgtttgcactcttttgatgcagcaaa

SEQ ID NO: 29594 - DNA, 121 bp, Artificial Sequence
  Synthesized
  misc_feature (61): n=a or t
tttgtcaccatcataattagagggtcaattaaggttttgttgaactgcgatctagataacntttcacagtcccacagagctcaaacaactgcctggctttgctgtacatctcctttctggc

SEQ ID NO: 29595 - DNA, 121 bp, Artificial Sequence
  Synthesized
  misc_feature (61): n=t or c
cttttgctccattgaactgtatggagaggacttcaaatgtaacacaaattaattcatggangactcagctgggtttattattcatttgaattttcagaattgtccaacatgcaaatgaatg

SEQ ID NO: 29596 - DNA, 121 bp, Artificial Sequence
  Synthesized
  misc_feature (61): n=a or g
atacactaaattcattgtttggtggtatgaagtaatagcacaactgcagccttatagtccnagggcatgggctaaacaagaactgtaggcaaagtcgcactagacaagctagaaaaagcaa

SEQ ID NO: 29597 - DNA, 121 bp, Artificial Sequence
  Synthesized
  misc_feature (61): n=t or g
ctgaaaccaaagccattcagaaaggcacagcaagaacctttacagttcaaggcttaatacngggcattcaattttgtagatgaagtggcagagatctgtagaaatagtaatctgttcagaa

SEQ ID NO: 29598 - DNA, 121 bp, Artificial Sequence
  Synthesized
  misc_feature (61): n=t or c
ggacccctaccagcaaggaggtcacgaggagaagctcttcctttgggaaaccttgagagangtcaccacgctgatcaaaacttgcaggtgggacacagatttgttattttccaagggaaca

SEQ ID NO: 29599 - DNA, 121 bp, Artificial Sequence
  Synthesized
  misc_feature (61): n=a or g
tgcagtgacctgccctgagagcaggcaggtttagcggagagtaatcatgtaagtcaccacngaaaaacataatccattaaagatggtcttatcgtgaacagaatggagcagagaaagaaac

SEQ ID NO: 29600 - DNA, 121 bp, Artificial Sequence
  Synthesized
  misc_feature (61): n=c or g
tctgaaaatataggtgtcttttttattaagtggagcaccagcatatgtaccacgcatcccnatttgctggtggtgctgcggtgtcggagcagagggaacagaagcagcggcaaacaaacgc

SEQ ID NO: 29601 - DNA, 121 bp, Artificial Sequence
  Synthesized
  misc_feature (61): n=a or g
taagcgttggaagaaccgtctggtttggggtgcgtgaaggtgcgtttctcaccagtagganctcttccaattggttatgtgttatggtgtaaaacttcatttttaggtggtgagctgattg

SEQ ID NO: 29602 - DNA, 121 bp, Artificial Sequence
  Synthesized
  misc_feature (61): n=a or g
gcaattgcttcaggtaaaaagaaaaggctgtagaagagcacatacattgtttagtttcacngattgttctgggcttcagttcccttgacaaatgggactgctttatttccctgataagttt

SEQ ID NO: 29603 - DNA, 121 bp, Artificial Sequence
  Synthesized
  misc_feature (61): n=a or t
taatggcttttgcgtggtaaatttttcagctgagaaatacatgttgaggaagtgatcaaangatcttgcaaacatggaatgccattggttctgtaagatcagagaaagaaaaattcaatgt

SEQ ID NO: 29604 - DNA, 121 bp, Artificial Sequence
  Synthesized
  misc_feature (61): n=a or g
atttgattacagcttctgatatcagtggtggtgttctcacatgcaaacactgaaggattangcaccacataattccacacttacaatgctagcatactgtcaacaagaactttgtctaaat

SEQ ID NO: 29605 - DNA, 121 bp, Artificial Sequence
  Synthesized
  misc_feature (61): n=a or g
gaaactgttttcccatgagaatgatgaaatctgcagggggatgtgtagcaattggctatcnaagaggttattgagaagaataaaaagttcattgagactgtcattccagctgaacaggtac

SEQ ID NO: 29606 - DNA, 121 bp, Artificial Sequence
  Synthesized
  misc_feature (61): n=t or c
cacagagagggaggaagtgtttttcactgttattctatcaagacatgacgaatgattcaangagaccccaaggctgagcccatggcaaacatgctcagatgaccagaaggatgcatttcct

SEQ ID NO: 29607 - DNA, 121 bp, Artificial Sequence
  Synthesized
  misc_feature (61): n=c or g
agtcacaaaataaaaaatgcagcagataaagagcatgagtgaaatattgcgtcagtaagtncgtttcttaggtgatactgatctgttgcttctagagtacaagtgtatgcaatgtccactt

SEQ ID NO: 29608 - DNA, 121 bp, Artificial Sequence
  Synthesized
  misc_feature (61): n=a or g
agggctgcagcaggatggtaggggaagtgtatggtttactgcctcctcaggccttgagagnagcagggaactaaacaaggctttgagctactgatgctggacttgttcataccttgttcaa

SEQ ID NO: 29609 - DNA, 121 bp, Artificial Sequence
  Synthesized
  misc_feature (61): n=a or g
taaaggcattaaaatctgatatatatgtttttggatgaagaattggaaagaacagtattgnaaaaagggtgaacaatgtattccttggtttttttcctgagatctgctttcttggagaggc

SEQ ID NO: 29610 - DNA, 121 bp, Artificial Sequence
  Synthesized
  misc_feature (61): n=t or c
gctcaaaggggggggaaaggggccggctttgcacccggcttctcctcagtgaacctttatnactccatgtgtataaatgcccacagctcattacccgtgaccagcccagcccccaaccttt

SEQ ID NO: 29611 - DNA, 121 bp, Artificial Sequence
  Synthesized
  misc_feature (61): n=t or c
caagtacctttagttattctttattgcaacttcacattaacagtatctctttgctcctatnccacacaatcttcctacatgactatatggtcacaaatacaagttcttgtgatttaaagtc

SEQ ID NO: 29612 - DNA, 121 bp, Artificial Sequence
  Synthesized
  misc_feature (61): n=a or g
tgagcctgaagaaatgacactgggttgcatatcatgataagcaagaggaagctcccttctngtccagaggctttcattaatatcttaatttatacacagtatattttccctgcagacattt

SEQ ID NO: 29613 - DNA, 121 bp, Artificial Sequence
  Synthesized
  misc_feature (61): n=c or g
actttttgtatattacgtgcgtgtaagtatgagtgttattctaatgcacccagtgataatntaagccaatacattagtgccccgtgacttccttacactttgccttgattcctaacccatg

SEQ ID NO: 29614 - DNA, 121 bp, Artificial Sequence
  Synthesized
  misc_feature (61): n=a or g
cttttactgattgtcttttgtctaaagatgagaatcactgttagagctgctattttctaantggcagagcagttagtgtagatcgggttgccttcaatataagaatacaatgggcagtccc

SEQ ID NO: 29615 - DNA, 121 bp, Artificial Sequence
  Synthesized
  misc_feature (61): n=a or g
tttagatactgacttgcatattagttgctttctacagttgagcagaataagaatcaggaanagaggagacatcttttactgtaagaatcagggagagggaaggacaaatgtcttttttctc

SEQ ID NO: 29616 - DNA, 121 bp, Artificial Sequence
  Synthesized
  misc_feature (61): n=t or c
ttattgccacttttcttagttccatgtccctgtgatagaacaaacttgcccaattccaagngtgcattttctaatgtacttctgccttcagcgtggccctcctccccgtgtttccctcagc

SEQ ID NO: 29617 - DNA, 121 bp, Artificial Sequence
  Synthesized
  misc_feature (61): n=t or c
agatgctttggaatatgagatgctatgggatatgagatgttaacgggatatgagatgttangggatatgagatgctatgggagaagtgatgctgtgggagaagagacgctctgtgatataa

SEQ ID NO: 29618 - DNA, 121 bp, Artificial Sequence
  Synthesized
  misc_feature (61): n=a or t
cagataattcttctttcagtagtagacttgcatagtttttccacttgacagaaacagtacnggtactagcaattatacaagaacattctcaagcataaaggaagtgagttcacttagaaat

SEQ ID NO: 29619 - DNA, 121 bp, Artificial Sequence
  Synthesized
  misc_feature (61): n=t or c
agtttgtaacatagagtaacatttacaaaagtcctttgtcgccatgctctatattttattntcaaacatctgtcaaaaatcagggctttttaagcaacatctggagtaaattcaagcaatt

SEQ ID NO: 29620 - DNA, 121 bp, Artificial Sequence
  Synthesized
  misc_feature (61): n=a or t
cagaggtcatctttatccttcagagtaggttcattctattgtctagtctttctgttgtccncactgggagacctagagcaccaaagctttttggctggcatgactttagaatggcttgtgg

SEQ ID NO: 29621 - DNA, 121 bp, Artificial Sequence
  Synthesized
  misc_feature (61): n=t or c
atacagacaagaaaatctaaatagcttaatggaagtcttggctttccaagtaaaagtgccnatcttctggcttttaataccacgtggccagcattttcattctgctttagtctgacttaaa

SEQ ID NO: 29622 - DNA, 121 bp, Artificial Sequence
  Synthesized
  misc_feature (61): n=t or c
cgtcctcagatactgctatatgtctacttgcttgtctaagaaatatagttagtttgatgtnaagctactgttggcagtttggcaggagggaatcatgaggaattctgataagttgaattac

SEQ ID NO: 29623 - DNA, 121 bp, Artificial Sequence
  Synthesized
  misc_feature (61): n=t or c
tatgcattgctttactgatgaagaaatcctgggagtcgttaccagccatggtaatgtttcnagctcctgggctcagatcagaactagaacattctaaaagtttagcagataggtggacagg

SEQ ID NO: 29624 - DNA, 121 bp, Artificial Sequence
  Synthesized
  misc_feature (61): n=a or t
tgactggatctgcagagaattccacaccaagtatttcagctatctgggtttttgaggcaanaaacttcctcagaagaattgtatctatccacgtctttctcaaaccacccagtgatgcttt

SEQ ID NO: 29625 - DNA, 121 bp, Artificial Sequence
  Synthesized
  misc_feature (61): n=a or g
tgctatttctcaaccttccaactcagggatttacaagtactttaccaattttaattctgtnagaccagttccaaaactctgatttccaactgtgggtctgtgtgaaaaaagtgcgtcagat

SEQ ID NO: 29626 - DNA, 121 bp, Artificial Sequence
  Synthesized
  misc_feature (61): n=t or c
agcaaccacacattctcctcgtttactcacagctgacacaagtatttggtactttctcagngacttcttgcctgacatgccctccaattgcttttacctttttgtaattgtttggcaaata

SEQ ID NO: 29627 - DNA, 121 bp, Artificial Sequence
  Synthesized
  misc_feature (61): n=a or g
gttgctctcagccaaaagactcagggatgccagacagccaaacgagatgttggaggcctcntcctgccttgctgggctgaggtctccactactagaaggggaagtgttgatgttgcatcag

SEQ ID NO: 29628 - DNA, 121 bp, Artificial Sequence
  Synthesized
  misc_feature (61): n=t or c
gatggtggaacaggaccagggatgtgggcctggagcccacctgggtaccggagcatttccngcagcacagacaggctcggtgctcatcaattttatcattctttatatcgtcgttaagagt

SEQ ID NO: 29629 - DNA, 121 bp, Artificial Sequence
  Synthesized
  misc_feature (61): n=a or t
tacctcacgagattaaactcagtcctttgtttctctataatggaacttcctcccttttggntcatcttcatccttgtggcttctctccccttttacttagtctttcctaaaaccaacaaat

SEQ ID NO: 29630 - DNA, 121 bp, Artificial Sequence
  Synthesized
  misc_feature (61): n=t or c
gtggctttgagcatcctcccccactcttcatgtctgttgtttttggcacctgtgactcaanacgcttgtcagagttaggctgtcatgcatggccagccttcagtggtgctgtatgaggtca

SEQ ID NO: 29631 - DNA, 121 bp, Artificial Sequence
  Synthesized
  misc_feature (61): n=t or g
cggaatcttcctgcagtcagaaagcaaatggctcagctctcttgtccacgcactcctgctngaagagagttgagctctggagtcgcagagttctgtttttgaaatgaggatgtgcccgtga

SEQ ID NO: 29632 - DNA, 121 bp, Artificial Sequence
  Synthesized
  misc_feature (61): n=a or c
ctatgaagtattgttttccagttacattgttcagtatcagttaactggaaaataacttctncagggacaaattctccattgattaaatattttcaccgacttcagtagcatgaaaacacaa

SEQ ID NO: 29633 - DNA, 121 bp, Artificial Sequence
  Synthesized
  misc_feature (61): n=a or t
tgatgctgcttctcctggaatgtgaaattttttagatgtttctgtgaggtgggacaaagangatgtgaattcctgaaggaaggaaacaaaggaggacaaacttacgactgagtggttgttc

SEQ ID NO: 29634 - DNA, 121 bp, Artificial Sequence
  Synthesized
  misc_feature (61): n=a or g
gatggtgtgcttgtggccccaccccctttcagtcacaagggatggtgcctgcagcttctgnctgaccggaattcagttgccctgcataggctgttccttgcttcaacacaggaggcagctg

SEQ ID NO: 29635 - DNA, 121 bp, Artificial Sequence
  Synthesized
  misc_feature (61): n=t or c
taatacacttgtaacacaaagtctgatccactcatctttaatttagaaaaaggcaccaaanctgatattctgcaatttatttaaaatcacaacaggtcataatattctgaccttgcttata

SEQ ID NO: 29636 - DNA, 121 bp, Artificial Sequence
  Synthesized
  misc_feature (61): n=a or g
cgaagtaaaaaacttcttatatggcttataattttaaacagacaatgttgccaaaagccangttctattctgttcttaagatttttttccctgtcaatatgagtcattatgtattttgatg

SEQ ID NO: 29637 - DNA, 121 bp, Artificial Sequence
  Synthesized
  misc_feature (61): n=a or g
gctccggttgctcctaggtacaggcttcttctaggatctccactctgctcttccttagctnctctgtggggtgtggatctgtggcttgagttggagggagccacatgtcagacagagctgg

SEQ ID NO: 29638 - DNA, 121 bp, Artificial Sequence
  Synthesized
  misc_feature (61): n=a or g
gtgctgggcagcaccatgctggcagaagtgcagttttcatcaccttccaacagggactgtngaacttctggaggctgcagtatctgtaatttctttttttctgagagtccagggagctcct

SEQ ID NO: 29639 - DNA, 121 bp, Artificial Sequence
  Synthesized
  misc_feature (61): n=t or c
tgtttggaaataatgcaatgacaagcactatcaaccattttgttttatgaatgttataaangggactgactttgcttgtaagtttaaaaagtcagtctttgtggatttcacacctacctac

SEQ ID NO: 29640 - DNA, 121 bp, Artificial Sequence
  Synthesized
  misc_feature (61): n=t or c
ccagcacaataagttattccaataagaggcagatgctatttctgagcagagcagaatcccntcccacccatgcctactgtggttccttggtcccctccacttggtagtggggagtccaaag

SEQ ID NO: 29641 - DNA, 121 bp, Artificial Sequence
  Synthesized
  misc_feature (61): n=t or c
tatttgagttgtcagaataagaaggagaaacaactggtattgagatgaattttccaaaccntgcttttgctaagcactgtgtgtagataaatcttgcacagtacagtttgattcagtgcac

SEQ ID NO: 29642 - DNA, 121 bp, Artificial Sequence
  Synthesized
  misc_feature (61): n=a or g
tgggacaattggtgacaaaagaaattcaggttagatataaggaggaactttataatgatgngcataattaagtgcctcagtagattatctaagagcttggaccgtgtcgctagaagaaaaa

SEQ ID NO: 29643 - DNA, 121 bp, Artificial Sequence
  Synthesized
  misc_feature (61): n=t or c
cagactgctagtacagcattaagtttttatctccacaatatgtattctggagctagtaccngcacattctttcatgtgatgaaagcttacactgtctgcattttctcccccaggtttaaat

SEQ ID NO: 29644 - DNA, 121 bp, Artificial Sequence
  Synthesized
  misc_feature (61): n=a or g
gaaaacctatgcctgagtgatgcgttttggcacaggctgtaactggctggcagcttctccntgacttcactggtgttgcccaaagaacagacgagaccggatgctactcatccagggatca

SEQ ID NO: 29645 - DNA, 121 bp, Artificial Sequence
  Synthesized
  misc_feature (61): n=a or g
ctaaagtaactatcaacattttgggggaatattctctgaaattccttggggtgaattatgnggtaaagaactctgaaaatgcaggggaaaaaaaaagtgtgcatgcttcagtggaaataat

SEQ ID NO: 29646 - DNA, 121 bp, Artificial Sequence
  Synthesized
  misc_feature (61): n=t or c
aatgttctgctctccatggaaggctgaaaatcttgatttatataatattgtgaagtattanctgattagagtttaatgctctgtgaggttaaattattgggtttctgttggctttatgcca

SEQ ID NO: 29647 - DNA, 121 bp, Artificial Sequence
  Synthesized
  misc_feature (61): n=t or c
aagcaaataggcagaagagcatgggctgatgaagaactgtgccaaaagcatcagaattgangaatccaaggagacttagttgtgttctcagcttttttggtggaatgacctaggtggtaga

SEQ ID NO: 29648 - DNA, 121 bp, Artificial Sequence
  Synthesized
  misc_feature (61): n=t or c
aacgtctgtttgtcaacagtgcttaataagcagttgttaaggggcagtttatttaaatacngaatgttggctaataactacttagagaccacatgttctgaagtattgccctttgtactga

SEQ ID NO: 29649 - DNA, 121 bp, Artificial Sequence
  Synthesized
  misc_feature (61): n=a or t
gcactagctaaatgtacggatacaaaaggctcttttcctttaatttttggacttttctcancttcatgcgttaaagacttccacaacttattcctttttatttctctgttgcctctttttc

SEQ ID NO: 29650 - DNA, 121 bp, Artificial Sequence
  Synthesized
  misc_feature (61): n=a or g
tcattcagatgttgacttgaatgttggtagagttcagaatccatcctccaaggtaacttcngagtcggactgatcttgcttggataatgtgataacaattggataacaatcaaggccaggc

SEQ ID NO: 29651 - DNA, 121 bp, Artificial Sequence
  Synthesized
  misc_feature (61): n=t or c
gtcctggcctgggaaggatcccagctcacccccagcatgttggatgcaagttgtgggtttntgcagcaacctcaccaactccagcagcggtttgcaaggaaaaaaggtttctcagcaatag

SEQ ID NO: 29652 - DNA, 121 bp, Artificial Sequence
  Synthesized
  misc_feature (61): n=t or c
atttgccatcttcattgcagctctgtgaacacataaacagggacctgtgagtttcaacctnggctcccacaactgaaagtggacgtaatgagaagacgacccacataaccacaagtgctac

SEQ ID NO: 29653 - DNA, 121 bp, Artificial Sequence
  Synthesized
  misc_feature (61): n=t or c
ttccctttagccagcaaagcagaaagtgggcttcactgcctcttttccctctcactcctcnggcgttcctggctcgaggcatttcagcagtgcaggaattgtgctatccctgggtgacaga

SEQ ID NO: 29654 - DNA, 121 bp, Artificial Sequence
  Synthesized
  misc_feature (61): n=a or g
tagaatagtatgtgtttagaacttgtctcaggaaggtacttccatgcattaacttcagaanagaatcagtaaaatagatcaaaagtagcagagaagactaattccgtattttgtcttgtat

SEQ ID NO: 29655 - DNA, 121 bp, Artificial Sequence
  Synthesized
  misc_feature (61): n=a or g
actggcgtctgcagaaccctgtctcctgcagagcttcaccctttcaatcatcccatctccntcccatggccaaaaagccaccatccacacctcaatactactggcatgcaggaccgcccta

SEQ ID NO: 29656 - DNA, 121 bp, Artificial Sequence
  Synthesized
  misc_feature (61): n=a or c
actcatgcctcagacacccctcggcacctcacaggggagcagaaaatggcatcagcacttnccacacaacagtgaggagtgctatagctgtaaggaaaacagctacagatgacaaagggca

SEQ ID NO: 29657 - DNA, 121 bp, Artificial Sequence
  Synthesized
  misc_feature (61): n=t or c
agcataggaaaaatacttaagggaaaagtcctttgttggccaagataacatcatatatcanttgcagctaaacatctgtgccctgtattcagtcccagtgatatggggataaaaatcatca

SEQ ID NO: 29658 - DNA, 121 bp, Artificial Sequence
  Synthesized
  misc_feature (61): n=t or c
tgaatgaaagatgcctacgtctgattcaggtttgaacttaaagccctaccaaaggttccanctacccaagcatttatttttgaagttgcagtgaagttctcccatctgtccccacctacct

SEQ ID NO: 29659 - DNA, 121 bp, Artificial Sequence
  Synthesized
  misc_feature (61): n=t or c
gttctttcacactggacagggcgtgccttttgtatgtcttttcatggtattttgttgtgtngagaaatggctccagtatcttttgagagcatttctgctgtttctcatccatttcccattt

SEQ ID NO: 29660 - DNA, 121 bp, Artificial Sequence
  Synthesized
  misc_feature (61): n=t or c
gtgcccctttgcagcattgttctggctcttcagatgagaggttttaccccagtatttaccngctgtcacccagccatgttgtgccctgctctaaaaggactagacgtgagccagataagca

SEQ ID NO: 29661 - DNA, 121 bp, Artificial Sequence
  Synthesized
  misc_feature (61): n=a or g
gtcctggtcctgttacactatgacaagcggcctctttgcttgggtgagtgggaggaaatanaacactagaggcactgtattccagctattctgaactgttttcttttgtctgtgagtataa

SEQ ID NO: 29662 - DNA, 121 bp, Artificial Sequence
  Synthesized
  misc_feature (61): n=t or c
ctttcatctagtggcacagttgacgctgctacatgcacatatggattaagttctgcaatgngatgaagagtggcctcagccctaaaagaacagaaacaggttttttatgcatttacaaagt

SEQ ID NO: 29663 - DNA, 121 bp, Artificial Sequence
  Synthesized
  misc_feature (61): n=a or t
ccttaccttttactgtgtaaattgccctaaaaatatatcaattcacatgtgtacttcttgnggtagttctaatatatctaatatatttatataaatatattctaatatatttaaacataaa

SEQ ID NO: 29664 - DNA, 121 bp, Artificial Sequence
  Synthesized
  misc_feature (61): n=t or c
ataccactacttactctcaatgtttgctgttctgtcagttttcagtaagccttgccataangcattctgttgcatcttctaaatgattttaaaaaacatatcacgtgcagcttaataatta

SEQ ID NO: 29665 - DNA, 121 bp, Artificial Sequence
  Synthesized
  misc_feature (61): n=c or g
ttgctctgtatggaagtttttagggtaaagaagactgaacaagaaacagcaaaatgtgatnatgagaaagactgggaacaaagtaaactgtgacaaactgatcgaagagtctgagaaagtg

SEQ ID NO: 29666 - DNA, 121 bp, Artificial Sequence
  Synthesized
  misc_feature (61): n=c or g
ctacctggcacatatgtactcttcagaaacacgagctataccatgagaataacgtgcaganacagctgatgtaaggatgtactgttgtttcattctgaagaatacatagcagaagtaccca

SEQ ID NO: 29667 - DNA, 121 bp, Artificial Sequence
  Synthesized
  misc_feature (61): n=a or g
ttaaatgaaatatgtgcggaggtaaaaagggtcaacccagtcttggatctgctttgttagnctcttagttgttggagagatgagttctgtctgaactaaaatgtgcccttttctgaactat

SEQ ID NO: 29668 - DNA, 121 bp, Artificial Sequence
  Synthesized
  misc_feature (61): n=t or c
actggcttgtggtttatgaatgccagtgaccaaaatcccactgagaggttttcgaaagacngtatgcagtagatttgtggtcatcatttattacatgtttgatagatgtgtggtaaaatgt

SEQ ID NO: 29669 - DNA, 121 bp, Artificial Sequence
  Synthesized
  misc_feature (61): n=a or g
atgtaaaacggcagcacctactttttctaggtaggtgtaactccaaaccttcccatctgcnaacatgcgcgatatgatcctgccttgcttgtcgatgtctgtcctttcgctcatggctccg

SEQ ID NO: 29670 - DNA, 121 bp, Artificial Sequence
  Synthesized
  misc_feature (61): n=t or g
ttatcaaacatggattttatacacacaggaagtttttcgttgttgtttccttcttttcttnttaaatggtacaattcttgctctctttactgacaaacaagcataagctaagcataaatgt

SEQ ID NO: 29671 - DNA, 121 bp, Artificial Sequence
  Synthesized
  misc_feature (61): n=a or g
tcgtacactgagagctgctttctgccctgtaaggttgtgattcaggcttgcaggctgaacncaagctgctagggaggatccttgtaggacacaggaaagaagctccatctcttttccttct

SEQ ID NO: 29672 - DNA, 121 bp, Artificial Sequence
  Synthesized
  misc_feature (61): n=t or c
cttgtacttcaataaccaataatgttttgacatcttatagaagtgacactgcacactgttntaaacttgaaagccatcgtaggatatgaatggagggctgactgattacatacatgcagat

SEQ ID NO: 29673 - DNA, 121 bp, Artificial Sequence
  Synthesized
  misc_feature (61): n=a or g
tagtgtgagcacagttacatatgtgcgatatttgtaacgcgcttaatacgaccatccggtnaatttatacactctgaataataatgaaatccaggtttaattattgattttaaaaaatgct

SEQ ID NO: 29674 - DNA, 121 bp, Artificial Sequence
  Synthesized
  misc_feature (61): n=a or g
tgaaaatcaataatgcataaatgaagaaactaagaatagaagctaaaagaccaagccaacnatgccttgaaaccaaacgtggcttgattccttgaatggaaaaccagatttcgtttctccc

SEQ ID NO: 29675 - DNA, 121 bp, Artificial Sequence
  Synthesized
  misc_feature (61): n=a or g
tccaatcagtgtagattttgagaagaagggacagaagagtggaacttgctgttgtatgatnatctccccttaacagctggtgtttctgatagtgctgttcatgtggaaggcagtggaccat

SEQ ID NO: 29676 - DNA, 121 bp, Artificial Sequence
  Synthesized
  misc_feature (61): n=c or g
ttctgtttcctgtagagatccaatggaagtgaggttgtatttccactactctcgtgttttntgcaaagaagtgccctgagaaggagggaaaacctgcaggagaggtcgggagagctgtgtt

SEQ ID NO: 29677 - DNA, 121 bp, Artificial Sequence
  Synthesized
  misc_feature (61): n=t or c
ccagttgtcaaacatttttaatcaaacagaagctctatatgctaaatgcacggtgaaaacngacaagctatttcatgtgtatgcagtccaagaaaaaatgaatcagttgcagtgacaaaga

SEQ ID NO: 29678 - DNA, 121 bp, Artificial Sequence
  Synthesized
  misc_feature (61): n=t or g
aagcactcagatttcaatctaggaaagctctccctccaacacaaccgaagcactcagcttngtctgaagctgcagacttacagtgatcttcattaccccaccgttttctctccttctgccc

SEQ ID NO: 29679 - DNA, 121 bp, Artificial Sequence
  Synthesized
  misc_feature (61): n=t or c
aaaaatatatttatgaaacattttgtcgctaatcctcaaactccaaactaatagcagcggngatgagctgagctgattcttgtgactaatgctttttgcaaagacgaatctgattgacgtt

SEQ ID NO: 29680 - DNA, 121 bp, Artificial Sequence
  Synthesized
  misc_feature (61): n=t or c
caaaactgtcagcagaaacatctgggagagtgacatttaggataactactgatgcaggccntggcaattcatgcagcatctgaccaccaacagaaggcaagccctgtgctccccattctgt

SEQ ID NO: 29681 - DNA, 121 bp, Artificial Sequence
  Synthesized
  misc_feature (61): n=a or g
tcccgctctcctttggatccctattgcccccagatagtctgtacagatgggatatttgtcntggcctttatctgcaactctgcactgactaaacttattcactgtcttgatgagtataggc

SEQ ID NO: 29682 - DNA, 121 bp, Artificial Sequence
  Synthesized
  misc_feature (61): n=a or c
agtcttcatctagggagttatcatctagatcctacagaaatttaaataattacggtgaagnttattcttcggctgctttggaaaagtaagctctgtttcaaatcagtactagtctggaaag

SEQ ID NO: 29683 - DNA, 121 bp, Artificial Sequence
  Synthesized
  misc_feature (61): n=a or t
tgcctcttatttcccacttcctcttaaaggacaagatatgtcaaggctctcactagagggncaagaaagagacccatgcttgtgtgagttcagccttggccaggactgaccctgcccccag

SEQ ID NO: 29684 - DNA, 121 bp, Artificial Sequence
  Synthesized
  misc_feature (61): n=t or c
tctgcacagcccagagctggtgcagcctcacagacagagttcaacagtgaacaagcagctntccaggtctccatcttcatttctttttggtcttggcatccatccaaattcggaggcatgg

SEQ ID NO: 29685 - DNA, 121 bp, Artificial Sequence
  Synthesized
  misc_feature (61): n=a or g
attaatcctgggaagaggaagcagggggttgaatttgactctcatgtccaggggaaattcnctcagctctctggaagaggtcaaaagtcagagcgggcagcagaacgggtcctgcactgag

SEQ ID NO: 29686 - DNA, 121 bp, Artificial Sequence
  Synthesized
  misc_feature (61): n=a or c
cagaggcccagatagacggtaactgttgccacacactccttatttaaatgcaatttgtttnatctcaaatcaggctcaaccatcaaaggctctcttctgtagcttactgacagttcacttg

SEQ ID NO: 29687 - DNA, 121 bp, Artificial Sequence
  Synthesized
  misc_feature (61): n=t or c
tgtgtgggtcttacacagcacacctgcaattcactgctttgatgtacatttttgcatgaangttcaccataaaaactttcatggatacttatggaaatatcaggctggtgacctaaagaag

SEQ ID NO: 29688 - DNA, 121 bp, Artificial Sequence
  Synthesized
  misc_feature (61): n=t or c
cgtggcttgggtgatacacaatgcaattcatttactcctcgtatgttattattgaaaaganatttattattgtgctattttcaaaaggactcttcttccaacatttttactggaaatatat

SEQ ID NO: 29689 - DNA, 121 bp, Artificial Sequence
  Synthesized
  misc_feature (61): n=t or c
gctggtgaggcaccatgtgggctcctccagggagggaccagccgaggtcggagccgcctcnacaaagcctattagctgcatttaaaccaaaatttaaagcaggcgagctgaataattaaaa

SEQ ID NO: 29690 - DNA, 121 bp, Artificial Sequence
  Synthesized
  misc_feature (61): n=a or g
ggagattgctaaggtgttaagtatggaaatacatgtactgtaagcatcactgtaggtaacnttccccctaattaaaataaagatggtaattttcggagatgcctgagaggttcaagattct

SEQ ID NO: 29691 - DNA, 121 bp, Artificial Sequence
  Synthesized
  misc_feature (61): n=t or c
aaatctacaattataaaagctctgaaagtgctgcctcctcacataaaagtgtcatggaaanagatcatcaatttactattgtgagagttgagaaagaaaatttaatggcaaaaatggctta

SEQ ID NO: 29692 - DNA, 121 bp, Artificial Sequence
  Synthesized
  misc_feature (61): n=a or g
ccctttccctaaggttttgaaagcactctcaagcatcctggttttgactttccctaaagcnaaatccctttaggcatacagttagccatggggccaagagttttactctcaactcttgaat

SEQ ID NO: 29693 - DNA, 121 bp, Artificial Sequence
  Synthesized
  misc_feature (61): n=t or c
gagtattactggtaaataatcctgtgcagttctgctgctgcaataaagatgtcatcaaccngtggagcagcgcatggcaccacattaccttttaatttgctcctcgtaggtctctttttgc

SEQ ID NO: 29694 - DNA, 121 bp, Artificial Sequence
  Synthesized
  misc_feature (61): n=a or g
cctcatccccctccaaacctcttcatcccttccaaaatactttcatccttatcctcatacncttaaccccattctagaccctcattcctctccagacacctccatccccctcctcaccgcc

SEQ ID NO: 29695 - DNA, 121 bp, Artificial Sequence
  Synthesized
  misc_feature (61): n=c or g
ataatcttttagattggtaggtgaatttgcgaacgtgctatgcctacactaataaccttangtgatatatgtagggtgccagccttaactgtaacagccaaagtccagatttcaaaaatac

SEQ ID NO: 29696 - DNA, 121 bp, Artificial Sequence
  Synthesized
  misc_feature (61): n=c or g
tttttttttcccaacagtgtcatataaggaatagaatgttttctttagcagaacatctttnccatttggtgttctcaatcccgtatttaaacaatacatttctctccgttctgctgtaaac

SEQ ID NO: 29697 - DNA, 121 bp, Artificial Sequence
  Synthesized
  misc_feature (61): n=a or g
gcggtgcgccggggctcacaggctgggcgagggcttgctgctgcttgtgcatccataggcntgagcataaatctatatgttttaaatagatgaggctggcagagaagctaaacagttacca

SEQ ID NO: 29698 - DNA, 121 bp, Artificial Sequence
  Synthesized
  misc_feature (61): n=a or g
agtgtgtgagtgaaagttaggagaggacagatccagttcaagatgtcacaaggactgtatntgggtacaaagtcatcacagaagtgagactatggcagtgtaatccttagtagaaaaagga

SEQ ID NO: 29699 - DNA, 121 bp, Artificial Sequence
  Synthesized
  misc_feature (61): n=c or g
aaacacataagttttaaagtaattagtcatgacatcatgaccagtagttagcttctttaancagagctgtagaaaagtgagatttttcagtcctttagaagcaggagttatttacatgtgt

SEQ ID NO: 29700 - DNA, 121 bp, Artificial Sequence
  Synthesized
  misc_feature (61): n=t or g
tttcctttcaaacacccaatgtttgctatctggacaagatcatactatattgtaacttatntcctaggtatcagggagaaggaagatcagtgttttatcaactgcaatgaagccagtctca

SEQ ID NO: 29701 - DNA, 121 bp, Artificial Sequence
  Synthesized
  misc_feature (61): n=a or g
gaacagatcagaaagatactttgatacatacatgccactgcagtctacctgagtatttagnacagaagaattcatccatccctgtctaacaaagttatttgactttggacagcattcctaa

SEQ ID NO: 29702 - DNA, 121 bp, Artificial Sequence
  Synthesized
  misc_feature (61): n=c or g
gaatcagcaggagtcttcctccgggtattgttggggagattgggaacagaaggggactgtncctgagctgaaagaaatcaaatgtaaataattgcgtagattacatggctacgctgctttc

SEQ ID NO: 29703 - DNA, 121 bp, Artificial Sequence
  Synthesized
  misc_feature (61): n=a or g
gtctccaaagcctttatctccttattgcatgtgacctcgaacatagcacgaatggcatgtngttgaatgcctcttgtaaggcatttcatgtaaggaggaatggaagcaatcagtgcccatt

SEQ ID NO: 29704 - DNA, 121 bp, Artificial Sequence
  Synthesized
  misc_feature (61): n=a or g
tagcttttgaatgcatatatcctgatgtgaatcaaattttgaaatccttgcacttaaaatnaaagtatacatagttataactgatgacttcacccacacaatattcattccaacctcctgt

SEQ ID NO: 29705 - DNA, 121 bp, Artificial Sequence
  Synthesized
  misc_feature (61): n=a or c
gtttcatagaatacacagaacaccttaaaggaagagcgaacatgagaaaatgtgccataanccttccattcagaagtagtctcccaggctccctctttgcttttatgcttttataattgga

SEQ ID NO: 29706 - DNA, 121 bp, Artificial Sequence
  Synthesized
  misc_feature (61): n=a or c
atgcacacacttctgagaaatacacacaacttaagagtcaacttagtaggaaaatgaaaanctttgcagagatgcagagaagctgatttaaatccaaagtgcacagtacagaaccagacag

SEQ ID NO: 29707 - DNA, 121 bp, Artificial Sequence
  Synthesized
  misc_feature (61): n=a or g
gtaatttttttttctgttttcagccaaaagcatagctagttctgtcattgctgtgaatgtncagctcatgtatgtgcgggaatgacgtgctaatttggtctaagaattatataaagtggaa

SEQ ID NO: 29708 - DNA, 121 bp, Artificial Sequence
  Synthesized
  misc_feature (61): n=a or g
gataatgccatgcctgccctgggaatgtaattactcagatgtgtcttctttaaaccagcanagctgcctcagtctcttctcattaaatgagaaagttactaccccaaatttatccctcttt

SEQ ID NO: 29709 - DNA, 121 bp, Artificial Sequence
  Synthesized
  misc_feature (61): n=t or g
tgccaccaccacctgcttgaggaaatgggaccctcacctttgtggatgtaccgagccaccntgcggaaatcatcctgccgaaagccacgggaggtgagagctggtgtcccgaaacgcagac

SEQ ID NO: 29710 - DNA, 121 bp, Artificial Sequence
  Synthesized
  misc_feature (61): n=a or g
tgagttggaacagtctatctctcgtataacttcagtcatttggttgagccctcttcttganctagtgagtgagtaccagcgagcaaatgatgctcagtagcttctagaataagaaaaaagt

SEQ ID NO: 29711 - DNA, 121 bp, Artificial Sequence
  Synthesized
  misc_feature (61): n=a or g
ttgcacaatttgaccacaaaaaaaccaacaccttttcaacacacctgctaacatctggccntgtgctgctttgcctgctgagctctgaacaataggtctctgaatggaattataatgtgta

SEQ ID NO: 29712 - DNA, 121 bp, Artificial Sequence
  Synthesized
  misc_feature (61): n=t or c
gatcaaacaaagaggcaggcactcagtgttgacaagaactagatcaaaacagtgttttgtnctaccaggctgaagctgagctatacgctcctaagaaccctatcagtaccaggtaaggccc

SEQ ID NO: 29713 - DNA, 121 bp, Artificial Sequence
  Synthesized
  misc_feature (61): n=t or c
ctggtcctgctcttagagaaagacctccctctagatttaagggaggtaggactggagctanttaatgaggcacacttatcccagacttgaccctgattttgcacagtcagaagagcagcat

SEQ ID NO: 29714 - DNA, 121 bp, Artificial Sequence
  Synthesized
  misc_feature (61): n=t or c
cgtgcaggagatcagtgtgtctttcggccggctcatgcctgcctgctccataggaggagcntcaagaagctgggtttggtgccttggaggctcagatgaaatgacagcaaattgcactgaa

SEQ ID NO: 29715 - DNA, 121 bp, Artificial Sequence
  Synthesized
  misc_feature (61): n=t or c
tttttatcatcaatattatttttccttccttttctaaggaccctaagacataggacaccanctgtcctaaaatgaaatacaaggctttcatggaaaagaaggaagagacaaaccacttgac

SEQ ID NO: 29716 - DNA, 121 bp, Artificial Sequence
  Synthesized
  misc_feature (61): n=a or g
gttttctgtgtgaacaggtatggatacacacagtgtttcagtcttgctgccagaggtggcnttcttggaaagctcctgctttgcctcccttgtgctttcccttttatccttagactacagt

SEQ ID NO: 29717 - DNA, 121 bp, Artificial Sequence
  Synthesized
  misc_feature (61): n=t or c
atggacaaatgttgcacataatccatcaggaaggtggggaaagcaaccatacgtacccaangtgcagccagttacctcttgagtgctacttcaattttcctactttcaatatgcactgcaa

SEQ ID NO: 29718 - DNA, 121 bp, Artificial Sequence
  Synthesized
  misc_feature (61): n=t or c
acacagtgcactggaaaaactattgagtctttcactccttcaaaatggtgctgcagttctnaatagatatttatggttctgatgattcagttaacataggtaattttggcaatatagaaaa

SEQ ID NO: 29719 - DNA, 121 bp, Artificial Sequence
  Synthesized
  misc_feature (61): n=a or t
gcaggtttggatgtaccgaatcttgtgtgtgcagcagtgtgtgtgtgtaaaaccaagtaanattatttgctataattaatcttaaataactaatcattattaatccagatcaagctttaaa

SEQ ID NO: 29720 - DNA, 121 bp, Artificial Sequence
  Synthesized
  misc_feature (61): n=a or g
gagctgaaggtactgagtagacttagagctaatttgaaacagctagagctgtttcagaacnttgtgaaattactttgggttcaatgtccatggtcatttctgtaaactgacattaaaatta

SEQ ID NO: 29721 - DNA, 121 bp, Artificial Sequence
  Synthesized
  misc_feature (61): n=t or c
aagctatgcttcagagataaattcaattacaggtaaagcacatttgtatttgaaaggaggntcagtattttcagtaaagcatcccatttacaagaggttgctgcagaagcagagattctcc

SEQ ID NO: 29722 - DNA, 121 bp, Artificial Sequence
  Synthesized
  misc_feature (61): n=a or g
tatgctggcaatagaattcatctcaatacagaaattcagcttcatgacttcccaagcaacntcagcctaaaaaacatgctttgaaatattccgtatgtaatgcaataaagcacaagtgagg

SEQ ID NO: 29723 - DNA, 121 bp, Artificial Sequence
  Synthesized
  misc_feature (61): n=t or c
gctgcaagttacatatcactgaagcttttacagtctacttgcaattggacttagcatctangaaaccacagcaagagtaagctcctgtcttaaatccatcacatttggcttcacagattct

SEQ ID NO: 29724 - DNA, 121 bp, Artificial Sequence
  Synthesized
  misc_feature (61): n=a or g
aagctcagcagctgccctttgggggtcccttccaacagaactctgctgtcataattctggntttcacctatcaaacattagggtggagaggtgaatgagacctctgtgtagctgaagcttg

SEQ ID NO: 29725 - DNA, 121 bp, Artificial Sequence
  Synthesized
  misc_feature (61): n=a or t
gtacttggctgaagttagggtctcggtgaagctgttgcataccaaacaaactaattttaantggctgggtaactagatggtggcactgaaggttattttctacataccccagttccacaca

SEQ ID NO: 29726 - DNA, 121 bp, Artificial Sequence
  Synthesized
  misc_feature (61): n=t or c
tctacctatttaagaaactattgttctaaaaatagttgcttacagtgtcaaattatattantggcattaacattgccagactttgcaattaccaaaggagcaaatggaaattcagtaagaa

SEQ ID NO: 29727 - DNA, 121 bp, Artificial Sequence
  Synthesized
  misc_feature (61): n=t or c
tttgattctcaacaataagaaatctgattgtaaaacaatactgacattatggtgagctatngataaaagccttaaacatgaagtcctgtaagtttctgcttgtggttgctattagacaccc

SEQ ID NO: 29728 - DNA, 121 bp, Artificial Sequence
  Synthesized
  misc_feature (61): n=t or c
tactgctcacgagtacctacaaagcttttgtacctgggacagtttcttcctgcagggccanacaacacccagcaggctttagctttcagcctaccatggctcctaagaactgcgccctgtg

SEQ ID NO: 29729 - DNA, 121 bp, Artificial Sequence
  Synthesized
  misc_feature (61): n=a or g
ctgaagtcagtgaaattaaacagcctgtaagattgaaagaggagttgaagtgttttcaagntttgcacctcatacaaccaaatcttttaaaaagtaggaggcctacatatcctttatatgc

SEQ ID NO: 29730 - DNA, 121 bp, Artificial Sequence
  Synthesized
  misc_feature (61): n=a or g
tcgcaatcaaacgggcaaggctctgctttgtcttggctgactctagagctctggactcacngaaaaaaatgagtaaaatctatgctaacagaacaaaagtagcagctcctctggctaggag

SEQ ID NO: 29731 - DNA, 121 bp, Artificial Sequence
  Synthesized
  misc_feature (61): n=t or c
tagccctcaccagggctcgcattgctcacagatgcctctgagaagtgcaagacaactcctnactatcaaatgctgaagggattgtcctttctcattctgcagtctctcactccttttattt

SEQ ID NO: 29732 - DNA, 121 bp, Artificial Sequence
  Synthesized
  misc_feature (61): n=a or c
cgttatcttctgttctactcttgcagaaaagtatcttttactacacagctttcatagaatnagagaatggcttggactcaaaggaaccctgaagaccatccagttcaacccccatgctcta

SEQ ID NO: 29733 - DNA, 121 bp, Artificial Sequence
  Synthesized
  misc_feature (61): n=a or g
tgttccgtgaatgatggtaccagggaggaagtgctagcattaccttagagaaaattgactnacagagctgcagccatcatcctcaaggcgttattctggcatatagcattcatccctggaa

SEQ ID NO: 29734 - DNA, 121 bp, Artificial Sequence
  Synthesized
  misc_feature (61): n=a or t
tgacgtttgaagtaattgtaccgtctgtctgttcatcgtccccaaactcatttgaaaatanggcccaatcctgacaaaattgattgaggagtggaagtccctatttaaattcttgtaagtt

SEQ ID NO: 29735 - DNA, 121 bp, Artificial Sequence
  Synthesized
  misc_feature (61): n=a or g
attgcataggcatggtagacagatagctcacaggcagctctgatggacagctgatagatanctgacaaacagctgacagtcagctgagccaccaccaaggatcccccagctggtctctcat

SEQ ID NO: 29736 - DNA, 121 bp, Artificial Sequence
  Synthesized
  misc_feature (61): n=a or g
gtttgaattagccctgtgttagatagaggagcatggaaaattgatgaccaagagaagcagntgagagcaagaccaaatgaaatgtggcagggagatgactgttactatgcaaatgttcagc

SEQ ID NO: 29737 - DNA, 121 bp, Artificial Sequence
  Synthesized
  misc_feature (61): n=t or g
ctttatttttgtttagcttaggcttttgcctctacttatgcttccaagatttcaaaaaatnctttctctatttaactcgtgcatgttcagttcagatctttgccgaaaaagagactgcata

SEQ ID NO: 29738 - DNA, 121 bp, Artificial Sequence
  Synthesized
  misc_feature (61): n=a or t
gatgtaaatcggtacttgctcttaatagtcactggtactctccaaaccctatttatatagntagcagctgccactgtggcattttcctaccacatagcaacaacaccgcatagcaacaaca

SEQ ID NO: 29739 - DNA, 121 bp, Artificial Sequence
  Synthesized
  misc_feature (61): n=a or t
catgttcagtggaaatggaaatgtcagcaaatatctcaaaaccaaaagaagagttgatccntttcagcttatgttttcactgttatcaagatttgacagaggctaacccaggcaccaccag

SEQ ID NO: 29740 - DNA, 121 bp, Artificial Sequence
  Synthesized
  misc_feature (61): n=t or c
cataggcgtgtaattagcatatttgaaatgagtcctaaagttggatgttaacttactcatnttgaaatgtgatcaataacattcatttgtgcatggacatagatagacaacgtgtacaggt

SEQ ID NO: 29741 - DNA, 121 bp, Artificial Sequence
  Synthesized
  misc_feature (61): n=t or c
catctttcaaggatcagttgttaaagggactgttctattccctaccacttattaactgttnattgagatgaggagttaacagtctgttgtagcataccaaggtaattctctccactgttca

SEQ ID NO: 29742 - DNA, 121 bp, Artificial Sequence
  Synthesized
  misc_feature (61): n=a or t
tggcttacgcacttccatggagcagcagaggtgggcagatgagtgttaaagcttatctacntttacaatcagaatataatcagaaatctctataaacctagacaaactccagctgtatgaa

SEQ ID NO: 29743 - DNA, 121 bp, Artificial Sequence
  Synthesized
  misc_feature (61): n=a or g
gctgatgttcacagtgggattataaacttacttccattccattaagcatggtctgcgacancgtgcacaccatctcttattatacagatacatgcaatccatcaaacaattttaaaaagta

SEQ ID NO: 29744 - DNA, 121 bp, Artificial Sequence
  Synthesized
  misc_feature (61): n=t or c
attctcttttccagctacagtatctgagccagaaatacatatatctttgaaaaacagatgntttcaaatagctgttgctttttaagcacaaagaacttggctcttgtaggctgtatgccta

SEQ ID NO: 29745 - DNA, 121 bp, Artificial Sequence
  Synthesized
  misc_feature (61): n=a or g
cttttgtaggactaaaagcagtgcgggaggctgtagtgctcctgcttttaactggcacccntgatgaaaataccttgggtcttgctgctgttgcctcatctgagtctagctcaacctttaa

SEQ ID NO: 29746 - DNA, 121 bp, Artificial Sequence
  Synthesized
  misc_feature (61): n=t or c
tcgccctcaaatttcatttgttcttgcttttgtgctccacttcaaccacagccctgtgacnatggtccttgaattgaagtttttcttgcactgggtgcaaggaccaggaaaacactgacca

SEQ ID NO: 29747 - DNA, 121 bp, Artificial Sequence
  Synthesized
  misc_feature (61): n=c or g
cccttccagagtcaggtctgcctgttgaaaatgctgccaattcccatgcacagccataccngccttgtgatgctgtttatcctactctaattgctttacctacagagaattagtgacttat

SEQ ID NO: 29748 - DNA, 121 bp, Artificial Sequence
  Synthesized
  misc_feature (61): n=a or g
ctgagcagtgcccaaaccccacttcttcccgaaggcctctgaggacgggcattagagagcntgtggtatcggctctcctgacacaaacccattgtggtcgagccggaatccttattaattc

SEQ ID NO: 29749 - DNA, 121 bp, Artificial Sequence
  Synthesized
  misc_feature (61): n=a or g
tgtctagagatcaggacccagaacctataggggctgtcctgatgttgtcataagtgtcccngtgtcccactaactgtcggtatagacaaatgattttacagttagaagcaaatgtaatgac

SEQ ID NO: 29750 - DNA, 121 bp, Artificial Sequence
  Synthesized
  misc_feature (61): n=a or g
atcagaagtacttcaagtttctcttatgtgtgatctgttagcatacgatggaattttaatnctaaacctggtcaaatttttgatgagtgagatcaggataggaatgaaaaacagtttcaaa

SEQ ID NO: 29751 - DNA, 121 bp, Artificial Sequence
  Synthesized
  misc_feature (61): n=a or c
agctttgtcgggtttcttctattttcggggtagatgcagaagaatactcagcacgttcacnagaggagaatggaccagaggagaacagtgccagcagtctgtgcgtcatctacagtgtatg

SEQ ID NO: 29752 - DNA, 121 bp, Artificial Sequence
  Synthesized
  misc_feature (61): n=t or c
gaccgcccacccagccctgggacacaaagctccttcaatatgggaatcacagaggcatccncaccaagaaccgagcttgccatgcaaaagacaggtacctctgcccagggccaaggtgggc

SEQ ID NO: 29753 - DNA, 121 bp, Artificial Sequence
  Synthesized
  misc_feature (61): n=a or g
gagggagagctgcagcttgcttataggaaattctttccccaaatttggggtgccattgacnagtccacagcgcttccaaccgacgagcagtgtgttgttgtagggcctgctagagaagggc

SEQ ID NO: 29754 - DNA, 121 bp, Artificial Sequence
  Synthesized
  misc_feature (61): n=c or g
aaagaaacaacaaataaaatgtgcaaagaaaaactgtccaaatatccgtagatgtgaaggnacctcatggttcaaagagatacaaaaaattatacaagatgaaaatctggttgtatgtttg

SEQ ID NO: 29755 - DNA, 121 bp, Artificial Sequence
  Synthesized
  misc_feature (61): n=a or g
ggttacgaggtgctgaggcagaagaaatgttagctattataaattatatgctatcgtggtngctgtgagcaagctttccctttctctttatttatctgaagggatcccgacctctactgga

SEQ ID NO: 29756 - DNA, 121 bp, Artificial Sequence
  Synthesized
  misc_feature (61): n=t or g
aaattcatctgcaacttctgtgacccattttccaatacctgtgccccagcttatactcctnccacagcaaaacagagcctgaggctcaccctggcagcagatgagaacccgaagattgcac

SEQ ID NO: 29757 - DNA, 121 bp, Artificial Sequence
  Synthesized
  misc_feature (61): n=a or g
gttggcatgattgcatgccaataaatgtgatctctgctgcaaaaggagttgtccatagagnggccagttttgttccagactccattccagaaactgcataggtgcactgatgcagtgctga

SEQ ID NO: 29758 - DNA, 121 bp, Artificial Sequence
  Synthesized
  misc_feature (61): n=a or c
aatcatcagtcctttatggtagccttaagaatgacaccactatgcatgcctcccacattantttttctggttattgacacacagctgcactaaatccagcatccctacattcagagctttc

SEQ ID NO: 29759 - DNA, 121 bp, Artificial Sequence
  Synthesized
  misc_feature (61): n=a or g
ggcgaactccgggcttcttatcggagtttggcagtcatctgcggggcggtaggagaaaaanctgtgagcgtttgggtgtattctgagagaagcatttctctgggatttagtttaaaagcgc

SEQ ID NO: 29760 - DNA, 121 bp, Artificial Sequence
  Synthesized
  misc_feature (61): n=t or c
cagtggtgttcacatgcattctatcaaatgaaaatatgtaattaaataaaagcactcatcncagtaatacataaatccaacatttctgcaacagtttaagttttttaagccacaacatggc

SEQ ID NO: 29761 - DNA, 121 bp, Artificial Sequence
  Synthesized
  misc_feature (61): n=t or c
tcttgcattcaaaataaaagcaggacatagaataacagtacatgtcatgctgagctcaaanatcatcaaacaaaaagcttcctcatacttaaaggcttctctctgatgttgaaatcagccc

SEQ ID NO: 29762 - DNA, 121 bp, Artificial Sequence
  Synthesized
  misc_feature (61): n=a or g
gaattggtgattaaatagcaccaagagaggtgacctaacccttttgagctccctgcatttnggctgggatacagaaatcagatggtttgttacttggagggtaggttatttttagttcaga

SEQ ID NO: 29763 - DNA, 121 bp, Artificial Sequence
  Synthesized
  misc_feature (61): n=a or g
ctcttcaacagaggcagtcaaagtaatccttaaaggctgtctatatgcaacaattagcagnaatagacaaaacattttactgctgccacaaaacacggaaacagcacagcttggagtagta

SEQ ID NO: 29764 - DNA, 121 bp, Artificial Sequence
  Synthesized
  misc_feature (61): n=t or c
tctacgaggcagagtcagaatggctccacggcagtccgtggagcagtgacgtgaattcccngtcgcaggaaaagttccagacgaggatttgtacgggggtggtttgggggcgcagtcctca

SEQ ID NO: 29765 - DNA, 121 bp, Artificial Sequence
  Synthesized
  misc_feature (61): n=t or c
cattatctgttaagagctccaaaatgtagtgattgacactgaaaatagtagtataatgtcnttggatgactagagaaaacaactgatattgtaacagtgagtgatggatgaaaacaggata

SEQ ID NO: 29766 - DNA, 121 bp, Artificial Sequence
  Synthesized
  misc_feature (61): n=t or c
gtgtaaatgaggacttggctaacactgagtgccttgcaggagtttttttgcagtagtagantaaaatgactgcagaggattttaatttatttggacatacagaaagcagccccagtaaaac

SEQ ID NO: 29767 - DNA, 121 bp, Artificial Sequence
  Synthesized
  misc_feature (61): n=a or t
tctgctggtgaaaacagcccagctctcctccctggttgggcactacagaaggggaccaggncaacagtccatgagaactgacacaactgaaatcccatgatacttaagagctggagacctc

SEQ ID NO: 29768 - DNA, 121 bp, Artificial Sequence
  Synthesized
  misc_feature (61): n=t or c
gagaagagccctcagtacttggatgtcgtttcaaacttagggcttcccctcctactgttcnctccaccatcctcccttcccttcattctaaatacacacagagcctgtcaggaaggggtta

SEQ ID NO: 29769 - DNA, 121 bp, Artificial Sequence
  Synthesized
  misc_feature (61): n=a or g
ttttgtattcaaaaaagaccagtcttgtgaatttcaaaaaggatgttttgttacaacaacncattataaagaacagttgtttctgatggacttctgaagccctgatcttgccttagatttg

SEQ ID NO: 29770 - DNA, 121 bp, Artificial Sequence
  Synthesized
  misc_feature (61): n=a or g
ctgcagatatgtatggctcttcctcacagtattctattgggcagttaaaaacaagctctcnaaaagttaagttgacaaaactggttagtacactcaatgaagctacctctagctgactaac

SEQ ID NO: 29771 - DNA, 121 bp, Artificial Sequence
  Synthesized
  misc_feature (61): n=a or t
gctgctgttagaggaatggagggctctggatgtttcctggaagctatcaaattgcctcctnctgcaagtgaaaggcaacttttcatgtctgctccttgcaaagtctcgggccatattcaaa

SEQ ID NO: 29772 - DNA, 121 bp, Artificial Sequence
  Synthesized
  misc_feature (61): n=c or g
gagatgagaggggcaatagcagagaaacaaatacattcaatggattttaaatggaaatgtnaaagtgctttttcacagcgaatgaaggcacatgaacagctgtgggagacagaaagatacc

SEQ ID NO: 29773 - DNA, 121 bp, Artificial Sequence
  Synthesized
  misc_feature (61): n=a or g
aaatttgtctttgattgagctggagggtattttgtccagccatagaactatgacatgatcnctaaagactccgcaacggttagcaatctttggtcctgtggcatggttgatgctgaagaaa

SEQ ID NO: 29774 - DNA, 121 bp, Artificial Sequence
  Synthesized
  misc_feature (61): n=a or t
tagggatggatttcactggagcttccccagtggaatattcatgttccatatgtttccagtntgccaacaggaagaactgaaggaaggacctggggggaacctgcgggccagagcagtaggg

SEQ ID NO: 29775 - DNA, 121 bp, Artificial Sequence
  Synthesized
  misc_feature (61): n=a or g
ctcaggacagtaaaaggcgcaaccgaggggattcaagtaagggtgaagatatcaaaaaagnacaccttaagagactttgaacgaaaaacgaagtgtttatcttatcttccatcaaaacatt

SEQ ID NO: 29776 - DNA, 121 bp, Artificial Sequence
  Synthesized
  misc_feature (61): n=a or g
atagcagaatggcatgccaaatctgtaacagtcatttaagtgctggttacctgaatgtgcntgtaaggatgtgatactactcctaggcgatgataatttgtaatttttcagtgatgcctgt

SEQ ID NO: 29777 - DNA, 121 bp, Artificial Sequence
  Synthesized
  misc_feature (61): n=t or c
ggatccacctcacttaacttcagacctctatacagaaacactaggcagtgaaaaaataganatttctgcagcatggtttatctgtcatctttgatgaacaatccaagatgactgagttctt

SEQ ID NO: 29778 - DNA, 121 bp, Artificial Sequence
  Synthesized
  misc_feature (61): n=a or t
tgggatggacgtcatttggccttgtagacttgtacacattctatctcatgaggtactttcngacttgctctgttcttacaatcagagggattttgttcccctgatcctcacctagagattc

SEQ ID NO: 29779 - DNA, 121 bp, Artificial Sequence
  Synthesized
  misc_feature (61): n=a or g
tctacaacatgcatatagttctgccttgtgaaaacagttacagttttgtcattaacttcancgtcagcagataaaacttgtaggcaagaaatctattatgcaaatgtcttaaaaaggcaat

SEQ ID NO: 29780 - DNA, 121 bp, Artificial Sequence
  Synthesized
  misc_feature (61): n=t or c
gtgtcaaaaaaattgttgtaatcagcaaagtgcatgtgcctatgtacactcatgctcagcnaacttgtaagtacatgattaagtgctgctgaaatcactgggacttactacattactgaat

SEQ ID NO: 29781 - DNA, 121 bp, Artificial Sequence
  Synthesized
  misc_feature (61): n=t or c
catgtataaaatgaggtacctctctgagggatatcataatgtctgtcagttggcatttgcntcgcacagtgatgttactctcagatgtagtagtgtctcaggaagacttaatgtaacaggg

SEQ ID NO: 29782 - DNA, 121 bp, Artificial Sequence
  Synthesized
  misc_feature (61): n=a or g
tgtagcatggataagtacaatttagggaaattaaatgaaattttttcttgccgcaacttgnttactgaaactcttaatgcttgtcaccctcttgtgtttattctaaaaattgcattctgct

SEQ ID NO: 29783 - DNA, 121 bp, Artificial Sequence
  Synthesized
  misc_feature (61): n=a or g
actgtatttgtagtctgtttcaagatccttcttttatcaagactgtatgaagatcattctnttatctgcataaataaaatccctgctatgcataataagtgccacatttttaagaaaagaa

SEQ ID NO: 29784 - DNA, 121 bp, Artificial Sequence
  Synthesized
  misc_feature (61): n=a or g
cttgtttcaagtcttcaacataaggagttttaaatgataaaatctgcacttttagcagtcntgacttttaaaggagtcacatgactcagaacaccgagtgtagcaaaactagtaactcaca

SEQ ID NO: 29785 - DNA, 121 bp, Artificial Sequence
  Synthesized
  misc_feature (61): n=a or g
gcaatgagcagtgagaccctttgagattctggtcttaccatataagagccctaccaaaccnttaatgactaatagactgtgacctagaaaactccaactcatgtgtccctgtttatcatcc

SEQ ID NO: 29786 - DNA, 121 bp, Artificial Sequence
  Synthesized
  misc_feature (61): n=t or c
ttcagactagaagaaatgtacccaaggaatgatgcactgcacctttcaatcccagacctcngcaggcagcacaaaaccagtccagcagctgtggggctctggttcacagcacgggtgacct

SEQ ID NO: 29787 - DNA, 121 bp, Artificial Sequence
  Synthesized
  misc_feature (61): n=t or c
tatctctttcttgggtcaagtcctactccatatgtttctttgtcttgtaaagcatgtaagntcttggagatactcaactaaggtagagcaaaacaagccccatcggtagccatgagtagat

SEQ ID NO: 29788 - DNA, 121 bp, Artificial Sequence
  Synthesized
  misc_feature (61): n=t or c
gaatgtaatgaacttaaagaagcccagcttgtcctgggtgtgatgaaggatggggactgcngatgacataatgcaggacagatattgctccgagtgaaatggcagcagcactgtggggctg

SEQ ID NO: 29789 - DNA, 121 bp, Artificial Sequence
  Synthesized
  misc_feature (61): n=a or g
tggaatctggtgctgccagcacagctggcacgaggacacttacgacagaaatccagctccnagatccaaaatgcctggcagatgctggtcaggcaatctccaagcagaaaaggacaactca

SEQ ID NO: 29790 - DNA, 121 bp, Artificial Sequence
  Synthesized
  misc_feature (61): n=t or c
caggaaaatggacacatttttctcactaagagactacaggatcaaaattttgtaacgctgngaatttcctgttgaagatttgccattagttaaatatagaaatggcagagtaattctcaaa

SEQ ID NO: 29791 - DNA, 121 bp, Artificial Sequence
  Synthesized
  misc_feature (61): n=a or g
gacctgctcggcttcacagcctgggtctgcaggtttgggggctcacagaaaaccccagtgntagaaaagtacattgggaagatgtgcagatcatttgtggggtgaacaaaaatgctcccgt

SEQ ID NO: 29792 - DNA, 121 bp, Artificial Sequence
  Synthesized
  misc_feature (61): n=t or c
ctggcacaactgaaaggcactgctccacgatgcgttgctccatgatggagcagggctgcanggggtctgatcagggctctcagcacacttatccaagcgtctgcgtgtttaaaatttctct

SEQ ID NO: 29793 - DNA, 121 bp, Artificial Sequence
  Synthesized
  misc_feature (61): n=a or g
gttcactcttgaagccccttacaatcaatgggcactgagatgagtaaatagaaatctggcnattagaaatctgatatgtttggatctggagatcagccttggaacatgatttccccggcat

SEQ ID NO: 29794 - DNA, 121 bp, Artificial Sequence
  Synthesized
  misc_feature (61): n=a or g
gaagattgaaatactacaacgtaaaatctgaaagttctcctaatgttaaaaattaactccngaagccttgaaagacaaacagaaacatagcaaagaccacgtaaaaccgccacgctcactg

SEQ ID NO: 29795 - DNA, 121 bp, Artificial Sequence
  Synthesized
  misc_feature (61): n=t or g
gggagggcagaggttttatgtcagcagagacgcaagcaaactggaaagaaacaaagccaantttttaccgcactccttctcattgcttttttaataggtctccctgatttgatgcagtata

SEQ ID NO: 29796 - DNA, 121 bp, Artificial Sequence
  Synthesized
  misc_feature (61): n=c or g
cttaggtttcttggtggttgtacctgccatccccttgacagaaaaatgtttcctatgtganttgctgcctatggtaatgcatcaggctgtaaaaggttctgtcgtgcagcagtgagagtcg

SEQ ID NO: 29797 - DNA, 121 bp, Artificial Sequence
  Synthesized
  misc_feature (61): n=a or g
ttgagcagagacgcgcaaaccaaagaacctaattggttttgtctggtgtgtgtatggaccnaaactgccaagctgtagaatacaaagggtaactgccaccaaagatttgggcatcacttaa

SEQ ID NO: 29798 - DNA, 121 bp, Artificial Sequence
  Synthesized
  misc_feature (61): n=a or g
cagaggtcttgctgaaatccagcttttgccatctgtgccatgcatgcagcagatggacggnctagatagaggtcctgagcaaaggcccatctgagccctggattttgatgagctgtctatc

SEQ ID NO: 29799 - DNA, 121 bp, Artificial Sequence
  Synthesized
  misc_feature (61): n=a or g
tctgctgtactgtaggtgcccaaagataatctatgcatggactgtgtaatttggtgcacantgtgcacagctagaggaaagagtacactgtcaaaataataataatagttattattattat

SEQ ID NO: 29800 - DNA, 121 bp, Artificial Sequence
  Synthesized
  misc_feature (61): n=t or c
gccctagtcttgccctctttgcatccagatctaagctacagcactgtgttttgagttctcngcctgctaatatcttccataaaattaatcactggttatttgaggaagttaactgccttat

SEQ ID NO: 29801 - DNA, 121 bp, Artificial Sequence
  Synthesized
  misc_feature (61): n=a or g
cccaaacctcaccagccttgcctggtagatagctaagtgtgggcaggctgctggtgtgctntcctgcaggtgtcagagttgagaaaatccgtgagagcagaatttgactcctgaacccagc

SEQ ID NO: 29802 - DNA, 121 bp, Artificial Sequence
  Synthesized
  misc_feature (61): n=a or t
ccaaaaaaaagtatataaggaaagtggaaaaattattccaagtctcaccctaatctgagcnaagttcattcagtatgtgataggcttctgttgctgctttgtagtgcacaggtaaaattcc

SEQ ID NO: 29803 - DNA, 121 bp, Artificial Sequence
  Synthesized
  misc_feature (61): n=t or c
caagttttcactattgggttttttgtgaccttcattatgaatcgatgaagtacagtattanaatgcttcctactttgataaatgttatacggacagagaaatatttgtgatttctggggga

SEQ ID NO: 29804 - DNA, 121 bp, Artificial Sequence
  Synthesized
  misc_feature (61): n=a or c
gacttcaaataagtttctgggcctaaccttcttcactactattattcttaaatagcaaccntgtgtttcactgaagtgaaggctaattcagaaggaagtgtgcagctcccactctcattta

SEQ ID NO: 29805 - DNA, 121 bp, Artificial Sequence
  Synthesized
  misc_feature (61): n=t or c
actatactgtgacctattgttcttagctctaccttccggaggatttcttctaatcactctncatcttctaacatgcaaaacatcttctgttttttttctagctcttcttgatacatgatat

SEQ ID NO: 29806 - DNA, 121 bp, Artificial Sequence
  Synthesized
  misc_feature (61): n=a or g
agatgaatgtggtgtttgtgctggtgtccttatatctttcatactgatctgtagatggacnagctacctccttggagcatgaagtggactcaggtgaggttaatcagcactgatagacttg

SEQ ID NO: 29807 - DNA, 121 bp, Artificial Sequence
  Synthesized
  misc_feature (61): n=t or g
catggtagcaatacgttggagctaactactgagacacaatgcatacatcctccgttcaagnttttgagcacaattttgtagaacagtgcagtaattggctattccttgatacccttctaca

SEQ ID NO: 29808 - DNA, 121 bp, Artificial Sequence
  Synthesized
  misc_feature (61): n=a or t
caattgattttttaattagaattcaccagggaaggaattttggcatttgctgagcttgtcngatgccttgatgacatttcccaattttgttgccactttacaaatttttcttgggctttat

SEQ ID NO: 29809 - DNA, 121 bp, Artificial Sequence
  Synthesized
  misc_feature (61): n=a or g
cagttggaacttgtggagagtgtgacgtcttgcactttcctgacatcttaggaaatagggnctgcacaaggtgaacggtttccatcaatgatgagactaattgctgagttctgagagtaaa

SEQ ID NO: 29810 - DNA, 121 bp, Artificial Sequence
  Synthesized
  misc_feature (61): n=t or c
caattcttagtggctcattcctctcaaaaatacatttcccatctctggtgttgctttgatngtctgatttgtgaaatagtagaatgaaatttatgctaagaagagttttcatcccttttgg

SEQ ID NO: 29811 - DNA, 121 bp, Artificial Sequence
  Synthesized
  misc_feature (61): n=a or c
acagagcttagtaatttagtggcagtagcattcaaggtttcattcctttgctattttacanactataatctttctttccttactttcagtctagtgaagtgatgtcagttcctttctattt

SEQ ID NO: 29812 - DNA, 121 bp, Artificial Sequence
  Synthesized
  misc_feature (61): n=c or g
atatattaatatgacagtcagacatctactttagaaaaaaatggtttcagaaacatatcancttcatggccttcaaacgaaactgcagtctttttagtacttctgagagaaggtctaaact

SEQ ID NO: 29813 - DNA, 121 bp, Artificial Sequence
  Synthesized
  misc_feature (61): n=t or c
aggcaggttgttttcaatcaagacttaagattagcaaatcagctcagttttccttacgtgnattatcttgactaataaggaaaagaaacaaaaatgcaagaatatgatgcaattatatatt

SEQ ID NO: 29814 - DNA, 121 bp, Artificial Sequence
  Synthesized
  misc_feature (61): n=t or c
gccaccctctcgtgagtactactgggcaggagagcagccctggggcaccatgctatgcccngttaccccaggtgatttttggggagtcctttccctactactaagaacctcttctccccgc

SEQ ID NO: 29815 - DNA, 121 bp, Artificial Sequence
  Synthesized
  misc_feature (61): n=t or c
cattcagaaagcaagcacattacagagaaacatcctgggagtcctgcctggacagctttgngtacagagcaggggattctcttgctgctttcacaggggaccaggcctcacggccctgaag

SEQ ID NO: 29816 - DNA, 121 bp, Artificial Sequence
  Synthesized
  misc_feature (61): n=t or c
atatttattagagtgtcttattttcatttacaccagtgataccaaccgacttctctggagntgaagagagccagcccactgaactggaagaaagaagtaggaagcagaattaagcccttat

SEQ ID NO: 29817 - DNA, 121 bp, Artificial Sequence
  Synthesized
  misc_feature (61): n=a or t
gttgcaatgagtcctttagagcaggcctgtgttttcagatgtatgaattttatatactgtncaggacaagatagaaattagagaatgctgttaagatgaaatccaattttggatatagatt

SEQ ID NO: 29818 - DNA, 121 bp, Artificial Sequence
  Synthesized
  misc_feature (61): n=a or g
tctgcttgcatataagcagaaacatagcccatctatgcgatatataaatacactgcaatanctccatgtaccaatacaggtttatttcaaccacttcaagatgttttagttccctttcttt

SEQ ID NO: 29819 - DNA, 121 bp, Artificial Sequence
  Synthesized
  misc_feature (61): n=a or t
tgttcagctattattaagtctgtctggaaatatacacaattattgtatgtaggcaaacctnttaaaagacattcttcaacactcacatgcactaccccaatatgcatgtacctttagttca

SEQ ID NO: 29820 - DNA, 121 bp, Artificial Sequence
  Synthesized
  misc_feature (61): n=a or c
tctgtgtgtttgatgtattaatgataaatgatcagaagttggctcatgaatccctgagcanaagatacaagatcttaagtaatgtatttaccccattaacaggcaggatacacgttgtaca

SEQ ID NO: 29821 - DNA, 121 bp, Artificial Sequence
  Synthesized
  misc_feature (61): n=t or c
agcagtatctgttatatccagccctatacacattcatcactcctcctgagctcacgtgcangtgtgcatccagatgcatgcataaaccttgttgtctttagtgcaaaaaaaaatgtgcagt

SEQ ID NO: 29822 - DNA, 121 bp, Artificial Sequence
  Synthesized
  misc_feature (61): n=t or g
gctccagctctgcatgctggcttctttaattcctgcctggctgcatggatgagctgcatcngctaacatccctttaattgacttcagtgaaacaggatgcaatcagcagtgctaaagacaa

SEQ ID NO: 29823 - DNA, 121 bp, Artificial Sequence
  Synthesized
  misc_feature (61): n=t or c
tacaaaaactaggttctgagttactactgcgaaacaggcataatagataattgatggaaanggcagatgaacaataggaatttctgttcattattagcaccccaaataccccaatgttcaa

SEQ ID NO: 29824 - DNA, 121 bp, Artificial Sequence
  Synthesized
  misc_feature (61): n=t or c
gcagatttaggagccccaaactgaaatacagcactatttgctaaaactaagaaaggagacnttgccaaatggtaattttaataaattacttaaaagtctaaattaaatacaggcttacaca

SEQ ID NO: 29825 - DNA, 121 bp, Artificial Sequence
  Synthesized
  misc_feature (61): n=t or c
aagaacagtaatgtaaattgaaggaagtagtgaaggggcaaaagcagcaggaaggaaatangtaaaggaggaggtgtgcagggaattggtgtgcagggaggtgtgaaatgggattgagaag

SEQ ID NO: 29826 - DNA, 121 bp, Artificial Sequence
  Synthesized
  misc_feature (61): n=t or c
actgcagtgaaaagaggaaccaaagccacttttccaggaccagcactgcagctgtaccctngcatgtccccctgcaccttccaagatgtggagagcagctcccattcccagctatcccacg

SEQ ID NO: 29827 - DNA, 121 bp, Artificial Sequence
  Synthesized
  misc_feature (61): n=c or g
aggctctgttgaagaagcacacaaggtggaagcagacacctggagtttgctaggggaaggnctggctcaaagccatctgtggggctcccagtgccctgctgggacacgtactccagcccca

SEQ ID NO: 29828 - DNA, 121 bp, Artificial Sequence
  Synthesized
  misc_feature (61): n=a or g
ctgttactaagacaaaacaagtaaagagtaaaaagcaaaacaagggatgaaatgcaattcngcgatagtaaaagtgcaacagagctcactagattagataaaggcattataattttctcat

SEQ ID NO: 29829 - DNA, 121 bp, Artificial Sequence
  Synthesized
  misc_feature (61): n=t or c
gcttcaacatctctaagcagcaggtataagggacggatcctcagtaagtctgactttgctncagacatttacgaaaaagttggttctgtcaaatcagagaacttacctgcaatacctcggg

SEQ ID NO: 29830 - DNA, 121 bp, Artificial Sequence
  Synthesized
  misc_feature (61): n=a or g
gcagccacactctgtggcagagactgaaggctgagtgttttgcttatgttcatattgattntagctatcttttcagtttctcacacactcctcataaattatacgcccttgcaaactgtgc

SEQ ID NO: 29831 - DNA, 121 bp, Artificial Sequence
  Synthesized
  misc_feature (61): n=c or g
gaccagaatcagggctgtgcaagccctgaggttgttgcaacctagaagttaaaacttgatncttgggtaaaatgggcatttggaagcagtttcacagacaccctggaaggtccttctgcct

SEQ ID NO: 29832 - DNA, 121 bp, Artificial Sequence
  Synthesized
  misc_feature (61): n=a or g
tatgtcaaattgaaagtgcttggaggttttgaagattgaggtggactaagtacagaaactntggccttctagcctcatgtaactgtagtaattttggtctgtgctggttttgctctttggt

SEQ ID NO: 29833 - DNA, 121 bp, Artificial Sequence
  Synthesized
  misc_feature (61): n=a or c
gatagcagtgccagactgtgtgcaggaatgaaatactggtagttgaaccttagcttctatnatttggtcatcgatagtctttcctgcagatttcagacaagctacaaagggagaaaaaaag

SEQ ID NO: 29834 - DNA, 121 bp, Artificial Sequence
  Synthesized
  misc_feature (61): n=t or c
aatgtactcatttaattagtgggaactatgacctcataaagtcctccttcaatttacttangttgtagtcatcaaaaatgtgtctttatcttgttcagggctctaagaaatgctattcaga

SEQ ID NO: 29835 - DNA, 121 bp, Artificial Sequence
  Synthesized
  misc_feature (61): n=a or g
tgagggctgttcagtataagctgaagtgccgaagccagtgtgactgctttcatgcttaaanatcaatgtgggcttaatgtttctgacaactcagacgtataaaacaattacctggataagc

SEQ ID NO: 29836 - DNA, 121 bp, Artificial Sequence
  Synthesized
  misc_feature (61): n=t or c
cagagctgcagcaggagttacaaactcagccctgaggcattcctgccatctttcttttccngtctccgagaggctccatgaagaaccaaccacccttgcaattatttttttaaatgctttg

SEQ ID NO: 29837 - DNA, 121 bp, Artificial Sequence
  Synthesized
  misc_feature (61): n=t or c
tcagaaataaagtctgtacagaaggtaagcagtgccaggaaacattcccgtgactctgtanttttaaagtgttaaactgtcctggcaccagcatggcctgctccatcccacaccctctcag

SEQ ID NO: 29838 - DNA, 121 bp, Artificial Sequence
  Synthesized
  misc_feature (61): n=a or c
cacacacacacacacatatacatacatgatgaatgctctgaacaggaagcatcagcactgncttatctgactgcactccgtattaactcagcagagcaaacgcagtgccaaaaagcgaaag

SEQ ID NO: 29839 - DNA, 121 bp, Artificial Sequence
  Synthesized
  misc_feature (61): n=t or c
ttccaacttgggatattctgtgattctatgaatgacaatgcattgttctttggaagtatantggaaggtactgttagcatattaactcacattattagactcccagcaaccaaaacttcta

SEQ ID NO: 29840 - DNA, 121 bp, Artificial Sequence
  Synthesized
  misc_feature (61): n=t or c
aatgctcttgagatcccatctgttgccaacacatctcccaagacagcaaatgatgggcatncctggctaaataaagagaatttcccacacccattaaagatctacacagcaaagactgttg

SEQ ID NO: 29841 - DNA, 121 bp, Artificial Sequence
  Synthesized
  misc_feature (61): n=a or g
agtgcttagtgtatggacccttgcctttgacttaaaagccctccttgtagttatgtaaaanttgttcattcttttttcaccctattctcatactttaataatgttagaaattgtcaagtgg

SEQ ID NO: 29842 - DNA, 121 bp, Artificial Sequence
  Synthesized
  misc_feature (61): n=a or g
gaagtccatccaccagtcaagtgcgcttcagcctcatctacttacagtgatgccatcagtntcttctataatttggaaaggaccaagacctcacctgaatgccgtggctcatgcacgtgtt

SEQ ID NO: 29843 - DNA, 121 bp, Artificial Sequence
  Synthesized
  misc_feature (61): n=t or g
agtccattgttgtagtaccatgtctggcttcaaagataaaattataggtaggaataaatanatttagaacttaataggttgatttttaaaagtataatggccactgtcatggttttgtgat

SEQ ID NO: 29844 - DNA, 121 bp, Artificial Sequence
  Synthesized
  misc_feature (61): n=t or g
ctccactgctgatatctctcctggttttattgcccacaactgcttgagaaacaatatttgntgaaaaaatccagaggtaatttattaaaaagaatagatttataacccacacagggatgaa

SEQ ID NO: 29845 - DNA, 121 bp, Artificial Sequence
  Synthesized
  misc_feature (61): n=a or c
caatcaatgccaatgcattcaaactcaaaaaccaccaggcatggtagagagaaaacacttnaagtttgtggtcgtttaagaggtctgtttattggctgcagggtccaacaccttcttcgct

SEQ ID NO: 29846 - DNA, 121 bp, Artificial Sequence
  Synthesized
  misc_feature (61): n=t or c
ctgcatttggtcactgacagaataaggttctgcacaccaacacctattcattccagacacnctgctgcaaactgacaactgctacaaagctaggatgtgtaaaacagaagcagtttttggg

SEQ ID NO: 29847 - DNA, 121 bp, Artificial Sequence
  Synthesized
  misc_feature (61): n=t or c
ctgaggctgaaccgagataaatccataagcagaaggagggaagcaacctgccaccatctcncctgtccccaaagtcaccacatgagtcctgtatgttccccgttaccccactccacaccag

SEQ ID NO: 29848 - DNA, 121 bp, Artificial Sequence
  Synthesized
  misc_feature (61): n=t or c
agatcaagagggaaaaattaaacaggaaaatgtgaaaaataattggaagtcattaaagagngtttcagtggagtttccaaatgccacaaccgctcgttgggaaggcagaggtgttttgagt

SEQ ID NO: 29849 - DNA, 121 bp, Artificial Sequence
  Synthesized
  misc_feature (61): n=a or g
gaaacaggaaacagatgtattcagcattgtaaccgtctgtggtttggagtgggttgggatntaggggtagtacaatagctggggtcagagacacgcagcggagcaaagggctattaactct

SEQ ID NO: 29850 - DNA, 121 bp, Artificial Sequence
  Synthesized
  misc_feature (61): n=t or c
ttttttttttttctttctttctttcttttttttctggtaataaccagatatgaaataatanattagagattttgaatcccactcttaatgctgcagacaagaagtttaggtgtaggatacc

SEQ ID NO: 29851 - DNA, 121 bp, Artificial Sequence
  Synthesized
  misc_feature (61): n=t or c
tgcattcacagagattgctctgtatcatgtacacagctagcaggatacgagaacattgtgntttgcttgtaaaacctgcagtgctttgaacctgcttcctttttagcgacaagaatatcat

SEQ ID NO: 29852 - DNA, 121 bp, Artificial Sequence
  Synthesized
  misc_feature (61): n=a or c
cttttatctactgaaatgaaccttcgtatctcgccttctgaaggcagaatctgcttccagntcctgcaacaccgcgagtacccgtgggactgtggtgggctcgtgcccggcgtctgatcag

SEQ ID NO: 29853 - DNA, 121 bp, Artificial Sequence
  Synthesized
  misc_feature (61): n=a or g
ggagataaactgtgctcctactgaagtgaaagggaagagccttggtggtcctggggccatngggtgaggttgtttttgccttatcctcccttaagggagtgtgggggctgtggtcccaagg

SEQ ID NO: 29854 - DNA, 121 bp, Artificial Sequence
  Synthesized
  misc_feature (61): n=a or t
tcatgtgtcctctcttgcaaaggcactccttgtagccttattaatcccttgtagaagtgtnatatacagagttgtaagttttaagattcaaatatgcatgtccacagctggcagacgattt

SEQ ID NO: 29855 - DNA, 121 bp, Artificial Sequence
  Synthesized
  misc_feature (61): n=a or c
accaagcaatccctggggctgggattggagtgttgtcagagcaatcaggaaggtggttttnttctcacttagttcatgtttagacaattatactcatgactggaaggctaaaaagcatttg

SEQ ID NO: 29856 - DNA, 121 bp, Artificial Sequence
  Synthesized
  misc_feature (61): n=a or g
tgcacacttagaatggtataaatctgaagccttcccccaaagaatcttacaaattcaacantattcagtaaacgcttttgtgtttgtatccaataagtattgcatcctaaagcatcacaga

SEQ ID NO: 29857 - DNA, 121 bp, Artificial Sequence
  Synthesized
  misc_feature (61): n=t or c
atttataaaataaactgatccagaactgaagtggaggcaaaacagttggtaaaagagccanagtctgtcaatgttttaatattaatttactctttttaaaataaaaacactgagaaaaata

SEQ ID NO: 29858 - DNA, 121 bp, Artificial Sequence
  Synthesized
  misc_feature (61): n=a or g
accacgtttcaactccatctgctggtaagcctgagacaaacctacctctgtaagctggtcnccatttagtaaaggcagtgttctctagagacttttgcataggactagggagtaatagtta

SEQ ID NO: 29859 - DNA, 121 bp, Artificial Sequence
  Synthesized
  misc_feature (61): n=t or g
aactttgaaaatacgtgaagttaaatacaatacattaatatttgtaccatatttgtaaccntaagtgcacatcagtttatggacctctttttcttccccctttgtcagccgccttctaaag

SEQ ID NO: 29860 - DNA, 121 bp, Artificial Sequence
  Synthesized
  misc_feature (61): n=a or c
ggcaatgcgaaactgtgaggagaaagaggagagagtcatgcttctggaatcttggaagacntttgaagaggagtttggaactgatagcactaaagagaggatagaaaaacttatgcctgaa

SEQ ID NO: 29861 - DNA, 121 bp, Artificial Sequence
  Synthesized
  misc_feature (61): n=t or c
tcagggtacaagaaagggcaaggttgccagatgtagatttggctgctgactctagtgctanttaatggaagctaaatagcctgtgttgtcaggtgtcataaactgctctagttagtgtctt

SEQ ID NO: 29862 - DNA, 121 bp, Artificial Sequence
  Synthesized
  misc_feature (61): n=t or c
ttgagctaaaacttcttcctattattaatgtatgaaattctctacaaaacgaaaaatacanttcctctcatccccataaattgcttcccaatatgcagttacctcagctggagttagagtc

SEQ ID NO: 29863 - DNA, 121 bp, Artificial Sequence
  Synthesized
  misc_feature (61): n=t or c
tatgatacttgagagcatttgtagggtagcaagcctgcactgtctgttttatgtactttgnctttcagatgccattgtctcatcagaaaggtgctataatgcattgctggttttgacaaac

SEQ ID NO: 29864 - DNA, 121 bp, Artificial Sequence
  Synthesized
  misc_feature (61): n=t or c
agcttctgaatagcagaagaggagctgagagttaggagatctatctccttgttacacacantgacagttatgttgcagcaacacaaccaaaaaatccccacttctccatccagcagttctg

SEQ ID NO: 29865 - DNA, 121 bp, Artificial Sequence
  Synthesized
  misc_feature (61): n=t or c
cagccaaggctgccccatcccaggtgcagaatatgacacctgctcttgttaaactttatgnagttgatgattgccaagctctctgattggtcagaatctctctgtaaggcctctttacccg

SEQ ID NO: 29866 - DNA, 121 bp, Artificial Sequence
  Synthesized
  misc_feature (61): n=a or t
tgtgcagaaattgtctcaaagaatttagatttaatttctctgaaatcctggtttcattatnatttgctctgtacattagtaagtgtccatatgttaaaagaaagcaggagtagataactaa

SEQ ID NO: 29867 - DNA, 121 bp, Artificial Sequence
  Synthesized
  misc_feature (61): n=a or g
tctacatacaagatgccttcctggctctctttgtttcttcacttacgtgcaaaaagggagncagtgcgccacaccggtgcagctcaaaagactatgaacaagcagacagcatagcttaaag

SEQ ID NO: 29868 - DNA, 121 bp, Artificial Sequence
  Synthesized
  misc_feature (61): n=a or g
cagacggctttctttgtttcaaatgagttttccctctcattaaaattcactttttattacnaaaactaccatttggagagcgaaaattgaaatgtttgtggttcctactgaaccaccttct

SEQ ID NO: 29869 - DNA, 121 bp, Artificial Sequence
  Synthesized
  misc_feature (61): n=t or g
ccaaggcaaataaggccttatttttccaatggcagtgtaaataatgcagcaggatggtgcnacaaacagcagtgtttaggcagattggagaccggagagagtatagtttccactttcaatc

SEQ ID NO: 29870 - DNA, 121 bp, Artificial Sequence
  Synthesized
  misc_feature (61): n=t or c
ttcatagttctgggtgcagtttgcctagaacgcatacaaaacttcttggtggggaagacantgttaatatttgtatggtgaatttagggatggtaataaagtcatattttagttccacctt

SEQ ID NO: 29871 - DNA, 121 bp, Artificial Sequence
  Synthesized
  misc_feature (61): n=t or c
cccaaagccaacttccctgaccagaggcaaagcccatggaaaacaggaatcatgcctgggngttccattcacactgggcagcgctgtggcactcacctgcctgctgctttgcccccagata

SEQ ID NO: 29872 - DNA, 121 bp, Artificial Sequence
  Synthesized
  misc_feature (61): n=t or c
tctgtggagacattctttaaaaaaacttctttggactaatgttctatattttataatccantttggttaataatgcatacctcgtcagttcaggaaaagttaggtgaatttcctcttttat

SEQ ID NO: 29873 - DNA, 121 bp, Artificial Sequence
  Synthesized
  misc_feature (61): n=t or c
aaactataaatgtataacttcttcacttgtattatacacaaaagcttcccctatgccccanggacattagtgtttaacctcaacgtgtgattttaagatgttgagaatatgagctcccttg

SEQ ID NO: 29874 - DNA, 121 bp, Artificial Sequence
  Synthesized
  misc_feature (61): n=a or g
gaatatatggacattctaatctaaaagataagaggaacaattaggcttttagattgtaaantgtttctcccaaaagtcattctttgatcttgagtaattttacagtgtaatttagcagttt

SEQ ID NO: 29875 - DNA, 121 bp, Artificial Sequence
  Synthesized
  misc_feature (61): n=a or g
aaacaccaccaccagagtattacattaacctcctataatatgctgttagtaacccccatanctcacaacgtagggctgtgttgctgtggcacaagcagcccacctcaagaaccagaagcct

SEQ ID NO: 29876 - DNA, 121 bp, Artificial Sequence
  Synthesized
  misc_feature (61): n=t or c
catgtggttttgcacgtgagtccctggatcagggcagggttcccttggcctgcatctccangggaagactgtcccctcccttcaacaggagcttatcccacactccaatggccaattcaag

SEQ ID NO: 29877 - DNA, 121 bp, Artificial Sequence
  Synthesized
  misc_feature (61): n=t or c
caaaacctgaacgtaatcccaaccccagacctgatcccaaacgcacacgctgcacccaaanggcagatcccaaatggtgaccttttcaccagagcccccattcccaccagtcctgagcatc

SEQ ID NO: 29878 - DNA, 121 bp, Artificial Sequence
  Synthesized
  misc_feature (61): n=t or c
ctgaggagtggaagtcttccacctgaaagattcacctggctgtctccctttgttcagagcnggcactttccatgagaaagtgcgatcctgcatggtgaaagagaaatcaaaaaccacttca

SEQ ID NO: 29879 - DNA, 121 bp, Artificial Sequence
  Synthesized
  misc_feature (61): n=t or c
ccctatagaggcctttggggtgggactgattccatggggggcattggaatgggatcaaccnaatggagggtgttgggattggacagacctcatagagactacttgggtatgatatacccca

SEQ ID NO: 29880 - DNA, 121 bp, Artificial Sequence
  Synthesized
  misc_feature (61): n=t or c
attaattgaaaaatccatgaaagcaaaagggctgcatctgggccaggcgctgctgagcacngcgtgtctccatgtgtcctcctgagctgtgagtgtgctcctagcagcccagcagggacca

SEQ ID NO: 29881 - DNA, 121 bp, Artificial Sequence
  Synthesized
  misc_feature (61): n=a or g
cccttttttttccctaagtgtggaaggcaacaaaattttctgtaactcatatgctcaatanaaattatcttccctgtttctgtaatagcgatgtacagcatttagaactcccaccagcacc

SEQ ID NO: 29882 - DNA, 121 bp, Artificial Sequence
  Synthesized
  misc_feature (61): n=a or c
agctgagttgcatggggaatttccttagctctgaaagccttccagatggcagctgcatgantgttgcacctaatattgagcttgcaagagcttagaaatggattttggggcagccttccat

SEQ ID NO: 29883 - DNA, 121 bp, Artificial Sequence
  Synthesized
  misc_feature (61): n=t or c
agctgtgcagaagccatagaaaaagaaaatgcatgaatgtgtgttcttacaaaattctaanagaactagctaataaaccttaaatgctacagaagcttccaaagagagcttgttaactcca

SEQ ID NO: 29884 - DNA, 121 bp, Artificial Sequence
  Synthesized
  misc_feature (61): n=a or g
gcaccttgctgaatgggactgccactgcacatcacccaaaggatgtatgataacaaaagtnttgggtgctttggcccacatttgccatatgctgctgtgccacatctgcttgcctttaaat

SEQ ID NO: 29885 - DNA, 121 bp, Artificial Sequence
  Synthesized
  misc_feature (61): n=t or c
acagccaacattaaagtctttgattttgctaaatattatcttggtggaattccatcttctntacggaaacggtgagtagctataaaatgactgtagtactttgtacggtaactccatctaa

SEQ ID NO: 29886 - DNA, 121 bp, Artificial Sequence
  Synthesized
  misc_feature (61): n=t or c
gcgggtgccatttggaaagctgagctttgggttgttcgtgctccaagggagggacttttcncttcctgggtgagcgtgggtggcttcgaagcagctccaattttagtcttttctgcaccac

SEQ ID NO: 29887 - DNA, 121 bp, Artificial Sequence
  Synthesized
  misc_feature (61): n=a or c
aatgcaaaaatcagtgctcacatcagagccttctgtgcctgcgatctctcagttgcacatnacgagtgatttctattcattacccaagctggcagaggttcccggcccaaaggctcttggc

SEQ ID NO: 29888 - DNA, 121 bp, Artificial Sequence
  Synthesized
  misc_feature (61): n=t or c
ctttagatctatggagcttcaggagatgaattcaaatgcaggagttggtttagattttagnaactgagtgagtatgccagggctgggcagaggaatgggatatttattggtggaaatgcat

SEQ ID NO: 29889 - DNA, 121 bp, Artificial Sequence
  Synthesized
  misc_feature (61): n=t or g
cacggaaagcatgcctcacaaagagatagacaatggtagggttatatcttgtacaatgaangtgattttcagattgatatagcttgcacagttctgccccacagcagtgagagctgaggtg

SEQ ID NO: 29890 - DNA, 121 bp, Artificial Sequence
  Synthesized
  misc_feature (61): n=a or c
ctttcttgtatagtgtgttggatacaacctgttcattttttagctgtgcagcagctcttcntagtgaaaagaaggagtttttagtattatttgctggtctttacagcagccatgttcataa

SEQ ID NO: 29891 - DNA, 121 bp, Artificial Sequence
  Synthesized
  misc_feature (61): n=a or g
gaatggaaatgtagaaatgagcagattagcttcctctctgtaaagaaagagaggcactttngaaagcaaggtagatatttcagattatttgcaggcacagccaaggaatcaggaacactaa

SEQ ID NO: 29892 - DNA, 121 bp, Artificial Sequence
  Synthesized
  misc_feature (61): n=t or c
gaaagcacagtaaggtagcactgcttttaaaacaagtagtgatagatttaccacaatccantctacaaatggtccagtggagtacagtacctaaatcaattggggaaaacaaaagaaaaca

SEQ ID NO: 29893 - DNA, 121 bp, Artificial Sequence
  Synthesized
  misc_feature (61): n=a or g
gttaagcagcgttctcctagtcagtatctggaaacatccgattctgaggcagctgaagaangtctgctgctgttcagaagcagtggtacacagatgttactatacagtggctcagaggata

SEQ ID NO: 29894 - DNA, 121 bp, Artificial Sequence
  Synthesized
  misc_feature (61): n=t or g
caatgaattttatcacaaactttatttttatcatttccaggtcctggaattgcttttgttntttatccagaagccttaactagacttcccctctctccattctgggctatcatattctttt

SEQ ID NO: 29895 - DNA, 121 bp, Artificial Sequence
  Synthesized
  misc_feature (61): n=a or g
acccttccaatatggaggtgctgttatgtctcttgaatgacaggctctggggctctgaaancataggggaaggttcacctggaaagttcgacctcacctgaagctccccctcattatagtt

SEQ ID NO: 29896 - DNA, 121 bp, Artificial Sequence
  Synthesized
  misc_feature (61): n=t or c
cgtgaaagtgtttctgtgtgcttatgatggaaaccagcagtcataactgaacgctgattcngaggtggtggttgttgattgtaatggacagagtgactgtggccgtgctgtctgttcgggc

SEQ ID NO: 29897 - DNA, 121 bp, Artificial Sequence
  Synthesized
  misc_feature (61): n=t or g
gaacacagtagtgtgcagacatggatttttgtgatcatatatttgctaagccaagctgtanaacatttgctgtttctctctagaacataaacaagcaggtagagagtcaatgttaagatac

SEQ ID NO: 29898 - DNA, 121 bp, Artificial Sequence
  Synthesized
  misc_feature (61): n=a or g
agatcctaaagaacaaagtggatgtttatgctgcaaagaggcattctgttgataggtttcngaaagaataacctaaaccctagagtaatttttgaggtacagatgtctgtaaaatgagaaa

SEQ ID NO: 29899 - DNA, 121 bp, Artificial Sequence
  Synthesized
  misc_feature (61): n=a or g
gagctgaagcaggctgaaaccatcacggtttgtgtggctttttttgaatgaaatccttggncctccatggtgaggactgctgtggtggctccatgcaggtggctcagacccacagatcttt

SEQ ID NO: 29900 - DNA, 121 bp, Artificial Sequence
  Synthesized
  misc_feature (61): n=a or g
aatacgataaggcacatcataaagggttatgggcaagaaagtagattccaagaagcaaatntttgagaaaaatggaaccgtgatttaggaagcttcattgaagtgctgaggtttggcagta

SEQ ID NO: 29901 - DNA, 121 bp, Artificial Sequence
  Synthesized
  misc_feature (61): n=a or g
tctacacaagatctggccttcttgagcactctttagtttctttcccctgtttataaactantacttgtttcacagaaggattatccaaaatcagattgacctgcctgaaactattccataa

SEQ ID NO: 29902 - DNA, 121 bp, Artificial Sequence
  Synthesized
  misc_feature (61): n=t or g
ttaggattccttctgctgtgtaatctgctccttgcctgttgttacctgcctacctgtcctnctcactgtgaggagacaggcctcgttgggctatccttttctagctgttgtacttatggaa

SEQ ID NO: 29903 - DNA, 121 bp, Artificial Sequence
  Synthesized
  misc_feature (61): n=a or g
agcctatgctgatatgtccaaggtggatggtaaaatgtctctgaaagtgggctgcatccanatagtttatctgcatcaattcttcatgtctctcttggtaagacattagctacatttctct

SEQ ID NO: 29904 - DNA, 121 bp, Artificial Sequence
  Synthesized
  misc_feature (61): n=a or g
ccatgatgtattttcaaatagagatttctgagggtgagaaagacaggtgagcagacaaagnaccattccagatttcctcacagctctcctttgtcctgtttggtctcttcacataaacaaa

SEQ ID NO: 29905 - DNA, 121 bp, Artificial Sequence
  Synthesized
  misc_feature (61): n=a or c
gtagtgattccagttgattgtgaatatctgatgaggatactgtccctgcagtgcctctgantgcaatatttttagtgaggcaaaatgcttgagcacattgtaatgcggcataactcaatag

SEQ ID NO: 29906 - DNA, 121 bp, Artificial Sequence
  Synthesized
  misc_feature (61): n=a or g
gctgagcaattgttaaaggggttttgtggtgccgctccttagtcctcagaattgcccatgncttggggaggatgggtactcaggagaacaatccctggccccggacaatatgatgaaagca

SEQ ID NO: 29907 - DNA, 121 bp, Artificial Sequence
  Synthesized
  misc_feature (61): n=t or c
caaataagggagctgcccattgccccaacaagaattaacaaattgttcagttcagactacnctataagtagtagaaggttatgtggtttatagctgactactttataacatcagagaaaag

SEQ ID NO: 29908 - DNA, 121 bp, Artificial Sequence
  Synthesized
  misc_feature (61): n=a or g
cttttcatattgataattaactccctggggtgatctctctgctagcagtccttacgctgtntaatacactgttccttccctatgctgctattgtagatagaatattttcatatggaacttg

SEQ ID NO: 29909 - DNA, 121 bp, Artificial Sequence
  Synthesized
  misc_feature (61): n=t or c
acatgcaacattccttagctccatataggtttggcccacttccgtccctttgcaggcacanagtgaccactcaacacaagaccagaattttcctgggaaaggcagaaaatgtgaagatctg

SEQ ID NO: 29910 - DNA, 121 bp, Artificial Sequence
  Synthesized
  misc_feature (61): n=t or c
tattgacttgttttatttgcaagctttcggttttctctaaacacagccattattttggtancttgcaatgagctctgtatgatgaggtgatgtgagctgtagcagtgacagctggcaggga

SEQ ID NO: 29911 - DNA, 121 bp, Artificial Sequence
  Synthesized
  misc_feature (61): n=a or g
ggacctcactgtgaatgcacatggggaaaataacattgctccaagtgcaagaggattttangataaaattgaccattgcaacatgagaggctgcatgctgggatcacacccttggtgtgca

SEQ ID NO: 29912 - DNA, 121 bp, Artificial Sequence
  Synthesized
  misc_feature (61): n=a or g
taatttctatttttcaccagaggcagctcagggtctgccacatttactatgcagacaaaanttttactttttccaggctattcttctgctctttcagctaaagcagccaatggcagctgcc

SEQ ID NO: 29913 - DNA, 121 bp, Artificial Sequence
  Synthesized
  misc_feature (61): n=a or g
agtactgattctcattttaaacaccgaggaaccaaggtgtctggaagaagagagaagcacngaagttttgtatttgaataaagaagtccaaagatagagagaaaggaagtggtatcaagag

SEQ ID NO: 29914 - DNA, 121 bp, Artificial Sequence
  Synthesized
  misc_feature (61): n=t or c
aagcaaaacacttcttacggagcaagaatggctttgagcatgtatttgtaattacacacangcctaggaatgcagaagtgcagcagctctgttaaagccagattccctctccttgtggcta

SEQ ID NO: 29915 - DNA, 121 bp, Artificial Sequence
  Synthesized
  misc_feature (61): n=t or c
ccaccagctggaggccctgaataggagcaaaacaaacagatttaaccttttcttgttaaantgactacatttcacagttcacctttacatctccccatgcaattccccaccaagtcatttt

SEQ ID NO: 29916 - DNA, 121 bp, Artificial Sequence
  Synthesized
  misc_feature (61): n=t or g
tggaactgctggagacagccatattgtgcaactcaaacagaaatgatcacttacagactcncattgccagcaaaatttgttgatatagcaatatttccccgttgcagtttattccctttgg

SEQ ID NO: 29917 - DNA, 121 bp, Artificial Sequence
  Synthesized
  misc_feature (61): n=t or c
gtggacacgatgatcctgaaggtcttttccaaccaagatgattttatggcgccatttcctncatctcctgcagtctcaacagatgtcaggatttctgtcattgtttacccaaccaaatggc

SEQ ID NO: 29918 - DNA, 121 bp, Artificial Sequence
  Synthesized
  misc_feature (61): n=a or g
ccctcctcagagtacacacggttacacaaatcctgctgtatggcaggaatgagaacacccngtagcatctctgtgccacggccattcatacaccagcctctgtgcattgctcatttgatct

SEQ ID NO: 29919 - DNA, 121 bp, Artificial Sequence
  Synthesized
  misc_feature (61): n=a or t
gcataagggaagatgagaaggcgagaaacacagagcaagtgagacacggaggaagggaganggacatttttgtctttgaacatttttaggtctaaagcttaacagggcctcacataaaccc

SEQ ID NO: 29920 - DNA, 121 bp, Artificial Sequence
  Synthesized
  misc_feature (61): n=a or g
ataaagggcatggaagtcatagtgacatctttttgcaattcagaaaatgacaaaatacccngggactcttatttttgtgccctggaacaagtcttactgtttgagataacctgtggctgat

SEQ ID NO: 29921 - DNA, 121 bp, Artificial Sequence
  Synthesized
  misc_feature (61): n=t or c
acactggctttgcatccagtgatgagtaagcagagagggtatgtctgtgtgaagctggggnttggtatgcatgaaatgaaagatgaaataatgcagttttgctagtctatttttttttttt

SEQ ID NO: 29922 - DNA, 121 bp, Artificial Sequence
  Synthesized
  misc_feature (61): n=t or c
tcagcattgtggagatggaagctcactgctgttggtgaaggcaatggatggtctcctagancttgccacatttgcagcccagcagtggtcttgccagcccatttgttgctatccagttaaa

SEQ ID NO: 29923 - DNA, 121 bp, Artificial Sequence
  Synthesized
  misc_feature (61): n=a or g
aaggaatcaagctatcctagtgcctagaaaagtttcagatttaagtgagaatgcatgattnggacatatcacaaggagtgttgcttgtcagtgaagcactcaatccttggtggattgtaaa

SEQ ID NO: 29924 - DNA, 121 bp, Artificial Sequence
  Synthesized
  misc_feature (61): n=t or c
acaatatggagaacacagcagccaactacacagctgctaaagatggagttagaggttcaangccagtctaggagcacacaacaacataaacctgtgagcaacacagtcttccaaagaaact

SEQ ID NO: 29925 - DNA, 121 bp, Artificial Sequence
  Synthesized
  misc_feature (61): n=a or g
aagcagtacagattttcttgccctgcaaggacaagaggacaataggaataaaagtctagtntctttatgaaaccttggataaaaagtttgaatgaagtttacaatattgcatctattttat

SEQ ID NO: 29926 - DNA, 121 bp, Artificial Sequence
  Synthesized
  misc_feature (61): n=t or c
ccagttgaccgcaaatttaagttctcagcacacaagagagattatgtggctccatgtgatntaaccatcacttgattctgggtctatccttctaggctgaacagaatagctagaatagccc

SEQ ID NO: 29927 - DNA, 121 bp, Artificial Sequence
  Synthesized
  misc_feature (61): n=t or g
ctgtctagaagacaaggctgacttggcaattataatcagaaatgtaagagaagtaagtgtnagacactgaaatcaaagttaacaagcactttattagtgcagctttcactgtgcggacttc

SEQ ID NO: 29928 - DNA, 121 bp, Artificial Sequence
  Synthesized
  misc_feature (61): n=a or g
tacttgttagagccttactgcagggctgagacgttatggattcaaaagcagtgccaggatngtgtggttggatgtgctgggatttagataaatgaagacatctttgacatgtttaattcat

SEQ ID NO: 29929 - DNA, 121 bp, Artificial Sequence
  Synthesized
  misc_feature (61): n=a or g
ctgataatgtagtaatcttattaaaaagtgaccaatacacaaagttaaactgcatttcatncactcatctaaacaatatctttattctgaatggctacttccatcagctaaacatttgaat

SEQ ID NO: 29930 - DNA, 121 bp, Artificial Sequence
  Synthesized
  misc_feature (61): n=a or c
gacaaactgtcccgacaaagacagaagcagagaaggcaagacagaaacaagggaggctgcngtagatgatgtcatatatagagcaatgtttgctctctctcccactgaaacatcctcttta

SEQ ID NO: 29931 - DNA, 121 bp, Artificial Sequence
  Synthesized
  misc_feature (61): n=a or g
tgacttcggtcgcttaaggttagcacctcctatagtcaagagaaagggagagatcacgacnggagaattactatacagggcacacaggaggaaaagtccctggtggtagtgccctcccttc

SEQ ID NO: 29932 - DNA, 121 bp, Artificial Sequence
  Synthesized
  misc_feature (61): n=a or t
agcaggcttatgataaatccattttctccttcttattttggatgtgcaaggttcctctgangaaggatcatcttagcggatccctcccagtatgtaacttgactgtcaccacactgtatgt

SEQ ID NO: 29933 - DNA, 121 bp, Artificial Sequence
  Synthesized
  misc_feature (61): n=t or c
ttgttaatggttaggagtaggattttaatgtgttgctacagaaagaaactcatctcagtangcgtgcagtcattagacacgtaggacataagggaaataccttgggttgcatgtatcacca

SEQ ID NO: 29934 - DNA, 121 bp, Artificial Sequence
  Synthesized
  misc_feature (61): n=a or g
ttacactgtattttgtagtaaatgtatagtaacagatgttcaaaatatgtctttagactancgtcatcttcaaggaatagcttcatcttcaagagatatcagagagctgtctgaaattgta

SEQ ID NO: 29935 - DNA, 121 bp, Artificial Sequence
  Synthesized
  misc_feature (61): n=t or c
tgctgcttctcacccaaagaagaattgtgctgaaactggagttggtgcccactagtcatcntgagtgtggtccagttgttcctacgcttcatgcccagaggcaatgagtttgcagtttttc

SEQ ID NO: 29936 - DNA, 121 bp, Artificial Sequence
  Synthesized
  misc_feature (61): n=c or g
gaggatgaggtacgtgctgtatgtaccttgtgcctgcagctaagcctttcttgagtatctncaaacaaaatactgacctcatccaatgttactgccttgagcacacctctcctctacctca

SEQ ID NO: 29937 - DNA, 121 bp, Artificial Sequence
  Synthesized
  misc_feature (61): n=t or g
ccctgagttaagcacagcagctgtatcacaatactagttttcccagtcacatgacagttanccctgagaactcctgaatccacagaacacaccacagagatgcactttatctcctgtctga

SEQ ID NO: 29938 - DNA, 121 bp, Artificial Sequence
  Synthesized
  misc_feature (61): n=a or g
gagtcactggagtaaaaagtagtcttttaaaagaaaagcattgtttgtctcctctgctaanattcctgcactgcgtggcctgatagagttcactgccagatttccttcaggctacgtgaaa

SEQ ID NO: 29939 - DNA, 121 bp, Artificial Sequence
  Synthesized
  misc_feature (61): n=a or g
ttctgctaagtgatcctaacccaccatacagaaatagacagttccccatccgaaggtcacnggcactgctcgatttccttttcccttgcaaactcttctataaaactgcatcaatattttt

SEQ ID NO: 29940 - DNA, 121 bp, Artificial Sequence
  Synthesized
  misc_feature (61): n=t or c
tcttctggaaggtttaggaactctcacagttcagagaatatcatcctctaccagtgtgagncaggaaaacatcttccctgtgcaacacatgtaacttacctacaccagtccttgcactttt

SEQ ID NO: 29941 - DNA, 121 bp, Artificial Sequence
  Synthesized
  misc_feature (61): n=a or g
ttacatgtgatagatacaatgggaaaaataaacactagcaggagtttcaatcaaagtatgntgtatgcttctgaggcaaaaggatgcaccttaggacagctactaattacatatacatata

SEQ ID NO: 29942 - DNA, 121 bp, Artificial Sequence
  Synthesized
  misc_feature (61): n=t or c
gtaaaatacctgggaaaataaattttgcctcactttaactcacacaaaacttctgggttgntatctgaacactgattgtagaaatgcaccccacccaaattaacacattgggtaacaggta

SEQ ID NO: 29943 - DNA, 121 bp, Artificial Sequence
  Synthesized
  misc_feature (61): n=a or c
ctacatacagcaaatcatcatatctcacccgaaagcttcagatacttcaaagtgaacagtnatttaattagtaaagagatggtagttcaatatatatacttcatacttattaatattactc

SEQ ID NO: 29944 - DNA, 121 bp, Artificial Sequence
  Synthesized
  misc_feature (61): n=t or c
ttgtagactttagaagtacaccaaaaaaagtaggaaaacaagaacaggtaaacttaatgantcaataacttttaacttaagcagtagatggcttctgaagtcttacagtttgtagcaaata

SEQ ID NO: 29945 - DNA, 121 bp, Artificial Sequence
  Synthesized
  misc_feature (61): n=t or c
gctccatcctcctgtttcagcccagaggggctcacattgtgccagactcctgggggctcanttcatcgtagggttcatcatcacattgagtcactgagatgcctgatgcatcttagtgctg

SEQ ID NO: 29946 - DNA, 121 bp, Artificial Sequence
  Synthesized
  misc_feature (61): n=t or c
tgcaaaatcccttggagaggttcaggagttagttttatgaatgttctgccaggagcgcatncaaatccccacaaagtctcttcactcagctctggaacactcctcctaagaacagtttttc

SEQ ID NO: 29947 - DNA, 121 bp, Artificial Sequence
  Synthesized
  misc_feature (61): n=a or c
aaactcatgcagtttttaaatcatcttagtacagttctgtatacaggaactgcccatcacnggtgcaaagttgtacatcaaggacaagcaaagactgctgctccagaaaactgggatctgt

SEQ ID NO: 29948 - DNA, 121 bp, Artificial Sequence
  Synthesized
  misc_feature (61): n=a or g
tggggttgggctatgaggagagaagataactggggagcaatgagttacctcccacattctngaagggaaggaggaccctgatgaagggtgatgagtttctgcacggctgaagggaggtggg

SEQ ID NO: 29949 - DNA, 121 bp, Artificial Sequence
  Synthesized
  misc_feature (61): n=a or t
aacaaatcaaacaaaaaaacccagcaactttatttttctttctttgtgcttattttgtgcngttaatgctgcatcctctactggaatcagtatggacatgtcaaagcacaggagctgttcc

SEQ ID NO: 29950 - DNA, 121 bp, Artificial Sequence
  Synthesized
  misc_feature (61): n=a or c
agcaagtgttctgaactaccttctgtgtgtgttgcgattgctgttgacgtgtcctcttccngtgcatcctggagtggggcactttaaaacgttttcatgcatggcaagaactaaggaagaa

SEQ ID NO: 29951 - DNA, 121 bp, Artificial Sequence
  Synthesized
  misc_feature (61): n=t or c
tagtacttttccaggtgtaccagtcagttagttgtaatctaggtgtgtttcctctcatcanctttagagtgtcaaagaaacttcacaattgcattaaatgaactacagggaagagaagaaa

SEQ ID NO: 29952 - DNA, 121 bp, Artificial Sequence
  Synthesized
  misc_feature (61): n=a or t
agtaagggtggtgacttgcataaaggctgtcttttcagttctaagcatttgaagataagcntttgaaggaattaatgaattagagtagattcctggaaacacaccagaaaaataaaataga

SEQ ID NO: 29953 - DNA, 121 bp, Artificial Sequence
  Synthesized
  misc_feature (61): n=t or c
tcccgtgtaatagactagtgagcaatgataatcctacaggggcttttgcagcattctctcnctatgatggttaaaggtcaacttacttgaaacctctcctcaaagatgcagacatttgaat

SEQ ID NO: 29954 - DNA, 121 bp, Artificial Sequence
  Synthesized
  misc_feature (61): n=a or c
agatataagattcttcttgtttcctgcggtgaaaatccacaaagctgagcactgctttcanccaaacattgcagcaggttcaggccatggtgctccgcagcttcagtttgcatgggaccag

SEQ ID NO: 29955 - DNA, 121 bp, Artificial Sequence
  Synthesized
  misc_feature (61): n=a or t
gaagactgtacatctgtctgccccttttcctgacttgcctccacctgcttcagagcactgnggcaaagtgtgcctctttagtctttagaagttgattgggtaggttgggttaaatgttgga

SEQ ID NO: 29956 - DNA, 121 bp, Artificial Sequence
  Synthesized
  misc_feature (61): n=c or g
tatcataaatcataaatttaaggtgttatacataatctttttagaagttttgcattcactnccttatacaggtagaataatgataataaagttatgtcagcttggtagccaagaaaaagaa

SEQ ID NO: 29957 - DNA, 121 bp, Artificial Sequence
  Synthesized
  misc_feature (61): n=a or g
agccatccatacatatgagaaaagtacattacatatgaaaggaaatgatcttccattttgnaaaggctaaaagcctacttaatctaaaattccttaattcgatgaagcagtattttataat

SEQ ID NO: 29958 - DNA, 121 bp, Artificial Sequence
  Synthesized
  misc_feature (61): n=a or g
ccaatatcttagccatttcaatttaattgcatctttattacgaagacaagcatcaacttcngccactacaatgaaagtatgtatactaagaaactacctatgtcatgaatttacatgcctt

SEQ ID NO: 29959 - DNA, 121 bp, Artificial Sequence
  Synthesized
  misc_feature (61): n=a or g
acaaaaactctctgatttgactgtttagatcagatggaaataaaggtgttagtaactgtancatagcttcacagtttcctgggaaccgtaaaatgtgaatactcctttgggtagaattcca

SEQ ID NO: 29960 - DNA, 121 bp, Artificial Sequence
  Synthesized
  misc_feature (61): n=a or g
ggggaaccagcaagtgagaccgtgtgatcacatgagcttgagtggctgcaggatgggtgcnaagcagatcttgtggagatgccatccaagaagtgcttcacgttggtgcctggaggtgtac

SEQ ID NO: 29961 - DNA, 121 bp, Artificial Sequence
  Synthesized
  misc_feature (61): n=t or c
tgttttcctcttggtttacaaagaaaactcagtgtcaagggaactgatgactgggatgtgntggactaatataaatttatctgaagccaagaatgcccctggtttggctctgaaaagagta

SEQ ID NO: 29962 - DNA, 121 bp, Artificial Sequence
  Synthesized
  misc_feature (61): n=a or g
gggccgctgttggaggtgatggccgggacccatcacaggatagaatggaacctcccgtcanagacgggcccgagagaaagtggccgctgcaaagctgtggggtggcttcggggaacggctt

SEQ ID NO: 29963 - DNA, 121 bp, Artificial Sequence
  Synthesized
  misc_feature (61): n=t or g
agctaaaaagactgtcaaggatggtaaatattatctgctgattcattaggtagaagccatnggatcttgagcagtttgtaacgcattgcaataaatgacatgttaacttcagagttaacaa

SEQ ID NO: 29964 - DNA, 121 bp, Artificial Sequence
  Synthesized
  misc_feature (61): n=a or g
cacacagggcatcaaaccctagtttattcagattcctcatcttaatataacaggcataatncttcatgctgactttggatttacagatgtgtcctctcctaaaatttaaaagaagccttca

SEQ ID NO: 29965 - DNA, 121 bp, Artificial Sequence
  Synthesized
  misc_feature (61): n=a or c
atgtttttgtctatatctgtcttttggtagcttccattatcctcacagattaaactatcanattggacaagttgaagagagtctgtaagcccattttttcaatgtttcagaagaatcttaa

SEQ ID NO: 29966 - DNA, 121 bp, Artificial Sequence
  Synthesized
  misc_feature (61): n=t or c
aaatgcatccattacccaaataagcaaattaggtactgtaagtggtatataaatatgttanatctctgaagaatgaatctggtttatactagctttaagggaatacttttagtcaggacat

SEQ ID NO: 29967 - DNA, 121 bp, Artificial Sequence
  Synthesized
  misc_feature (61): n=t or c
cagaacaaacaaaaaccaacaaatcaaaacaaaaatagtggctccatatccacagagaganctatggtctattctcttgcagccaaacttggttatgaaacaaagtcttgtgaaggcaaat

SEQ ID NO: 29968 - DNA, 121 bp, Artificial Sequence
  Synthesized
  misc_feature (61): n=a or c
gtatgggtttgccatgcctaaccaatgtggtaacctcctgtaaggaatggatgaggggagnagtggatatggtcttcttcctgcagttcagtactgcctgtgacactcattcccccacata

SEQ ID NO: 29969 - DNA, 121 bp, Artificial Sequence
  Synthesized
  misc_feature (61): n=a or g
gtcaacagaagagtccatcttcattttatattttatttagagcttgaagaaacagcctgcnctttaaactaaggagaacatggccacgtaagggttataaataaactgtgaaatgcagata

SEQ ID NO: 29970 - DNA, 121 bp, Artificial Sequence
  Synthesized
  misc_feature (61): n=t or c
tctctactctgccaagtccctcagtatgagtacttagaagttcgtactgtaactctgaaanatatgctacctatctcctcttccattagtgttcttgttgagttaaaacttgccccagtgt

SEQ ID NO: 29971 - DNA, 121 bp, Artificial Sequence
  Synthesized
  misc_feature (61): n=t or c
gttttcttttcataggtatttagggtttgatcatgctgctacgctttttcacatccgtganggtgcttctgattctgtggaaagaccaatctatctaacaaacacattcaattttgcagtc

SEQ ID NO: 29972 - DNA, 121 bp, Artificial Sequence
  Synthesized
  misc_feature (61): n=a or g
ttattttaattttaagtatagtaacggtgtgatgataagtggggattattaatgatttacngtcatagaaagtgaaaatataaggcgtaatgtaatggaggacgttgccataaatgttctc

SEQ ID NO: 29973 - DNA, 121 bp, Artificial Sequence
  Synthesized
  misc_feature (61): n=a or g
ctcagtttgtgaggaccccagatgagcccctcctgaaaagcattccctcttctaacaggcntgggcagtacaaaagcaatgatctggaccagctgcaaacctcagctcctgagcatctcaa

SEQ ID NO: 29974 - DNA, 121 bp, Artificial Sequence
  Synthesized
  misc_feature (61): n=a or g
tgctcagcccctccagccccagggatgtgtcatttcttcagtcttaagatgccttcacttntccctttttggaaactcttcattctttgtcaagtaaaataaatgccaaacatgggtcaaa

SEQ ID NO: 29975 - DNA, 121 bp, Artificial Sequence
  Synthesized
  misc_feature (61): n=t or c
tttggaggggacttctgcaagtctttggtccaagtactacaagtgggaccatcccctgtgntagatcagaccagcctgtgtaaagccaagacttggaaaccaaaatgtagatccctccttc

SEQ ID NO: 29976 - DNA, 121 bp, Artificial Sequence
  Synthesized
  misc_feature (61): n=a or g
ctgggccgcatgagggctctgggttgtgggttggacatgcctgttacaatggcttcattcntctttctacagcagtcatttggtttgtgcatttcttaatattcctgggatgagagggagg

SEQ ID NO: 29977 - DNA, 121 bp, Artificial Sequence
  Synthesized
  misc_feature (61): n=t or c
gtatgtaacacatcttatcattcagttgtgctttacaaaataagcgacctagtcatttttnaacaccaatcttttaattcctgctttttaactgcatttaaactgctaatattttaagaac

SEQ ID NO: 29978 - DNA, 121 bp, Artificial Sequence
  Synthesized
  misc_feature (61): n=a or g
gcgtggtggcaggggaggttggccaaagcaggtggtgctttctttctgcccaagcaccacntggactcttggtatctgtcaccagccagtgcaaatgggaaaagcaccagagctcaggaat

SEQ ID NO: 29979 - DNA, 121 bp, Artificial Sequence
  Synthesized
  misc_feature (61): n=t or c
ggtaaatgcagtttcaaatcttcacagtctgatatagcaatttagtatgaatgtgtcacangtggacagaatacttttttataatactccttttatatttcttccttaagatagtttttaa

SEQ ID NO: 29980 - DNA, 121 bp, Artificial Sequence
  Synthesized
  misc_feature (61): n=a or g
gagtcttctatattttgtgaatataaactgaggagtggagttgctacagagatgaattccnctgaggctggatttttgttcgaggttggtaatgttccttaatactccaagccttctgttt

SEQ ID NO: 29981 - DNA, 121 bp, Artificial Sequence
  Synthesized
  misc_feature (61): n=a or g
agaggaagctgcgttctgaggaactgctttttcagctgtgagtggtgaaccagttcctccngacccgctcagctacagaggtcacacagcagccccagtctgcattcccatagaagtgtac

SEQ ID NO: 29982 - DNA, 121 bp, Artificial Sequence
  Synthesized
  misc_feature (61): n=a or t
tttcctgtgatcaggtatataaatagatgccctaaatataaaagagaccaactaggtctgnaggtaccatgaaaattcagctagtccttcctcactccattatagttgcccctaggatcaa

SEQ ID NO: 29983 - DNA, 121 bp, Artificial Sequence
  Synthesized
  misc_feature (61): n=a or g
ctttccggtccttgcagtctttctgtaaattgtttctttctacttccagaattttttaccntgtttattctaagaatatttttctatcagacatgcatgagggcccattaatatgattttc

SEQ ID NO: 29984 - DNA, 121 bp, Artificial Sequence
  Synthesized
  misc_feature (61): n=a or g
ttgcctaagctgaagagaatgttttttgaaaacaaaatataccagaaagtgttcagtctangtctgtgtctgaggtatatgagcaagagagggaatcatgttttgaaccctttgtttggag

SEQ ID NO: 29985 - DNA, 121 bp, Artificial Sequence
  Synthesized
  misc_feature (61): n=t or c
tataactagagcaattgaattgcatctacagagaatcaatccacaatctttagaagaaaanctcttagggaaacaaaagatattagggattctgaagagcaggaagtgcgcagtgaggctt

SEQ ID NO: 29986 - DNA, 121 bp, Artificial Sequence
  Synthesized
  misc_feature (61): n=t or c
actgggctcaccaccttgaaaacaactctgagtagacttctacctacctgaagctaacatnctattgcagaatatatgttgatgaggactggtcatacagttaagaaaataagacgttgtc

SEQ ID NO: 29987 - DNA, 121 bp, Artificial Sequence
  Synthesized
  misc_feature (61): n=t or c
gctagattcttctgcaaagggagatgtgacattgtttcgtggcatctctgaaagcccgagngaacactttctgagtgaacccggccatttatcttccaggaagcagctgcatattgcacct

SEQ ID NO: 29988 - DNA, 121 bp, Artificial Sequence
  Synthesized
  misc_feature (61): n=t or g
gcaggtacatcagcatggagccttttcaaccaggggagaacccacagaccaatttctcctncattcactccagtgcctgtaggaccagcagcaagctacacctctgcctgatttatgagtg

SEQ ID NO: 29989 - DNA, 121 bp, Artificial Sequence
  Synthesized
  misc_feature (61): n=t or c
aagaaacaagtactgctgcttaatggaaaaatcaaaatatgccacctccttgtgggagagnctgttcctattcactgactaggaaggaaaggcaggggtgacagctctggcctaagacaat

SEQ ID NO: 29990 - DNA, 121 bp, Artificial Sequence
  Synthesized
  misc_feature (61): n=a or g
caatttaagagaactcccatagcagtcaactgttgattttgatacatgaaaatatttgacngtccatttttatggccttatttttcaagccattcaagcagctgagctgctgatgaaaata

SEQ ID NO: 29991 - DNA, 121 bp, Artificial Sequence
  Synthesized
  misc_feature (61): n=a or g
ctcaagatcatctccctgaatgttccatcaaaacatcttatttcctattttttccaccccnaatttctcattgtccaatttacgccaatagatgtgaagtatttccctgactctctagata

SEQ ID NO: 29992 - DNA, 121 bp, Artificial Sequence
  Synthesized
  misc_feature (61): n=t or g
aagtcacttacacacatgcccaatgctgagcagtgacagcaaagtccccaggaactgactncaggatacagcagcagcccttgtggcctggtgcactcccagcaagcacagtgaggactga

SEQ ID NO: 29993 - DNA, 121 bp, Artificial Sequence
  Synthesized
  misc_feature (61): n=a or g
taggagtcttgagcacactttgaaaaatgagccccctgcttgcatacaatataacaaaatnaaatcagggtcagaaaaccaattgtagcagaactgataaacaaaactgcagcatcagaca

SEQ ID NO: 29994 - DNA, 121 bp, Artificial Sequence
  Synthesized
  misc_feature (61): n=a or c
gatttttgtgttctatgtgagagatgagactatttaatgcatagtttaaatgctcacattntgtaggctgtagaggacgtctgtgttgctttattaatgaccagaaggtgatctatggctt

SEQ ID NO: 29995 - DNA, 121 bp, Artificial Sequence
  Synthesized
  misc_feature (61): n=t or c
cgttgcattttgtcatccaaagaatcaaagtactaagaaactttgtcctggtgatgtatantttggacacagagtgttgtatatcacagtatgcaattacttgcaaggcctcttctctgtt

SEQ ID NO: 29996 - DNA, 121 bp, Artificial Sequence
  Synthesized
  misc_feature (61): n=a or g
taattggaaaaagcaaagaaagataagtgacttagaaagctgcactgggagtagaagatgnatacagttttgtttacttagaagagaagaataataatcttaaactattcaattgtttact

SEQ ID NO: 29997 - DNA, 121 bp, Artificial Sequence
  Synthesized
  misc_feature (61): n=c or g
ggtgccttctgttctcatttttcacaaatgaaaaataattatggaaacagtaaattatttnaaatatcggtgctgtagataacctttacactttactctttcagtagcagagaactatcaa

SEQ ID NO: 29998 - DNA, 121 bp, Artificial Sequence
  Synthesized
  misc_feature (61): n=a or c
ttatcagaagaattaaatgcttgcctacatgattcaatgcaatggtttcagaataacattnatgacataggcagctttgcatctagcatacagatctattagtcagccattgagagactta

SEQ ID NO: 29999 - DNA, 121 bp, Artificial Sequence
  Synthesized
  misc_feature (61): n=a or g
gcgaaatggaaatgttaataaaaataaaggggatagtatcattactgttgttatatatagngagcaagtaataccagaaaattgaagtgcttcccctaagaatacctgataaataaaacta

SEQ ID NO: 30000 - DNA, 121 bp, Artificial Sequence
  Synthesized
  misc_feature (61): n=a or g
ggagtagcagaaatcacatccctatccctgcctacagcaatctattaattaaaagataacnaaatctaagtgcatttaatccatggcagagcgttcttgggaacctgagcatcaatctgct

SEQ ID NO: 30001 - DNA, 121 bp, Artificial Sequence
  Synthesized
  misc_feature (61): n=t or c
tcagaaaggtccatcttaaaagcatactccttaaaactttaatatgtatcaatcctgctanttgccagaaaccgagatatatatcccaactaagtgccatgaagttctctcacacctaaat

SEQ ID NO: 30002 - DNA, 121 bp, Artificial Sequence
  Synthesized
  misc_feature (61): n=a or g
ccttctgagaatttccaatttaattaatctgtctgagctgacattacttttggtagagatntggtttacagctccagtaactgcttttggaggagccactgtgcagacaagaaatgctgtt

SEQ ID NO: 30003 - DNA, 121 bp, Artificial Sequence
  Synthesized
  misc_feature (61): n=a or g
tctaatatacagcacccatgtttcagagatactggggatcagaagttcctcttcaagctcngccacttttacttatacgatcatctttaaaatgttcgttttgatttatatatatatatat

SEQ ID NO: 30004 - DNA, 121 bp, Artificial Sequence
  Synthesized
  misc_feature (61): n=t or c
taagagcatcttattaccttgaaagtatcatcagacatagctttttatgggatattctctnccttaagacatagattgaagattacgacttctttcactagtaaagttaacatataaaaga

SEQ ID NO: 30005 - DNA, 121 bp, Artificial Sequence
  Synthesized
  misc_feature (61): n=a or g
ttcaaatgaaactgtttcttctgctacaatactgtaattacaaacatttggcagtgccctnacacttgacaattctcttccacaaataaccattgcagtatattatgcagttcatccattc

SEQ ID NO: 30006 - DNA, 121 bp, Artificial Sequence
  Synthesized
  misc_feature (61): n=t or g
taagtggaagaaacacatctgtgggaaaaagaatgatccagcaccagcaatggctttgcantgtgtaccgcactgagctctcccagccaagcgtgtggagatggcacaaaatcacatctga

SEQ ID NO: 30007 - DNA, 121 bp, Artificial Sequence
  Synthesized
  misc_feature (61): n=t or c
ttgttagctttgggtaaagcataggaagtctttataacgctacagtgtcctgtctggcganagggcaacccagagtctccaaatcctgaatacagacactcccattcaattaaaactttca

SEQ ID NO: 30008 - DNA, 121 bp, Artificial Sequence
  Synthesized
  misc_feature (61): n=t or c
cctgcccaaaatcttcagaaaggatgaaaaaatggccttatattcagttctaatgaccaangcagttgcaattgcatttgtttaaaattcacttcactgtttctttcctggcagacctatg

SEQ ID NO: 30009 - DNA, 121 bp, Artificial Sequence
  Synthesized
  misc_feature (61): n=a or g
aaccagatgaagttggtcaacgacaaaacttgataggttagtccttatttcttccttcaangcaggcatggaagaagaagctctttctattaagaactgaaaggattactgacacttctag

SEQ ID NO: 30010 - DNA, 121 bp, Artificial Sequence
  Synthesized
  misc_feature (61): n=a or t
ctttttcaggaaatgcaatgaattgttgtcagatttttgccttctctctcaggggaatgcnaagacaactgcagtagagggcagataaagcagccatgtgaagtgatgggtattattccag

SEQ ID NO: 30011 - DNA, 121 bp, Artificial Sequence
  Synthesized
  misc_feature (61): n=t or c
aaaaaaaatcttgtagaagatgtttgaaaagacagaacagagggaatgattttggagacanatcccagtttgaaattttatggctgaatgagtcatagaatcatagaatggtttgggctgg

SEQ ID NO: 30012 - DNA, 121 bp, Artificial Sequence
  Synthesized
  misc_feature (61): n=a or g
gactgctttagttaccatattattgctaatgaaggagaggtttacagctcagctacaggtntgtgtgcccttacatcacatatacaaacaaaactcatggtacaggcagtgcaaattaaat

SEQ ID NO: 30013 - DNA, 121 bp, Artificial Sequence
  Synthesized
  misc_feature (61): n=a or g
ccaatgtgtagctgtaataaaaggggcaaacacagtcctctggaagcacaagaatctgacnctaaaacactacatgaagacatgtagtcttactatcgtgcatagtaaacatactttgcag

SEQ ID NO: 30014 - DNA, 121 bp, Artificial Sequence
  Synthesized
  misc_feature (61): n=a or g
ttgtctcattaatagtatctgagttttgtacacagcagtaagttcatgttccaaatcactnttccttgtccctaggcctatgtaacttcacctagtgtagatgtttttcagacaatgcatt

SEQ ID NO: 30015 - DNA, 121 bp, Artificial Sequence
  Synthesized
  misc_feature (61): n=t or c
agtactgaaaggtatattatgttcaattatgcagcacaaaaaaatgctctgtccacatacnactagtgtaaaaactcttcatcttgtggattaaactccagcaagccatgcaattcagcta

SEQ ID NO: 30016 - DNA, 121 bp, Artificial Sequence
  Synthesized
  misc_feature (61): n=a or g
ctctcaccacttctgtcacaggagtcacaaaattaactcaggcttcttctcaaaaccagcntttaggttccagttattgttaaaaatcatttaaggaaaatattttttgatgaaaacagca

SEQ ID NO: 30017 - DNA, 121 bp, Artificial Sequence
  Synthesized
  misc_feature (61): n=t or c
aatgatattctgattctatgattctacgaccatggcttgtaacatgtagtatttctcctcngtgggactttatccctctttatcctgagcatagagtcatcctctcagatggcctgtgggc

SEQ ID NO: 30018 - DNA, 121 bp, Artificial Sequence
  Synthesized
  misc_feature (61): n=a or c
ttgtcgtatatcttcttttgaacctaacataaggaagcagtatcgttctaatttcctaganattattccatttagatattcagtgaacttagtccctgtgaacgtttgcttatgcactgaa

SEQ ID NO: 30019 - DNA, 121 bp, Artificial Sequence
  Synthesized
  misc_feature (61): n=t or c
ctgcaatcacttgggcagtcccaagatctgccttttcccataggcagtgctgccatgaacngacgcctgctgacgtaagtgggagctttgtgtctatccagggattaggccctttgctcag

SEQ ID NO: 30020 - DNA, 121 bp, Artificial Sequence
  Synthesized
  misc_feature (61): n=t or c
gtatgaacgtcaagcacgggcttgaaacttgatgagctaaggtgctttaggtctgaacgtntccctgttctctgaaaatctgtaaagaatagtatattacaaaatttgtgtttaaacaatc

SEQ ID NO: 30021 - DNA, 121 bp, Artificial Sequence
  Synthesized
  misc_feature (61): n=a or t
tacttccttaaaccaactcaaacagaagacaaatgaatgtgtttttaactaagtacccagnaaagtttaggtacctggatatgaatgtagtcagttggcctcaagcaccacactagattca

SEQ ID NO: 30022 - DNA, 121 bp, Artificial Sequence
  Synthesized
  misc_feature (61): n=t or c
gttaatgctttcttgtgtattgttttggagtttgtggtcataataaaatagatgtattctngtagaaatctcagttatttctgaatatagagtcataaggcctttaaaaagctttcttttc

SEQ ID NO: 30023 - DNA, 121 bp, Artificial Sequence
  Synthesized
  misc_feature (61): n=t or c
ttctctaaactgttaggctagggcagtgcaagtctgcatccatattgcttgctgaccttangttccttacaaataaaaatgttcaaggtattgatagcgggtgtctaatttgcatggaaaa

SEQ ID NO: 30024 - DNA, 121 bp, Artificial Sequence
  Synthesized
  misc_feature (61): n=a or g
tagagttcaagttaggatgcctgggctctatttgcagttctgtcactctccggctttgggnaattgagaatgttacttattgccaattttcagttttctccttccttttctcattatatta

SEQ ID NO: 30025 - DNA, 121 bp, Artificial Sequence
  Synthesized
  misc_feature (61): n=a or g
aaaacttgactttatcagcagaacactgagttgatggttattgctttgttgctatttaagncctccatcctgcaaaggaacagaagtctagagtttcagagatctaacctctattataatt

SEQ ID NO: 30026 - DNA, 121 bp, Artificial Sequence
  Synthesized
  misc_feature (61): n=t or g
gtggaatgcccctttccatgcattcccacatacatccttaagtatacagctcctccctttntagcagtgttctttttaaaggaatgtttcatgttgaatgaagaaaatagttatgaagaaa

SEQ ID NO: 30027 - DNA, 121 bp, Artificial Sequence
  Synthesized
  misc_feature (61): n=a or g
aagcgtacgctgctctccctgataaaaggatcagaaagcagtatttttatgacgatcaacntttggccagtatctgagctagaaaatgtacgtcctgttttgattttcaggcttttcagtg

SEQ ID NO: 30028 - DNA, 121 bp, Artificial Sequence
  Synthesized
  misc_feature (61): n=a or g
aggcaggtgatgtgtctgactctaaagcgtctcgatctgaatatcctcacaagggaaaacntcaaaccactcttggtgattccagtggacgttttcacctcctaaaggtttctggcagtgg

SEQ ID NO: 30029 - DNA, 121 bp, Artificial Sequence
  Synthesized
  misc_feature (61): n=a or g
ccctcccccttgctgttcctgttaagcccatccctatcacattttaattgtaacaggcaanttaagggaaactgaaacgtgagaatgggcatttgcagtacaaggatgcagtgaaggcaga

SEQ ID NO: 30030 - DNA, 121 bp, Artificial Sequence
  Synthesized
  misc_feature (61): n=a or g
aatgaacatttcccaaaccctgcacttcaacctgcactgctctttgcataaattcaactcntggccatcctcacttactagtaataaaatgaactgcaaagcaggggaaacacaatgctag

SEQ ID NO: 30031 - DNA, 121 bp, Artificial Sequence
  Synthesized
  misc_feature (61): n=t or g
acttccattgattacactagaaattctgtgatgtgtaaaagttctgcagtttctggtaagntagtaaggtaataagggtggataatagcaggacaaggggaaatggttttaagttgaagga

SEQ ID NO: 30032 - DNA, 121 bp, Artificial Sequence
  Synthesized
  misc_feature (61): n=t or c
aaaagaaaataaaaagggttccactatttgctatttgttctttctatgaagtctctgcatntttaggtttcatagttctatatagtttctattattttgtagaaaaagtctctcaggtaga

SEQ ID NO: 30033 - DNA, 121 bp, Artificial Sequence
  Synthesized
  misc_feature (61): n=a or g
agctataactgaatagtttaaatatcaacttgttactctttccaataacttgaaaataagncatcagacagacagaaaaacaagccaagatccataaaaaaatatttgtgcctttgatagt

SEQ ID NO: 30034 - DNA, 121 bp, Artificial Sequence
  Synthesized
  misc_feature (61): n=t or c
ctgtgactccaaagccccagaaagagcctctaacccaattcccttcaagtgcacaagcctngcaaactgcagcatctgtttgccactgtattcaccgagttcacagggcaaacaaaagatc

SEQ ID NO: 30035 - DNA, 121 bp, Artificial Sequence
  Synthesized
  misc_feature (61): n=c or g
gcttctaaaaaagttaatggattgcagtgctttgctccatcacatgcctaggtgaagatgntggttaaatctcctgacaagatcaggcctggagtcttgaactgttactgatttcaccagg

SEQ ID NO: 30036 - DNA, 121 bp, Artificial Sequence
  Synthesized
  misc_feature (61): n=t or c
gccgtgagatggagggcatttcctggctataatggcctctgcttccattcagttgttaccngaatttggagatataagtaacaaaataagacatgtgaatttgaatatcaaaataacaggt

SEQ ID NO: 30037 - DNA, 121 bp, Artificial Sequence
  Synthesized
  misc_feature (61): n=a or g
tttttcctcattttttatgaaaagattttatttctgacagatgaacctgagacgaaagagnccagatcctagcacataagtgctttttgcttctgttgttgtaaatggaatacatttttcc

SEQ ID NO: 30038 - DNA, 121 bp, Artificial Sequence
  Synthesized
  misc_feature (61): n=a or g
cccctgagatacaacccttcctctttgagacactttgttttggcaccttagttatgagtanagagaccagcaagcaggaattaaaagcatacagcaagtatttatggataacaaatatgag

SEQ ID NO: 30039 - DNA, 121 bp, Artificial Sequence
  Synthesized
  misc_feature (61): n=a or g
agacaaagcaatacaaataaggaatgttttgagtagaagaagaacagtaaatttatgcatntagtatcattctgattccagaacaaaatcctcagttgttcccaagtatagaattataagg

SEQ ID NO: 30040 - DNA, 121 bp, Artificial Sequence
  Synthesized
  misc_feature (61): n=a or g
caaggcaatacaaatatcactacaatgcagtttaaccatcttttcatttgtctgtctaatngagggaccaattctccactagaaagacaaaaggaagagtaaatacagattgctgagcaga

SEQ ID NO: 30041 - DNA, 121 bp, Artificial Sequence
  Synthesized
  misc_feature (61): n=a or g
aaaggaagggagaagctattacaaaagtctgcagctcctcaccaatgaacccatatgagantatggatgcagtttgctttacgtttgtcagcagttactttttttttccccactgtctata

SEQ ID NO: 30042 - DNA, 121 bp, Artificial Sequence
  Synthesized
  misc_feature (61): n=a or t
tgcaggacttctctttctctctttattgctttttaattgtttgagaaaagcccaatccctnttcatttcatacatctcctaggtttggtgatttcaggggaatgtcaacaaatgtaatcct

SEQ ID NO: 30043 - DNA, 121 bp, Artificial Sequence
  Synthesized
  misc_feature (61): n=a or g
ttaaagcaagtagcggactggaaggaatcatggctgaaactgtatctactacccatgttcntgtgttcctaatactgtagcaataccaaaacccaggtaattcccaggcagatcacctaac

SEQ ID NO: 30044 - DNA, 121 bp, Artificial Sequence
  Synthesized
  misc_feature (61): n=t or c
actcattttccacatatgcattggttctatctagatatggaagtaaaaaaggtgaagtcanggaataagagaagcaaaagactcatagaggaactcagctgatacctaggctttcctaact

SEQ ID NO: 30045 - DNA, 121 bp, Artificial Sequence
  Synthesized
  misc_feature (61): n=a or c
ctggttggccgatgtttcttaatactagataaattaaaccagaaactctgagatcacatanactgtgtgtataaatgaaaggtgctggtgtttttttctttgctctttttttgttgttgtt

SEQ ID NO: 30046 - DNA, 121 bp, Artificial Sequence
  Synthesized
  misc_feature (61): n=t or c
aaaaaaaggcaagtgctctcctgaagtagtttcaggcatgtttcttcaggcatatgcttgnaatgccatatgagtacacttcagttattcattatagttgttctttggggtgattgggtca

SEQ ID NO: 30047 - DNA, 121 bp, Artificial Sequence
  Synthesized
  misc_feature (61): n=t or c
ctcttcccagcacggtctggtggctccaaccccatcctctgcaatatctccatcagtgagngaccgaggcaggtgctgagatttcaaactgttgttcttatttgcctccagatcttcctcc

SEQ ID NO: 30048 - DNA, 121 bp, Artificial Sequence
  Synthesized
  misc_feature (61): n=a or g
acctaatcaaatcaattaaacatcattattagagagataacattaagatagtacctggagnccttaacaaagaagaggacccctccttgtgccaggcgagctttatgtacaaagggagcag

SEQ ID NO: 30049 - DNA, 121 bp, Artificial Sequence
  Synthesized
  misc_feature (61): n=t or c
gtctgcaaaaagactttttatacacatgcaatatttctctccataaatgactgagataccntgcaattcaaacctcagtatccctccagctgaaagcttcgatgtgtctacctcagtattt

SEQ ID NO: 30050 - DNA, 121 bp, Artificial Sequence
  Synthesized
  misc_feature (61): n=a or g
tcctgtcccgatactacaactgcacagacttactgttcatgctcagaaaaaggaagaaagngcaagcagtatttcaaaacacagcaaaacgcctgtttaggggcttgtttttcatttaata

SEQ ID NO: 30051 - DNA, 121 bp, Artificial Sequence
  Synthesized
  misc_feature (61): n=t or c
aagaagcttaaaatttgagcacttgtaagtagcagaatctttctgccacacagcatgacangagctacggccattgctgttagtggcctccctaaagtctttaaatacatccatggatatc

SEQ ID NO: 30052 - DNA, 121 bp, Artificial Sequence
  Synthesized
  misc_feature (61): n=t or c
tttgtcagaatgactttgagctagatgagctgcctcctgtaaaacacaaacctttgtaagnttagctttacatcctcacaactacttgttaacaattgtctcaactttctacattagctgt

SEQ ID NO: 30053 - DNA, 121 bp, Artificial Sequence
  Synthesized
  misc_feature (61): n=t or c
ccacaaatgattcacattatcatacagataccttaaatggcaataaattaaagaacagaangcatgtcctcatagagaggacatcagaaagataactgcaacttaaattttgtaggtttag

SEQ ID NO: 30054 - DNA, 121 bp, Artificial Sequence
  Synthesized
  misc_feature (61): n=t or c
aacaggtttaaagatgagacccagacccaggagggagcaagactgcagtaggcaaaagctngtctgaactactgggtttgtcagctgtgactttggctctgctaaggggttgaatactctt

SEQ ID NO: 30055 - DNA, 121 bp, Artificial Sequence
  Synthesized
  misc_feature (61): n=a or c
atgctgtatttagctttataatcatgctatcgttatcagcaatacccagaaatagttacanaatttttaaaggttctttacataaaaaaattaacacatttaaacaggtggactaccacat

SEQ ID NO: 30056 - DNA, 121 bp, Artificial Sequence
  Synthesized
  misc_feature (61): n=a or t
ctgcatgaaagggacagcagaaggatcagagagatggcgaatataggaggataaagggacntgtaaaagtactcccgacacatacactgcaagtattttcaatactttgactctacacgca

SEQ ID NO: 30057 - DNA, 121 bp, Artificial Sequence
  Synthesized
  misc_feature (61): n=t or c
gcagacaaagttgaacccagcctctgcaccgatccaaagcactgttagtcctgctgcctgntaagattctttctaccctgcaggtcagaggagtacgtggaccagcgttacaaggagtatt

SEQ ID NO: 30058 - DNA, 121 bp, Artificial Sequence
  Synthesized
  misc_feature (61): n=a or g
cctaatccttctatccacttatttggactccttgaggagacacttctgaatacagaatgcnttaattacttttttctccttccagtgcccttacatcatcctcccatttccccgctgttca

SEQ ID NO: 30059 - DNA, 121 bp, Artificial Sequence
  Synthesized
  misc_feature (61): n=a or c
ctcctatcacatcatcttttgcctacctctacaaggaggcacttcagtaaagagaggctantgcaaaactatctcacagaaactatttctattagccaaaagggaaactcctgctatttca

SEQ ID NO: 30060 - DNA, 121 bp, Artificial Sequence
  Synthesized
  misc_feature (61): n=a or g
aaaacagtggtacaacaagcatctcagttttctttaataaaattgcttcccagtgaaattnctatcatgttggtaaagtaataatggaaaagttctttgtgaatgacagtagaatacactg

SEQ ID NO: 30061 - DNA, 121 bp, Artificial Sequence
  Synthesized
  misc_feature (61): n=a or t
aaataaaagtagaagactctagctttatataattggaaccttggctaattgctatcctctnggatattaggacagaaaagtgcttgcaagcattcttgctggaagaacagcggtctgggtt

SEQ ID NO: 30062 - DNA, 121 bp, Artificial Sequence
  Synthesized
  misc_feature (61): n=t or g
cactccttaaatctgaataaccaaaacaatagaatgcttttatttagtttgacttcgttgntgtataacaggtgatgtttccatagaactatatgaaacagtgaattcatatgttagtttg

SEQ ID NO: 30063 - DNA, 121 bp, Artificial Sequence
  Synthesized
  misc_feature (61): n=t or c
gagaaaggaaatggtaagggagagaatccgaacaccaaaacaccctgccaccacgtgtggnttttctgacctgtcacattttatggataaagcccatccgaaatgatactgtgacgcagtt

SEQ ID NO: 30064 - DNA, 121 bp, Artificial Sequence
  Synthesized
  misc_feature (61): n=a or t
tcttccccagggtaaaaggggaaggaacagcaatggaaagcaaacactgggatgtcctcanctttcacacaagatcttacctttcctattacaaaatactttacaagactattacgatgga

SEQ ID NO: 30065 - DNA, 121 bp, Artificial Sequence
  Synthesized
  misc_feature (61): n=a or g
tccttcctgtaatcacactactgatttcagagctttctcttgggaccaaggctccctgacncatgtagtagcatgatggtattgcctgaattattccccatcctaacaccagtgcatgtca

SEQ ID NO: 30066 - DNA, 121 bp, Artificial Sequence
  Synthesized
  misc_feature (61): n=t or c
gtgtttttactcagggacactggtgaagtcaacatataccagatggtagcacagccattanagcatctaaataaatactcaagttactgagttcacacctgcaaatcaggagttgacctac

SEQ ID NO: 30067 - DNA, 121 bp, Artificial Sequence
  Synthesized
  misc_feature (61): n=t or c
ttgggtaactcagagcttggagatcccccaccacggcacaatgaggctgaagttttggagnagggaattacctccatttccaggcggtggctcgcagggcccactgcaggtgtgcagaact

SEQ ID NO: 30068 - DNA, 121 bp, Artificial Sequence
  Synthesized
  misc_feature (61): n=t or c
taaaataaataaacctgacacagaaggatatcctggtttttgtgaatctgaaatctgttangtgccaggttttacaccgaaatcaatttcaggggatcaaacccctattcattaacttctc

SEQ ID NO: 30069 - DNA, 121 bp, Artificial Sequence
  Synthesized
  misc_feature (61): n=a or g
tgaacactgtaactctttccaacatcttggtaaaaagcattgcatgcaaactattatatcntttgtcagaaagataactaaaatgttgtcaggcaactgcatgaatgtttgagtcatgagg

SEQ ID NO: 30070 - DNA, 121 bp, Artificial Sequence
  Synthesized
  misc_feature (61): n=t or c
tcaagtcatcagcgtgtcctttgattagctgaggtacgcgcctttgagaccaaggtgtccngaaatatccttggactgcagcacgggaagacagtgtgtctgtcggaatagcagttgagtc

SEQ ID NO: 30071 - DNA, 121 bp, Artificial Sequence
  Synthesized
  misc_feature (61): n=a or g
tttcagtgttctgactgccacctgcgcctgtaggtttcatgatgatttaactttcattagncttctgttacaaactatgttttgattctagtttcttttagtctacactgggttacctgga

SEQ ID NO: 30072 - DNA, 121 bp, Artificial Sequence
  Synthesized
  misc_feature (61): n=t or g
taagggtgtttggaaaagtcagcctggagcataatcactcagcactactggaaccccagcngggagaggaaactggatcaggaatagggagatgagagccagggagaacctacgaatggga

SEQ ID NO: 30073 - DNA, 121 bp, Artificial Sequence
  Synthesized
  misc_feature (61): n=a or g
cttccatcaccttggcttttaatttagagggcaggttgttttgtctgtcattcatcttagncaattttcaaactcttctgtgtcctgaactttcctaggaggaactttgctctgtatttac

SEQ ID NO: 30074 - DNA, 121 bp, Artificial Sequence
  Synthesized
  misc_feature (61): n=t or c
gctatgccctgtaattattagccatcacacgcgtgaagcctctcagttgctcctatgctgnatctctctttggttatgatgtccttcttgcagttctgttcctcacttttccataatcaga

SEQ ID NO: 30075 - DNA, 121 bp, Artificial Sequence
  Synthesized
  misc_feature (61): n=t or c
tgaaaaccaacaaaagccgatatttttacatccaatgcaaggaacgtttctcctgtgacangcttttacagcatctctatcttttataccacagaaaccacgactgaatcagacagttcca

SEQ ID NO: 30076 - DNA, 121 bp, Artificial Sequence
  Synthesized
  misc_feature (61): n=a or c
tagtcaacaatgaatcttttgtgtgtcttacaatgctatcatgctaaaaacacaaacatcngtagactaagctattaggaaacacatatgcaggtgctgtactgaacaactttatataaac

SEQ ID NO: 30077 - DNA, 121 bp, Artificial Sequence
  Synthesized
  misc_feature (61): n=a or g
gactgccgtatgaagaagccatacctcagtgtgagtggaagagagctgtatggcgatatcngacatggaaatcgtgcgtctgggctgagaagtgccgtttgcatgttcctgccacagtccc

SEQ ID NO: 30078 - DNA, 121 bp, Artificial Sequence
  Synthesized
  misc_feature (61): n=t or c
tactatcttctgttggaaagtgtacagtcttgaaaataaacttagtgctgttgttccaagnggaattatcatgagtccagcaaaagttccattattttctgttttgttctctttcataact

SEQ ID NO: 30079 - DNA, 121 bp, Artificial Sequence
  Synthesized
  misc_feature (61): n=t or c
tttccgcgatgaaatcccgccgaccaaccgctctgtgccggcgcaatccttttccctgcangcccacgttaagggcacgtgagagtttctggtagcactccgcatcttcacatcgccacca

SEQ ID NO: 30080 - DNA, 121 bp, Artificial Sequence
  Synthesized
  misc_feature (61): n=a or g
ctcagtaccaaacaggctcttcatttgcttttctgcttgggtagtgtttttcacaggactnctgtaatgcaagactcagattattttccagttttttacaaaaaggtgaaatcagagatgc

SEQ ID NO: 30081 - DNA, 121 bp, Artificial Sequence
  Synthesized
  misc_feature (61): n=a or g
ctgtttgagatgccctagggtaccccacctggactgcgtttgcacttcaagaaaaacacanggtgtcttaagctctgtgccatatctgctggctccatcttactactgcatggtactgcag

SEQ ID NO: 30082 - DNA, 121 bp, Artificial Sequence
  Synthesized
  misc_feature (61): n=t or c
attctttaatttgcagtacagtcattactgtgtattcagatgctaaaggtcttctagaccngtaagatttgtgcaattaaaatatgcccttactttttttttcatttaaagcctgaagagt

SEQ ID NO: 30083 - DNA, 121 bp, Artificial Sequence
  Synthesized
  misc_feature (61): n=a or g
ccttagtggtgctctacacacctcaactgcctaaagagttgtgctgaaatgcagtaccacncagggtgatgtgaatggaggcactcactcctatgggcaagtggctgaggagccctgtcag

SEQ ID NO: 30084 - DNA, 121 bp, Artificial Sequence
  Synthesized
  misc_feature (61): n=a or g
caaggatgcagtcaactacttgtatgaacaagtctccttttcatatttgcttgggatgctngctgtagtatatttgtcacattatttgaaaccatggccaggtaggatgccacttcttact

SEQ ID NO: 30085 - DNA, 121 bp, Artificial Sequence
  Synthesized
  misc_feature (61): n=t or c
ggaattacagcaactttcagggaaataattttgtctcattagcattcataatccagctganacaagacaatctctggctgcctttgttaccaggcctacctcaggtctctctcacggctct

SEQ ID NO: 30086 - DNA, 121 bp, Artificial Sequence
  Synthesized
  misc_feature (61): n=a or g
ctgagcacagaggtcaggtttcattccagcattgcagtgttccattgcttctcagctcagntcaagcaaggcacagagggtagaagcaggacccaggccaaaggggcttagatgggaggtc

SEQ ID NO: 30087 - DNA, 121 bp, Artificial Sequence
  Synthesized
  misc_feature (61): n=a or g
ggattttacagcttctttcctatttcactgggacctgtggtcggagaatagtgttatttgncataagttgtcatagttccctgatctggtcctgagaaaactagttctcccatcacatccg

SEQ ID NO: 30088 - DNA, 121 bp, Artificial Sequence
  Synthesized
  misc_feature (61): n=t or c
gtctgagtgagcagtggtatattacaaatctcaaagcaaaatacgtctcgccatcacatancagcatggataccacagcagtcaagacattatctcaactgtatttaaatcacaaatatca

SEQ ID NO: 30089 - DNA, 121 bp, Artificial Sequence
  Synthesized
  misc_feature (61): n=a or g
tttcagaccaaaattgctttaagttcaaattcttgtggttcgcttatttagtagtcctcangggacatcccttctggatacctgagtctcacttgaatccatttaaacttgtggcatcaca

SEQ ID NO: 30090 - DNA, 121 bp, Artificial Sequence
  Synthesized
  misc_feature (61): n=t or c
accacaatgctaggattgtaacctgcttcctctacaaagccttctactgttcaactgcaanggagttgtgcagctgatttgttcggaaagtgctgtacttactttgaaggcagggagagga

SEQ ID NO: 30091 - DNA, 121 bp, Artificial Sequence
  Synthesized
  misc_feature (61): n=t or c
agtgttagactgttttcaatactgatagcagtccctgaagcattcttcaggtagggaccgnttgctaaatcattaaggaaaggcaaagtgaacaccccaaaacacaagcaagttctcaggt

SEQ ID NO: 30092 - DNA, 121 bp, Artificial Sequence
  Synthesized
  misc_feature (61): n=t or c
ctgcctgaacataaatgaatgacttgcgaatgcctatcatggcaattgcagtggtatattnaccttctggtcaattaacattttcatatttacagattattcctgaaaggtccacagaagg

SEQ ID NO: 30093 - DNA, 121 bp, Artificial Sequence
  Synthesized
  misc_feature (61): n=a or g
gaaaatctgataaatggactcctaagaatggaccttgtaagattcatcagcttcagatacntgcagctccattgatatcaggtatttacatataataaatctgtgatattttgaaaagtat

SEQ ID NO: 30094 - DNA, 121 bp, Artificial Sequence
  Synthesized
  misc_feature (61): n=a or t
tcactaacagtacaagcagaatatgaccatctttgataactcagcaccggtatatgatatncataacgaaagcttcaattatacattcagaaatatattcttgaaaatattttaccagaga

SEQ ID NO: 30095 - DNA, 121 bp, Artificial Sequence
  Synthesized
  misc_feature (61): n=a or c
atagggtttatcttttgaatctgcgtggtagaaatgaatttttgttaatatgaaaaatganagtgaatatattaaagcagaaagataatgtcacgatgagtgttgcagaaatggatgactc

SEQ ID NO: 30096 - DNA, 121 bp, Artificial Sequence
  Synthesized
  misc_feature (61): n=t or c
gctgctcctgcagaggttcctgttctgagctcatgtgcagagcagcagctcattgctcctntgagaaggcagtgtcctgaaggtgtgtgtgcagtgctctgataacgttgctctcctcttg

SEQ ID NO: 30097 - DNA, 121 bp, Artificial Sequence
  Synthesized
  misc_feature (61): n=c or g
cagagattaaagaagtttcctttatttctgtctttagaaatgctatggactctgataaagncagcacatggctctattagtttatttgcaccaaagcatttcagcgtgtagttggctgttc

SEQ ID NO: 30098 - DNA, 121 bp, Artificial Sequence
  Synthesized
  misc_feature (61): n=a or g
tggtgcaatcagaaaagaggtttcatgggcagaacagagcccagcaaaggcgaccaaggcngatgtgaaaccagtagaaattgtccatttatttattctctggcatgtttgtttataaacc

SEQ ID NO: 30099 - DNA, 121 bp, Artificial Sequence
  Synthesized
  misc_feature (61): n=t or c
cattctatagtggcaatatgaagccaatgcaagtatagcaacttatccagccagtattagngttgtcaaatgaaagctaacagaaaaatacctgattcctgcacatttcttttacaacatg

SEQ ID NO: 30100 - DNA, 121 bp, Artificial Sequence
  Synthesized
  misc_feature (61): n=t or c
agagtgcaaggtgagcaacatccagccccctgcatgcaggaaaacccatccgcatccaacnccccatttcttccaccagcacctcaaggatgggatgaaggcagcaagaaaccgcagcatc

SEQ ID NO: 30101 - DNA, 121 bp, Artificial Sequence
  Synthesized
  misc_feature (61): n=t or g
tacattttaaagcagcattctgtatatttgttttagcacatatggaagagctgggtccacngaatggttgatatttttagacctatctccagcaatgagaggttactgacctctatcaaag

SEQ ID NO: 30102 - DNA, 121 bp, Artificial Sequence
  Synthesized
  misc_feature (61): n=a or t
cactccctactgcagtcttctataaatacagactctaagtctacttaacagcattataaanggaagaacttcagctcaagaaagtcattctgtgtcattttttgttggaggtgcaatggag

SEQ ID NO: 30103 - DNA, 121 bp, Artificial Sequence
  Synthesized
  misc_feature (61): n=t or c
cactagctccacatagtgtagaggaaacattcatgtaagagttccccattatcctgacaanaacaagagactgcagaacactgggagcctggcacagccccaggaagggactgtgtgctct

SEQ ID NO: 30104 - DNA, 121 bp, Artificial Sequence
  Synthesized
  misc_feature (61): n=a or g
ttccaaggtcctctcaacccacttgctatgcttctacccactagccatagaaatgcttctntgaacctgaaaggacttcagcataccatgaacaaagcctacaatggaaacctcaaattga

SEQ ID NO: 30105 - DNA, 121 bp, Artificial Sequence
  Synthesized
  misc_feature (61): n=t or g
tagctaatgttaaccagattgctttctctgactgatactttctgaagattactagagcatntttcgtgataatcatttcaaagtagcaattagtaatgaaggcgtatttactgatttgcag

SEQ ID NO: 30106 - DNA, 121 bp, Artificial Sequence
  Synthesized
  misc_feature (61): n=c or g
tggagaccactgtgtatgaagaacgttacactgaaaagatttatcataaaggggccagggntgtgacctgaaatctatttcctgaaacagaaaataaaaattagcaaagattaagtggcaa

SEQ ID NO: 30107 - DNA, 121 bp, Artificial Sequence
  Synthesized
  misc_feature (61): n=a or t
cgtatgtatgggcagattctggtacttactctgatacactttgaacaaaaagtcccattgngcattgatagaaaaagttaaatgggtaggatggagcattttaaccctggatctcttttcc

SEQ ID NO: 30108 - DNA, 121 bp, Artificial Sequence
  Synthesized
  misc_feature (61): n=a or t
gatcaacctctgttatgcagctgggtgtaaaagttgacataactagaagaaacgtttaagnaagaaatcaagataactttcagtagagtctttgggtacctcaggaaataagcattggaca

SEQ ID NO: 30109 - DNA, 121 bp, Artificial Sequence
  Synthesized
  misc_feature (61): n=a or g
cttgtcaaacccaggtgcacaggcaggatgcatccacagatttcaggaagaggtgagaccntgagacctgagaagggtgtattgcatgaggaaaaaaaataaaaatcacacagactagtac

SEQ ID NO: 30110 - DNA, 121 bp, Artificial Sequence
  Synthesized
  misc_feature (61): n=t or c
gctagtgagggatgcccctgcctatggcagggagtttggactagactatccttaaagatcnattccagccaacaccgttctgtgatctatgaatattactggatttaagtaatacaaaaat

SEQ ID NO: 30111 - DNA, 121 bp, Artificial Sequence
  Synthesized
  misc_feature (61): n=a or g
gagaaaaagcctagtgatttggaggtctggtacttagatgtgtgtgaagaaacaccctcanctctgtaaagagaccattctgcagtggttaatttacatttttcttgtattaggttgatta

SEQ ID NO: 30112 - DNA, 121 bp, Artificial Sequence
  Synthesized
  misc_feature (61): n=a or g
ggagagccaacttgttgatatcagcaacaactctcctcagtcctttacagagtggagaagntttttgctgtttgaaagtttcaagtgttcatttttggcagacctttcagcagagcagttt

SEQ ID NO: 30113 - DNA, 121 bp, Artificial Sequence
  Synthesized
  misc_feature (61): n=t or g
ttgcattaactgtctgtacttcaaatgtcagtgagcgcttatatctgcaaggaactttcantcagtttagacataataaaataccaagattttgcaagtataaaaatcaaaaagttgaaga

SEQ ID NO: 30114 - DNA, 121 bp, Artificial Sequence
  Synthesized
  misc_feature (61): n=t or c
agatgtacgtggagatctgcagatccgtgagtgagggacagaaagggagggagtgagaaangcgggggtttgttaaaacaacagacatacctatggatcagagtttgaaggcactactgaa

SEQ ID NO: 30115 - DNA, 121 bp, Artificial Sequence
  Synthesized
  misc_feature (61): n=a or g
cctaaatcccagccagcagctggccatcgctgtgctgtcgctcaccctgggcaccttcacngtcctagagaacctcctggtcctgtgtgttatcctccactcccgaagcctgcgatgtaga

SEQ ID NO: 30116 - DNA, 121 bp, Artificial Sequence
  Synthesized
  misc_feature (61): n=t or c
gagtctaacttttggctccacatcacagtcttttatgagctgttaaagtgcccattatcantaatggagattttattgtttcagaagatatgtcaaactcacctgggctgtttcagttgcc

SEQ ID NO: 30117 - DNA, 121 bp, Artificial Sequence
  Synthesized
  misc_feature (61): n=a or g
cagttggtttcggcctgggctgagctgcttctgtgatgaaggtttcgctctgcagaagccnttcgtagctgcgtgcataaggcagagggtgttttgtgtgtatatgcttaaaggagaaggg

SEQ ID NO: 30118 - DNA, 121 bp, Artificial Sequence
  Synthesized
  misc_feature (61): n=a or g
gctctgttttggagagactcgtcttccatcctgaacttagctcagtgcccaccatagctcngtgcccaccggctggtattgcacatgccttcctgcctctttgttggcttattttggaggt

SEQ ID NO: 30119 - DNA, 121 bp, Artificial Sequence
  Synthesized
  misc_feature (61): n=t or c
gaagggcacgctgagcctgagtgcagcaagtttcccatttcccagagatttccaagttggntttggctttcgaacgatggcgtcgactggaacgctcttaagttacaatctatgggtatga

SEQ ID NO: 30120 - DNA, 121 bp, Artificial Sequence
  Synthesized
  misc_feature (61): n=t or g
agtattgaacatatatacttgcaatgcactacaggtatttttatcaagagtactgcatatnagaagtggtctgtgtttgtgcaaagaaaaaaaaagctctattttgagactacaaaattac

SEQ ID NO: 30121 - DNA, 121 bp, Artificial Sequence
  Synthesized
  misc_feature (61): n=a or c
atgatgaaggttgaaccctcatggggggctttgcctattgccaagagacactgcagtcttncccccttggccctgggatgtttgcttgcttggagggggagaaataagataaaggggagaa

SEQ ID NO: 30122 - DNA, 121 bp, Artificial Sequence
  Synthesized
  misc_feature (61): n=c or g
gaagaagcttgagccagagactgtgtgtgtctcctagcacagagaatttgatctctctttngatcttaaatgctggagaaataagtctggcagtgaatataagaaaagaggaaacttcagg

SEQ ID NO: 30123 - DNA, 121 bp, Artificial Sequence
  Synthesized
  misc_feature (61): n=a or g
agaggatgagttggattccagcaagaagcaacgcaggaactgaatgagggtttccttatcngcaaacttgttcagctggttcaccagagctgtacacagctggtcctcctgactgcctgaa

SEQ ID NO: 30124 - DNA, 121 bp, Artificial Sequence
  Synthesized
  misc_feature (61): n=t or c
tatactgagaatgtaacaacaatgtctaaatcaattatacatcctgttggaatactctccncaaaaagcaatacagaaatagatgacactaagatccaagcagcaaaaacaaggcacgtat

SEQ ID NO: 30125 - DNA, 121 bp, Artificial Sequence
  Synthesized
  misc_feature (61): n=t or c
ccagcccatctccaaactggataaaagaccctaaattacagaactgccacaactctaccgnggagaaaatggtcagccaaactttcagtgcgtctcttctgcagaagtggtatggggccat

SEQ ID NO: 30126 - DNA, 121 bp, Artificial Sequence
  Synthesized
  misc_feature (61): n=c or g
tccagggatggtgtgctgccatcctgagggactccactgggttatagggatgggccaagangaacctcatgcagctcagcagggccatagcaaggccccatggatgtactggggccaatgg

SEQ ID NO: 30127 - DNA, 121 bp, Artificial Sequence
  Synthesized
  misc_feature (61): n=t or g
tgcatccctatctcttatttttctgtttttggttaatcgttagatatctaaattgttccangccagttaagttcattcctttggcggattttgctcatcatcatctattaaaaatctgctc

SEQ ID NO: 30128 - DNA, 121 bp, Artificial Sequence
  Synthesized
  misc_feature (61): n=t or c
tgtctggcagtatgctagtacagctctgcttttttattacacctccagtacatatgtctcngatgctgctaagtaattcttcttactagaagtcctaaaatcacacttcattgtgtcccaa

SEQ ID NO: 30129 - DNA, 121 bp, Artificial Sequence
  Synthesized
  misc_feature (61): n=a or g
ccaggtctgttcatgttagatacttccttcagcatttgagtacttcatagtctttaaaccnttttagactggtgactcctttctgacacaaggaagtaccagtcttatttttctcatcatg

SEQ ID NO: 30130 - DNA, 121 bp, Artificial Sequence
  Synthesized
  misc_feature (61): n=a or g
tacagtattttgcttttgctgaagtgttaagaaaacagaaataaaactgaacaccaacacncaagtggtgtgatataacaggcaacagattctaaagacaatgtatttttttggaaaaaga

SEQ ID NO: 30131 - DNA, 121 bp, Artificial Sequence
  Synthesized
  misc_feature (61): n=a or g
attgcagaagaacacatcattctccccaaggatgctcaaagttaagaggagttcaagggcngactgtacaaatactgcaagagaaatctctagaaatgaccaaaacacagaaaatgtagaa

SEQ ID NO: 30132 - DNA, 121 bp, Artificial Sequence
  Synthesized
  misc_feature (61): n=c or g
ttctctctggcctccataactacgtttcaacagatttcaggcatgccattagctacagcantggatggaaatctctgtattaaatttacctttagagatctgaagagtaagcccactcttt

SEQ ID NO: 30133 - DNA, 121 bp, Artificial Sequence
  Synthesized
  misc_feature (61): n=a or g
tcccaggtacatctccaggagttacaaccgcagctatttgccttttagttctaagctctcngccttcaagttctcttaagatagaaacacatggtcagttggctcagctctttggctcctc

SEQ ID NO: 30134 - DNA, 121 bp, Artificial Sequence
  Synthesized
  misc_feature (61): n=t or g
gtcgtaactaacaatagcatatatctgtgaggtttttatgtatttagttagctagcacagnagtgtaatgctaattgcatgtgagctatttaagcagtttagcagattgtctgagtggaac

SEQ ID NO: 30135 - DNA, 121 bp, Artificial Sequence
  Synthesized
  misc_feature (61): n=t or g
tctacatcacacaccttgcaattacagcccttacagacataattacaatttccttgacttnttcctattatatttagaaaactataatttttgcattacatgtgtatggacccagttcatt

SEQ ID NO: 30136 - DNA, 121 bp, Artificial Sequence
  Synthesized
  misc_feature (61): n=a or g
ttttcttaggtcccgttcttaaaaaggagagaatctagttcaatgtatttagtatgaatanactatgtttcttgcactaccactgatttaatcttaaaattagaaatatacatgcattaac

SEQ ID NO: 30137 - DNA, 121 bp, Artificial Sequence
  Synthesized
  misc_feature (61): n=a or g
gcagggcaaacagctgcagaaagcactaagctttcccaggttagcctcacccaggcctacnattgccaaatctccaactaaaacttgaattaacttctatcaaaaacaactctattggtct

SEQ ID NO: 30138 - DNA, 121 bp, Artificial Sequence
  Synthesized
  misc_feature (61): n=t or c
ggccttgggacacaacgggtaacagccacaatgcaccgcttccaccctgaaggttaaaagnaagcaaaaggtgagcgcgacatcagggagccaaaaacttcctttggtgcaggaccatgga

SEQ ID NO: 30139 - DNA, 121 bp, Artificial Sequence
  Synthesized
  misc_feature (61): n=a or t
cagacagacatgttgaactatgttctgaagttcaggtacttatccaaaactaatttaatgntcccactatacaaacatgccatatctcttgatgcctgccaaattttgttccaacagctaa

SEQ ID NO: 30140 - DNA, 121 bp, Artificial Sequence
  Synthesized
  misc_feature (61): n=c or g
acaggcaagtgggactttagctcatcctccatctctttgcaaaatgaattgtagtgccccntgagcaaataatggtcccaatgtacataattttgtcccaagatgtgagagtagcagctga

SEQ ID NO: 30141 - DNA, 121 bp, Artificial Sequence
  Synthesized
  misc_feature (61): n=t or c
agctgcccatctgtgtgaagccaccacagacataaaaaatatgctcgtagaactcttgtgnacatatgcatagctgttacagaaaagacattggtttctccaaaatatgttttgttgcagt

SEQ ID NO: 30142 - DNA, 121 bp, Artificial Sequence
  Synthesized
  misc_feature (61): n=a or g
tgtcttgtatattgagccagcataaatctgccacggtcagtgaaactcattgcatcaggcncagtacaaaataagactaaaaagtatggagtgttgaaaatgtactacactctgctcttac

SEQ ID NO: 30143 - DNA, 121 bp, Artificial Sequence
  Synthesized
  misc_feature (61): n=t or c
ttttcccccacaggaacaattagtaatttgcctccatttcacttaatttccttcaagaaanacgtttggaaaccagcctgtgtctgagccgtcaccccactcgctgcagtggagaaatgat

SEQ ID NO: 30144 - DNA, 121 bp, Artificial Sequence
  Synthesized
  misc_feature (61): n=a or g
tgattccctctatgctgataatggggcaactttgaaatctgtcttctctctacatgctagngagctttctcacttactgagttgtctctcaaaattttattttgtcagagaaaaatgtaga

SEQ ID NO: 30145 - DNA, 121 bp, Artificial Sequence
  Synthesized
  misc_feature (61): n=a or g
ctttccttatgtcctttcctgaaggccaaaaatgggttaggaatactctaaatgtaacagntcagtaaaaatgagttcatcttgagagtgggcagtaagttatatatgtgtattagctgct

SEQ ID NO: 30146 - DNA, 121 bp, Artificial Sequence
  Synthesized
  misc_feature (61): n=a or g
tgggtgtactcacagcaaatcattgctaacactatcacaaagcagcctctcaccagcacgnagttaggcatttacaataaagcatatctagaatccaagagtctgcaaccacctcttatat

SEQ ID NO: 30147 - DNA, 121 bp, Artificial Sequence
  Synthesized
  misc_feature (61): n=t or c
tagatagcacttaatagtagcttgtctacaaaaccatcttaacaccaacatgagatgatgngataatagccagagcatggagccttgtgctcccaatgcatgtgtctctgtcagacaggaa

SEQ ID NO: 30148 - DNA, 121 bp, Artificial Sequence
  Synthesized
  misc_feature (61): n=t or c
tcctattacctgtagaaattgccggtaatacttagcggaggaagcatttcacatcacaggntggaagatctctgaagcttatcaataccggttaagccagagatgaaataccacaatggaa

SEQ ID NO: 30149 - DNA, 121 bp, Artificial Sequence
  Synthesized
  misc_feature (61): n=a or g
ttgctcctcctggaggtttgactgcattgcaggaaaaagcttagcccaaggcttttgcacngtgagctttcatgatccacacaaaatgagacaaccagcataggaagaactcagtctttat

SEQ ID NO: 30150 - DNA, 121 bp, Artificial Sequence
  Synthesized
  misc_feature (61): n=a or g
tgcgtctggtgtgacctcgtggcccgatctcattgcctgcaattttactgtgctgatcacntgctcttttttggtatatatcttctacatcacgttgtattgtagaatgaaagccagtcca

SEQ ID NO: 30151 - DNA, 121 bp, Artificial Sequence
  Synthesized
  misc_feature (61): n=t or g
ctatcacctcttctgttaagtaataggtgaataatgcagagtattacaattgaagaaaatnccactgtccactatgtgtgggtgcatgtgaatataaacacatatataagcacacacataa

SEQ ID NO: 30152 - DNA, 121 bp, Artificial Sequence
  Synthesized
  misc_feature (61): n=t or g
actggcatatcccaagggcatgtatgcgcagcagatattttcatataccctgaacataganaagctgaaaccagctagcctgtgttacgaagttttgctggggtctgcaccatggaaaggc

SEQ ID NO: 30153 - DNA, 121 bp, Artificial Sequence
  Synthesized
  misc_feature (61): n=a or g
tggagctcagctcaagctgtggacgctgttgcttttcacttgggtgccttcagtgcactcngcagcacggcagctttgccactggtgtttagtctaggcttggcatatggcatcagctttg

SEQ ID NO: 30154 - DNA, 121 bp, Artificial Sequence
  Synthesized
  misc_feature (61): n=t or g
gcccagtataaaagcataaccttgggtgagcgatggtctggcagcttagaggagtgggctntacttgttaatttctttaccctctccttctcaaaagcattcacaactgagaatcaggaag

SEQ ID NO: 30155 - DNA, 121 bp, Artificial Sequence
  Synthesized
  misc_feature (61): n=t or c
actcgaagctggggggggggtcaataccccgcccaatgcgaggtacatggcctgcagatantgtggtcaacactccggtttttgttgtgaagggaaccttaatcatagcaaatctggctcc

SEQ ID NO: 30156 - DNA, 121 bp, Artificial Sequence
  Synthesized
  misc_feature (61): n=a or c
actagtgacatactgtgaatgacatatgttcagaaaagcttctttggaggcatagaagggntctgaaaacaggtacagaagcagctatggtccctcctatattcatgaataactttatgag

SEQ ID NO: 30157 - DNA, 121 bp, Artificial Sequence
  Synthesized
  misc_feature (61): n=c or g
atgctttgctatgccaagtctgttccagccaatagaatttgtatgctgttgcatgcttttntttcaaactgttgttgggtatgccagagctctcctgtacctttctcaaaactgcagaatg

SEQ ID NO: 30158 - DNA, 121 bp, Artificial Sequence
  Synthesized
  misc_feature (61): n=t or c
attcactagtcctctgccaatagggcatgcagattcctacaatctgagaattcattgttanctgcagccacaaaatatctcaatatctcagctataagaagcaatgtttaagagaattact

SEQ ID NO: 30159 - DNA, 121 bp, Artificial Sequence
  Synthesized
  misc_feature (61): n=a or g
gatttggacagcaaaacactgcacacttgctcacaccgccaaataactggaaatccagccntgcttctcactgccgcgttggtgtttggaccggagaacggtgagttggggagcagcacat

SEQ ID NO: 30160 - DNA, 121 bp, Artificial Sequence
  Synthesized
  misc_feature (61): n=t or g
taatgcttataagactataagcatttcaaagagtacaggtgccagcacagattttcattgntatgccaataactaactacttctctgtaacttaagttaactatttatttctaccctttct

SEQ ID NO: 30161 - DNA, 121 bp, Artificial Sequence
  Synthesized
  misc_feature (61): n=a or g
aacaatcaacaaacaaacaaaaaaactgaagacagactgaacttctgttatacattccccntatgttaatttattttgtcttgattccagttagtaaccttgcagctgtggaagggctggc

SEQ ID NO: 30162 - DNA, 121 bp, Artificial Sequence
  Synthesized
  misc_feature (61): n=t or c
ctacggatcccagcacaggcagagccaagcagaaaagaagattgctggccctgactctaanctcctgtttcagtgctttgagtcaccagtggtcatccaggagacttcagatgtgcagatg

SEQ ID NO: 30163 - DNA, 121 bp, Artificial Sequence
  Synthesized
  misc_feature (61): n=a or t
ttgatcggggaagctcagacagaactatagaactatcttagaaagaacagcaaaggccagncagaaacaactgctgtatagaagaacggtgcaagtaatacaaaaaacaacagctagtaca

SEQ ID NO: 30164 - DNA, 121 bp, Artificial Sequence
  Synthesized
  misc_feature (61): n=a or g
aggagaaagttgtggccttgctggtgctgagttaagcctttgtcatagttgtgatggagtnggatcttacccagttccaaaaaaatctaaggtttgatttataagtttgacctggctgtga

SEQ ID NO: 30165 - DNA, 121 bp, Artificial Sequence
  Synthesized
  misc_feature (61): n=a or g
gcgtcttccgtctgcacgcacgcgtgtgtggggctgcgtagctgtatcctaattacgtacntctcctgatttctctctctttcgggtcccttcgggctgcgctgctcgctgcacgcacctg

SEQ ID NO: 30166 - DNA, 121 bp, Artificial Sequence
  Synthesized
  misc_feature (61): n=a or g
atgatctcttctctacattaagaaaagaaagtattaagatcttgagcagaagatgaggttntgatcgtgatttacatactatttatgcacacaaatcccaccaccacaatcatttctttgt

SEQ ID NO: 30167 - DNA, 121 bp, Artificial Sequence
  Synthesized
  misc_feature (61): n=t or c
gaagacattgcacacacaaatacagaattagtacccaggtctgacccagttactattccangaacttccatgtactgtgaagtacacagttggtgttgctgggacataggattaaatttca

SEQ ID NO: 30168 - DNA, 121 bp, Artificial Sequence
  Synthesized
  misc_feature (61): n=a or g
atcaaaaggaatgttgaataactttccaaagattttggtaaagttgaaatatatgctttcnaacaccctgtggatttcacggaaggaatagataggtattttggtattctggctttcatat

SEQ ID NO: 30169 - DNA, 121 bp, Artificial Sequence
  Synthesized
  misc_feature (61): n=t or c
tctttaccttctagatctcagatttctttcaaaaagaatgttttggttttattcccccacntccaaacatacaatatgaaaagttgaagacttcagtttgttgagcagctactgccgttgc

SEQ ID NO: 30170 - DNA, 121 bp, Artificial Sequence
  Synthesized
  misc_feature (61): n=a or g
cattaacctctgctcaaggagcgccaatgtgagtcacacgttttttgcagcactgagtaanggcacccgttagtgagtaccctcacccaggcaccaggccaagaggcagcgggcaacagca

SEQ ID NO: 30171 - DNA, 121 bp, Artificial Sequence
  Synthesized
  misc_feature (61): n=t or c
gccatgagtaattgtgcatttctcacacgtgactttaaacatttggctattactacgtttngtaaagttcagccctgacttaaattcacatggacatataaaaacccagcagcaccacaga

SEQ ID NO: 30172 - DNA, 121 bp, Artificial Sequence
  Synthesized
  misc_feature (61): n=t or g
tgcttgtttgtttttaaagatactgagaacagtaaacgttctgagtgggacctgtaaacantcagtgttggaaattattttagattcaggactctgcttcccagaactctgcttcaaaggc

SEQ ID NO: 30173 - DNA, 121 bp, Artificial Sequence
  Synthesized
  misc_feature (61): n=a or g
gaatgtgaaatgtaatttaatttgcacatagatttttattgtttagagcggaccctgtaanataacagccttgtttaacaacaatgacattctaaatataaggttttaatatcactcacta

SEQ ID NO: 30174 - DNA, 121 bp, Artificial Sequence
  Synthesized
  misc_feature (61): n=t or c
gtttgttgaaaggagttcctgtacttccagtatttggttaagtggggaagaagtgcattcntgcccacagaaccatccgcccaacttcctatggtagaactgctaatttctgtattggaac

SEQ ID NO: 30175 - DNA, 121 bp, Artificial Sequence
  Synthesized
  misc_feature (61): n=a or g
tctttgtgtgctggtacctttagctcattgccattgctgatgagcttaggctgataatganagcagtgttcaattagtgccgaagcagaatagagacttcttcaaaatatcctctaggggt

SEQ ID NO: 30176 - DNA, 121 bp, Artificial Sequence
  Synthesized
  misc_feature (61): n=a or t
aaaaaaagaacacctccatggtaaaaatactgttgttggcagttgagttcatcagccagcnacactaaaatgagggctacattctcctttgcgctgcaaatgtgctacccccttcctgtag

SEQ ID NO: 30177 - DNA, 121 bp, Artificial Sequence
  Synthesized
  misc_feature (61): n=t or c
aatcttcttatatacagtatacaaaggctactgtgtgccttggttagggaagaatccctcntctcagttgctgactaaactagaaggtagtattgcgcttggagtgacctctgagcttagc

SEQ ID NO: 30178 - DNA, 121 bp, Artificial Sequence
  Synthesized
  misc_feature (61): n=a or g
atgtactgtgtccatttctgagtaaaggagctagaaagatgatgaagaaaagatagctctnttctcatgctctgtgtttctctcctacttaacaactgaaaaatttgtgattcagtgctct

SEQ ID NO: 30179 - DNA, 121 bp, Artificial Sequence
  Synthesized
  misc_feature (61): n=a or g
ccacaggcaccagacatctaggaaccaaaatacctatcaaaaaatcagtaggaccttggcntctttgttcggtgcctgagtcagtcaaatggtttttggcattttcttacagggtttcctg

SEQ ID NO: 30180 - DNA, 121 bp, Artificial Sequence
  Synthesized
  misc_feature (61): n=t or c
cgtttccttttctaacttcataaatttgttttctttattccacaactcccaggaagctctnctggccatttctgccctcgaaaaccttttaaaaattggggtaagagcggcaacttcccct

SEQ ID NO: 30181 - DNA, 121 bp, Artificial Sequence
  Synthesized
  misc_feature (61): n=a or g
tgcggtggctgcaggacccatcatatctgatgttactgaagcatcacaatccagcttaatnaatatgcagtcccctcctgataatgacaggtaaatgtgtttgtgtgtaaaaacaaagaga

SEQ ID NO: 30182 - DNA, 121 bp, Artificial Sequence
  Synthesized
  misc_feature (61): n=t or c
tatgaatgtgtagtagctgaggagaagagcttcacagaattatttgtaaaaggtgagcaanggcagataaagagaacctccccctaacattttgcatcaaattattgtcaaatccgtcttt

SEQ ID NO: 30183 - DNA, 121 bp, Artificial Sequence
  Synthesized
  misc_feature (61): n=t or c
ttttgtggtgaaactcacaaatttgtggagattgcctttgctccaggggtttttcttctcngtctctctccccttctgggctatttttactgttttatatttggcattataaatgtgcttt

SEQ ID NO: 30184 - DNA, 121 bp, Artificial Sequence
  Synthesized
  misc_feature (61): n=a or g
ttcctgttggcaagctctgcaggaatgcttataaagaacaaatatcaaagtgtgacaaccncggctgattacaaatagcaggaacatttgcagagagctgctctgcaaagccggccccgca

SEQ ID NO: 30185 - DNA, 121 bp, Artificial Sequence
  Synthesized
  misc_feature (61): n=a or c
gcctgaggcacgctgcttagagcagaaagcagagcacaggggaaccttcttgctacgtgcngcagtgggtaaccggtgtgagcatagatcagctagaggttaaaattcttttgttgtaagc

SEQ ID NO: 30186 - DNA, 121 bp, Artificial Sequence
  Synthesized
  misc_feature (61): n=a or g
gatctaagcattaatgagactgttttgtagaactcatactactgaagcaaaaaattatgcntatagaaatcatgaaaagttaagtatttcttgaaatctgtggataaattaagtgttctga

SEQ ID NO: 30187 - DNA, 121 bp, Artificial Sequence
  Synthesized
  misc_feature (61): n=t or c
gtcaatagcagctggtaggcaagtgagcacagagaaggtcagcaaggggaaactcatcacnaggataagcctcgggtgaaaggcaaaccacagagcactgaactgctttcacaccagcggt

SEQ ID NO: 30188 - DNA, 121 bp, Artificial Sequence
  Synthesized
  misc_feature (61): n=t or c
tatttattaaattccaaagactgcttctgctggatcaaaaaaagtaatagaaacattagcntcacatccagactagaagtgaaattcagtgtaagtgttgagtttcaatgaatagtttctg

SEQ ID NO: 30189 - DNA, 121 bp, Artificial Sequence
  Synthesized
  misc_feature (61): n=t or c
tacatacttctgggaacagaacacatttgtaatacgtgctgcatctacctggatataacantgtcacagtggttatggccataagagagcaaaagactaccaagccagcaggataggcagc

SEQ ID NO: 30190 - DNA, 121 bp, Artificial Sequence
  Synthesized
  misc_feature (61): n=t or c
aacaaatagataaaaaattagactcaagcacaaaattctgctgtatatgatgcaccatttnatttgtaaagtttatttatgctgtccaactataaccatctaacctaagccactatttttc

SEQ ID NO: 30191 - DNA, 121 bp, Artificial Sequence
  Synthesized
  misc_feature (61): n=t or c
actcatcgacttcgggatcgcccacaagattgaagctgggaatgagttcaagaacatattngggaccccggagttcgtgggtgaggcacagttttgttggggggggggttctctgggctca

SEQ ID NO: 30192 - DNA, 121 bp, Artificial Sequence
  Synthesized
  misc_feature (61): n=t or g
gtggcagtgctgggttcctgcacagtgattccaaccccttaagacagatggaaaggaacanacttggttgtgaagtgctaccaagctccttttatagcaagcactcctaccaggctttttt

SEQ ID NO: 30193 - DNA, 121 bp, Artificial Sequence
  Synthesized
  misc_feature (61): n=a or g
ctcttgttaatgtactatcagcacaataacaagatcttcaaattttgtacaaaaatatttntctataaagttgctatggctacatttgaagtataaaactgttgttctcatggctttgaca

SEQ ID NO: 30194 - DNA, 121 bp, Artificial Sequence
  Synthesized
  misc_feature (61): n=a or c
gacccgttgtgagcatccgtgattgctcctctgtgtgatgggaagtgggagtaacccaccngggacacccaggaacccacagagagcagtcatcaacagcagcggggacccaatgggagca

SEQ ID NO: 30195 - DNA, 121 bp, Artificial Sequence
  Synthesized
  misc_feature (61): n=a or g
aaattgcatgcgctacatataaatgaacatcattagcatttactttcaagaatgccactgncagcaacagtagtacactcattttttctcctttttttgcccctagactcttacttcacac

SEQ ID NO: 30196 - DNA, 121 bp, Artificial Sequence
  Synthesized
  misc_feature (61): n=a or g
gccattttaattccctaaaatctgcatcagcaaatcctagagaggtgagcgtgggacgcanacctctgcctaacggctgggactgcaccgctccccatgtaattcagcaaatgaaagaggt

SEQ ID NO: 30197 - DNA, 121 bp, Artificial Sequence
  Synthesized
  misc_feature (61): n=t or c
ggtcacgtactgcggggtgcacagctctgactgccagctgtgcatcagagggtgtgtttgngggcacttaatggggatgtgctcttggtggagaggaggaaagcactgctgttggtagcac

SEQ ID NO: 30198 - DNA, 121 bp, Artificial Sequence
  Synthesized
  misc_feature (61): n=t or g
aagtgctgggaaatacatctgtgcttttttattgctgggcgggttgtccagggtgctgganagctatgtgagtcagtatggtgtaatagaatggcgccttttccagtaagctggagatctc

SEQ ID NO: 30199 - DNA, 121 bp, Artificial Sequence
  Synthesized
  misc_feature (61): n=a or c
ggagctgcagaaatgcacgttcacagttcacgagccagaccatgggcatcactcaggaganccttccccactgtatttcagctgctggttcgcttcacggatgtgagaatgtttgtattct

SEQ ID NO: 30200 - DNA, 121 bp, Artificial Sequence
  Synthesized
  misc_feature (61): n=t or c
aacgatggagttccattctctctagaccagatgtcagaaacaagcttctatgtcccattgnctccggtgtcactaagcagaaggcagctggccctgtactgaaaggcaagtgagctgctcc

SEQ ID NO: 30201 - DNA, 121 bp, Artificial Sequence
  Synthesized
  misc_feature (61): n=t or g
tgctggtccttcctttcaaagaaactgggcaagtatcctgtttaagagagctgtcttgatngcatctacactcaagccacgataacagccatttaatccatactgaagcctgttttaagga

SEQ ID NO: 30202 - DNA, 121 bp, Artificial Sequence
  Synthesized
  misc_feature (61): n=a or g
tcccaccgctcaggcatccagaggcacacaggctggaaaaagacttatctgccttatttcncataattttggggatgaatattaaccttgcacttatctgttacctccaacggtcagacag

SEQ ID NO: 30203 - DNA, 121 bp, Artificial Sequence
  Synthesized
  misc_feature (61): n=a or g
cagatagctagagcttttgtatctgctttttttctgtcagtgtgtaaagttggattggatncagggtgatctatttacgtatttatacttgtatattttataatcaaattagacactttta

SEQ ID NO: 30204 - DNA, 121 bp, Artificial Sequence
  Synthesized
  misc_feature (61): n=a or g
tctctggaacaaataaaatccatagttgccatgaaaaaacgatagaagcagttcaaaggtngggtctttcaatggtgattaagactggtaattaagcaacttgtggttaacatcaccagga

SEQ ID NO: 30205 - DNA, 121 bp, Artificial Sequence
  Synthesized
  misc_feature (61): n=a or g
atcagaatttttttcaaaaatgggtttacttcagactcaagatggtgtttctggctagagntgttaagagaaagcaatcatttctgcacagctaattaatagttcttactcaggattgcca

SEQ ID NO: 30206 - DNA, 121 bp, Artificial Sequence
  Synthesized
  misc_feature (61): n=c or g
caataactagcataacatcattacagctatcagcagccctgtgcatagcaaactgcagctntttgacagatgacgtgctcatgctattctttaaaaaatgagtttaataatgttaaaaatt

SEQ ID NO: 30207 - DNA, 121 bp, Artificial Sequence
  Synthesized
  misc_feature (61): n=a or g
ctgcaaaactgcatgccagtgtagatgactgaagattgtttttatcagatgatgaagtacnggaatcctcctgtaaaggctcagggaaagagggagagaggcttgcaggagggcagtatct

SEQ ID NO: 30208 - DNA, 121 bp, Artificial Sequence
  Synthesized
  misc_feature (61): n=a or g
aaataaccataagttaaagagtgcgtaatacagatttagaaggaatagacacagcgttgcncgagcatttttaatatccaaaactttcagaaactaaagggttggaagaagaaagtgagtg

SEQ ID NO: 30209 - DNA, 121 bp, Artificial Sequence
  Synthesized
  misc_feature (61): n=c or g
ttttttcacatgcaattttaaattgctgactgatctgtatttttgtccatgttcagttttnccaatagaacttctgtattttgacacacaaaaagtatgcaactttggtaatgtgtttgaa

SEQ ID NO: 30210 - DNA, 121 bp, Artificial Sequence
  Synthesized
  misc_feature (61): n=t or c
tatgttggtgacttggaaaacaatgagataaaaatgcataatgcagaaaaacagggaggangtcacctgcagaagtttcacatcagccagaagaagttaggccaaaataatgcacttactg

SEQ ID NO: 30211 - DNA, 121 bp, Artificial Sequence
  Synthesized
  misc_feature (61): n=a or g
gtcctgacaagctgttttgcaggaggcaaggtcacctctcacgagcagtcagcattgcacntaacacaaggagggtgagccgtctctgcaaagcaaaccttacacctctgtgttgtgctgg

SEQ ID NO: 30212 - DNA, 121 bp, Artificial Sequence
  Synthesized
  misc_feature (61): n=t or c
gtgtgttccaaattcgtgatggatttcagatgttgcaaagctgagtcactgtcactataangtggctaatcttaaggatgagcttcaattccataatatgtcactctaacatttgtacaca

SEQ ID NO: 30213 - DNA, 121 bp, Artificial Sequence
  Synthesized
  misc_feature (61): n=a or g
agagtggctttgaagtgcagataactgattccctctctttgtcccccagttttcaaaagangaatgcaaacgtgttacaaactcccttccttaaatcatcttttctttctcctctcagttt

SEQ ID NO: 30214 - DNA, 121 bp, Artificial Sequence
  Synthesized
  misc_feature (61): n=t or c
tattgggttactgagcaggacgggttattttaatttgagattttcagaaagcaaattacanaaaattagtcaatgctgttgaaaatgtcctttattgctgcactttggtctgcttgcattt

SEQ ID NO: 30215 - DNA, 121 bp, Artificial Sequence
  Synthesized
  misc_feature (61): n=t or c
caaggcagtagcatccaatccagtaagaatgtggttgttagggaagcactgctcttgtcantgtcttcagtgcatcactgggactgcagagttccacttttgctaccagcagggctgttgg

SEQ ID NO: 30216 - DNA, 121 bp, Artificial Sequence
  Synthesized
  misc_feature (61): n=a or c
cagatgtccagcagaactggcaatgacagcaggagcagcttgctcccatctcaggtaacantggaccactgtcctctcaggttggtggtggaagtggaagtagatttcaccagtgtctgaa

SEQ ID NO: 30217 - DNA, 121 bp, Artificial Sequence
  Synthesized
  misc_feature (61): n=a or g
tgctaataccctgcagctaacatggatgctcacacagcaaacaggctgtctgtcccttacncataatgaagaaattaatgatacgtgtttgcatatatagaggtgggggggggggttggag

SEQ ID NO: 30218 - DNA, 121 bp, Artificial Sequence
  Synthesized
  misc_feature (61): n=a or g
atatgcgtgtggtttctcttctctttctcctttatttctaataaccactttgtattaaacntttcatcacagacgtttggtcatctttggtgaatacttgcttgtgttgcagttagtccac

SEQ ID NO: 30219 - DNA, 121 bp, Artificial Sequence
  Synthesized
  misc_feature (61): n=a or t
aatttcaaccagttaaatgtcttttgtttattgttgtttagtaaattccttgttttttcantgaagatggtggaaaagttctactcaagaaacagtaatagtaaaccatttggtgaccact

SEQ ID NO: 30220 - DNA, 121 bp, Artificial Sequence
  Synthesized
  misc_feature (61): n=a or g
taccaacaaatgttaggcactgctgctctccttgcctagttggccattaagaggaggactntcagccttcttcagacaaccatttgatcagcaccagcttgcaatggctcttggctggact

SEQ ID NO: 30221 - DNA, 121 bp, Artificial Sequence
  Synthesized
  misc_feature (61): n=a or g
agaacagaaaaaaaaaaacaaaaaaccctgccatttccctagtctttgtcttgactctacncacttccacactgcctttcccacattagttgctgctatttacaaatcagacagccacatc

SEQ ID NO: 30222 - DNA, 121 bp, Artificial Sequence
  Synthesized
  misc_feature (61): n=a or g
aagggctttttttcagttcaagtaactattatgggacttggtaagaagtcagcttgttctncacagtgaggttcagctacagtggccaacagaattttgctggaatccagagaaaacaaac

SEQ ID NO: 30223 - DNA, 121 bp, Artificial Sequence
  Synthesized
  misc_feature (61): n=a or g
agacgtcccattgttcctttgctgatcagaaatatcccactgtggctgtatacaggcttgncttatctgtctgactcttggacagctaaggaagggtatgatattgacacttttaaatcta

SEQ ID NO: 30224 - DNA, 121 bp, Artificial Sequence
  Synthesized
  misc_feature (61): n=t or c
gcatgtacatttccattgttagaaaagacaactcttaatattcagcttctcctttttcaanacagactctttttaaattgtccaatacaaacttatgtacctgaagagtgactgggctttg

SEQ ID NO: 30225 - DNA, 121 bp, Artificial Sequence
  Synthesized
  misc_feature (61): n=a or g
tgggctgtggaaaatatgcactttaaaaacacttgctatatatactactggagccttgtgncttcagtaaaaataaggccatgaaggagctactcaaacaagaaattgttccttcaggagt

SEQ ID NO: 30226 - DNA, 121 bp, Artificial Sequence
  Synthesized
  misc_feature (61): n=a or g
agtaccgtcagtcactgtggataccttgtctttgttggagatcctgatgttgaatttatangaaatgtatgaaatatgcatctggtcattgtcttttctgctttctttgtatttttgggta

SEQ ID NO: 30227 - DNA, 121 bp, Artificial Sequence
  Synthesized
  misc_feature (61): n=a or g
aatggttttgtgcaggccattgccaatggtgtgtgaacctctctcagcccatccgtggganggaccaggagagagctggcctttttctgccacatctttggtattttgtcttcagaagctt

SEQ ID NO: 30228 - DNA, 121 bp, Artificial Sequence
  Synthesized
  misc_feature (61): n=t or c
attatgaagaaaatccattgcacagtttgtgcctttaaacagaaggcactcccaggtgtanggaggtaccaccaagcaggaagttacattttaaaaattccaaaacagtccacaaaaaaag

SEQ ID NO: 30229 - DNA, 121 bp, Artificial Sequence
  Synthesized
  misc_feature (61): n=a or g
cccgtgctggctgcgctcactgtgcacccgttgcagatggttcgagccctttgttatccantggttggatgagaacgaggaggtgtcgcgggatttcctgcacggagcgctggagcgcgac

SEQ ID NO: 30230 - DNA, 121 bp, Artificial Sequence
  Synthesized
  misc_feature (61): n=a or g
gtataagcaccttcctgatggttctgcctcattaggactgatcaccagaccttaaaccccncagccaatttccccctgctgtacccacccacatctgagctttcatgaagggtttcccaaa

SEQ ID NO: 30231 - DNA, 121 bp, Artificial Sequence
  Synthesized
  misc_feature (61): n=t or c
agttttgctgaatacttaatgttaaactctgtacttacaaaaatgtcctccttttgcaagntggtcaagaatgaagtaaaactgactgatctcctggatactggacatatagtttcctttg

SEQ ID NO: 30232 - DNA, 121 bp, Artificial Sequence
  Synthesized
  misc_feature (61): n=t or c
agccctgagactttcccagccaggtggtggatgtggccccaagtactcacagcttaagganaggacactgcggttgtgtctgctctctgcacaaggtctgtggtaagacaactgtcataca

SEQ ID NO: 30233 - DNA, 121 bp, Artificial Sequence
  Synthesized
  misc_feature (61): n=a or c
tccttgataaatcatttcaattcactgcactgctaggaaattaacctatgaaaagaagaanaagtttttctcctgatttaacactctgaaactgcttaagaggagtgggccaaggagagat

SEQ ID NO: 30234 - DNA, 121 bp, Artificial Sequence
  Synthesized
  misc_feature (61): n=a or g
taggctaggggctctctttgcagtttctgttttgcttccaaatgtgatagtggattttgcntttcttctcatacatcagttacctccagttcctttgtttctataccagttacacttggac

SEQ ID NO: 30235 - DNA, 121 bp, Artificial Sequence
  Synthesized
  misc_feature (61): n=a or g
aatactggagtggtctctaaaaatcactggtactcccagtactaattgatagagatagatncgtgcttatgaggatagatataatgtcagtatatctcagtcttactatgattaatgtagt

SEQ ID NO: 30236 - DNA, 121 bp, Artificial Sequence
  Synthesized
  misc_feature (61): n=t or c
gtacatgatacattgataaatgatacatgatacaatttctcagaagttcttgtcttggcanacttgatatgcatgatgagcagttcaaatcatcgcagttagagaaatgtcatgatgtgaa

SEQ ID NO: 30237 - DNA, 121 bp, Artificial Sequence
  Synthesized
  misc_feature (61): n=a or t
gatgctaaccatagcatctagtcttgtatttgaccagtgctctcaaaaatttagagtaacntaacacactacagactccttttctaatgatctatgtgatgaatcgcactctcaaagcacc

SEQ ID NO: 30238 - DNA, 121 bp, Artificial Sequence
  Synthesized
  misc_feature (61): n=a or g
atctccttgagctcactccagcactccattcccagttgcttcagtgggcaccactgccctntgctcagctcctctgcactttcaccttctcccctttcaaaagctggtactacacacactg

SEQ ID NO: 30239 - DNA, 121 bp, Artificial Sequence
  Synthesized
  misc_feature (61): n=t or c
tctcatctggtggcaaacagtttgcctctggagaaggtgtgggactgggatatgaataganaggctgacatcatgcttcttcttgtcttgattttcctgtagttatctttccactttttac

SEQ ID NO: 30240 - DNA, 121 bp, Artificial Sequence
  Synthesized
  misc_feature (61): n=t or c
cttcaggtaggagcagtgctgtgcccctataaggctgtgtcacgggctgagcaatgggatnggtggagctgagccccagttctccattccctttccccaggggtcctctgaattggtaccg

SEQ ID NO: 30241 - DNA, 121 bp, Artificial Sequence
  Synthesized
  misc_feature (61): n=a or g
gtgcaggtgggtagtgcgtacaatgaggacaatgagccagccgtaagattttcaatctgtnaagtattgcattgcttgcaaatacctttcagacaagctcttagaaaacattaaagaaaat

SEQ ID NO: 30242 - DNA, 121 bp, Artificial Sequence
  Synthesized
  misc_feature (61): n=t or c
atgcaataaatttggcaagaatcatccctgaagaaaaacacaattggttttaccaagcacngttaaaaatgtattttcaatctagtatgtatttctaaagagagatgaacttgggaaaaca

SEQ ID NO: 30243 - DNA, 121 bp, Artificial Sequence
  Synthesized
  misc_feature (61): n=t or c
tccatcctcgttctgaggagacatcaataatatagctcacaaaatgaacatctggaatacntcttaaatatttatgcccataagtctcgttgttgctggggttagtacctgacaaagtgat

SEQ ID NO: 30244 - DNA, 121 bp, Artificial Sequence
  Synthesized
  misc_feature (61): n=a or g
agttccacctcgtatttcagccactaacacgttaaggctcactgaagaattttcatcacancagaacatataccaagtctcattcctgataaagtttcagtcctactgtctgaaacagaag

SEQ ID NO: 30245 - DNA, 121 bp, Artificial Sequence
  Synthesized
  misc_feature (61): n=t or g
tgacgttgtccagaagcaggtgatctaacaccctcttacagccagggttcctgtcatttgntcactccgtgcaatacaaatttttatttgaactccactcgtaggaaataaatgtccatga

SEQ ID NO: 30246 - DNA, 121 bp, Artificial Sequence
  Synthesized
  misc_feature (61): n=a or t
ttacttttcttttttttcccaaaccatataatttacaatcgcaaaaaaagccaaattttantttttcatcccacattgttatctccagctgccaaatatcagtctgcagcttcaaattatg

SEQ ID NO: 30247 - DNA, 121 bp, Artificial Sequence
  Synthesized
  misc_feature (61): n=t or c
tattaccactacactttggagtggatctattttatattcattgtgtgaaaagaggaattgntacaaatggtaaaagagtgcatgtttgtaaatgcccagagccctgcagatcctgctccac

SEQ ID NO: 30248 - DNA, 121 bp, Artificial Sequence
  Synthesized
  misc_feature (61): n=t or c
gagctggctgtgggctcaggagaggggaagtcctgtcctctcactgcccactgtgaacttntgcatcttacttagaaattcagcggccgttggctgcttgcttcttgctcagccaaagatg

SEQ ID NO: 30249 - DNA, 121 bp, Artificial Sequence
  Synthesized
  misc_feature (61): n=t or c
ccgccctctgagtgaagaatttcttcctaacatctaacgtaaatgtccccccctttagttnaaagccattcccaaaacgttacagattgctgcagcaacgagaactattgcttgcagcagg

SEQ ID NO: 30250 - DNA, 121 bp, Artificial Sequence
  Synthesized
  misc_feature (61): n=t or c
gacagaaagcaaagaatggagagtcagctatacagcaacacagaggatccacctcatccanggagcaatggaggcctctgcttctctgactgacttacctccaggtattcatcatgtgcct

SEQ ID NO: 30251 - DNA, 121 bp, Artificial Sequence
  Synthesized
  misc_feature (61): n=a or c
ataaacatccaagtctatggacgttcataaacattaagtgacgttaaccattacaatcttnctgtgataacttcccattgctacatttagaatcatcagaccagaatataagaacatattt

SEQ ID NO: 30252 - DNA, 121 bp, Artificial Sequence
  Synthesized
  misc_feature (61): n=a or g
cttctgctgtcctcaggctttatctctaggaagtcaaagcttctgttaaatagaatatacnctgattggctgtcttctgtactgaactgcatcttgctgagcaccatacggtcttagtttt

SEQ ID NO: 30253 - DNA, 121 bp, Artificial Sequence
  Synthesized
  misc_feature (61): n=a or g
cagctcctggtcctgcaggcaaggtggggaggcgcttgagttgtccactgagccagtttangggcatttatctggactgaatttcagcagctgttattagcactttgcttctgggctgtaa

SEQ ID NO: 30254 - DNA, 121 bp, Artificial Sequence
  Synthesized
  misc_feature (61): n=t or c
gtgaacttgtgagaaattcctgaattcagtgagtggcaggccatgtagagacttatccttngtgaggtaagttttcagattgacagaatggttttatctttggcaagaatagagagtttta

SEQ ID NO: 30255 - DNA, 121 bp, Artificial Sequence
  Synthesized
  misc_feature (61): n=a or t
gacagcagagagaggcactgcacccttctggtcatggttttgtgtgggtctgtctgagtcnagctgcaataagcactcctcattatgagaggaaatacagctggtaataacctgaggtctg

SEQ ID NO: 30256 - DNA, 121 bp, Artificial Sequence
  Synthesized
  misc_feature (61): n=a or g
tgccctgctctgaatacattgcttttgtttggcagtaggctttaggggactggggaaaggntgatttacacttcagtgttcttagaggtaaactacagagctccataaagttcacttccca

SEQ ID NO: 30257 - DNA, 121 bp, Artificial Sequence
  Synthesized
  misc_feature (61): n=t or c
gtttcagcatccccctaccagccccagaaactcacatagcacattggatgttaagcctttncgattctaaatctaaattggagggtttaggtgatggctgaatggtgttaggtttggctgc

SEQ ID NO: 30258 - DNA, 121 bp, Artificial Sequence
  Synthesized
  misc_feature (61): n=t or c
taatatttttcattttgaatggctgtggtttcgtgctgctggtaggattcagaaagtgaantgcagagattttcttatgaatgctctatgtagaggcaagtaactcactgaaagcctcaaa

SEQ ID NO: 30259 - DNA, 121 bp, Artificial Sequence
  Synthesized
  misc_feature (61): n=t or c
tctaaaggttttgagaacaacttatgctgaatttctcctttttccaatctttgtcttctancagtgagcttcagggaaacagaaagttaatgcagataaactttgtggtcaaaatgcccgt

SEQ ID NO: 30260 - DNA, 121 bp, Artificial Sequence
  Synthesized
  misc_feature (61): n=t or c
ttttgtgttgtttaatttgttttggaaaataaataaatgtcagaatgtttaacagcaacantccaactgcggtttcaatctttgagcccatgtattgctgacatgtatgtgagtggttcca

SEQ ID NO: 30261 - DNA, 121 bp, Artificial Sequence
  Synthesized
  misc_feature (61): n=a or t
caaatgcagtaaaaatgtcccaaaaatgtagaatggggggggatgctttttcaactgtganttcttcctgctctccttcagctatcaattttgaaactgccttgtatgaagaaagcacaag

SEQ ID NO: 30262 - DNA, 121 bp, Artificial Sequence
  Synthesized
  misc_feature (61): n=a or t
atgctcaggaataggttgtggttggatgagtctgaccttgcagcgcgtactttggagtttnttcttgtgcaaaaagcactctttggtcttcaaaggtccttgatttaataggagaccaaaa

SEQ ID NO: 30263 - DNA, 121 bp, Artificial Sequence
  Synthesized
  misc_feature (61): n=t or c
catgttttggtggtggtgtttctgttgttttgtttaagaagtcaatcagcttggtacaaantgatatcaagagtaatgcctgggagagcactgacgatccggcttctgctcagctggattt

SEQ ID NO: 30264 - DNA, 121 bp, Artificial Sequence
  Synthesized
  misc_feature (61): n=t or g
attgatagctttagggaaaacattggtaaatgtttatgtttatgaaccacctacttactgngcacttatttctctttcagctctaggaagagaatgtcagtgattgttcgcacgccaacag

SEQ ID NO: 30265 - DNA, 121 bp, Artificial Sequence
  Synthesized
  misc_feature (61): n=a or g
taaagttagttcttctcctaaaaaggaattcttcccatgtttttaactgaatatttgaccngatcacaatgtcttccaaagcagaggaaagctgtttcttgacttcactaggccttggatt

SEQ ID NO: 30266 - DNA, 121 bp, Artificial Sequence
  Synthesized
  misc_feature (61): n=a or t
agcagactgagacttcagcatcatggtcttcttggtgacggtgacctgcatgttgttattngtgcagtcacagaacaatttgttgacacttttactactcaggatttggttggcctggttg

SEQ ID NO: 30267 - DNA, 121 bp, Artificial Sequence
  Synthesized
  misc_feature (61): n=t or c
ccctctctgttatcagtgaattatgtaatgccagtatgtcacccaagatgttttccagtgncccaaaagcaataaatgtcttacaaccaaaattgttctaggacgataaggtacaagatgt

SEQ ID NO: 30268 - DNA, 121 bp, Artificial Sequence
  Synthesized
  misc_feature (61): n=c or g
tgccatattcacaaaatacacatcttttgatctcttattcctcttaaagtaaaagtgatanactattgtatatattgcaaaacccttccctcctttaagaaacataaaagtatacaaatat

SEQ ID NO: 30269 - DNA, 121 bp, Artificial Sequence
  Synthesized
  misc_feature (61): n=a or c
tgctttgttaacctgctaagtccattcctttttactttgttcatatgtctgcgagaattcntagacacaccgtagcttcagagtagtcttgtttttccgttttttttccatgcctgttttt

SEQ ID NO: 30270 - DNA, 121 bp, Artificial Sequence
  Synthesized
  misc_feature (61): n=c or g
agaagtaaataggtttggagtagaggattagagtatcactggagaaatttgcatgtgttanaaatatacaaatacctgagttcttttttacctgtagttatgtttgtcatgcatattctat

SEQ ID NO: 30271 - DNA, 121 bp, Artificial Sequence
  Synthesized
  misc_feature (61): n=a or g
atgaggaaaaagtgaggaatatgaaagatgcacactctaaccattaatactaaataatttnaagtcaggatatgacaaggaaatccccataagtgcctaattaaaaattggttcagtgtca

SEQ ID NO: 30272 - DNA, 121 bp, Artificial Sequence
  Synthesized
  misc_feature (61): n=t or c
agcagagcccagccaagacctgcccactggggatacctggcatgacctctgccgatgacangattgactctttgtcccatccttgccaggtacattgccctgggtcctctatgcatcctgt

SEQ ID NO: 30273 - DNA, 121 bp, Artificial Sequence
  Synthesized
  misc_feature (61): n=a or g
atagtggtgtttacaaattcaaaattggcatttgcatgcagatgctaatttaagatctctncatcaagtctcagttacttattttattcccaaagcatctccttggtttttagttcttctg

SEQ ID NO: 30274 - DNA, 121 bp, Artificial Sequence
  Synthesized
  misc_feature (61): n=t or c
gaggccctacaatttataagcttactaaatttccttcaagtttcatcatttgtcacagcgntcccaggtcagctcagactattccttcttgagtaaaatctctaggttttgttattaagtc

SEQ ID NO: 30275 - DNA, 121 bp, Artificial Sequence
  Synthesized
  misc_feature (61): n=a or t
tcaagttgagtttttggagctgagaagaaacaacatatttaataaacagcaggccaactanaaggccatatattattctctatgcttctgctgcagtggaaggtgaaaaatgggagagcat

SEQ ID NO: 30276 - DNA, 121 bp, Artificial Sequence
  Synthesized
  misc_feature (61): n=t or c
aagcagctctggaataagaataaataaaactcttgaagaatatatttagaattttaaaaanagagactgaacgggcacccagacaactccagaaggggctgaagagttgaagcacatccct

SEQ ID NO: 30277 - DNA, 121 bp, Artificial Sequence
  Synthesized
  misc_feature (61): n=t or c
ataggctatgtctgactgagagaggcaataagggatgggttatttctttcactaattttgnatttcttgtaccctgtaaactagttgctttagccttagatatttcctagtttgctaggat

SEQ ID NO: 30278 - DNA, 121 bp, Artificial Sequence
  Synthesized
  misc_feature (61): n=t or c
ggtaagtgatttgctcgggacacctgttaaaactggctgtcaaaaatcaggccagaacagnttatgtggcaatgcagcatgctttgctgctctctgaaagcacgagacagaagagcagtta

SEQ ID NO: 30279 - DNA, 121 bp, Artificial Sequence
  Synthesized
  misc_feature (61): n=a or t
gcaaattgtcatagcctaagagaaaataagcagaattctcttgttaaaaaagtctccatgnccagcagtacaaacatttccaagttcctctgaagtcactgagctttcacattatcatgag

SEQ ID NO: 30280 - DNA, 121 bp, Artificial Sequence
  Synthesized
  misc_feature (61): n=c or g
gtgtgatttttgataaaattaccatgcctgtcactgttatgctcttaatgttgatttgagnttttctatccctcactgggaggagttactacgttacaggaaagcctaacctttcctttag

SEQ ID NO: 30281 - DNA, 121 bp, Artificial Sequence
  Synthesized
  misc_feature (61): n=a or g
catgcagcagtgctgaagttcaaagacacactcttctggctctgctatgaagaaaatatcntcaagttcatccaggaatgtacttctcagtgaggatccactacttcgctaacgagtgaaa

SEQ ID NO: 30282 - DNA, 121 bp, Artificial Sequence
  Synthesized
  misc_feature (61): n=a or g
atgtgtagctttgctttttacttaaagacacacctagcagaacaatagctcagcaggtacnagcgctgctgaacaatgctcagactccatgtagtttcaagtttacatcctgcaggcactt

SEQ ID NO: 30283 - DNA, 121 bp, Artificial Sequence
  Synthesized
  misc_feature (61): n=a or g
acagctccttgaggattgtgtcaaagcccagttctgctgaaacagagcactcttgcagtcntagcattgggaacctgtgttgcagtttaatttctaaaacaaattatttgattgttattac

SEQ ID NO: 30284 - DNA, 121 bp, Artificial Sequence
  Synthesized
  misc_feature (61): n=t or c
cggatcttatcacgctgtacctatttttattaccatgccttacaggaaaaacaacctttcngttcccctgccccatgacctgcttcgtcagctcggaagaagtgcaatctgtgtcaccgaa

SEQ ID NO: 30285 - DNA, 121 bp, Artificial Sequence
  Synthesized
  misc_feature (61): n=a or g
aataatttaggcttcatttcagcctataaaaccaaagaggtattttagtctcttactttcnacgagtttcttcttgttttttgttcatccagcaaaaccaaaatgttcttacaaggcagaa

SEQ ID NO: 30286 - DNA, 121 bp, Artificial Sequence
  Synthesized
  misc_feature (61): n=t or c
ttcagatgatttctgagagaaccagcctatcagagaaataagagaaactccgctcttacancttcctcctgtgaaaaaccttacaccttccttttttcctttgcttcttgtcttttcgtta

SEQ ID NO: 30287 - DNA, 121 bp, Artificial Sequence
  Synthesized
  misc_feature (61): n=a or g
taacaatcacagaggctgccatttcagagcattttctgaaatgttagtgagggcatattgnaagactgcagcacttcttggtttcactgtttattgaatgaatgagtctcacatgggttga

SEQ ID NO: 30288 - DNA, 121 bp, Artificial Sequence
  Synthesized
  misc_feature (61): n=t or c
ccattctatgattctacagaatgaaaatatattgccccatacattgcactggtatcaaatngacataatatttgagatcagaacatgattttcatgcagtgtcctgacttttcttttttct

SEQ ID NO: 30289 - DNA, 121 bp, Artificial Sequence
  Synthesized
  misc_feature (61): n=t or c
tcatggctgttttcatttctcttcttccactaggcgtttgtacttcaaaagttctgtctgnctgcatatgcattaacttcagcgctcagtaaacacaggtttcacatctataaataaaata

SEQ ID NO: 30290 - DNA, 121 bp, Artificial Sequence
  Synthesized
  misc_feature (61): n=a or g
ttctgcaatactaacattcacttatattttagaagtcctgcactgtcagagtttagtgagntacccacaggacatcaaagggtaagataaagtacacttatacatgttctatttcttccag

SEQ ID NO: 30291 - DNA, 121 bp, Artificial Sequence
  Synthesized
  misc_feature (61): n=a or g
tcccattacagtgttttaaggtctggttactgccagggctctgtgtctctcagcgtgtccntctctcttgaccccatcagtggcggtggaacacggagccaagtttccaacatctcttttg

SEQ ID NO: 30292 - DNA, 121 bp, Artificial Sequence
  Synthesized
  misc_feature (61): n=a or g
gaaaaaaatcaagaaatagtttgatttatagaatttgtctggaaatcggagataaaaattnttttgaaacagatgagttcatatgcactgttcagcagctgtaaggaatctgcctgaccct

SEQ ID NO: 30293 - DNA, 121 bp, Artificial Sequence
  Synthesized
  misc_feature (61): n=a or g
ttactggcatggcaggctggctagccattgcctgagaaaaacaaacagacccttgaggtanctgtcagcagctggtacaatgtgtttgggatggggtttcattctctgtctggggttttat

SEQ ID NO: 30294 - DNA, 121 bp, Artificial Sequence
  Synthesized
  misc_feature (61): n=t or c
ctatcttaaggattctttaactatctctatcagtgtactgtctgtttactgccaaccacanatcaacagtttgacttaaatgaatgatctgcgtccctttatatttgctgacttccgagga

SEQ ID NO: 30295 - DNA, 121 bp, Artificial Sequence
  Synthesized
  misc_feature (61): n=a or g
ctttgcttttgttctgatttcttctcagaagaccagagcactggatatgcaaacactgcancagctgccaggtgagaagcactcatctgtgtctaccgtgtcttctgggtaaaggtctgtg

SEQ ID NO: 30296 - DNA, 121 bp, Artificial Sequence
  Synthesized
  misc_feature (61): n=a or g
atacaatcaacttcagaaatcatttgtgattgttcttgtcacagacttttggccaaattantcaccattacatgcaggcaaacctggaaccgctccctcaacttcatcttccagctcagaa

SEQ ID NO: 30297 - DNA, 121 bp, Artificial Sequence
  Synthesized
  misc_feature (61): n=t or c
tttgatattgtaactgtcagaaatctatcctgcacaacagagctatttatttactccaaanaagctagttcaatttttatgtttattacatagtgacctcagcccaacctttgttgaataa

SEQ ID NO: 30298 - DNA, 121 bp, Artificial Sequence
  Synthesized
  misc_feature (61): n=t or c
gacattcactacacgctttgctgtcacttctgtaagaaggcaggaatacccagttttctgngagtttattgaggggaactgctgccatgccttagtgaaatgcaggcatgattgatccccc

SEQ ID NO: 30299 - DNA, 121 bp, Artificial Sequence
  Synthesized
  misc_feature (61): n=a or g
acacttaatttaaacataacactgtaataggataggaaaaaaattcagaccttataagacngtttctcatcaagttgtgttttatctactgggccaatggttctgttcatcagaggaaact

SEQ ID NO: 30300 - DNA, 121 bp, Artificial Sequence
  Synthesized
  misc_feature (61): n=a or c
gctctttcaaacactatccaatatgcatgattggaatagctgacctacattaaaacatgtnttttgctagattacagcaaagcacaaatgcttagagctatcagggaatactaaagcaaca

SEQ ID NO: 30301 - DNA, 121 bp, Artificial Sequence
  Synthesized
  misc_feature (61): n=t or c
agaagtcacgttgcctatacaagcagtctgttacaggatcgaatggggaaatctgccttanggaaaaggaaccattcacttcttttttctaaataaaaatctattgtaattctgtatttta

SEQ ID NO: 30302 - DNA, 121 bp, Artificial Sequence
  Synthesized
  misc_feature (61): n=a or c
accccagcgctccagtaagaaaaccaatgagtttccaaacctggctgataaggaaagattnaatttagtacagtgaaaatctagacataaaaacagaagcacacagcaacctgaaacctag

SEQ ID NO: 30303 - DNA, 121 bp, Artificial Sequence
  Synthesized
  misc_feature (61): n=t or g
caaagatgtttagtttgtggtggttaaggatagtagaaattccagtgatatttacttatanttgttaaaaacagaagctgaatggttatttctttacagcaacaggggctgtgacaggtgt

SEQ ID NO: 30304 - DNA, 121 bp, Artificial Sequence
  Synthesized
  misc_feature (61): n=a or g
cagagacacggcaaagcaaagtgatgagttgggcaaagggtgagaagggctgggacatggngggctcaactgaaagcttgagtgtggggagcgtgaagatagcaggggttgctgggaggag

SEQ ID NO: 30305 - DNA, 121 bp, Artificial Sequence
  Synthesized
  misc_feature (61): n=a or g
gctaagttctatccaatcccaaatttacaaaggtctgaaaaagttgcatctcaatatctcngtaaggtggatattacacacactgctgggatgatgaagtaggagcaaaggatcaaatgac

SEQ ID NO: 30306 - DNA, 121 bp, Artificial Sequence
  Synthesized
  misc_feature (61): n=a or g
cagcacaaattatggcaataagatttgttagtgtctacaaaccccaacaagcctcaaagcnatcctaccattttctaagggagaacctgctcttctttgttcctttaagtgatcagatgtt

SEQ ID NO: 30307 - DNA, 121 bp, Artificial Sequence
  Synthesized
  misc_feature (61): n=a or c
aaacaaaatccccctactcactaaagaaaagcttcttagagggactggagtgactagaaanagtacctaaaaatattcagcctacttattctgccaaattgaaggaaatgccaaatgaagg

SEQ ID NO: 30308 - DNA, 121 bp, Artificial Sequence
  Synthesized
  misc_feature (61): n=t or c
cctccaagaggatgtattgccccatcctgatctttcttgcagactgatttagtgtgttganaactatggcgttgccgaggggtcttaactgaccttcagtggtgaggacgttggctttaat

SEQ ID NO: 30309 - DNA, 121 bp, Artificial Sequence
  Synthesized
  misc_feature (61): n=a or g
ccactgaataaaatttatcccagttagttttaggcacctaaccaagcactgttcctaacanctcttaaccagatcaatggatgtctgaattactatgccagttcaggtcttatcttagcca

SEQ ID NO: 30310 - DNA, 121 bp, Artificial Sequence
  Synthesized
  misc_feature (61): n=a or g
catctctccaaaggttaaggtaaataccagacagcactgttaacacagctttgtgtatgtntgttatgtatgttgacacgtatagaaatagtgcatgaagtgtctgaacaggagagggaaa

SEQ ID NO: 30311 - DNA, 121 bp, Artificial Sequence
  Synthesized
  misc_feature (61): n=t or g
caccaatccttgggtggggtggggatgcgtgtaggaatgagtccttagaagcccgatgcangggcttacaagtcttatttttattcttttcaccccccatcagtgtgttgttttccaatct

SEQ ID NO: 30312 - DNA, 121 bp, Artificial Sequence
  Synthesized
  misc_feature (61): n=a or g
ataatgaacgctatgctaaggaagatgttctcctttcattctaattgtgagatggcacttngtaacatgagaagaacattttgagtatgatgtggtactgcttggagcccaagcagatgca

SEQ ID NO: 30313 - DNA, 121 bp, Artificial Sequence
  Synthesized
  misc_feature (61): n=t or c
ggcttttccacatgtcacttagtattgataacttttgtggaattatatttgtagaagatanagttaataagtcagtacataatttgttagctttctgtaagcatctttgagtgttttgtaa

SEQ ID NO: 30314 - DNA, 121 bp, Artificial Sequence
  Synthesized
  misc_feature (61): n=a or g
gaagggaatgtgttactggcaccaccataattcattttctgtgggaaaggagggagagganagcattttctttagcagagtaaaagcctttggctagggacagggtgggatcagggtgaaa

SEQ ID NO: 30315 - DNA, 121 bp, Artificial Sequence
  Synthesized
  misc_feature (61): n=a or g
tgttgaaagtgtaagctattagctcacaaagctattgagagaaatatcttccagaacttcntttaaaacatcagccttttgattttaggccagaaaaaaaaacagtagtctattaattctc

SEQ ID NO: 30316 - DNA, 121 bp, Artificial Sequence
  Synthesized
  misc_feature (61): n=a or c
agttgcaaattctggtttaaattctctgtgcaaatgtactaattctagttgaagaacatgntgtagataccccaggcttgtaagaaatgtgaatacttacctgactagacggtactctgaa

SEQ ID NO: 30317 - DNA, 121 bp, Artificial Sequence
  Synthesized
  misc_feature (61): n=a or t
tctgaacagcttgaatactgcatgagctagaacatggtgtgaattgacagctgtgatgatnatctcatagcaactttctgcagcatgataggacataaccttctctgccaaatgacatatt

SEQ ID NO: 30318 - DNA, 121 bp, Artificial Sequence
  Synthesized
  misc_feature (61): n=a or g
aaataatttacaaatagaagcctatctttgatatccatataatatcttttctacttaactncatgaggtgctttccaggaaaaccttcttcacatagtgtggcaaggcccctcacaactat

SEQ ID NO: 30319 - DNA, 121 bp, Artificial Sequence
  Synthesized
  misc_feature (61): n=t or c
accacactgctgccagcaggacacgccagagccagggaaggatgtccacccatcccacctnagcactctgcaagaccacatgcatgagaatgctctgagagcagcaggcaaaaggcaaaat

SEQ ID NO: 30320 - DNA, 121 bp, Artificial Sequence
  Synthesized
  misc_feature (61): n=t or c
acccttcccattggcgtaggcatggtttggccagcagtccaacggtgtatccctattgttngggtttctgctctttgcattggctaatcagacaaactgaccaagttttgtgcaggctccg

SEQ ID NO: 30321 - DNA, 121 bp, Artificial Sequence
  Synthesized
  misc_feature (61): n=t or c
aagtacttcatacagaacaggatgatgcatttatttgcttcattactcatggtttccttantcagctaatgctttgcccttacgtatacttttgtccttttgtgtcacctgccgtcttttg

SEQ ID NO: 30322 - DNA, 121 bp, Artificial Sequence
  Synthesized
  misc_feature (61): n=t or c
ttaaatagaagatctccccagcacacctttccaagagcaatccagctttgtttctgccacntccacttctctcactaatgccacaggttttgcccatgcactacaagaacaattactcaca

SEQ ID NO: 30323 - DNA, 121 bp, Artificial Sequence
  Synthesized
  misc_feature (61): n=t or c
ccaccacagtctggaaagaatcctgatggtgttgaactgtccaggactaaaaccagtcttnttttttcatctctacatcatttctgtctgtggttcttaagttgcaccatcatagcattgg

SEQ ID NO: 30324 - DNA, 121 bp, Artificial Sequence
  Synthesized
  misc_feature (61): n=a or g
gctcagatgacaaagtgagacttcaagctgcttggtggagatgatggcggagagaaacacnttgtgtccattcatcagctggtgtgggaagagaccactcctcctttgagaggctctgatg

SEQ ID NO: 30325 - DNA, 121 bp, Artificial Sequence
  Synthesized
  misc_feature (61): n=a or g
acaattgtaacttaagtccctactattatttcatcatacatccgcagtcgcaaaagatgcntggccgatttcgtgtgttgctgttgattgtatacaaaatacacaagtatttttgcatata

SEQ ID NO: 30326 - DNA, 121 bp, Artificial Sequence
  Synthesized
  misc_feature (61): n=t or c
aagggcattggggaataaatgaggtacgtgatgagaattacagcaggagaaatatgtcttntgcatctccaacaactgaaacagaggcatgcccaaggcttgtttggttcttgtttctgtc

SEQ ID NO: 30327 - DNA, 121 bp, Artificial Sequence
  Synthesized
  misc_feature (61): n=a or g
gtgttttatgagaaccctttgctggtgcccaacaggcacactgcacctcagtgctgcgccntccctgcacaaccgggggatgaatgagaagagagaaccaccagctatacacagctcagct

SEQ ID NO: 30328 - DNA, 121 bp, Artificial Sequence
  Synthesized
  misc_feature (61): n=t or g
tctgttgttgacatccaagaggtgcttctaaatcatctccttcaccatgtctcaaaatgcntacaggtaagaatcaattagcaaaccatgatagaaattgcctaagcacaaaacagttggg

SEQ ID NO: 30329 - DNA, 121 bp, Artificial Sequence
  Synthesized
  misc_feature (61): n=a or c
ataaatgactgggtactcagatgccataagtactgggttcatttcaatgagcttcaggttnttacagaatgttcccacgttttaccattcaagttataaaaattctctggcaaatttgata

SEQ ID NO: 30330 - DNA, 121 bp, Artificial Sequence
  Synthesized
  misc_feature (61): n=c or g
aatgagtgagaaaggccgcttattccctcatgtggaaattatttgtattgcatagtttcantgttctgtgtggtttatggaccgtgtgtctaatgagctttctgtaccccagaccgaataa

SEQ ID NO: 30331 - DNA, 121 bp, Artificial Sequence
  Synthesized
  misc_feature (61): n=t or c
agagagaaaagcatatgccataagaggcaaacaaaccagaactttttcattgaagaggacngccaatgtgacctgaaacttaataaaacaaaaataagattttggtgattaagttgccaaa

SEQ ID NO: 30332 - DNA, 121 bp, Artificial Sequence
  Synthesized
  misc_feature (61): n=c or g
ccactgccacgtcaggtaactcacatcaaggtcaaacagattctccttgctagaagtggancaggaccttaaaactctgcccagatgcctctagcgagttcctgctcgccttcatactttc

SEQ ID NO: 30333 - DNA, 121 bp, Artificial Sequence
  Synthesized
  misc_feature (61): n=a or c
gggctaacagagagtttttgagtctgcagaagcaatttgccagcacattaaaatgataagnatcacaaccagtcacttctacagggctgcaaaggagaaccagagaaaaacactccttgtt

SEQ ID NO: 30334 - DNA, 121 bp, Artificial Sequence
  Synthesized
  misc_feature (61): n=a or g
tcagccattggctgcattggtttgcccattggagtgcacggattcaatcatttgcaaaagnacaccccacacgcacctaaccagtgctctcctgtcagcttcccaaagccatcccggtacg

SEQ ID NO: 30335 - DNA, 121 bp, Artificial Sequence
  Synthesized
  misc_feature (61): n=a or g
tgccatctgccaacatctgtcagtgaatccccaagagagcaaatgtggtgcaatttcaacntttttctgtttcagtatactgaaccaatttcaagagcatgttagcatccctcttgtgttg

SEQ ID NO: 30336 - DNA, 121 bp, Artificial Sequence
  Synthesized
  misc_feature (61): n=t or c
ctgctcaaacagatatgccatcaatctcaacgtgatttttgaatctcttaggcaggtttanaattttaacttcttagaaaaatgtgaaagttattcacaagcttcagttctcagccatcaa

SEQ ID NO: 30337 - DNA, 121 bp, Artificial Sequence
  Synthesized
  misc_feature (61): n=a or g
ggagtgagatttctcagtagcaagaaatgttctcttctagatcgtcgtcttttcctctgcntgaggattggcctcttttactcctacttagcttctttttgtttctcatcctgctgttctc

SEQ ID NO: 30338 - DNA, 121 bp, Artificial Sequence
  Synthesized
  misc_feature (61): n=a or c
cccgtctgtctaatctggtgccaaattacctcggagctgagttggttgccgggtgtccatngtttggtgcatgctgggctttgctgaggatggcgagtggcagggaggagaacctgccccg

SEQ ID NO: 30339 - DNA, 121 bp, Artificial Sequence
  Synthesized
  misc_feature (61): n=a or g
ctgctcctttccttctaccactttaacttcatcaaagaaggcagtcaggtgctatttactnccttaagtagatctgtgctgactgttcccagtgacctttttgtccttcacaaacctgggc

SEQ ID NO: 30340 - DNA, 121 bp, Artificial Sequence
  Synthesized
  misc_feature (61): n=a or g
aaaggagctggtaagaaagaagaaaagatgtaatagagtgagagaacacttctctatgtgncttacagctgtgctgtggaacaaaggtgcaaaccttgcacttcttcagaccagtagactt

SEQ ID NO: 30341 - DNA, 121 bp, Artificial Sequence
  Synthesized
  misc_feature (61): n=t or c
agaaactctaaagaccacatcatgagggtggactgattgccagttatatgaagatacctanaggttccctgagctgtggcagcttactggttgttcattactcccctgcaaagaggtagca

SEQ ID NO: 30342 - DNA, 121 bp, Artificial Sequence
  Synthesized
  misc_feature (61): n=t or c
tgtagcatttatcgttcttgttggtaagagtaactgcctcactttgcatgtggattcttcnaacacttctatatcgactcaggcagagcatagtaattagggtgagttctagtccatctct

SEQ ID NO: 30343 - DNA, 121 bp, Artificial Sequence
  Synthesized
  misc_feature (61): n=t or c
ggtgccagcagatgctgttccttgctggcgaatctcacccggagaaatggctttgatcaangctcttggatttcaggcttcagccttgatcaaggcaaggggagggaccggcttgaactct

SEQ ID NO: 30344 - DNA, 121 bp, Artificial Sequence
  Synthesized
  misc_feature (61): n=a or g
ttgagtagaaccatgaaactggacccagcactatttttaaggaatacattaggcaagtacntatagcacaattatgcacattcctgtatttagaggagaagaattaacagtaaaaatacaa

SEQ ID NO: 30345 - DNA, 121 bp, Artificial Sequence
  Synthesized
  misc_feature (61): n=a or t
agaaaagatgtttatttcaagcttgttcattttattttcatgtaaaaagccctttctaatntttcttacttattcttcatgaatcagaactgtgttcagtcactgcatagcctaaatacct

SEQ ID NO: 30346 - DNA, 121 bp, Artificial Sequence
  Synthesized
  misc_feature (61): n=a or g
gagtttgtgcttagatctattagcagttcatgataatgctacctaaagttatccctgatanctactttttcacatacaaagcttgaaggcttatatatcaataatccctatgttttggcat

SEQ ID NO: 30347 - DNA, 121 bp, Artificial Sequence
  Synthesized
  misc_feature (61): n=t or g
tgcacacactatcttctgctgtgtttgtgctatcttcaggcaatgagattttaattttgtntttgctgaggatcctacagttttctaccatggtgtattcttcagttcttcacatgtgaca

SEQ ID NO: 30348 - DNA, 121 bp, Artificial Sequence
  Synthesized
  misc_feature (61): n=c or g
agttgccgtttctttaaaaactccccgcttaactgcttgcaggttgatgggcggaaaatgnctttttcttttatgaattaagctttcatttctgcaatcaattattcccttcggctctttt

SEQ ID NO: 30349 - DNA, 121 bp, Artificial Sequence
  Synthesized
  misc_feature (61): n=t or g
aagacaaaacttcattttcatgtccaatgggcatttgcataaatgtctacttgtataaatntccattaacaccattcagtcaaatgttttataattgcctctggtgccagagtcactttgc

SEQ ID NO: 30350 - DNA, 121 bp, Artificial Sequence
  Synthesized
  misc_feature (61): n=t or c
caggacttacccaagcagtcaggattttgaggagcagacatcagcagtaatgtgacaaacnggaatacaggtccggaatgatgtctgaggagcatttgtgcccagcactgcagagcgggtg

SEQ ID NO: 30351 - DNA, 121 bp, Artificial Sequence
  Synthesized
  misc_feature (61): n=a or c
aaagtgaagtcagaacaaataaaaccagtagatgatggtggtagttacttttggaccatgntgcaagtttgacagaatagagaaatcttctgaaagtgcttgtttcaagacttgtaattca

SEQ ID NO: 30352 - DNA, 121 bp, Artificial Sequence
  Synthesized
  misc_feature (61): n=t or c
tctgaaacagcccttaggaaaaacagagacaaaaataagccttaaatatattgagaacttncatagaaccacgagtaagattaaaaggtctgtctgcaacagtgggggtctggttacaaga

SEQ ID NO: 30353 - DNA, 121 bp, Artificial Sequence
  Synthesized
  misc_feature (61): n=a or g
ggaagaaaatctgtagagttaagctgctcttgcaattctcaggctgcttccactgctcccntaccattcctacgatggtctctgtttaactctcctgccctgtctgccctgcaccctgcag

SEQ ID NO: 30354 - DNA, 121 bp, Artificial Sequence
  Synthesized
  misc_feature (61): n=a or g
tctatctctcacatatgaaaacatactgatccattccgtggagtttggggtttgtatatantagggttttaagatctctaactgcatatcccacccccacaacccattttctgacgtcact

SEQ ID NO: 30355 - DNA, 121 bp, Artificial Sequence
  Synthesized
  misc_feature (61): n=t or g
cacatatatgccttctgcattttgaaagggtcacttcattagaagaacccttctgaaaagnacttttctagaaaactgtgaaacctggtgtctccatctctctaacatgcttaaagcactg

SEQ ID NO: 30356 - DNA, 121 bp, Artificial Sequence
  Synthesized
  misc_feature (61): n=a or g
agtcaatcagtctccatccaagttacctgctttcaaagagttgaacgttgacatcggtgcntaaagaactgcatgcaccatcttttgatgaagagttttagatactgttatcagtgtatgc

SEQ ID NO: 30357 - DNA, 121 bp, Artificial Sequence
  Synthesized
  misc_feature (61): n=a or g
ctatctaatgagctgaaccacttaatcttcttgctagactagctgccaataaaccctcaancaaggtacatattgaacttcaggtatgaatgggtgcctgagaaaattaagatgcagtaaa

SEQ ID NO: 30358 - DNA, 121 bp, Artificial Sequence
  Synthesized
  misc_feature (61): n=t or c
acaatgtgctattttgttttatgttgctttatatatttagatttttaagattcatatactnaagatcagtttagtcacttcagcaagtttatacacatgttatttttggcctttattctca

SEQ ID NO: 30359 - DNA, 121 bp, Artificial Sequence
  Synthesized
  misc_feature (61): n=t or c
ttgcatgattcttaagtacttaggggtgtttggtttaattgggttttgcccgaggttttgngttggcttggagccactcggtagatgtttggtgggagtggtgctcccagtcagtttggtg

SEQ ID NO: 30360 - DNA, 121 bp, Artificial Sequence
  Synthesized
  misc_feature (61): n=t or c
tctttgcagttcagcttgttgttctatttgacacctggttttggactttatgtcagtctcngtgctttgcaaattccaggtgcagtaaacatatccttaacacatcatttgggctagactg

SEQ ID NO: 30361 - DNA, 121 bp, Artificial Sequence
  Synthesized
  misc_feature (61): n=t or c
tccattttgtctttgccaatacatttcccgtgagagaacataaggaatttaaatagtctgntctacttgttttaaacttgtacaaccctcacacatggtatacctaacgagcgtaagatgg

SEQ ID NO: 30362 - DNA, 121 bp, Artificial Sequence
  Synthesized
  misc_feature (61): n=a or g
cagaacacctgctgtatgtatttatacttgattttctttaactttcactgaacaactttcnggtgcatcagaatgtaactacacatttaaaataaacagtactcattgcttcaatctcctg

SEQ ID NO: 30363 - DNA, 121 bp, Artificial Sequence
  Synthesized
  misc_feature (61): n=t or c
accaactacaacagagaaatggacagaaaacactgctagcagaaatacatagttctgaggnatgcaaagctcctcttggcactctcaagaccctccatcctgcacgtcgtaactctgatct

SEQ ID NO: 30364 - DNA, 121 bp, Artificial Sequence
  Synthesized
  misc_feature (61): n=c or g
agaaaggattttgcaattagctgtcagacatgcatgcatttttgatttccaattgcattanattattcttgtaatggtagatttcaggaaaagggttttataagtaacttgcaaacaggaa

SEQ ID NO: 30365 - DNA, 121 bp, Artificial Sequence
  Synthesized
  misc_feature (61): n=t or c
ttaggaggcatatgtctctcaatcacctaactaggataccatgtccaagtcaacaatgagnaccatctaccaggcattatgaagaagctgtacataagatctttctttctgagttaattta

SEQ ID NO: 30366 - DNA, 121 bp, Artificial Sequence
  Synthesized
  misc_feature (61): n=t or c
gctgaggagctaagaaatctcggtccattttgtttaagaaacagcatgatgggcagcgggnatctgcaatgggaagggatatctcctatggaaagtgttagaaactgtaacgactaaaatt

SEQ ID NO: 30367 - DNA, 121 bp, Artificial Sequence
  Synthesized
  misc_feature (61): n=t or c
tgcaggaagatgcagtcctggggctcgtttcttccctgtgtctgcataaagcaggtcttgnaggaacccaccagctgtctctggtgaggatgatacatcaaacaactaatttcagaatgat

SEQ ID NO: 30368 - DNA, 121 bp, Artificial Sequence
  Synthesized
  misc_feature (61): n=t or c
tgttacatgggtcgtggctgggagccttggtgttctcttagtcatggaggggctgtttatnatgggaaccagcctttttcctgtgtatgcattggccttagtgacttgattgcttatgagt

SEQ ID NO: 30369 - DNA, 121 bp, Artificial Sequence
  Synthesized
  misc_feature (61): n=t or c
gcttttagaggtcccttatagctcaaacggttctataccctaacaccagcagaacacaccnagaaggtgaaggctcccaacttctgctggcagcttctcacaaagagccgtccctctgccc

SEQ ID NO: 30370 - DNA, 121 bp, Artificial Sequence
  Synthesized
  misc_feature (61): n=t or c
gggtagcagaatagctggaaatgtcctctgcatggaaagcactaacaaagaagtctgctantggtgaactgtctggctcaagtgtatctcaagactgggctggaaatagactgtacactta

SEQ ID NO: 30371 - DNA, 121 bp, Artificial Sequence
  Synthesized
  misc_feature (61): n=t or c
tccaatatttacacaaacagtggaagaaaaaggtatcaattttaagaatatcatcaatatnttgtagtgcatctttgaactgcagcaatgaaagtttatttccttgttcctcataaaatgt

SEQ ID NO: 30372 - DNA, 121 bp, Artificial Sequence
  Synthesized
  misc_feature (61): n=a or g
taataacgaacacctgcagcaaggccttcagaagcactgtagtttgagttattttatcccntttgggtctgttcttccaacagctaaattacttaagtcactggatttccatttctgatct

SEQ ID NO: 30373 - DNA, 121 bp, Artificial Sequence
  Synthesized
  misc_feature (61): n=t or g
atatgcttacaaatacaatatttagacaaaatatataaaaataattattgacacataaaangcaagctactgagcaaacttttgaaactaatatacctcttgagggtagttggcaagctta

SEQ ID NO: 30374 - DNA, 121 bp, Artificial Sequence
  Synthesized
  misc_feature (61): n=a or g
gaaaagaagcagtcatccttaactttgctattttaaggtttatctggaaaagtttatcagngaggcacaagaaaatatctttgagtaaatctcttcttaccaatgtatttcttcctgcaca

SEQ ID NO: 30375 - DNA, 121 bp, Artificial Sequence
  Synthesized
  misc_feature (61): n=t or c
gagtagttgtttttgttgctgaagttgacttttgacacttttcaccctgatcccattatgnttctgcccatctcaccattataagaccactgaattccactctgggttgtgtgggtctctg

SEQ ID NO: 30376 - DNA, 121 bp, Artificial Sequence
  Synthesized
  misc_feature (61): n=a or g
agcggtgatgccaccgcctcgctcaatggccttgggtaagtcacccagcgttcatttaccnatgataaataaagcacagagttctttctctcctcttttcctcactcttttgttttccttc

SEQ ID NO: 30377 - DNA, 121 bp, Artificial Sequence
  Synthesized
  misc_feature (61): n=a or g
aacataatctactctcaagcaccctttcagctttcaattttctgcaaatggtttgataacngagagttttcagaaaatccttctctccatatgaaaaagaaagaggagttctactgcagag

SEQ ID NO: 30378 - DNA, 121 bp, Artificial Sequence
  Synthesized
  misc_feature (61): n=t or g
atctggatgctgtcagaaaggtccctgcagtcatgttcactgtgatgcagtttctaccctngtataccacactgatgggaactggagcaacacagcccagcacagcatggctgcacactgt

SEQ ID NO: 30379 - DNA, 121 bp, Artificial Sequence
  Synthesized
  misc_feature (61): n=t or c
cacacccttacatggaggaggagtgatgaggtgaatgtgatgccatgagaactaccctcantgcatccctgtctgtgccttccctaccaagaccagtccactgtgggggaatccctacagc

SEQ ID NO: 30380 - DNA, 121 bp, Artificial Sequence
  Synthesized
  misc_feature (61): n=a or t
tttgtgttttaggtgatactggattaatcatttttgctgacagcaagtgctggaatacttngtagaagggggacatataatagcatttgggccggggaagatctgctcctgtctgatgatg

SEQ ID NO: 30381 - DNA, 121 bp, Artificial Sequence
  Synthesized
  misc_feature (61): n=t or c
aaacactcatggaccagaagctaaatacagagtccaatgcaagctgtgaaatcaccgatangttgttgaagatgacatgaaggatgaaatatttattataaaaacatggactgtgccatca

SEQ ID NO: 30382 - DNA, 121 bp, Artificial Sequence
  Synthesized
  misc_feature (61): n=t or g
atgaggaagatgcgcacttaccaacatccagtgatcctcatgaaagaggacatcagatggncatggacttgaaattagattgaacagcccaaccccatcccagccagatgcatgtggagcc

SEQ ID NO: 30383 - DNA, 121 bp, Artificial Sequence
  Synthesized
  misc_feature (61): n=a or c
tgtcaagttcatagatggtattttcaaatctggccactgtttttcacacaggttgaataanagaactggagaaaggacgagatcagaacaaatacatttgccccttattggctgccttggt

SEQ ID NO: 30384 - DNA, 121 bp, Artificial Sequence
  Synthesized
  misc_feature (61): n=t or c
tcagaagagcaaagcccttattccctatgaaatcagagagcagacagtgggattcacagtnttaatgactgagcagtagagtttttatctgatgctaaatgaaggaatttagagctgatga

SEQ ID NO: 30385 - DNA, 121 bp, Artificial Sequence
  Synthesized
  misc_feature (61): n=a or c
ctccgtgcacaaaacgccaggctcatgctccatttcttacgatagtaatgacgtatctttnaaaacctggagttgtttgaagtttcaggactcagacctgccccaaaacaaacgcagctga

SEQ ID NO: 30386 - DNA, 121 bp, Artificial Sequence
  Synthesized
  misc_feature (61): n=a or g
aggaggcatccctaggccctggggtcaggcacggggcctgtaaggggctgcagaactcccnctgataacacgcattgctacagtatttccaagtgatgcagacgaccaaggacaataccac

SEQ ID NO: 30387 - DNA, 121 bp, Artificial Sequence
  Synthesized
  misc_feature (61): n=a or g
atagttgtgccattattttttagaataattctttctgaacagggctttggggcttccttcngagcagaggaaagtgcagcttcagctggagctgttctgtagtgaagttctcatttatttt

SEQ ID NO: 30388 - DNA, 121 bp, Artificial Sequence
  Synthesized
  misc_feature (61): n=t or c
ttttctttctaaaattaacatgctggtttttgtttacatcttcttactcttagtatacaantatatgtatgtctcaggagaacacctgcttaccttattcaccaaacctgataatctttca

SEQ ID NO: 30389 - DNA, 121 bp, Artificial Sequence
  Synthesized
  misc_feature (61): n=t or c
agagcgggagaaagaatattaagggactacttattcgggagtatggaagaaagctcatttngttgcattttctaagctatagttttagctgtgcatgcattttaaaatcacactgaaggca

SEQ ID NO: 30390 - DNA, 121 bp, Artificial Sequence
  Synthesized
  misc_feature (61): n=t or g
aaaatgcaaagttctgcagattggttagagtaacttcatgtaatgatgtagactgaaggcngacataatgatcagtctctgcaaataaagactgggttatgactcagacatgagtcagcag

SEQ ID NO: 30391 - DNA, 121 bp, Artificial Sequence
  Synthesized
  misc_feature (61): n=a or g
caatctatctctaattcacatcccagaagcagaagccacaattgttaagaaatcagtaganctgtggaagaactctgaaaaggttgctacagtatgctcagctactgcttttcacagcttg

SEQ ID NO: 30392 - DNA, 121 bp, Artificial Sequence
  Synthesized
  misc_feature (61): n=t or c
ttttttgtctgatttgtgtatcctttcatatgtcctctacacagagagggtctgtgtgctnttctgcagtgtttgctctgtgtgtggtgaatggagtatttgaaacctcatcaatggtgag

SEQ ID NO: 30393 - DNA, 121 bp, Artificial Sequence
  Synthesized
  misc_feature (61): n=c or g
cacacatatttatatggtgtatatgtggtgccttagttctcaaattgaatgaatgaaaaangtaaactacagaatagagcacactgaggtgaaataatctgcttgagaatacaaagcaggt

SEQ ID NO: 30394 - DNA, 121 bp, Artificial Sequence
  Synthesized
  misc_feature (61): n=a or g
gggaaatatgtgagaagaagtggtttcttcaagacttttcagaacatttcctaggaaagcntatagtatattttaggaattaaagagtacatgtgaagactgagtagtggcaaagataata

SEQ ID NO: 30395 - DNA, 121 bp, Artificial Sequence
  Synthesized
  misc_feature (61): n=a or g
ctgctgtgattcttagcagcagagtgcagggaggcaacgtggggaagatggtttgttagcnaggatttctggattgccattttcagctccagaatggttaattatgttttttcaatgagtt

SEQ ID NO: 30396 - DNA, 121 bp, Artificial Sequence
  Synthesized
  misc_feature (61): n=t or c
agttcaatttacttggaacatttctccaaggattttaatatctttgattttagccattcanaacaatcatcagcatcttatctacaaatttaacagactttccaaaaaataccaacatttt

SEQ ID NO: 30397 - DNA, 121 bp, Artificial Sequence
  Synthesized
  misc_feature (61): n=c or g
gctcccgaaaatatgataaagcgggtgactgcaaaacactgccgaccagcgtcagtgaacntatcttagaatagcagtgatgacatcagggggaacttagcgaacgggagtggcggtgtga

SEQ ID NO: 30398 - DNA, 121 bp, Artificial Sequence
  Synthesized
  misc_feature (61): n=t or g
aatttaagcagtagatctgggttgtgccagtgaactaaattctttatgtggtgatgtcatnattccaaataataaaaactcatgtgaaatcattgtgcagcgctgggggaagaatgcatgt

SEQ ID NO: 30399 - DNA, 121 bp, Artificial Sequence
  Synthesized
  misc_feature (61): n=a or g
cccagtttagttgggaagtatttcagtgaaattgcctttttccagttcgagccctctcccnagcatcttctttttctccatcgtttctgctggccttcacctgttcaaatatgctgagaaa

SEQ ID NO: 30400 - DNA, 121 bp, Artificial Sequence
  Synthesized
  misc_feature (61): n=a or g
gtgtccttagtaatctactaaacaaaaactcaaagcttgactcagttgcatttgaacaccntctgcagacattacaatgaatgtatggagtgcaagataatgttcttattactgtgttact

SEQ ID NO: 30401 - DNA, 121 bp, Artificial Sequence
  Synthesized
  misc_feature (61): n=a or t
ggatagtgagacctctcatcttctctatcttttcctcatttttaggaagctgccagtgagncagttttcagcttaactaagcatccagatgctgcaagcaaaggcctccacgatatgaagt

SEQ ID NO: 30402 - DNA, 121 bp, Artificial Sequence
  Synthesized
  misc_feature (61): n=t or c
ccacatccagtccctgaccctgcataagcatcctccaggcttgccacactccttaccatcnccaagtcaaagcccaattgcgacctccgagcaaaacccaccagccttgtgagatgcagaa

SEQ ID NO: 30403 - DNA, 121 bp, Artificial Sequence
  Synthesized
  misc_feature (61): n=t or g
ggttgtttgggagctgcagcttcccacagcccggggctcttgggtttgttctaacctgtgnctgaaccttgaacttcctggtgaatgcatgctgttggaatagccgtcttgttctttcagt

SEQ ID NO: 30404 - DNA, 121 bp, Artificial Sequence
  Synthesized
  misc_feature (61): n=t or c
gacttaagcatcattactcaacagcataggttaggatagcattttaagaagtcattgaaangtgaatgcatgagataagatttggaaatgactgaaaaatgtgttagagccataaattcta

SEQ ID NO: 30405 - DNA, 121 bp, Artificial Sequence
  Synthesized
  misc_feature (61): n=a or t
aacccttgcaggctcagccagttgagtcaaactttgtgtcctgtaagatctgtttccaganggttttgagaaagacaattttttttcctccatgcttctttgttcatacaagccaggggtt

SEQ ID NO: 30406 - DNA, 121 bp, Artificial Sequence
  Synthesized
  misc_feature (61): n=a or g
caatgctttatcctgtagggttttctggctagcaggggctgtgagtcagactttgatgggngcatgggtccatgtgtcaggcttttcttgattttatttgttgagacatctccaggggtgc

SEQ ID NO: 30407 - DNA, 121 bp, Artificial Sequence
  Synthesized
  misc_feature (61): n=t or c
tgccacaatttggcgtaaaaattttccagaaattttagaagaaaaaccagtcttggaacantctagtcatggcatctttccataacattacaaataaatggcataaggggaaactgaatta

SEQ ID NO: 30408 - DNA, 121 bp, Artificial Sequence
  Synthesized
  misc_feature (61): n=t or c
ggaaccactgtgcattaaatcatgaattcatttaacataaactaagaggaagacttgaaanctgctctctcagttcttgaacaagtggtatatgagatagtgaacaaagtatggatgcctt

SEQ ID NO: 30409 - DNA, 121 bp, Artificial Sequence
  Synthesized
  misc_feature (61): n=a or g
tccaagatcccttatctcattggcattccctttatccctagttttaggactcaaaagttcngatgttgctggctcagagaaaccatattgtgagtgtccctgcaattaacactttattttc

SEQ ID NO: 30410 - DNA, 121 bp, Artificial Sequence
  Synthesized
  misc_feature (61): n=a or g
caagtgcctgtaaattttcagttgtgatttgtgttttgtagtgaagcatacttatctacangaataaattagtcatgactgcatggtgttcagaatgctttggctattggctgtttccact

SEQ ID NO: 30411 - DNA, 121 bp, Artificial Sequence
  Synthesized
  misc_feature (61): n=a or g
ccaaacaaaaacccaccaggcaaaggttgatttttataatgggaagtagtaatcattttcncagctttgtgcatagtgtcatgtggtgttttgtgaagaaataatacaaaagcaatatctt

SEQ ID NO: 30412 - DNA, 121 bp, Artificial Sequence
  Synthesized
  misc_feature (61): n=a or g
taaatgttggcgttcagtcctttgtcatttatagcaaatgaggtggaaaatttaattgccngaggctgttcaatccaggaggcagaaatgtacaagtgcacaaaagagatttgaggaaagg

SEQ ID NO: 30413 - DNA, 121 bp, Artificial Sequence
  Synthesized
  misc_feature (61): n=c or g
cactgaagattctgcctgtcagtaaatgaaataagattcaaaccaagctcaggaaattaanttcatcatattaaatggaaattctcattttccttgctgctgtagtcctgtacactctaat

SEQ ID NO: 30414 - DNA, 121 bp, Artificial Sequence
  Synthesized
  misc_feature (61): n=a or g
acagaactatgaggatgtgttcagcaaagaagttgtcaatagctttttccccagcccaccncatccttcctacctcatctacctgaggatgagcacagcaccctgcccacctgaggataca

SEQ ID NO: 30415 - DNA, 121 bp, Artificial Sequence
  Synthesized
  misc_feature (61): n=a or t
aatgaaattcacttagctcatctagggaaactgctcaacaacaacatacttaccacagttncaacaaaaccgagcatctggaagcagaatcggatcattaacactattagtaaactttcac

SEQ ID NO: 30416 - DNA, 121 bp, Artificial Sequence
  Synthesized
  misc_feature (61): n=a or c
aatgacgaaaaaacctttacaaaggaagaggagctccttactattgaaacaagtatcatangtgtagtcataatacaattgcatgactgcatagattctctgaggcagaggttatttgtca

SEQ ID NO: 30417 - DNA, 121 bp, Artificial Sequence
  Synthesized
  misc_feature (61): n=c or g
ttactgagctccttgtctcagacccttggattagcagatccatttttattgacacagaatntgtgatctccttaaagaaaataaatataagctctagtttacatctttgcatctttaacca

SEQ ID NO: 30418 - DNA, 121 bp, Artificial Sequence
  Synthesized
  misc_feature (61): n=t or c
aatcaattccactgaattagctgtgagcatacaactgaatatgaccatctgcatgggacanagacttcatttttgtgttacagaggctttcctatttctgcttcacccaacagagcatctc

SEQ ID NO: 30419 - DNA, 121 bp, Artificial Sequence
  Synthesized
  misc_feature (61): n=a or g
aaattatgcactcctggagagaatatagttgcaaccccactgttaatgtggattcagtcantggagccagagtagagccaatcgtaaggaaagcattacaaaactcataaaggtagatgct

SEQ ID NO: 30420 - DNA, 121 bp, Artificial Sequence
  Synthesized
  misc_feature (61): n=t or g
ctgaagcatgaggaaggatttgtggtgagaggatggttatccttctcaagccatttttgtnaaaagggaaaacagtctctcctaaaattcattatattcgagatatttatgcatttgaatc

SEQ ID NO: 30421 - DNA, 121 bp, Artificial Sequence
  Synthesized
  misc_feature (61): n=t or c
cagtgagtgttcttacacctctactctcagaattaatggatgatgcaggtacacacataangctcctctagtccccacctcgattttcaggcttgttgttgactatgggaacatatgcagc

SEQ ID NO: 30422 - DNA, 121 bp, Artificial Sequence
  Synthesized
  misc_feature (61): n=a or g
cagcacacacttctgccactaaggcctccaagcaagggccagacagctgtgctcacctgcncattcccacatgcacacgtgctctcacaccacccctacactgctatttttgtgagcattt

SEQ ID NO: 30423 - DNA, 121 bp, Artificial Sequence
  Synthesized
  misc_feature (61): n=t or c
taggttatattcactgggatacagatggctgtgcagaaggcagttgagatctgaaagaaanaagcatcaaaatttgtttacctgaatcacaatgagatcttgaatgttgtagctctttaat

SEQ ID NO: 30424 - DNA, 121 bp, Artificial Sequence
  Synthesized
  misc_feature (61): n=c or g
cagtacaaggacattactgggagcattgctttcaaagcaggcactcattccctccttttanctggaacaaccactgctggagcaataccacttctttgtctctggatggagtatgttcagt

SEQ ID NO: 30425 - DNA, 121 bp, Artificial Sequence
  Synthesized
  misc_feature (61): n=a or g
aagccaaactacacagtaatccaaagtttggcaaggccgttggctatctccattcagtcantggcatcactgcagagactgctagcaatgtgtaagaggtcattagtggtatttgggctaa

SEQ ID NO: 30426 - DNA, 121 bp, Artificial Sequence
  Synthesized
  misc_feature (61): n=t or c
ccacatttatttcactctccacacttctgcatcaatccagaatcttaaggtctcaaaaatntgcagagcatgtgctggtagatacactgcagcattgcagtgaggacctaccagcataagg

SEQ ID NO: 30427 - DNA, 121 bp, Artificial Sequence
  Synthesized
  misc_feature (61): n=c or g
cctttgtccttccctggtcatcttgcctgtaaacgcccagccttatctccctcttcatcgnagggtctttaaggtagcatgctggcgtgcctaacggggatgccatttggcctacaggtcg

SEQ ID NO: 30428 - DNA, 121 bp, Artificial Sequence
  Synthesized
  misc_feature (61): n=t or c
tgaagtgtgcgctttggctgtacaggggctgaaccactatgcaggtgtagctgtgggacgngcactgtaaccatgcattctgcagacttacagcagtacgaggaagctgtgctctccagcc

SEQ ID NO: 30429 - DNA, 121 bp, Artificial Sequence
  Synthesized
  misc_feature (61): n=a or g
agcagagctggcaacgcagctggtatttgtcttacacatacagaagtgtgagaaggtacgnaaagtagactccactgagggggaaaacaaaggctctggaaaaaagttagggttgttcttg

SEQ ID NO: 30430 - DNA, 121 bp, Artificial Sequence
  Synthesized
  misc_feature (61): n=c or g
cttaagcacgatgtagcagtcggcctcgtagaacttcccatagaaggcatcatctaccagngtgggcacgaagttctcgatctgccagatgctgaggccgggcagctgccccacgtcctca

SEQ ID NO: 30431 - DNA, 121 bp, Artificial Sequence
  Synthesized
  misc_feature (61): n=t or c
ttgtggcactaacaacacccctcatttcatcttgtgctgagactcaaatgtgaaggactgntgctctcatgagtatccaaggatattattccccagcagatgtgtgctgtgctgtgacaca

SEQ ID NO: 30432 - DNA, 121 bp, Artificial Sequence
  Synthesized
  misc_feature (61): n=a or g
ctggacatgtagtgcaaacctattcaattgctagtaatgctttcagattagtgttaactgntgatgttaatttgaaagtacgcagcagcttctcagccagttacctcggaattcccttctc

SEQ ID NO: 30433 - DNA, 121 bp, Artificial Sequence
  Synthesized
  misc_feature (61): n=a or g
tgcaaattccactgcccgctcgctgcacactgacacaagtaggattgtacttccactgccngttgttctgtttgtgccaatgccaaaaatctatccaatgagtccaaacatatgaagcttg

SEQ ID NO: 30434 - DNA, 121 bp, Artificial Sequence
  Synthesized
  misc_feature (61): n=t or c
atagaaagaggaattaatttaatgctcccttagtcaataaacgggactgtgaagacagtgnctgttgttacttatagaagatagtgggtagggtagtcaggcatagatttccagggggaga

SEQ ID NO: 30435 - DNA, 121 bp, Artificial Sequence
  Synthesized
  misc_feature (61): n=t or c
tctgggaatgtgatgaggctttgtctagaaatatgtatagaatgttgacagttgtcaaaanctaatcttagaaaataaatcctgtcttttccttttctggggagaaaagacggtcatgttt

SEQ ID NO: 30436 - DNA, 121 bp, Artificial Sequence
  Synthesized
  misc_feature (61): n=t or c
gcaaggaaggctgcatcatgatgctctgttttatgggaatttagacactgcttctgcctgngtgccttctgagaagtacttattcacctttaaaaacatctcatacctagctgcatgcata

SEQ ID NO: 30437 - DNA, 121 bp, Artificial Sequence
  Synthesized
  misc_feature (61): n=a or g
cgtacatgtgctctttccatctcctccagtaacacgcatgcaaacaattctctcacatacntgctggcaaactgtgcaagtcaccattctccacttcagtttctttgcttcgcacactgat

SEQ ID NO: 30438 - DNA, 121 bp, Artificial Sequence
  Synthesized
  misc_feature (61): n=a or g
cttgcatgtgtgcaaagaggtgtgctatccctcagcctcatccaaattactttgaattcantggcagacttctccatcagtctccagctttgcttttcatgctacctaattggatttccta

SEQ ID NO: 30439 - DNA, 121 bp, Artificial Sequence
  Synthesized
  misc_feature (61): n=c or g
tcacatcacactgaattggtgtctttcattaaccacctgcttcctagagaaagaaaatttnctactgttctttcacctggatttcaacaaagccttgatcaactaccagacgtgaaatttt

SEQ ID NO: 30440 - DNA, 121 bp, Artificial Sequence
  Synthesized
  misc_feature (61): n=a or g
accgcgtggtacagagctgctgagagctgctgctcatcactacgggtgcattctgaacacngctattgaacgagggacagtttcacctctactgatgaggtgatgggactccaatgaaagc

SEQ ID NO: 30441 - DNA, 121 bp, Artificial Sequence
  Synthesized
  misc_feature (61): n=a or g
tactctgtaacagtaacttgcaacgtttatgatacatcagtaaagggggatgccattagcnatgacagaaaatgtttgatgctggcagattagttaacttcttgttaattgagacttctca

SEQ ID NO: 30442 - DNA, 121 bp, Artificial Sequence
  Synthesized
  misc_feature (61): n=c or g
gaaatgagcttggaaaaagaatatattggctggtatcaaaatttaactatcaggtatcctntctatatggagctctgcaacaggtatgccaaggtacaccatcttcttaaacgctttaaca

SEQ ID NO: 30443 - DNA, 121 bp, Artificial Sequence
  Synthesized
  misc_feature (61): n=a or t
aaggaatcttgaaatcagcttcccatttgtctgccttcccaaagccttagaaatactcatncttacaacagcaaaccgcagccccagcgtgagaaaggtcccaccccccaggaatggggcc

SEQ ID NO: 30444 - DNA, 121 bp, Artificial Sequence
  Synthesized
  misc_feature (61): n=t or c
ccttttacagccttgcatacccagggaggaataagaggcatttaaaactccaccacatctnttcctgctctgcaaatccacctcatgatccttcatttacctgcctatctatccatctatt

SEQ ID NO: 30445 - DNA, 121 bp, Artificial Sequence
  Synthesized
  misc_feature (61): n=t or c
tttggctcagcaaataattgtgatctgtacataatccaatcacatacagctggaaggcagngatttttctggtgaagtttgaaattaggtatgggtgtaacaaaggtcctcactgtaggca

SEQ ID NO: 30446 - DNA, 121 bp, Artificial Sequence
  Synthesized
  misc_feature (61): n=c or g
ggaaactgctcagacccaaaaagcactgagctgggactcgggatgcgtggtcaggccaagnctggtgcacagaacctgtgtgtaaaaccagagcctgtgcttccggcaccgcttcactgcg

SEQ ID NO: 30447 - DNA, 121 bp, Artificial Sequence
  Synthesized
  misc_feature (61): n=t or c
ggctgtagtagactacaggggccactgcctccagaatcacagacaggaccttgggcacctngctgaggcatcttgaaaggatagatggatggggtgcatcccagcctgccagagggcatcc

SEQ ID NO: 30448 - DNA, 121 bp, Artificial Sequence
  Synthesized
  misc_feature (61): n=a or g
aaagatcacccctctcacctgcatcacagccagttcctttgccaacacaaccacgccgtgngctgaatgcaaatcagtctcatgccacaggaacctatacaggctgaccaaccatacccct

SEQ ID NO: 30449 - DNA, 121 bp, Artificial Sequence
  Synthesized
  misc_feature (61): n=t or c
gaagaagcgggccataaaggaagggttggtgtcctaccaggaccggctcattgctgaatancagacgtgctccaacgaggtgctgattgtaagtcatgggcagtagggtgggagcagtagc

SEQ ID NO: 30450 - DNA, 121 bp, Artificial Sequence
  Synthesized
  misc_feature (61): n=c or g
tcaaattctacccaaatgcaaaaagatgaactgctcagttttaagcgtcattatcaaaganttgtgaaaagagtcttgttttaatggccagattttgaaatcatcgtcaagagagtagaat

SEQ ID NO: 30451 - DNA, 121 bp, Artificial Sequence
  Synthesized
  misc_feature (61): n=t or c
cttggaaaaccaggaggtcttataataattgagtaaattaaacactttatttcatacacantaaaggtctctaaagagaaaagctggcttctactgtatgctatgaagagttcaattaaat

SEQ ID NO: 30452 - DNA, 121 bp, Artificial Sequence
  Synthesized
  misc_feature (61): n=a or c
agagcgatggccaagagacaacattaactgctcccagagcttgtaaatggcttgagaacancatggggtgtgatgtactgagatctcgggattgcattttaggatttagctgggagcagat

SEQ ID NO: 30453 - DNA, 121 bp, Artificial Sequence
  Synthesized
  misc_feature (61): n=t or c
gatgcaggaccaccacacactttcatctaatgtgattgggaaaaaggcagtgctctccccngcctcagaaagtaagctgggccacaggaatctgagataccttacggtttccttctcccat

SEQ ID NO: 30454 - DNA, 121 bp, Artificial Sequence
  Synthesized
  misc_feature (61): n=a or g
ggaacagatgagagaagaaagagagcttgttgaacagctgcgtgaggtatgtgagtgttgntagaactgtgctgatctaatgtattttgttttctttaggaagttgcataattaggataat

SEQ ID NO: 30455 - DNA, 121 bp, Artificial Sequence
  Synthesized
  misc_feature (61): n=t or c
agagctgctgccctcactgagcacttataggtgtttgtaggtgtatttctgtttaaagtanggagcctatatgttcaactggcaggtagttaagttcaactggcaggtacttaagtagttt

SEQ ID NO: 30456 - DNA, 121 bp, Artificial Sequence
  Synthesized
  misc_feature (61): n=a or g
aatgaaagctctcctttgtccacatgttgccattacttcctcagtctgagggctcaagganggaggctaccgtatcgagaaaacagaccctgagaagatgagaaagagtaaaattaaaaaa

SEQ ID NO: 30457 - DNA, 121 bp, Artificial Sequence
  Synthesized
  misc_feature (61): n=a or g
agtaaattacctagctattaaataaaacaaatacacagtgcatagatataaacatgttatnccagatgtagctgtgaacaatccagatgagaaagaaatatctcccatagacagctgtcta

SEQ ID NO: 30458 - DNA, 121 bp, Artificial Sequence
  Synthesized
  misc_feature (61): n=t or g
agttttccctgtccagttgctagggagatgacatttccactgtctggctctgggcaagtgncgtgagttctggtggaccacttccttgtcaccgttcaccatagagctttcaggctgttga

SEQ ID NO: 30459 - DNA, 121 bp, Artificial Sequence
  Synthesized
  misc_feature (61): n=a or g
actgagaacctccagcattagtgtgtgcagcagcagcagcacagggttacgcgctgtgctnaagaactgctctcaaaatgaaggcctgggtgcaaccagagaaggtgaagagacataatgc

SEQ ID NO: 30460 - DNA, 121 bp, Artificial Sequence
  Synthesized
  misc_feature (61): n=t or c
cagactctaaccctaaacctgaccctaaccctgaacgtaacgcctaagcctgaccctaacnttatccctaattctgcctctagaccatgctttccccactcgctagatgcacaataaaccc

SEQ ID NO: 30461 - DNA, 121 bp, Artificial Sequence
  Synthesized
  misc_feature (61): n=t or c
caatatcctgattaggtcctggaatgcagtactgctattagaattattgtcctaaagcccngttaatggtacatcattaaaatctcctttaacttgcagaaagtaccaatcagctctcaag

SEQ ID NO: 30462 - DNA, 121 bp, Artificial Sequence
  Synthesized
  misc_feature (61): n=t or c
aattgatttcctgtgggaaggctgcagctttaggaggggatgggaatgaaacaaccactcngtgaatgaactgagggggggtcaatgtctgtagttaatcagctgaaatggctcttagtta

SEQ ID NO: 30463 - DNA, 121 bp, Artificial Sequence
  Synthesized
  misc_feature (61): n=t or g
cctctcatgggttacttatgaatagaatcccaacattagaggcagttattcaaagtaaaanactggcctttgtccagcatctaaaaagagagagattgaggcagaactcatctcagattcc

SEQ ID NO: 30464 - DNA, 121 bp, Artificial Sequence
  Synthesized
  misc_feature (61): n=t or c
ccttttgtatctaacatagcatatttgtgtacagcaacaaagaaacagggctatccttcgnattccaggtttaaaataagtaatagcaaaatagcttaggaggttagtaaatgttcttccg

SEQ ID NO: 30465 - DNA, 121 bp, Artificial Sequence
  Synthesized
  misc_feature (61): n=a or g
gttcctggtgatgtagaagactgcatgctttgacatagtgcatttgttgttgatgaagacncagaaattgggtatgattaaatgaaataacatcagagaatggaaataatgaaatatatga

SEQ ID NO: 30466 - DNA, 121 bp, Artificial Sequence
  Synthesized
  misc_feature (61): n=t or c
atatccagattgtacatcagcatcactggattccactgggggaaaaccagaaggctgttcngagcagtgggcaggaataaaggagggagaaggagaggagggacagaggacattacaacat

SEQ ID NO: 30467 - DNA, 121 bp, Artificial Sequence
  Synthesized
  misc_feature (61): n=a or g
aatccaagactaaaagctaatgatgaatttgtaaagcactcaagatcacctacacaacacngaagaagccaagaaaggacagataacagagcaattctcaactgacagttcgaagaatcaa

SEQ ID NO: 30468 - DNA, 121 bp, Artificial Sequence
  Synthesized
  misc_feature (61): n=t or c
tgtatgcttagaaagggctctgtgaggtccttgcagaagatccttgttcccaagccactcntgtggtcatgcactgggaatgtgacctgcatggctctgttttgggggattttttgtgaga

SEQ ID NO: 30469 - DNA, 121 bp, Artificial Sequence
  Synthesized
  misc_feature (61): n=t or c
aataggcaatttgccactagcatcactgtgaagggaatcaaagcttgtgctttatgcaacnatagttcatagtgttcttctttggctggctgtattttggggttattttctatttattatc

SEQ ID NO: 30470 - DNA, 121 bp, Artificial Sequence
  Synthesized
  misc_feature (61): n=t or c
gcggtgggggagggggggggggcacagcgcgggttggttttaagttctttttatgcttttnggtgtttgtggggaaagaacaaaggcagttttgcagcaaagggaggtgaattgctctctg

SEQ ID NO: 30471 - DNA, 121 bp, Artificial Sequence
  Synthesized
  misc_feature (61): n=a or g
aaagctgcaattttcatcaaacaaacaacgagcccaaagaaatctttctcagtatctaacntctaacatctgtgtcaatcacagcaaacactcttatggttctttgcatggaagcaagaat

SEQ ID NO: 30472 - DNA, 121 bp, Artificial Sequence
  Synthesized
  misc_feature (61): n=a or g
caggaaacacatgccaccttccaatccagttcttacacatcccaggccagcctgttgctcntcttccctcaaagcatttcttcctttcagcatctttctctatttgtctcagaaaccaaca

SEQ ID NO: 30473 - DNA, 121 bp, Artificial Sequence
  Synthesized
  misc_feature (61): n=a or g
ctttctgttccatctgtacgtttgtgtggttagctccaaatgatagtgtcctaacaatcanttatttgggagtagacctcagagcccttcaagctttgcataacagaacaggaattactat

SEQ ID NO: 30474 - DNA, 121 bp, Artificial Sequence
  Synthesized
  misc_feature (61): n=a or g
gctgacatgtgtcagtgttttggttgctttctctttggccaccaacacactacactgcctntctgaaggttagatctctcatttgtctcggatcgttttcttctgaccctatcagaggaag

SEQ ID NO: 30475 - DNA, 121 bp, Artificial Sequence
  Synthesized
  misc_feature (61): n=a or c
aacgacagatagggacctctaaaggctgtcaggacactacaaaactacacataaatgagcntgggaaaagaatggtgaaaaacatttgcatttaatgtaaccataatactagtgattagcc

SEQ ID NO: 30476 - DNA, 121 bp, Artificial Sequence
  Synthesized
  misc_feature (61): n=c or g
gagttagctgctgttaatgagtgcattgcaccagccatgccaagtggctttctgagcactnaagggatcctttttgaattgctgctcatgtgtatgtgatcttaaagcctgaaggtgcttc

SEQ ID NO: 30477 - DNA, 121 bp, Artificial Sequence
  Synthesized
  misc_feature (61): n=a or g
tcacacacattcttgtcaactggaacttgtcatggtgaagtattaaattttgtagatcacncggcatctaaatgttctttaacagaaaaaatcatgtatctttatttcaatacagacacaa

SEQ ID NO: 30478 - DNA, 121 bp, Artificial Sequence
  Synthesized
  misc_feature (61): n=t or c
tttggtgctccttctccatggggtggggagagagaggtttgtgttggctctgcattggctntgtgtgtggcactgagtcctagtgggatgtggcaggctgatcgtgagctgcacagaagtc

SEQ ID NO: 30479 - DNA, 121 bp, Artificial Sequence
  Synthesized
  misc_feature (61): n=a or c
aaattagagtgagctcaggggaggaagaaaaagaaagattgctctcattccaaaatacctnggctcattttctacctggtttcccagggaaatggaggcaatcagtgtgcatgtgagcatc

SEQ ID NO: 30480 - DNA, 121 bp, Artificial Sequence
  Synthesized
  misc_feature (61): n=a or t
actctgctctcaaggcctatttggttttagctgtgtttgcaaaagaatagagagcatgcangtatgggctccttgaatttgggaagggagctgggggtcctgggaatcctgtgctcaccct

SEQ ID NO: 30481 - DNA, 121 bp, Artificial Sequence
  Synthesized
  misc_feature (61): n=a or g
gcaagagatatggggtcatggcagagattttggaagtgacgagagagtttactggggattntggattgcttgtatctttcattcctattaacagaagtttttgtcattcaaccttctggga

SEQ ID NO: 30482 - DNA, 121 bp, Artificial Sequence
  Synthesized
  misc_feature (61): n=a or g
gagggtcacccgttcaggtgcatgcagacccattcatttctgtgcagcatgtacagcaacntgtgcttgtgagaactcggcagtttgtggttagcttttcctgtgaacggtgtgagtactg

SEQ ID NO: 30483 - DNA, 121 bp, Artificial Sequence
  Synthesized
  misc_feature (61): n=a or g
ttcaattaatactgtgcgggaagttgaccacctcagggacaggaacagtggtacgttcagntggtgcattttgcaatgaattgtgcagtagtcattttgcagtcgcatagagcagtggttt

SEQ ID NO: 30484 - DNA, 121 bp, Artificial Sequence
  Synthesized
  misc_feature (61): n=a or t
caagatgcttcatagcttagagtatgtattgcattctaaatcagaattcatgcttatgcancctaaccagaaaagtacccaaagaatgataaggctaaacagctgatggtcccagcaactc

SEQ ID NO: 30485 - DNA, 121 bp, Artificial Sequence
  Synthesized
  misc_feature (61): n=t or g
aacctgatgaaatgcagatgggaatggaatgtgccagtttgttccttaaaacctgagaccnaagagtcagcatttctagtttttaccttaatacgtaaggatctgtatttttacagtttaa

SEQ ID NO: 30486 - DNA, 121 bp, Artificial Sequence
  Synthesized
  misc_feature (61): n=a or g
aaacagactatttcctacattcttttaggcaaacaaaatatgcagtactcctgaaagtgancacagagcccatctctggcttcaggtcttcccgcttgtttagagacatacaaaaaagtta

SEQ ID NO: 30487 - DNA, 121 bp, Artificial Sequence
  Synthesized
  misc_feature (61): n=a or g
agggcaaagaaaccatgataacaaagtcaccttccaggaaagcagaagtcagcaacacccntttcaggaactgatgtcctaccccacttgtgtagccacaggtgtacagattaactctcta

SEQ ID NO: 30488 - DNA, 121 bp, Artificial Sequence
  Synthesized
  misc_feature (61): n=a or g
gtttctgagtttctaataaaaataaaaactaatgactttgttgttagctaagctattgttntatgtgttcattaggtgtcaacttcctgaaagggtcaatatatacaaatatatatacata

SEQ ID NO: 30489 - DNA, 121 bp, Artificial Sequence
  Synthesized
  misc_feature (61): n=a or g
taactagtagtccccacagacagccaagtctgtacattaggccagttagtgtctaaaatgngtactttacacaaagaaaaagtacctgcccataagactacaattattcatgagctactag

SEQ ID NO: 30490 - DNA, 121 bp, Artificial Sequence
  Synthesized
  misc_feature (61): n=a or g
tttgtaataactaccattacgatttaaataagtactgacaataacagaatgcaggaagatntgaacttacacatttatctgctgtgcctgcatggccctcatgaatccatttattctttga

SEQ ID NO: 30491 - DNA, 121 bp, Artificial Sequence
  Synthesized
  misc_feature (61): n=a or g
gtgtatgatgactttaaattatagtaaagtgatccatggagaggggaaaaactgctatcangagagtaagtgaatgcaaaagaagacattggtaaccttgatttatgtgttctgctgatgt

SEQ ID NO: 30492 - DNA, 121 bp, Artificial Sequence
  Synthesized
  misc_feature (61): n=t or c
taacagtagagaaagtgctttctagtagttcagctaactaaatctcttctcagtagtactncccaaacattgctcaaaacagcatttttgtttatcaggctgatacatgggactgtgaaac

SEQ ID NO: 30493 - DNA, 121 bp, Artificial Sequence
  Synthesized
  misc_feature (61): n=t or c
ggtgtgatgttagatctgtgactgtaagagcaatctcctagtaggttctgtaactaagaangtggtgggtataaagaaagccctgcttatgcccgtccagtcaagcacagatctataaata

SEQ ID NO: 30494 - DNA, 121 bp, Artificial Sequence
  Synthesized
  misc_feature (61): n=t or g
ttaatctctacctcttcatcacaaagtcttgttctctcttaatggaaaccgacttctgtangttttcgaaaagtaacaattagaagttatttagactttgagaacaagggcactggaatct

SEQ ID NO: 30495 - DNA, 121 bp, Artificial Sequence
  Synthesized
  misc_feature (61): n=t or c
ctgagctcctttgaagaaaccacctgagctaataacatcatcaccttccccgttatccacnctgcgcatctgctggtgcttgtgtgctcctgcatttcctgccttcctctagtatgcaggg

SEQ ID NO: 30496 - DNA, 121 bp, Artificial Sequence
  Synthesized
  misc_feature (61): n=t or g
tgcttggtttagaaatagagatggaaacgatgcaattgctgttttttagcaaattacagtnctatgtttacgtggttctattcatcaagtgaagatggatcatataaaaccatagtatgaa

SEQ ID NO: 30497 - DNA, 121 bp, Artificial Sequence
  Synthesized
  misc_feature (61): n=t or c
cctatttgtttgctatcatcatacattaggatgtctatagcagagtagtacttgtggtggntgctttactcactgaagtctattttcattgccctaggatccagtgacagacactaggtac

SEQ ID NO: 30498 - DNA, 121 bp, Artificial Sequence
  Synthesized
  misc_feature (61): n=a or g
taatgcacagtagagaggaggggaagaggacaaagacctcaagcagagggctagaagaagnataagctgatgagggaatattgctctgaagaagtaggttagcaaaaggacattttcaacc

SEQ ID NO: 30499 - DNA, 121 bp, Artificial Sequence
  Synthesized
  misc_feature (61): n=t or c
tgctgctctgcaaaccagagccaatgcacttgagtgcattcaggtgtatcgcgagtacttnctaagtgcctgaaaagcctcagtgttggtgtggagggacgtgttgttcagagccgtctct

SEQ ID NO: 30500 - DNA, 121 bp, Artificial Sequence
  Synthesized
  misc_feature (61): n=a or g
accactcagtcaccatatgatctcaaagcttcacaaagataaaggaatagctgtctttaanaactctattaatcacaagaacgatctgcgtgttaggcatattcccaaagctttctaaaag

SEQ ID NO: 30501 - DNA, 121 bp, Artificial Sequence
  Synthesized
  misc_feature (61): n=t or c
aatattttctgacaaatctacaggcagaaaaaaaaaccaacagcaatcttcggtgtttacnaccttgtggctcgagctggtaaatattcccctctcacagacacattctttcatcattcgc

SEQ ID NO: 30502 - DNA, 121 bp, Artificial Sequence
  Synthesized
  misc_feature (61): n=a or g
ggcagatcagacttgtttttatgggggtactttggcttctttctgactggaactgtagcantttctctgtatcatttacattagaacagcaatctcagatttcaaggcagtggctttcggt

SEQ ID NO: 30503 - DNA, 121 bp, Artificial Sequence
  Synthesized
  misc_feature (61): n=a or g
tgaatctgatgacataacgagagatagataggaaacagaacagagctcaaagaaacgttcntattcttgacagaaaagtaatgcacattttacaaatttgaatgagccaccttattctgag

SEQ ID NO: 30504 - DNA, 121 bp, Artificial Sequence
  Synthesized
  misc_feature (61): n=a or g
gatttgctctcagaccttgtgtggagaagatgtcatttttctgttggtctgtatgccatcntaaggacccactcatgcaccaaagtcctcccaactctgctccatgtgaggacgtgctggt

SEQ ID NO: 30505 - DNA, 121 bp, Artificial Sequence
  Synthesized
  misc_feature (61): n=a or c
aggctggaagcctacaagctgaaggtaccaatataagacaccaccttcaaaaagcctaggnaaacaaatgtgttttaagccagtgggcatttaaaggacatgtcagtgcttcatgcttaac

SEQ ID NO: 30506 - DNA, 121 bp, Artificial Sequence
  Synthesized
  misc_feature (61): n=t or c
ttcactttcctgctgatacagagtcactatgtaaaacattcatggcctatgtaatctctcnaatcctaaacaagattagaatagggaaatgaagaatgaaggtgctgcctgtggcagcaga

SEQ ID NO: 30507 - DNA, 121 bp, Artificial Sequence
  Synthesized
  misc_feature (61): n=a or g
aaacagagaaaaagaaaaatcatcacaaacaatagaaaaatgtaagtggaaaatgcagacncacagatctgtaaaacagcttctgaaagcatttcagtcatatgaaggatggtttagagtg

SEQ ID NO: 30508 - DNA, 121 bp, Artificial Sequence
  Synthesized
  misc_feature (61): n=t or g
tcagccaagttttgctcatgtgtgcaacagtgtggattagatcctaaaagaaaccttcccntgcacagcgcaggaatcacagatttatgcaaatatggtgtaagtgtatgatccaaccaaa

SEQ ID NO: 30509 - DNA, 121 bp, Artificial Sequence
  Synthesized
  misc_feature (61): n=t or c
agcagggcagttgtcagaacatatgtacctacaaggcagacaccaacattaacttctcttntcaaaagctttcttttctccctgccccctatagccaaaatccccttatttctgaaacttc

SEQ ID NO: 30510 - DNA, 121 bp, Artificial Sequence
  Synthesized
  misc_feature (61): n=a or g
agaaaagcaaaatgctccttagggcatcagaggaagctatcagttctgcagattagcaacngcatcttttgatattctgaagggagagaaggtcatatttctggagactgagctacagcac

SEQ ID NO: 30511 - DNA, 121 bp, Artificial Sequence
  Synthesized
  misc_feature (61): n=t or c
tgtttatgcagatgtctccgggctatgagtatttgcggcagtattttccccttgcagcagntcgggaagaagctctgcttttccgaacgccgatgttggagattttcaccccaaatcccac

SEQ ID NO: 30512 - DNA, 121 bp, Artificial Sequence
  Synthesized
  misc_feature (61): n=t or c
aattttgtatatgcaaaatatttgaaacaagcttgccataggttgacataggtttttggcngtttctaatagcctgaactcaagattgcttcttttttttttttcctttcaaaaatctcac

SEQ ID NO: 30513 - DNA, 121 bp, Artificial Sequence
  Synthesized
  misc_feature (61): n=a or c
ataatcattttatacagtaaaagtccctttttcgaaactgttgatgtcaaacagttggacngttgtagaggctgaaacttcacccatactttccagttagacaaccgcaatcgaaaaacaa

SEQ ID NO: 30514 - DNA, 121 bp, Artificial Sequence
  Synthesized
  misc_feature (61): n=a or g
catttgctatcagtaagaaaattcgcttaagcagctgcgcaagtgaaatgcaaaatacacngccgagatgtgctctctggatggcaggatgtgcactgccaaagaagctctcacagaagag

SEQ ID NO: 30515 - DNA, 121 bp, Artificial Sequence
  Synthesized
  misc_feature (61): n=t or c
aggaggagtgctggctgggccccatctctttccccaaacgtgtgctttcataatgtccctncattaatgtccctgttcatttccccatggagaacatttaggatcctacatagaaaacttc

SEQ ID NO: 30516 - DNA, 121 bp, Artificial Sequence
  Synthesized
  misc_feature (61): n=t or c
tacaggaaaatcagaaaaactttttaaaagcctgacagtggtcatgtagatatggactaanagcatgaaacactttttattagaatgatgtttttaataagagtactaatgtatctgtcaa

SEQ ID NO: 30517 - DNA, 121 bp, Artificial Sequence
  Synthesized
  misc_feature (61): n=a or g
taaatctgtatttacagtttgtggtaatttaggcctttcatcactttgtggagctcccacngtgttcattgagtgcagctgctgtccctctggttgcagtagggttgaagtgccttgggac

SEQ ID NO: 30518 - DNA, 121 bp, Artificial Sequence
  Synthesized
  misc_feature (61): n=c or g
gagggcttttccagcctgaatgattctatgcttctatgaaaaccagctgtcagactgcatnttccaccttccttcacaaccactgcagcctggcatttctctatgtagatgcccgtgttcc

SEQ ID NO: 30519 - DNA, 121 bp, Artificial Sequence
  Synthesized
  misc_feature (61): n=t or c
attatatcagcagaaatactatgttcatgctgaccatttgcccctatatcttcagagttgntctttggtttcagcaccagggtaggaaattactgttattgtgaaaggctcttgtctctaa

SEQ ID NO: 30520 - DNA, 121 bp, Artificial Sequence
  Synthesized
  misc_feature (61): n=t or c
tccagtgaaacgaatcaagaagcggagatcgaagctgctgattttactccacatgcagagngttattctcagaagctgaaggtacctcagcaaatagcttgacatccgtgaaaagaacaaa

SEQ ID NO: 30521 - DNA, 121 bp, Artificial Sequence
  Synthesized
  misc_feature (61): n=t or c
cctgaaataaatcatggactgtctccttttctaaagtggttcagcctatatcattaagcantaatagctcagtgatttaagtttaaaatgggattttgtaatggatttcgaatgacagatt

SEQ ID NO: 30522 - DNA, 121 bp, Artificial Sequence
  Synthesized
  misc_feature (61): n=t or g
aaacttcctaaagaccttgagatagattttacactctgtatcagtgtgatatttcctccantgaaaataaggattgatgcttctgttggaaatggtcttgtataaattcatcctttctgct

SEQ ID NO: 30523 - DNA, 121 bp, Artificial Sequence
  Synthesized
  misc_feature (61): n=t or c
tgattattccagtagttaaaataatagttatttccagcatggcttacattttctttcttangtaccaaatgttaaatttcaaaacgtgtagatttcagctgccactaagcttcagtcttca

SEQ ID NO: 30524 - DNA, 121 bp, Artificial Sequence
  Synthesized
  misc_feature (61): n=t or g
gtgataacatgacttagagaatttctgggtgtggattgttacaactatggttttaaatggnggtagtgaatgaaggaaccttgggaaacctgagactaaaataatgtgcagagagcatgaa

SEQ ID NO: 30525 - DNA, 121 bp, Artificial Sequence
  Synthesized
  misc_feature (61): n=a or g
atcgcttctaaaacggaacagaaggtttgccagagcaagcctgttggcaagcgcgtcgagntaaagagtttcacgttatttccccacgttttcagctaaaaacacctttaagcaaatcttc

SEQ ID NO: 30526 - DNA, 121 bp, Artificial Sequence
  Synthesized
  misc_feature (61): n=t or c
agagatgagaaaagctcacagcacctgacaacctgcctgtgctgcatgaagtgcattgatncccacagctccacagggagatctgcacaacaacacgctgttgtcgtgcatttaaggatct

SEQ ID NO: 30527 - DNA, 121 bp, Artificial Sequence
  Synthesized
  misc_feature (61): n=a or c
aataaaaactaatttccattaatatagcgaggtgtttagtataaattattccagtgagagnagctatgaaaattgttttgaaggatttattttccacttacaagtttctttcttaatgagg

SEQ ID NO: 30528 - DNA, 121 bp, Artificial Sequence
  Synthesized
  misc_feature (61): n=a or t
tactttgaagtaataaaatttctaattgtgaacaaaagttagagaatgaatgaagtaaaangagctttagctgggttctggcccaattgctatagtagatatttgggatttagtccttcat

SEQ ID NO: 30529 - DNA, 121 bp, Artificial Sequence
  Synthesized
  misc_feature (61): n=t or c
catggaaagaaccctgtggctgctaacagcagagtgaaactgggtgtggggaaaggtgaantaccttcttagatggtggctgaaaagaacgagaagattgcaggtgcttacaaggagggga

SEQ ID NO: 30530 - DNA, 121 bp, Artificial Sequence
  Synthesized
  misc_feature (61): n=a or c
acagccgtgggccatggctcgggaaaatgagcactatagttagacactggtgttgtgtccntgccagcagaccacatacactccaggcagttacaagacaggatcttgctcatctgcaccc

SEQ ID NO: 30531 - DNA, 121 bp, Artificial Sequence
  Synthesized
  misc_feature (61): n=t or c
acttttctattctgtaattttgtaatgcacagtgcgctagactccattgggtaaaaagcancaccactcaaagatgtgttatcagaaatactaatttcatcttccaaccagtgagatggag

SEQ ID NO: 30532 - DNA, 121 bp, Artificial Sequence
  Synthesized
  misc_feature (61): n=a or t
aactagtttaactaatgggaaaatgtagagaggttaagtagtaagggtgatgaaagatttntggaacttgctgtatacagaaagatttatagattagaatcaagaggcctgctagatcttg

SEQ ID NO: 30533 - DNA, 121 bp, Artificial Sequence
  Synthesized
  misc_feature (61): n=a or g
agtgtttgatagttcctctgtaagcgatctgggatgtatggaggagtgcatcagccagcantcccaaactcaggcggtgttcccgtgtgattttttagaagccccagtgacatctctgtca

SEQ ID NO: 30534 - DNA, 121 bp, Artificial Sequence
  Synthesized
  misc_feature (61): n=a or g
tgccatcatgtttagtcggctttgaattttgacttcacagcttgggattgggggtttggcntgggcataaaagtgagacccacagagccatggggactcccattccatggagagacctgca

SEQ ID NO: 30535 - DNA, 121 bp, Artificial Sequence
  Synthesized
  misc_feature (61): n=t or g
cttctctgctccttttgtcatttgacaagaaagtgggttcctgcccagctgcaagaggcgncattgtaagatgagaaagataacaaagcgtaaaggagatgatacagtcctagtaatttga

SEQ ID NO: 30536 - DNA, 121 bp, Artificial Sequence
  Synthesized
  misc_feature (61): n=a or c
ccagtgaaatgaagtatttatgtgaaattatttaaattacttgcttaaattgaagaagttnagtccccagaaagacaaccctgtcttccctgcagcttgtagctgcaggatgtcactgtgc

SEQ ID NO: 30537 - DNA, 121 bp, Artificial Sequence
  Synthesized
  misc_feature (61): n=t or g
caaaccacaactacctgaagagacaaacaaagccagacaaaggctataaagtcactacagngaacttccatggggtcaactcacagtcaaccagctggaaatgataattacagattcagca

SEQ ID NO: 30538 - DNA, 121 bp, Artificial Sequence
  Synthesized
  misc_feature (61): n=a or g
agggaaaagagcacagaagtgaagtgggcagattggccaaggtcagaaggaactgggtagngaagccagaaatagcagcacgtcgtgctgccagcctgtgccttggctgcagacccaccgc

SEQ ID NO: 30539 - DNA, 121 bp, Artificial Sequence
  Synthesized
  misc_feature (61): n=c or g
ggatgtgtgtaacagaaatgcacatactttgtgcaagtggctaacatatggagaagaaganaggttgaaatagaatatctgattttggatgtttgtactttaccttcctttacaagaatta

SEQ ID NO: 30540 - DNA, 121 bp, Artificial Sequence
  Synthesized
  misc_feature (61): n=a or g
cctctcctggttgctgttcctgccacagctcacagagcaacctggccctagacccccacancttctctctgctccttagactaggagcaaaccgtagctatgatctcctttgaggctgctc

SEQ ID NO: 30541 - DNA, 121 bp, Artificial Sequence
  Synthesized
  misc_feature (61): n=a or t
gcaagctaaactcctctctggtttcaggactttcaagctactgaatctcctactcgagctntttctgtgagttaacttgttgtagtacaggactctacaaggcctaaacggtgcagggaaa

SEQ ID NO: 30542 - DNA, 121 bp, Artificial Sequence
  Synthesized
  misc_feature (61): n=a or g
ccacttttctgctgtataactgtccataatgctcttatagcaaaatttccaattccttatnggttcacttcagtgggctttatgttcattgaaagataacaggctgagtttgtagtgtcag

SEQ ID NO: 30543 - DNA, 121 bp, Artificial Sequence
  Synthesized
  misc_feature (61): n=a or g
caccatcctctgcaccttcagagcagtttatctcaccaaacacttcaactctgtattttgnctttttcaaagttgttgaagttttcaacaaactgcagaagattgtagcagggtgcaagaa

SEQ ID NO: 30544 - DNA, 121 bp, Artificial Sequence
  Synthesized
  misc_feature (61): n=a or g
atgttatctagaaagtgtcaaacctctcttaaaagttaaaagaaaagggaccgtgctcaanttctatttttttcctttactaagtaaaggttttaaaatttcatgtatgtattttatgcac

SEQ ID NO: 30545 - DNA, 121 bp, Artificial Sequence
  Synthesized
  misc_feature (61): n=a or g
actgtataaggatctatcactgtctagtgaagagatggcataaacctgtgctttcatatgnggactccaagaattactaatgctagccactgagaaagattattacaaagttatagaccat

SEQ ID NO: 30546 - DNA, 121 bp, Artificial Sequence
  Synthesized
  misc_feature (61): n=t or c
ttgctacataattttactttattttttggtcactgtttatttttgacatagcctcttctantctcttgttttacatccaggttagtgttctttgcatcagcaccagaccttcattgctaca

SEQ ID NO: 30547 - DNA, 121 bp, Artificial Sequence
  Synthesized
  misc_feature (61): n=a or g
tctcaatttgaattttaagtacaaatgtcttcccgtgcaaagttaggatgaaccatcgttntatttcttgcttggtagtaaagtgtttgtattgtcatgtagaaaggagactgctattggt

SEQ ID NO: 30548 - DNA, 121 bp, Artificial Sequence
  Synthesized
  misc_feature (61): n=t or c
tttatcttctactccctcttctgctgcagacacgcttccaatccagtctccctaccttccngttacttaaacttctccccaccatatcaggacacttctgcacatcccatctcacaccagt

SEQ ID NO: 30549 - DNA, 121 bp, Artificial Sequence
  Synthesized
  misc_feature (61): n=t or c
tcttcaaaccaagtgacaaatgccaggtaggattcaccctgactgttcatgtttagatacngacaacttgaacattacaccatttcctaaacaagttctgaatgcctttccattcccttat

SEQ ID NO: 30550 - DNA, 121 bp, Artificial Sequence
  Synthesized
  misc_feature (61): n=a or c
tcaaatatttgatgtgaagttgtacgcaaacagcgaaagagtgcatctcattgtccataanggtctgacagtccaaccagaataaatttaccctttttgttgcaggtggatcacacttgaa

SEQ ID NO: 30551 - DNA, 121 bp, Artificial Sequence
  Synthesized
  misc_feature (61): n=a or g
aaatgttctgtaacttccaggaaaatgcacaaaggattcctggaatctctcaggataatgnaattgaggttggtccccaaccaccagcacagatccaagacgaccacatctttttctagaa

SEQ ID NO: 30552 - DNA, 121 bp, Artificial Sequence
  Synthesized
  misc_feature (61): n=t or c
aacaaacaaaagtctgggagaaaaggagcactgaaagagaagacaacgtaggaaaattccnatgctccaaatcagctgctatcctacagaaaggagtgctacgcttaatgcagaatatgtg

SEQ ID NO: 30553 - DNA, 121 bp, Artificial Sequence
  Synthesized
  misc_feature (61): n=t or c
agattgcattagctggaaacctgcttagaaatttcacctttgtcagtatgagttgattcangcctctgcaccaaggtctacctactgctgtgggttttcacagaggagctgaagcacaagg

SEQ ID NO: 30554 - DNA, 121 bp, Artificial Sequence
  Synthesized
  misc_feature (61): n=t or c
tcaaaaatggtaagaaggacaatttgaggaaactatcctcaaattgaggatattgagatantgagatattgaggccactatcacgtggccaaagtaagcaccatccctggtaagatggagt

SEQ ID NO: 30555 - DNA, 121 bp, Artificial Sequence
  Synthesized
  misc_feature (61): n=a or c
gaaagatgtgcatttgaaatgacagtttttctccttctccaccactgctatgaatcccttncacctctttcccctcaaaaaaaaataaatggtttacccacatgtcgtgatattactgcta

SEQ ID NO: 30556 - DNA, 121 bp, Artificial Sequence
  Synthesized
  misc_feature (61): n=t or c
tgggatccgagctgtgctgtgcagtgcttgaggtcccttcccacactgcttcagtgccttnggaggatctcatccccacacatagccatggagtgcaggagggctgcagcctgcccggctc

SEQ ID NO: 30557 - DNA, 121 bp, Artificial Sequence
  Synthesized
  misc_feature (61): n=t or c
agaccttagctcaggtagaaggtagctcatcagctgaaatgcattaaactttaaatgaaancctcccttgctaattcaaaaggaaagggattaacttagagcaccatgcttgctggttaac

SEQ ID NO: 30558 - DNA, 121 bp, Artificial Sequence
  Synthesized
  misc_feature (61): n=a or c
ttagaataaaatattagattgagaaacaggcaagctttatggaatgtcatttaatcacatntactccctgaaaaacagccagtaccacagcacccacagcattgacagtactaacagcacc

SEQ ID NO: 30559 - DNA, 121 bp, Artificial Sequence
  Synthesized
  misc_feature (61): n=a or g
ctttaattcatggaaaacaaatggtaacactttcagaaacattacaatcatcacttaaaantgattcactcattaaagaagtacaagctatgttatacaagcaagttcctatttctaccta

SEQ ID NO: 30560 - DNA, 121 bp, Artificial Sequence
  Synthesized
  misc_feature (61): n=a or t
gaagagacaactgaggaggtttgccatttgcaccatcaaggtgtactgtacagacagaagnagttatataatgttatgtaaccatttcctcctcccttctgctagaacaagcacttagtag

SEQ ID NO: 30561 - DNA, 121 bp, Artificial Sequence
  Synthesized
  misc_feature (61): n=a or g
gcatcaccgaaggagggaaggcactgaaagcctgacctgcttgtgatccttggcaacaaanctgcagctgggttattcatatgagctgtatatagatttcacattcagactgcttcctaga

SEQ ID NO: 30562 - DNA, 121 bp, Artificial Sequence
  Synthesized
  misc_feature (61): n=a or t
actctggcactaccacctcagcagagaaagcagaactcacagccttgttaagagcactggngttagcaaaaggaaaaagtgccaatatttgggcagacttaaaatttgcatttggggttgt

SEQ ID NO: 30563 - DNA, 121 bp, Artificial Sequence
  Synthesized
  misc_feature (61): n=t or c
gcaatacttcaaggagctatttcatgtaatgcatgtagaaagacacagcttcccttttcanggctacagaaaatagaaaaggaagggaaggcataaattccttccactccacgtaggccaa

SEQ ID NO: 30564 - DNA, 121 bp, Artificial Sequence
  Synthesized
  misc_feature (61): n=t or c
ggctttcagaacatcgggaggtccttgtagtgggctagaatatcatgtctgcagtcgcacngagtccttaaagctcactgctggtcaatgtttctaatagtcatgacagatggaacagatt

SEQ ID NO: 30565 - DNA, 121 bp, Artificial Sequence
  Synthesized
  misc_feature (61): n=t or c
gagcaaaatattgctactcatttccacaagcacattaactctggtcagtgtaacagatggngtttgtgaaaaaatgggagttacatcaactgtggatacaggagtctctttttatcctcac

SEQ ID NO: 30566 - DNA, 121 bp, Artificial Sequence
  Synthesized
  misc_feature (61): n=t or c
ggaacatgtacagaacagcaagataacaactattagcaaacaatatgtacaaagttggtanaagaagcaacatttacttaaaaactaaaatgctagaagaaatatgtatgcagatattgca

SEQ ID NO: 30567 - DNA, 121 bp, Artificial Sequence
  Synthesized
  misc_feature (61): n=a or g
aagctgtgggagcatttacctttcctctaggagctggaaactgggattcttacagtctcangagtccagaagccacacataaacacaagtgccaaatgctgcaaggttggcaaagctgaaa

SEQ ID NO: 30568 - DNA, 121 bp, Artificial Sequence
  Synthesized
  misc_feature (61): n=a or c
ccatctctgtgggtctgttggcaaacagaggagaacagcaaagatgctgacaggcagcagntgagcaggtgatcaaagggtcttcccagtacaagctgcacactggagcgtgtgtgtaaga

SEQ ID NO: 30569 - DNA, 121 bp, Artificial Sequence
  Synthesized
  misc_feature (61): n=t or c
attcacattcaatctgaaaagaaggaagacagatcagccttttggctggcatgctacttgngaaggcagtgaggaatggggaggatgtagtactggtaatagtaagtagcccagaacttgc

SEQ ID NO: 30570 - DNA, 121 bp, Artificial Sequence
  Synthesized
  misc_feature (61): n=a or g
tgtccatagaagatcatagtcctttccacagtttcctgagttttctacagaactctatttnagcagtttttattttggctagagttactgctactagggaaatattgccttaaaattgcat

SEQ ID NO: 30571 - DNA, 121 bp, Artificial Sequence
  Synthesized
  misc_feature (61): n=a or t
tcacgtaaaggaaaagttttctaataaaaggcaaagtccaagaaaccagaagggttgtgcngttgcagtttgttccgggtggctttgacagctataacagaggcactgtcagcagcaatag

SEQ ID NO: 30572 - DNA, 121 bp, Artificial Sequence
  Synthesized
  misc_feature (61): n=t or c
tcctcattccccatcacggtatctaaaagaagaggtggtgcagacgaagggaatggtgcangtgcatgttttcaaatgctaccctcaatactgtcaagacttgcacgtgcactctctagac

SEQ ID NO: 30573 - DNA, 121 bp, Artificial Sequence
  Synthesized
  misc_feature (61): n=a or c
caacttttaattttcttttagctttacacagaaagtgagaggaagaatgagagaggggttntatggagaatgagagatctgataaaagataaatttatttaaataatcaagaatagtgtta

SEQ ID NO: 30574 - DNA, 121 bp, Artificial Sequence
  Synthesized
  misc_feature (61): n=a or g
acataagttttgcaaggtgtaaagaagagaaagagtttttttagtaagcaacaataagcantctacaaactccctgtttttcacttttcccatttttatactatgactttctcctccacag

SEQ ID NO: 30575 - DNA, 121 bp, Artificial Sequence
  Synthesized
  misc_feature (61): n=a or g
ctgccagtaaatgttttacagctgagttcgatggatggttctttcatttggcatccagtgntatcagttggctgattgtgtagcagtgttggaatctgagcaacaatatatacatgtagat

SEQ ID NO: 30576 - DNA, 121 bp, Artificial Sequence
  Synthesized
  misc_feature (61): n=t or c
cccctcttttccaatgctagaaagacctgtttgtggggcagagctgctcacatcccttccngtgcaggacaaaacgaacgcagggctttgtagcagcagctgtggtttgagagcccagagt

SEQ ID NO: 30577 - DNA, 121 bp, Artificial Sequence
  Synthesized
  misc_feature (61): n=a or g
tgggctttgtgtattcaattttggatgtttatgtataaaagtttgctatagtctaaatatntactatcaggatctcagcaaactcagagtaacaaatagatattttcagaaagaagaaaag

SEQ ID NO: 30578 - DNA, 121 bp, Artificial Sequence
  Synthesized
  misc_feature (61): n=a or g
aacctatagccccagaggagtgcaaaccacaatgggtcatatttgtttggtagtagatctngcagctgatggtcttccaagctgtccatgcaagatcatgtagctggttggcacacagaga

SEQ ID NO: 30579 - DNA, 121 bp, Artificial Sequence
  Synthesized
  misc_feature (61): n=t or c
ttataaaatggagacaaacgcaggctcagtttgataagaattctgtagtgtatcatacaantgaatgaagtaaatacagcagacttggcagtgtaattttgctggctgtagcaaacagctc

SEQ ID NO: 30580 - DNA, 121 bp, Artificial Sequence
  Synthesized
  misc_feature (61): n=a or c
cttgctgaagaaacagttggacatcactgctggaaatgcttaaggctgcaatatgtgtccnctcaaatgctgctagtcggaacatacaaacaaaacagcagtgcaatgattttgctgtccg

SEQ ID NO: 30581 - DNA, 121 bp, Artificial Sequence
  Synthesized
  misc_feature (61): n=c or g
cttgggctctcagctttggagaaaacacctgtccttctgaataaagttctgcactttttcntttatggtaatggttttcaacaaaagatccttacagaaaaaaagtagaagatattttact

SEQ ID NO: 30582 - DNA, 121 bp, Artificial Sequence
  Synthesized
  misc_feature (61): n=a or t
ggccctctgctcggacatggccacacttctctgtcgtctgagttttaattacagatcactnaattttcttagactgtgttctaaagtgaaaaagcttggctttctccgaggaaatgcctgg

SEQ ID NO: 30583 - DNA, 121 bp, Artificial Sequence
  Synthesized
  misc_feature (61): n=t or c
tatattctaacctatgttacgtgcaagtagagattttcagcaaaaatacaaacctcagatngaccttaaaatgcagcagcagtgatgttgctgggatggcagtctgcagagagaccctcag

SEQ ID NO: 30584 - DNA, 121 bp, Artificial Sequence
  Synthesized
  misc_feature (61): n=a or t
tgccagaccttgtctccatacacacactttcaaatgcattggaagactgtagatttgcctngcagttagactttaagctgtgatcccagccctggagaaattgcattttgaatcaagctga

SEQ ID NO: 30585 - DNA, 121 bp, Artificial Sequence
  Synthesized
  misc_feature (61): n=t or c
ggaagaatttagatagcaaaatatacataacctgaagtgtgttagaaaaatattgtagaanttactacgtgcaaagcaatcaaaatactcagaggaagtatatatagatgtttaaggttat

SEQ ID NO: 30586 - DNA, 121 bp, Artificial Sequence
  Synthesized
  misc_feature (61): n=a or c
aagtagagtctgcaagggtacaaaagctcaaaaggagaagttccactatcccttgcttgtnattcattctggttactcagaaggcaaggaacaaatagctcacacaaggaaaaaacacaac

SEQ ID NO: 30587 - DNA, 121 bp, Artificial Sequence
  Synthesized
  misc_feature (61): n=t or c
cccataaggaagacgacaacttgtaatgttccatattaagtagttaaatcctctgacagcnttcctgtcttctccttgatctttgtactttcatactaatgaacttcagtgtttgatggtg

SEQ ID NO: 30588 - DNA, 121 bp, Artificial Sequence
  Synthesized
  misc_feature (61): n=t or c
tgaggcacaaagtagaagcgtgatgaaatgagtgggtgagctcacgggacgcgtgagaaantcgagccacccctgaaaatcccaactaaccaccgctcctcccgggaaattcagcacttgt

SEQ ID NO: 30589 - DNA, 121 bp, Artificial Sequence
  Synthesized
  misc_feature (61): n=t or c
gctttaaaaaaaaggaagaatgtttcaacgacttccggaaatttggtctctggctaaaggngataccatatcagaacactgtgatttggcaccataaagctgcatattatttttagtattc

SEQ ID NO: 30590 - DNA, 121 bp, Artificial Sequence
  Synthesized
  misc_feature (61): n=a or g
ctcatttagcaggaggagaaagaaatacaacacagagatacgtggacaagtgcagaccaantgtagcaaaataactgattcaaattcaagcacagtggtcatcatacctttaatgatagaa

SEQ ID NO: 30591 - DNA, 121 bp, Artificial Sequence
  Synthesized
  misc_feature (61): n=t or g
ccacaccaatgtgaggttttgtcaggaatcaggctccgaatttcccttcccacccagcaantggatcaggttactgatcacctcactgaagaaaccaagtgtcttcctgtatttttgccgg

SEQ ID NO: 30592 - DNA, 121 bp, Artificial Sequence
  Synthesized
  misc_feature (61): n=t or g
atcacaggcaaaaagagatagcagccatggctttctaatggcaaatgcagaagtaatctcngaacactttcatacatagcacgcttcttctgagctgttgaaaaatgcatgatggaacttt

SEQ ID NO: 30593 - DNA, 121 bp, Artificial Sequence
  Synthesized
  misc_feature (61): n=a or g
caacaaggactatgtgcccagaaacaagaattcttttgtactaatatcaccatgagagagntctgttttttcagatacaagtagttcacatgttcttcaaattcctaaacaatcaataaga

SEQ ID NO: 30594 - DNA, 121 bp, Artificial Sequence
  Synthesized
  misc_feature (61): n=c or g
acttctgggcttaatgagaacaacaaacaaataggtagagaagagtctgcttgccataaanccaattccccattgggtctgttgaacactgagcagagcaaggtgcacagggcagaatggt

SEQ ID NO: 30595 - DNA, 121 bp, Artificial Sequence
  Synthesized
  misc_feature (61): n=t or c
aacctgttttgctaacaattgggatatactagatggacactgtaaaaaagtatcaatcttncacgtagcagccttcatgactcctggctgttaagggaacagctccactcaattatgttct

SEQ ID NO: 30596 - DNA, 121 bp, Artificial Sequence
  Synthesized
  misc_feature (61): n=a or g
ccagttgacggatatgaggtgcggacaaatccctttgtgcttcactgtcacaatagccatnctggcatctctggctctatagaaggtatgactacattacagccattttaagacttcaaag

SEQ ID NO: 30597 - DNA, 121 bp, Artificial Sequence
  Synthesized
  misc_feature (61): n=a or g
agggaaacagaaaatgagaaaataaatcctgtagcttttgtggacagagagaagggagtgngggaacaggagaggagagaggcaaggagaggaaagggaagggaagaaaagataaaaagga

SEQ ID NO: 30598 - DNA, 121 bp, Artificial Sequence
  Synthesized
  misc_feature (61): n=a or t
ttgaataatgtgcagctctgatcctaatatattgaaaaatatacagttgaaatagaaaaanatcagtaaggtatcaaagaccactgaagattttgaacatcttccatgtggggaatgacta

SEQ ID NO: 30599 - DNA, 121 bp, Artificial Sequence
  Synthesized
  misc_feature (61): n=t or g
ttcaggcaacattgatgaagaagacatgaccctggaaccacatgctctcaatgctcattgntaagcaagctgcggtggtccaaaagttcagaaagtcaaatgattttatttctatggacag

SEQ ID NO: 30600 - DNA, 121 bp, Artificial Sequence
  Synthesized
  misc_feature (61): n=t or c
aatgaagctaataaaattccagccagtaatctaaactgtagtgaacagcgttttaacatcncatccatgaaaggttaatgaaggctatgaactctgtgtaacacgaaccatttcagatgtt

SEQ ID NO: 30601 - DNA, 121 bp, Artificial Sequence
  Synthesized
  misc_feature (61): n=t or c
ggctgaagaaagaaagccatgatcactttcagagatccaaactagccaggacagagctggnaatatcctctctctattgagacgtcagcagctggcacttgcttcacagcgtaaatacatg

SEQ ID NO: 30602 - DNA, 121 bp, Artificial Sequence
  Synthesized
  misc_feature (61): n=a or g
acagcttctgttggttcttgaacatctacagcacccatgagagcgttctgcattcccatancagtctcccagagtttccaatgggagaagcagagcaaagggagggagtgtgtttaaaatt

SEQ ID NO: 30603 - DNA, 121 bp, Artificial Sequence
  Synthesized
  misc_feature (61): n=t or c
gcaaaagaatgttatgactttgtgagtaacccaatttcttcattctttcacacaaacttgntctaaaaccacacccttagcactgtcactcagttttgatttcagataattttctctttct

SEQ ID NO: 30604 - DNA, 121 bp, Artificial Sequence
  Synthesized
  misc_feature (61): n=t or c
attttctgatcaccatgatctttcaaagatgattaagtggtctcacagtgacagctcctgnattccttgtgagtgcatcctatcaagttccccatatttgtgtgtgcccacttggtttgaa

SEQ ID NO: 30605 - DNA, 121 bp, Artificial Sequence
  Synthesized
  misc_feature (61): n=a or g
aaaagtttttatcttctcagagtgtataaaccatcttgaaggaagactgcatcatttgaantgactcattctctaggacatctgaaaaaaatatggtattcatgttattgagaatccagtg

SEQ ID NO: 30606 - DNA, 121 bp, Artificial Sequence
  Synthesized
  misc_feature (61): n=t or c
gtgttcaagcttatttcagcagtgcagggagatatgaaggcacctgcactgacctctaagntagtttgtgctattttacaagtttaatattccatgttttgcccatcttcaaaggtgcatt

SEQ ID NO: 30607 - DNA, 121 bp, Artificial Sequence
  Synthesized
  misc_feature (61): n=a or g
gtttatcttattttatttaggccttagccgttctgtttttatgccaggatgtttgcaattnttttatgctgatcctctgtgatttgaactaattctttcttttctatgttttggaggtcaa

SEQ ID NO: 30608 - DNA, 121 bp, Artificial Sequence
  Synthesized
  misc_feature (61): n=a or g
cctctacctctagcttatgggctgaggcccgtggagccacccagttgcacaatctttaagntacaaaggtagccagttctgcagaccttaatgaaaagcacctttttattatttatttact

SEQ ID NO: 30609 - DNA, 121 bp, Artificial Sequence
  Synthesized
  misc_feature (61): n=a or g
aaaattgaccccatcagggataagataaaacccaggagaaatacagaacactcctagacanagcctaactggcatgcagctcctctgcttgtctctgaagtacctgctttacttcacacac

SEQ ID NO: 30610 - DNA, 121 bp, Artificial Sequence
  Synthesized
  misc_feature (61): n=a or t
cttatgtctgaagctggattatagcattttatactgagcaatagcatttttcatggagaantttaaggttaacacactgttgaggaacatcaaagaaataaaacagggatgattacacatt

SEQ ID NO: 30611 - DNA, 121 bp, Artificial Sequence
  Synthesized
  misc_feature (61): n=t or c
ctcgccttttcatgaaacacagcatagtcacacatcagtggaaacagcctctgagtccggnaaggcagaacaggcagtgacaccgtgctgcacctcatcatcgtctgcaaaacaagcagtg

SEQ ID NO: 30612 - DNA, 121 bp, Artificial Sequence
  Synthesized
  misc_feature (61): n=a or g
acgcctttagcgtgtttggtggctagcagctttgggattactcacatccttacgtcagccntggtgtctcaagagccagctaacctagacttctgggggtcaaaaagaatagtatgagtcc

SEQ ID NO: 30613 - DNA, 121 bp, Artificial Sequence
  Synthesized
  misc_feature (61): n=t or c
attccccaaatgtcactaaagaactttagcatctctggggtcccctgacatctctttgacncctgggagttgtcagaacctcagggcaccattgggtctcctggtggccatggggtgtcca

SEQ ID NO: 30614 - DNA, 121 bp, Artificial Sequence
  Synthesized
  misc_feature (61): n=t or c
aaaaactatacaagaaaacccacaccatggaaatggaaaagaaaatagccaggacaccttnatatgccagaactggattttttttcacagaatggtttcccttgtaaatttgtctgcacct

SEQ ID NO: 30615 - DNA, 121 bp, Artificial Sequence
  Synthesized
  misc_feature (61): n=a or c
attcagcacttctcccacacacagacgcaaaaaaaatcttatctgtttcccaattccagcnaggcagagtgagaacccaggcactgctgttcccaggcatcaggaagcttccgctccagga

SEQ ID NO: 30616 - DNA, 121 bp, Artificial Sequence
  Synthesized
  misc_feature (61): n=a or g
aagtgacaaagagaagaaatgcaagctcgaataaagatggacagtcacaaagtgaaggagntaaaaccaaccgtgctgttctttgagcagagaagctctaaccaacacaacccaaaagctt

SEQ ID NO: 30617 - DNA, 121 bp, Artificial Sequence
  Synthesized
  misc_feature (61): n=a or c
gtattcagcacaccacatgaaatgggccctccaagctagggtctgcctcatgcagtgcacngaaatgacctaaactaaggcagaactacctctgtgatggtgatatggcattctctagcct

SEQ ID NO: 30618 - DNA, 121 bp, Artificial Sequence
  Synthesized
  misc_feature (61): n=t or c
acagaacaactgctttagcatgaatgcagcagcgttgataatcagctgtatggggacaatnaattattttcctgtacaaaactcattccagtagggtggtactgaaggctgtgctgggatg

SEQ ID NO: 30619 - DNA, 121 bp, Artificial Sequence
  Synthesized
  misc_feature (61): n=a or c
tcgcttccagtgcgtgaggtcttattaatacaaccagtatcttcagggaaagtcctcgaanagatgggagctatgagaaggattttaaaatgaaatagcatttcccaaggccacatctgag

SEQ ID NO: 30620 - DNA, 121 bp, Artificial Sequence
  Synthesized
  misc_feature (61): n=a or c
cccctaacacacagtaggtttcagcagtaaaaatattgttttcctggactttatcttcccnaaatgaccagctttttagctaacacaaaccctggcccttgtaagcccaactcattataca

SEQ ID NO: 30621 - DNA, 121 bp, Artificial Sequence
  Synthesized
  misc_feature (61): n=a or g
ttgcttttctcctgcttatctggaaatagcaagttgcaagactgcagtgctttgtttcccnttttaccatgcctgctggtgaatgtgtgagcaaatggacaattctgcgtgcctgctttcc

SEQ ID NO: 30622 - DNA, 121 bp, Artificial Sequence
  Synthesized
  misc_feature (61): n=t or g
aggtggctgcatcacctggatgatgcatggagagcatcacgctgcatgtgcatgtgccctnaatgctcgctctgcgcagtcattagatgagatttacggcccttattaagccccccccccc

SEQ ID NO: 30623 - DNA, 121 bp, Artificial Sequence
  Synthesized
  misc_feature (61): n=a or g
cagtgaacaagttacaggtcacagtttttgcatacactaagtatagtttgcacacctaacntggggtgaattgaattttcagaagcagcacccgatggaaacagttctgaaaaaatttata

SEQ ID NO: 30624 - DNA, 121 bp, Artificial Sequence
  Synthesized
  misc_feature (61): n=a or g
gccacccaaccgattccttatccactgaaagttctacccttcatatcttcccagtttaganaaagaaatgttttgtgggaccatattaaaggcccagcaggagtccaggtagatgacatca

SEQ ID NO: 30625 - DNA, 121 bp, Artificial Sequence
  Synthesized
  misc_feature (61): n=a or c
tcctgctccctactttacagatagtgatgatgtatttattggtgcatctggactcagcagnatgttggaaggtaagctgatagtgagaagaaggaccttggtgcttatatccctgccatca

SEQ ID NO: 30626 - DNA, 121 bp, Artificial Sequence
  Synthesized
  misc_feature (61): n=a or g
aatgttcttcagttttgtttatttcgtttgcttttaagactaactttactggtattgtttncaaaaagcctagaaacgccttcctgaatgctgaactgcaaagcaacgattctttgtgctg

SEQ ID NO: 30627 - DNA, 121 bp, Artificial Sequence
  Synthesized
  misc_feature (61): n=t or c
taatgtcactgcctgaagagttcagtgttgctgtggtgtcactgattcctggctgcaaccngtgagttttaatgaccccatttttagcagcaatgaaacatctcagggtttttagctttct

SEQ ID NO: 30628 - DNA, 121 bp, Artificial Sequence
  Synthesized
  misc_feature (61): n=t or g
aggttgctaatgaattagctttgctttgaagaagaaagctgcagtgttcctaattaagttntggtatgggaggagaggtgcagcgattcggagccatctctccacgccgtgggatgctgaa

SEQ ID NO: 30629 - DNA, 121 bp, Artificial Sequence
  Synthesized
  misc_feature (61): n=a or g
gttgtttacatgccaacctcagcttttgccatgaaaatgccttaagcacttgaaaaatgcnttagtattgatagagaaaactacttatgcccgttaaaataatttaggtcttctctgccag

SEQ ID NO: 30630 - DNA, 121 bp, Artificial Sequence
  Synthesized
  misc_feature (61): n=a or t
aggcatgagatttgaagctgaaattttggaagggctgtgtatttaggacaactgccaaccnccatgcccagaaatgggaagcttcagaagcatcttgttcagagaggatccaaaacacatg

SEQ ID NO: 30631 - DNA, 121 bp, Artificial Sequence
  Synthesized
  misc_feature (61): n=a or g
attccttctggcatctagctggtgggtgggtgatttgtcagatgctctttttctggacagnagtttctatatttctgtgcctgaaccttaatccagaacagtcctgattcatctctgaact

SEQ ID NO: 30632 - DNA, 121 bp, Artificial Sequence
  Synthesized
  misc_feature (61): n=a or g
tttagagcaagaaaaattttacacgtgcttaaaatactaaacaagcttgcagtaatttgtntctgaacaatgttttgtatagttgctactagtgaagcaagagcatctagaattttttatt

SEQ ID NO: 30633 - DNA, 121 bp, Artificial Sequence
  Synthesized
  misc_feature (61): n=a or c
ctttatcacatgagtacatgagtattctttcatttgtttcattattaatatcaatctctgnaatactaattctccctagtttgcatacataatggaatatgactggatctcttgagatgta

SEQ ID NO: 30634 - DNA, 121 bp, Artificial Sequence
  Synthesized
  misc_feature (61): n=c or g
gctttgatttcctttctgcttgcatgggacttggttcatcatcactggggcaggagcacantgttagcacagagctcattgacctctccgtgtcgatgcagtgaggaatggagctgctggt

SEQ ID NO: 30635 - DNA, 121 bp, Artificial Sequence
  Synthesized
  misc_feature (61): n=t or c
agaattcctgtgctgtgaagggaagggattaaaaagtgacctccaggtaatgattcagtanccccaaaccattttctgtaggtctctctctcctacttttgtcatttggatagcccaaggc

SEQ ID NO: 30636 - DNA, 121 bp, Artificial Sequence
  Synthesized
  misc_feature (61): n=c or g
ggtccctgcatcccagttgtctattgggaaccatcccattgccatgctgtccctgtccctncatggggacttttccatatgaaaaggactttcctttgattttccttctattgcttgtctg

SEQ ID NO: 30637 - DNA, 121 bp, Artificial Sequence
  Synthesized
  misc_feature (61): n=a or g
aggaaggaattggctggtaaataagtcatgagctctccttgcaagtgtctgcctatcagcngggttgtcgtgggtaggcagaatggagctcgagcagagtttcagaggtgtgtgttcagcc

SEQ ID NO: 30638 - DNA, 121 bp, Artificial Sequence
  Synthesized
  misc_feature (61): n=a or g
gggcaggtccccatacagtgctacagtggctggatgctacatcagcacaggaggaggaggngaggaaggcacttcttggcctctgatgacgaaagcctgagctgtgctccagcaggccagg

SEQ ID NO: 30639 - DNA, 121 bp, Artificial Sequence
  Synthesized
  misc_feature (61): n=a or c
gatctttgcctgaccacggccaggctgaagcttcagctttgagctgcaagtgcagtgttgntgagaaacaaagtggcatctgtctattctggtttcatctattaagaagggtgaaatatgc

SEQ ID NO: 30640 - DNA, 121 bp, Artificial Sequence
  Synthesized
  misc_feature (61): n=t or c
tgcctacccccagcctgctgcccttttgggagtggagagagtttcgttgccatgagagcanggacaaaacatcagtgcaatgtcaatgctgttccagctagatatggagagcatagcacta

SEQ ID NO: 30641 - DNA, 121 bp, Artificial Sequence
  Synthesized
  misc_feature (61): n=a or g
ctgaagctgttacgtttaccaacaaatacatacgaggtctcaaactgtgtaatacttgccntgaataatcagcccttcctctctgttttgacaatacaaacggaaggcttcttccaattcc

SEQ ID NO: 30642 - DNA, 121 bp, Artificial Sequence
  Synthesized
  misc_feature (61): n=a or t
agaggtctaagctaacagctggtaaatgctggacaagtgaaaaggattcctagtccattcnaagacaaaccttgcaaactggaaatggatgcacatacaacgacgacttaggttggtgaga

SEQ ID NO: 30643 - DNA, 121 bp, Artificial Sequence
  Synthesized
  misc_feature (61): n=t or c
gatccatattctttattctgtgagtttgtgcaagaattatgatgagggcaactaaaacctngataagtgatacagtaactttgcaggcggtactactattttctttttgcttttttttttt

SEQ ID NO: 30644 - DNA, 121 bp, Artificial Sequence
  Synthesized
  misc_feature (61): n=t or c
taggtattgtgtatttctgaatgaatggtgcatttaccgttgtatgtaaatgtatatagtntgcaatatagtattttatttcatgtgcccttggaaagggttattttgtgcagccaaaaaa

SEQ ID NO: 30645 - DNA, 121 bp, Artificial Sequence
  Synthesized
  misc_feature (61): n=t or c
agcaagcaactagaagagagaaaatacggtatgctgagatgctgtcctctattgcctcttngactataattgtgttttgttttcttatgggatctgattaaagcctgtacctccggttgct

SEQ ID NO: 30646 - DNA, 121 bp, Artificial Sequence
  Synthesized
  misc_feature (61): n=a or g
ctagggtacaggcaaatagatattaatggtctgcgatagccattgttattccattgttgcncgtcaattcatgctggttctttttcattcctcctgcacacataaagctgtgaggaagtgt

SEQ ID NO: 30647 - DNA, 121 bp, Artificial Sequence
  Synthesized
  misc_feature (61): n=t or c
ccttcccacgtgcagaattgtacctgtgggctgcctggccatcactgcttgccatgcactngagaaacgtgacctcgcagcaataattacccactgatcaacgtctgatggatccaatgca

SEQ ID NO: 30648 - DNA, 121 bp, Artificial Sequence
  Synthesized
  misc_feature (61): n=c or g
gctacatggaatacttttgagagcagattgcgagcttgtcaatagacaagcttttgtcctntcaggaattgctctttctgttgtaataatatgactccttttatttgtgacctgctagagt

SEQ ID NO: 30649 - DNA, 121 bp, Artificial Sequence
  Synthesized
  misc_feature (61): n=t or c
cctgcaagggacggggattaaacatgcagactgcccgaaaccaccatttgagcttttccgncgcatctcggaaggatgacacctctcggtgcccaaacgcacacctccacggggcaccacc

SEQ ID NO: 30650 - DNA, 121 bp, Artificial Sequence
  Synthesized
  misc_feature (61): n=a or g
cagagctagaggagtgccgtggcagataagcagtagctgcgcagtatctctgcttgtgaanctagctctgtttgaccagcactggtagtgggatttaaacacagacaagtcagggctttgt

SEQ ID NO: 30651 - DNA, 121 bp, Artificial Sequence
  Synthesized
  misc_feature (61): n=a or g
ttctgcagctggcataaacgccacatcacatgttcaggctaattcaacaaaactagtcatntcgtaagggtcaaatacatattaccagataagccaagttctctgaatttaaagttatggc

SEQ ID NO: 30652 - DNA, 121 bp, Artificial Sequence
  Synthesized
  misc_feature (61): n=a or t
aaatgaattcacacatgcagttgatgcaagacataaatatcagctaccactgggaaaaaantttcacaaagcagctacttcatctttcattattcagtcctgatattcaaaggagacataa

SEQ ID NO: 30653 - DNA, 121 bp, Artificial Sequence
  Synthesized
  misc_feature (61): n=a or c
accagaagtcataaagcttagttagtgcaccactcctgccaggatagtgcaccctgcttgnctaaaatcagaaggcacaacagaaacaagaggctttcctctcctcagctgttccctcctt

SEQ ID NO: 30654 - DNA, 121 bp, Artificial Sequence
  Synthesized
  misc_feature (61): n=t or c
caatatctgctgattcttgggttacgctgagaattacgcatcttcccttctagcagtgaanggcttctggctgccagtgggagccaggcattgagctacagaagcaaaagattctcagaag

SEQ ID NO: 30655 - DNA, 121 bp, Artificial Sequence
  Synthesized
  misc_feature (61): n=t or c
tcattcttctagcaaaacagtgcacagtgcatcctccgtatcaatcaatattgaagctatngcgccatcattgaactcaaatgacgttcctccatctacaaccatacatgcatcccaacaa

SEQ ID NO: 30656 - DNA, 121 bp, Artificial Sequence
  Synthesized
  misc_feature (61): n=a or g
acatccacctctttacagtcaccgctctattttccatgtttcttatagttcaaattctggntataatgtaatgaaaaaagaacactagctgtatttgtctgaggacctgctataatgcaaa

SEQ ID NO: 30657 - DNA, 121 bp, Artificial Sequence
  Synthesized
  misc_feature (61): n=t or c
aagatggtgacaactttataaaaacaaccaaatgtaggcagatggagcacgtataactcangttatgccttcactgcaaaaggagaggtgtctttacacggggaaatgaactggagatacc

SEQ ID NO: 30658 - DNA, 121 bp, Artificial Sequence
  Synthesized
  misc_feature (61): n=t or c
gtagctaacagaggtgctgcagcagtgacaatgcagaccttcaagctagtcctgcaatagnactggcaaactaacgggcacagatgagaagtggtgagtgagatgatgtgcaacagcaaga

SEQ ID NO: 30659 - DNA, 121 bp, Artificial Sequence
  Synthesized
  misc_feature (61): n=t or c
catgagaggtaacttcacttgcagtcattttcacccaagtattgagctaactgagacagantgctgagaggtaactagcagggttgctgagaagcaacttccttggactactcagaggcct

SEQ ID NO: 30660 - DNA, 121 bp, Artificial Sequence
  Synthesized
  misc_feature (61): n=t or g
tgtcaccccaccctgcaccctcagatggggataaatgaatgaggtatggagtcagctcctnggttcttaactggttttgggatgcaggcagtaaggaaggggtcctgcagggctgtgttgg

SEQ ID NO: 30661 - DNA, 121 bp, Artificial Sequence
  Synthesized
  misc_feature (61): n=t or c
gagaactgaatgttaacagagtagagggtgccaagattacttttaccaaccatttttcacnttatccctgaactattaagggagaagaatgtatttactgctttgacatggaaatctgaat

SEQ ID NO: 30662 - DNA, 121 bp, Artificial Sequence
  Synthesized
  misc_feature (61): n=t or c
gagtgtcccaccgggcgcaggtacatggacagaccgtgcacttcaagaaggtaatggaggngctgagctgtggcagtgtggcagctccttcacccccacggatgggctccgggggggtccc

SEQ ID NO: 30663 - DNA, 121 bp, Artificial Sequence
  Synthesized
  misc_feature (61): n=c or g
tctggtatcgaactggctgttctgttgcattgttttctgctcagctgctttgaataactcntattcaagatctcccttgttattttctccatgtgcctctgaataccccaaattaattgca

SEQ ID NO: 30664 - DNA, 121 bp, Artificial Sequence
  Synthesized
  misc_feature (61): n=t or c
gctgatcctaagattagacatgacttaaatacgtctggacccaaataggaccatagttganagaacagtgaaacatgcattagcattgatttttactgctactttagtaacagttagagtt

SEQ ID NO: 30665 - DNA, 121 bp, Artificial Sequence
  Synthesized
  misc_feature (61): n=t or c
ctcactaagtaatggaagaataaaacattagccccttctcatttctctcagcaagctaaantgtcttaattttgtgttattattctgaattcttgagctgttttgattcttagcatcgcgt

SEQ ID NO: 30666 - DNA, 121 bp, Artificial Sequence
  Synthesized
  misc_feature (61): n=a or g
gtattttgtgtatgtatttaaagggtcctttgcaagcattagggtattttgggcaggaagnatggtaactgtcatggcggacaaagcgtgctgagctttcagacctcacctggataatggg

SEQ ID NO: 30667 - DNA, 121 bp, Artificial Sequence
  Synthesized
  misc_feature (61): n=a or c
gctctgtgccaaggcttacagcagaaaaaaaaggggaaggtgtggtggcaggaaggtttgnctgaaacgtgcctgtccagtcaggaccttttgtgacagattattaaacaaagcaatggta

SEQ ID NO: 30668 - DNA, 121 bp, Artificial Sequence
  Synthesized
  misc_feature (61): n=t or c
acttactttagacctgttaataaagcctgagctgaatttagtacagctggaacatatcagngtgagtccatttaaagctaacttggttccacttcgttcctcttaatcacactataattct

SEQ ID NO: 30669 - DNA, 121 bp, Artificial Sequence
  Synthesized
  misc_feature (61): n=t or c
tcacaagacagtctcattttttgcccacctttgctttgtgtgtaccctgtctgtctcatcnatagcattagagttaaagcctttggtttcagacactctctcattttatttgatttattag

SEQ ID NO: 30670 - DNA, 121 bp, Artificial Sequence
  Synthesized
  misc_feature (61): n=a or g
tgctcctttcattgttgctttgcagagttgccttcattttatactgacaatcagatttttntgggaagaattgaggacaatcagatttttgtgggaagggttgaggacagcagctgccttt

SEQ ID NO: 30671 - DNA, 121 bp, Artificial Sequence
  Synthesized
  misc_feature (61): n=t or g
attgtgatgggttctgtgacttactgaggttgaatctgcatgttaaaatcaagggtagttntaagtcgtatgctacagttgtgatgtcgactaaatatattgatcaaactctggttgtatt

SEQ ID NO: 30672 - DNA, 121 bp, Artificial Sequence
  Synthesized
  misc_feature (61): n=t or g
gaagtattacacatgcttctaatatctgcattaatttagcagaaacataagactttttacngtgaaagttatatttatcacagcttggtgcaaaatgaagttaagaaaggattcagggaag

SEQ ID NO: 30673 - DNA, 121 bp, Artificial Sequence
  Synthesized
  misc_feature (61): n=t or c
catgtctcagtttaatcctaggactagagagacaggttatccttttcagccttgattactnctgctttagggtctgtttggttgttgtttgtttgtttgtttccttgaaaggtggatgatc

SEQ ID NO: 30674 - DNA, 121 bp, Artificial Sequence
  Synthesized
  misc_feature (61): n=t or c
aatactagaaacagagacttgccaccaaataagttaccagaactcatattcatattatgtnctctttctttcacacactaagtattggcatagggtgacggcagaaaaaacaccaaaataa

SEQ ID NO: 30675 - DNA, 121 bp, Artificial Sequence
  Synthesized
  misc_feature (61): n=c or g
gttttagtgttcaataaatgaaacaaaagctaaaaaaagtttggttacagagatctgggancaaggttgaattgcagctggttctttggttcccacctttattttctgtactgaaatgttt

SEQ ID NO: 30676 - DNA, 121 bp, Artificial Sequence
  Synthesized
  misc_feature (61): n=a or g
ggtttgttcaatcatatatcttggccttggagtgactggaaagtactgctgcacacagaanggcataccaatgcaggttcactgctgcatgccacagaagatagcagtgaagttctaagag

SEQ ID NO: 30677 - DNA, 121 bp, Artificial Sequence
  Synthesized
  misc_feature (61): n=a or g
ccagcttctgtgggaaccgtgcttccctgcttgtgctgatgagcatggggacaggaggccntagcacagacccagtacaggccacactgcacgtgttctgaaggtacttctttttcatttt

SEQ ID NO: 30678 - DNA, 121 bp, Artificial Sequence
  Synthesized
  misc_feature (61): n=a or g
acagaaagaggagggctcccatctccttcctgtctcctggctctctgagcaggtctgtccntttgagtgactaagcctgtaatgatacacctgaagaagaaatgaaagatcagtgcattat

SEQ ID NO: 30679 - DNA, 121 bp, Artificial Sequence
  Synthesized
  misc_feature (61): n=a or g
agaaggagcttctttatacactgcttgaggtgacctttgctataaagataggaagtgcatntaaataaaagatgatgggctttgagcagcaaatgcccctgtctgctttagtagaaagctg

SEQ ID NO: 30680 - DNA, 121 bp, Artificial Sequence
  Synthesized
  misc_feature (61): n=c or g
taatacattcatattctattctgtttaaaacaatagaatggcatgaatagtgagcttttcnactgatctactcatgggaggtggtgtgtaatttctgtcacttgggtattgtttgcttttg

SEQ ID NO: 30681 - DNA, 121 bp, Artificial Sequence
  Synthesized
  misc_feature (61): n=a or g
ggctttacaggcacaggactgatgagtacagcctcttgttttggaaagctggatgcactcntctgacagcaactctgctattaaacattcagcttagtttgtatctcctctagtgctactg

SEQ ID NO: 30682 - DNA, 121 bp, Artificial Sequence
  Synthesized
  misc_feature (61): n=t or c
tctgcattgacgacaagggaaaatgagtagactttccacagctaaaataattagagatgtntggaaagataacagatgaataactaggatgatgctcaacaaaaataaacagtagctctcc

SEQ ID NO: 30683 - DNA, 121 bp, Artificial Sequence
  Synthesized
  misc_feature (61): n=a or g
acaggctacagagtagacttgaggcagtagcaggaggagaaggacctattcctcatcagangtgtgctatgttttcagggttttgaaggacaggtcaggattttcctcctggaattagagg

SEQ ID NO: 30684 - DNA, 121 bp, Artificial Sequence
  Synthesized
  misc_feature (61): n=t or c
atgtgagccttttgcaaatcataggtggcattgcctggtgaatgcctgtatgttgtcattnaaaatcatatatgtacatggatatgcagttgaatgtgtattttttgcttatatactttga

SEQ ID NO: 30685 - DNA, 121 bp, Artificial Sequence
  Synthesized
  misc_feature (61): n=a or t
tctttatttgatgaaatgagaggtttgtcagaaaattcttcttccacaggtttatgtgatnatatattgttctggttctaaattatatagctcatataatgtagctcatataattatagca

SEQ ID NO: 30686 - DNA, 121 bp, Artificial Sequence
  Synthesized
  misc_feature (61): n=t or c
aacacctttgcacaacaccagaaaatcatttctaagcccgctgatgtcaagatggggaaanagaaacctaaagcaatattcatggtcatggttggatgtgtgcaccagacagaagggctga

SEQ ID NO: 30687 - DNA, 121 bp, Artificial Sequence
  Synthesized
  misc_feature (61): n=a or g
ggagaaaatccagcagcccgtgctggagttcctgaaggtgaggtggttgggtctctgatcntagggccatgggatcgttgcactgtagaatcattgaatcgttggattgttgggtcattgg

SEQ ID NO: 30688 - DNA, 121 bp, Artificial Sequence
  Synthesized
  misc_feature (61): n=a or g
atgaagttggaagagcaaaaagcatttttaaagcaaaattcttgcgcgtctgtctctaggnatggttccaggttgcagttaattgaaaactactgatgttttatttatatgcactcaccta

SEQ ID NO: 30689 - DNA, 121 bp, Artificial Sequence
  Synthesized
  misc_feature (61): n=c or g
tcccccaaatcaggctcgttcttatgtacaacacgcggccgccaattaaattttagacacntttcgttttctgtcgttccccctctcattttctatagggagcactgattctccccgcggg

SEQ ID NO: 30690 - DNA, 121 bp, Artificial Sequence
  Synthesized
  misc_feature (61): n=t or c
tatgtttaaatacacaattttcatcctgaacagcagcgaccacctgtattaaaatctcagntacagcatctcagttttgttacgtactgtctgaatgctgcattgtagcaccctctgtttg

SEQ ID NO: 30691 - DNA, 121 bp, Artificial Sequence
  Synthesized
  misc_feature (61): n=t or c
tcctacattaccagcttgcctgctttgttttgttgcaagcatttttaatgtcttgctacgntgctcttctagcatgtggctggagtttcccattagctgaagatttgttttaaataattcc

SEQ ID NO: 30692 - DNA, 121 bp, Artificial Sequence
  Synthesized
  misc_feature (61): n=a or g
aagcaaatggtcattctgaggctctcagagcatcttagataccaactggttttacaggcanagagattgtgccacccttgttttacaggcactggtaagtgagttagtaaagtcaacaggc

SEQ ID NO: 30693 - DNA, 121 bp, Artificial Sequence
  Synthesized
  misc_feature (61): n=a or g
acctaacactgatggcagtagggttaaataggaggatgttgaaacaaaagaagtcaatcanttggaataaaaagaacttaaaggtaaaggtacttataaaaacactagagcagacatcaaa

SEQ ID NO: 30694 - DNA, 121 bp, Artificial Sequence
  Synthesized
  misc_feature (61): n=a or g
gaaacttcagccttcctgaatcaacttagtactttttagctgcagttagcactctgacacntagtcagatatttataatttaccttcttcaagtgatattcgcactggagtggtacaaaag

SEQ ID NO: 30695 - DNA, 121 bp, Artificial Sequence
  Synthesized
  misc_feature (61): n=a or t
accatggcaaattttggagttctggagaacaagatagaaagccatacattcctgagttatnaatcaagctctagcaataaatctctctgcctcagtttcttcatctgtagatctctctctt

SEQ ID NO: 30696 - DNA, 121 bp, Artificial Sequence
  Synthesized
  misc_feature (61): n=a or t
atcagcttcccgagctgatttcaacaattatttacaaggtccttctgactttgtttacatnaagtgcatcttttcctcctatttctcatagccagtactaatcttttctctcatgttttca

SEQ ID NO: 30697 - DNA, 121 bp, Artificial Sequence
  Synthesized
  misc_feature (61): n=t or c
ggtctgctacacctgaaaactttagattgttagaagcatcaggggagcttggtatgctgantctaagagatacagcacaggcggtggaacgagctgtgaaacttctcggtcaggctccatg

SEQ ID NO: 30698 - DNA, 121 bp, Artificial Sequence
  Synthesized
  misc_feature (61): n=a or c
catcacaagtttgtctgatttcagcatgacgtttatataagatatcccagctgagcacttncaattaggacagtcccttttccttaccttgcttgcaccacgcactgtttttatctttgcc

SEQ ID NO: 30699 - DNA, 121 bp, Artificial Sequence
  Synthesized
  misc_feature (61): n=t or c
gatcttgagaactggacgtcaatcagactcaaactgaacatataagctacaggtgtccctngtatcgatttgctccattagttgaaaaactgggaactgctgctaggacagcattaccgac

SEQ ID NO: 30700 - DNA, 121 bp, Artificial Sequence
  Synthesized
  misc_feature (61): n=a or t
atgtatgtgctctattggcacaggtttactggcccaaggcttttgtagcccaagtcttgtntagcactgtatcaattctgtacttcccataccttgaacgtaataattctaaaaacaccac

SEQ ID NO: 30701 - DNA, 121 bp, Artificial Sequence
  Synthesized
  misc_feature (61): n=a or g
ctgggctgcctaatgggctggaagagcctatcctgatgatggctacaaaaagcagagccanaggagtggtcactcggatatttttgcagcccgctgcaactgcagctctttcaagggtttt

SEQ ID NO: 30702 - DNA, 121 bp, Artificial Sequence
  Synthesized
  misc_feature (61): n=a or t
aagacactgttaatgacgcaggcaaacacagatgaaattaggagagtgtgtgtggaggggnctttcaaggaaacaaccggtgagcgtccggccatttgcagctgctctccagttctcctct

SEQ ID NO: 30703 - DNA, 121 bp, Artificial Sequence
  Synthesized
  misc_feature (61): n=t or c
taaggcctttggctgccataaggggtgacttgtttgatacagtggttggattgtagtattnttgctgttggtagcaatgctggagaacagtgtggaggtgtaactgaacagctaggacttg

SEQ ID NO: 30704 - DNA, 121 bp, Artificial Sequence
  Synthesized
  misc_feature (61): n=a or g
cagcctcaccagtccatactaacgctgccctgctctaatctgtaattacagaagagcaaantggtcaggagattggcacatttgcaaatagtgacctccatatcagcattgcaggcctttg

SEQ ID NO: 30705 - DNA, 121 bp, Artificial Sequence
  Synthesized
  misc_feature (61): n=a or g
acaaaaaagaaccttgttttcagaacccgagtcagctatattgcgttttctgggattgtcngtagtgtagatgtcaaataataaatattgaactgttccttatgatggatttgcagtccac

SEQ ID NO: 30706 - DNA, 121 bp, Artificial Sequence
  Synthesized
  misc_feature (61): n=a or g
tccctccttgatatccacgcaagtcttcaggtctgtaaatgaggtacattttgagtcttcncaactgtgtaatttctcaatccagtcagtataatctgatcctggtaactacaaactaaga

SEQ ID NO: 30707 - DNA, 121 bp, Artificial Sequence
  Synthesized
  misc_feature (61): n=a or t
atgggaagcagaagtcgggaagtagatgatgtggcatgctgcctcggcgtgatagaaacancatctgtgtttcagtcattgcttgggtagtgctgtttgggaatgtgtctagtggaggagc

SEQ ID NO: 30708 - DNA, 121 bp, Artificial Sequence
  Synthesized
  misc_feature (61): n=t or c
tcccccccttataaggactgggagatgccccaacggctttttcagggatggatccaagggnttcattcacgccacgctgctgtggttcatccccgagccaggcaccccacgggttgcgctg

SEQ ID NO: 30709 - DNA, 121 bp, Artificial Sequence
  Synthesized
  misc_feature (61): n=a or g
actctaaggttataacaatgagcacaatactggtattttataaacaggagaagtcttaacngatgccactattgtttcatgagtaacccaatagtctcttataattttggcagcttctaat

SEQ ID NO: 30710 - DNA, 121 bp, Artificial Sequence
  Synthesized
  misc_feature (61): n=a or g
ttcttctttctcccattcaacacagcgattggccagcacctgaaaggcagcccaagccatngtggccaccttctgcttcttggtctgtttttcatttgaactggattctgcctggctgctt

SEQ ID NO: 30711 - DNA, 121 bp, Artificial Sequence
  Synthesized
  misc_feature (61): n=a or g
ggaggtccctaatccaaacactatgaaccagcagttggctgggatggactggagcaggcantagcagagctgaccccagaggaaggctgtctctgggacttcatgcgtgtgacagccactc

SEQ ID NO: 30712 - DNA, 121 bp, Artificial Sequence
  Synthesized
  misc_feature (61): n=t or c
tacacgtacactgaacggccatcatgatacctaatgcctgttatcacgaagtgcttcaagncatatgaaaagcagatcaggtgaaggagggagaagaatcccaccatccccattccagcag

SEQ ID NO: 30713 - DNA, 121 bp, Artificial Sequence
  Synthesized
  misc_feature (61): n=c or g
tgacttgaaaaagtagggagcttttcaaagagaatttgctattaaatcctggttacagtanaaatcaggtcaagaaattattctccaattataatcaatagcaaagcttccctttactcca

SEQ ID NO: 30714 - DNA, 121 bp, Artificial Sequence
  Synthesized
  misc_feature (61): n=a or g
tggcaaacgatcaactcccactctcttgtgttgggcatttcggataattagatcttccttntatgtaatttcttacagcatttccacaagattcataatcgaatttcatatacagtttttt

SEQ ID NO: 30715 - DNA, 121 bp, Artificial Sequence
  Synthesized
  misc_feature (61): n=a or g
catttgtggtgtgtgactttgctctccatgactaccatttttccttcacaatttttaagcntctgcaagggacaatcaaaaatcaaggagaaaaacagattatttaccagtaacttgagtt

SEQ ID NO: 30716 - DNA, 121 bp, Artificial Sequence
  Synthesized
  misc_feature (61): n=a or g
gaatttcttaacacaggaaaagacataccctcgtgtaccaggattagtgcttccagtgctnttttatattataggcaacaccatctctacaaattaaaaaagaaaaaaaaggaaaattatc

SEQ ID NO: 30717 - DNA, 121 bp, Artificial Sequence
  Synthesized
  misc_feature (61): n=t or c
agaccatcagaccctgtgcttgaactctccagcttaactccctgtgtggtggaaatagcgngtgctctttcttctccttaatcacctgttaagcttttactgatcaaacagaattctggga

SEQ ID NO: 30718 - DNA, 121 bp, Artificial Sequence
  Synthesized
  misc_feature (61): n=t or c
atgttttcctgtgattatattccaccctatctgcactgctgatcttgtagactgcctcccnagcacttggtgaataaggtcacagcagtggaaaacaaatatgagctaaaacatatcttac

SEQ ID NO: 30719 - DNA, 121 bp, Artificial Sequence
  Synthesized
  misc_feature (61): n=t or c
ggatgcagaggggagatggcatggaccctcctcacagcataggccgcatgtggggcctaantgaagtgctgtggatttctggcctccattttcctacaaacacaagaggtaaaaaactgca

SEQ ID NO: 30720 - DNA, 121 bp, Artificial Sequence
  Synthesized
  misc_feature (61): n=a or c
atggtctaagaaagtaccatattattactttaatgtacttgcaacgatataaacttttgcngaattatttcagatggcagaatctaagtgcatcaagttttagtttcaacaagcagaataa

SEQ ID NO: 30721 - DNA, 121 bp, Artificial Sequence
  Synthesized
  misc_feature (61): n=c or g
gaaaagggaaatatgatctggccccactcttcggaaaacattgctgtatctttgaagaaantattttttcctaagcttcctaagttttgttttctcttcttttccgattgttcttgatttc

SEQ ID NO: 30722 - DNA, 121 bp, Artificial Sequence
  Synthesized
  misc_feature (61): n=a or g
caaaatcacatgtaaagtaaaatttaaaaaatccagttcacactcttacgtaaatgctgcntggtaaacaaaatatatagcttttattatgacgtactgatctccatttctctcaagatac

SEQ ID NO: 30723 - DNA, 121 bp, Artificial Sequence
  Synthesized
  misc_feature (61): n=c or g
ctgggggacaaaacgcgtgtcaaacctcctcgtttgaaatgattttgtactaaggcaccangactcgcagttaaagggcagcaataaaatgtgcttgaagccccgcgccctgaaggcctgt

SEQ ID NO: 30724 - DNA, 121 bp, Artificial Sequence
  Synthesized
  misc_feature (61): n=a or g
tccccgtggcttcacaaagcactgggacaccatcgtgcttcagcctgacaccaggacaaanctttaccagggctgaatcactccctgttatccaggtttccatcttcaccattagaaagaa

SEQ ID NO: 30725 - DNA, 121 bp, Artificial Sequence
  Synthesized
  misc_feature (61): n=t or c
gcaagtacacccactgcctggatatgctctgaagtgatgaatgacaacaccgaacactaanaaatccacttagctgttttaactatacgcatgtatcttacactaagtgatgaagctgttc

SEQ ID NO: 30726 - DNA, 121 bp, Artificial Sequence
  Synthesized
  misc_feature (61): n=t or c
caatgtccaagacagaggccatgattcagtttaccttctgcatctccaaaggatgatgatngatagactgaacacagctatgtttcatcactgtaaatgtgaaactgcaaataactttggc

SEQ ID NO: 30727 - DNA, 121 bp, Artificial Sequence
  Synthesized
  misc_feature (61): n=a or g
cctactcaaacccacagaactcatcttggacttcaggaggatttaaatcaggccataagcnctgctgatttggattagtaatgatgtacattgaggacaacatctgtatttcgggttgggt

SEQ ID NO: 30728 - DNA, 121 bp, Artificial Sequence
  Synthesized
  misc_feature (61): n=a or g
taagagtgatcttggtctggaatcattggctaggctttggatctagtcataggtaaaacangtagtgttaactggaactgggacatctttgggtgccacgtaacctgaagtggtaagcatt

SEQ ID NO: 30729 - DNA, 121 bp, Artificial Sequence
  Synthesized
  misc_feature (61): n=a or g
ccgggacaagcagcagaagaactccaaaggcagcagtgatttctgtgtgaaaaacatcaancaggcagaatttgggcgtcgagagattgagatcgctgagcaaggtaagggcgtgtggggc

SEQ ID NO: 30730 - DNA, 121 bp, Artificial Sequence
  Synthesized
  misc_feature (61): n=a or g
taaaaccagggagcgcaaaaaagacatatagggacagctttagtgagcccggggaactgantatttgtcttgaaaacattaatgatcttgggagaaatatacatctatagttcatacacct

SEQ ID NO: 30731 - DNA, 121 bp, Artificial Sequence
  Synthesized
  misc_feature (61): n=a or c
acatccattaacaaaaagtctttgctaataaacagtgaaaaccacacattactacagcagnaaatttaagctttttaaactctggaaatttagaattaaggggcagcctatcccagcaaaa

SEQ ID NO: 30732 - DNA, 121 bp, Artificial Sequence
  Synthesized
  misc_feature (61): n=a or g
aacttaaaaggagaataagcccctacattttacaaagaaatctcaatgattaatccttcanttgttaccattgttcttttcttaatgtactcaatgtctaaacagtgaaagtaagtgctct

SEQ ID NO: 30733 - DNA, 121 bp, Artificial Sequence
  Synthesized
  misc_feature (61): n=t or c
tgtgtagcttgaacttagatttaataagctgctcatatctctgcagtgaatgtttttaacntgatattactgatgttaaaaataccatcagttacatattaactgagtctgatccattttg

SEQ ID NO: 30734 - DNA, 121 bp, Artificial Sequence
  Synthesized
  misc_feature (61): n=a or g
aaatcaaatcaaaaaaaccgtaaggtgaaatcaatgtaatgaaaacactccaaatacccancagctgtactgcacacaccatgtggtgacagcagcacaattggagtattttaacagtaca

SEQ ID NO: 30735 - DNA, 121 bp, Artificial Sequence
  Synthesized
  misc_feature (61): n=c or g
tccgtaaggactgagcctccaaaaactttcctgacatcctttaaacacacaccattttctncctgtgaaaaccagcccttaaaacccttcctccattccactacttcttcttgacattaaa

SEQ ID NO: 30736 - DNA, 121 bp, Artificial Sequence
  Synthesized
  misc_feature (61): n=a or g
aatatagaagcattcccaaacaaggaaaatattaatatattacgggagaatgtaaatattncattattaacttcataagaagcgtccacagataagaaaggaaaataagaacttcatcttc

SEQ ID NO: 30737 - DNA, 121 bp, Artificial Sequence
  Synthesized
  misc_feature (61): n=t or c
ctaacatagcaagagcagagatctgctgtaggtagtcccaaatgaccactcatccttctcngaacagattggtgtctgcagatccatctgagctctatggggatttcctgaactaccacaa

SEQ ID NO: 30738 - DNA, 121 bp, Artificial Sequence
  Synthesized
  misc_feature (61): n=t or c
gatgaaatacaagaattagagagtgatggtcctgtgcctgacgtggcacatctcttgttgnaggacagagagacaaacgtgctgcatgctgtcttctgtggaggctgcagtgcctatgcag

SEQ ID NO: 30739 - DNA, 121 bp, Artificial Sequence
  Synthesized
  misc_feature (61): n=c or g
gctactcagtctcctcagtatcagtggccagaagaagccactctgcaaactcggaagagcnctatgcctaaggagtgactgaggcacagtctctgacatgtaggcagcaacctccatttct

SEQ ID NO: 30740 - DNA, 121 bp, Artificial Sequence
  Synthesized
  misc_feature (61): n=a or g
cttctttccttctttggccttcctttatttaatgcagcaactcgtgtgatctagacgggtntcgattgaaggacattaattagtaggaaatgagtaaccttttctagggttaacagtctgc

SEQ ID NO: 30741 - DNA, 121 bp, Artificial Sequence
  Synthesized
  misc_feature (61): n=t or g
aaaacacaaaacagagtgcaacaaatagcataattggacaatactacatagaatgtgaagnaaagttgtcagagaacaacccaaagggaggaaaaaaaaagggggcaaaggggaaggaaaa

SEQ ID NO: 30742 - DNA, 121 bp, Artificial Sequence
  Synthesized
  misc_feature (61): n=a or c
tatatctataatcagggatatatttacaaatacaaaggcgagtgctgaactacaaacagcnaagaacaggtgttctaggtgcagttcttgcttctccccatcatcatacatagcaatgagc

SEQ ID NO: 30743 - DNA, 121 bp, Artificial Sequence
  Synthesized
  misc_feature (61): n=t or c
ccttgttacttgttcacaaagataacctgttgagttcacaaagccaaagggaagcagttantcagaaaacaaggaaggctgaaagtgcccattagctgaaggaaaaatgaccatgaggaat

SEQ ID NO: 30744 - DNA, 121 bp, Artificial Sequence
  Synthesized
  misc_feature (61): n=a or c
acattccaagtgaaaatatttacgaatagattattattacgaactactacgaacagattanggataggaacaaatgggaggagaacagggaaggggtaaaccagaaaaacaccaatcttgt

SEQ ID NO: 30745 - DNA, 121 bp, Artificial Sequence
  Synthesized
  misc_feature (61): n=c or g
catttagaatatggtccttaaggatggtttatgcacatgctggtctgaaaacctcctctgnccacctagatttatagatgggttggctaacttctgcagcttttttgtattcccttttata

SEQ ID NO: 30746 - DNA, 121 bp, Artificial Sequence
  Synthesized
  misc_feature (61): n=t or c
aatagtaaaaagacgttttacgtggtaggtgtcacagctacaccttgcgtccaacctccgnggagtattttgataaatttggatttgcttcttggtccccattcaaagatattttactaaa

SEQ ID NO: 30747 - DNA, 121 bp, Artificial Sequence
  Synthesized
  misc_feature (61): n=t or c
tcctgtttatatgctcccttcaagggctggaagaccttagaacgcagcaactggttgagtnagaagatgtagggatgagattcttttctctaattcttttctctaggaataaactcactga

SEQ ID NO: 30748 - DNA, 121 bp, Artificial Sequence
  Synthesized
  misc_feature (61): n=a or g
gaacatggccttcaaagcagctgtttctattgtacacaagtttaattgagctacctggagnctcttgtctgtgttcacctaaatgtgtgcaggtctggagctgttgcaggggggtgcaagc

SEQ ID NO: 30749 - DNA, 121 bp, Artificial Sequence
  Synthesized
  misc_feature (61): n=a or g
taacctcatcattcccctgacatatgacaggtctgcatcgtaacctaaaagaaagagttantcttgaaggttcgctgctgtgagtatgaatgaagctgtctgttatcacacggaggagtaa

SEQ ID NO: 30750 - DNA, 121 bp, Artificial Sequence
  Synthesized
  misc_feature (61): n=t or c
catttgcatatcgaatcattagggaatacaagtcattaattatgttttggattccttaaanttatgaacaaaccctgaagtcacataccagttttaattcacatttacttaacagttaagt

SEQ ID NO: 30751 - DNA, 121 bp, Artificial Sequence
  Synthesized
  misc_feature (61): n=t or c
taaaagtatcatttttattcatctgggatttgaatatttaagagaaattaagtggatgtantggctgattgtactggtatgctttacacccagattttgttgctatcatttttgttgaatt

SEQ ID NO: 30752 - DNA, 121 bp, Artificial Sequence
  Synthesized
  misc_feature (61): n=t or c
ctctctgccaacagaaacctcacttagcctcaaatatagggatagccagtatacaagatangtagtattagcataccagctgagcagttacacatcagtgatgctgtgtgtagctgctgaa

SEQ ID NO: 30753 - DNA, 121 bp, Artificial Sequence
  Synthesized
  misc_feature (61): n=t or g
aaagaagaacaagcagccagcaccaagcacagccaagtaaggctttgtctttcagccctgnagagactgggtgtgttgtgcaggttcttttgtggtgtgaaaaacttcttagcatcacaga

SEQ ID NO: 30754 - DNA, 121 bp, Artificial Sequence
  Synthesized
  misc_feature (61): n=t or g
atttcaggcagactatggaaataaattactttacccagatgagtcttttgttgtagaaatnagggaatattctgttttactcactagtaagtaaagtgtgaatacttcatttcatagctct

SEQ ID NO: 30755 - DNA, 121 bp, Artificial Sequence
  Synthesized
  misc_feature (61): n=c or g
cgaaaccttctttgaaaactgcaccatcatctctactgtcttttataacaccggtaatggnattcctgacatgatctaatctctgtaattaggaacaattttatcagattctagaagaaag

SEQ ID NO: 30756 - DNA, 121 bp, Artificial Sequence
  Synthesized
  misc_feature (61): n=t or c
tcccatgtggtaggaaattaggctctttgggactgggtgtcaagactgtggtacttgccangtgaaacatctggctaagctctgggaagcaatgagctacttctgtgacctcttactgttc

SEQ ID NO: 30757 - DNA, 121 bp, Artificial Sequence
  Synthesized
  misc_feature (61): n=t or c
cttgaaagacaaaaccaagataaagcaaaacgtccttacatgatttcttcttatgggtcanggcaacagcagcagtacaggagacaaatgtcccttacagagctatattttgtatggatat

SEQ ID NO: 30758 - DNA, 121 bp, Artificial Sequence
  Synthesized
  misc_feature (61): n=t or c
aaacagcttttttttttctcggtactgagtgttaagttgctaactgattttacagagtagnaatagctctcgcagggtgaggcagatgtcatgcaacatgaaacttccaccatgagagaag

SEQ ID NO: 30759 - DNA, 121 bp, Artificial Sequence
  Synthesized
  misc_feature (61): n=a or g
gtagtctttctaccctacttacatgtgctactttctttgtagtatgtattataaaagcatnttttaagatctttcctgaaacgcttctcactctatggattaacaccaacaagaaactgct

SEQ ID NO: 30760 - DNA, 121 bp, Artificial Sequence
  Synthesized
  misc_feature (61): n=a or g
ctcctcacacctgacctggatctccctctgttagtgtgaagccagcaggggggtgatgccntccccagggcagtgaatgcagcaaacccctttggaaggaggcagcactgatttatttccc

SEQ ID NO: 30761 - DNA, 121 bp, Artificial Sequence
  Synthesized
  misc_feature (61): n=t or c
gtgctgcattggggccgaggagccgcatcctgcccctgtctggggctgggtctgctcatangtatgtggtctccaggcatcactaatgcttagtcctcactatttacgtttaaaaaaagaa

SEQ ID NO: 30762 - DNA, 121 bp, Artificial Sequence
  Synthesized
  misc_feature (61): n=a or c
aatcaactctggaagatgcttcatcgaaagcacctttgatgaagagctgacagcctagacnaattaaacacatggattctgaggagccctatccttgacaatcactaaagaatctggattt

SEQ ID NO: 30763 - DNA, 121 bp, Artificial Sequence
  Synthesized
  misc_feature (61): n=a or g
acgtgatactgcaagcacaatcccctactactatattgcagtgaaagcctgaaactgcacncataggcttcaggtttattgaacaatatcatctgctgtattcacatacctgagtttaagg

SEQ ID NO: 30764 - DNA, 121 bp, Artificial Sequence
  Synthesized
  misc_feature (61): n=a or g
tcccgttaagtgagctgaatttaacacaattttgatttaggctgttcatcttctgaatgtnaagtgaaatgatgatggctttaaagtaagtggtatctattatagcttaaattttatacat

SEQ ID NO: 30765 - DNA, 121 bp, Artificial Sequence
  Synthesized
  misc_feature (61): n=a or g
attaacttaaaagctgctgatgagacagaagcaacaaagcaagtcacatcctcaaactgtngcaggtgctgggaaatgccaatgtttcttgctcatggtgaactttatgggatttgttcaa

SEQ ID NO: 30766 - DNA, 121 bp, Artificial Sequence
  Synthesized
  misc_feature (61): n=a or c
agaacttgcctttaagatctgtaagggaaacactggtctgccatgagcctttacagcaaangaggccacctatgctgaactgcctttaagaggttggtaaagtgcttattcccctctgtct

SEQ ID NO: 30767 - DNA, 121 bp, Artificial Sequence
  Synthesized
  misc_feature (61): n=t or c
caagatatggaaaacagaaattagaggaagaaaagccagagcacatgaaatcctgcttgtnaacatgtcgataaaatattcagtcaaaatttggactggaagatttggcatggccaaaata

SEQ ID NO: 30768 - DNA, 121 bp, Artificial Sequence
  Synthesized
  misc_feature (61): n=t or c
aacaaccaacaagccaacataaaatcagtaatttgaataggacgaggccttgtttgtgagngtgcatgaaagcaaacaagccagcagtaatgcccaccaagcaattccatttagaaaactg

SEQ ID NO: 30769 - DNA, 121 bp, Artificial Sequence
  Synthesized
  misc_feature (61): n=c or g
ctgctggagataacaggcgatactggtagggctgcaggaaaagaaagagccgatagcagantatatgccttcctctgggaggagcacatgcagggctgctgcacccgtgcccagcgctgca

SEQ ID NO: 30770 - DNA, 121 bp, Artificial Sequence
  Synthesized
  misc_feature (61): n=c or g
atgtgcatggaaagagtgactgtaatgaggtacaaaagatgatccatttccattctttagnacagattaaaaaggtttttctgtgttatttaaaacagtatttttaataactacaggttta

SEQ ID NO: 30771 - DNA, 121 bp, Artificial Sequence
  Synthesized
  misc_feature (61): n=a or g
atgctgcccattcaaagatgacaattaaagaaatctgaaataaattaagctgtttatgcantgccattttagctcaactttcatgaaggagaatattctagaaaatgtgtttgagcagctt

SEQ ID NO: 30772 - DNA, 121 bp, Artificial Sequence
  Synthesized
  misc_feature (61): n=a or g
agttaaggacaggtattttcaaatgatgggtttacccgaacacagaatacagctatatccnaagcctacttgcaaatgttttgccatgaatacaatgaagaacagtctggtttgaccaagc

SEQ ID NO: 30773 - DNA, 121 bp, Artificial Sequence
  Synthesized
  misc_feature (61): n=t or c
gcagagccctgtggactgatactgtggacaactggcctttgagggagggtttcagagaggngacagtgacaaatctgaatatgcagcagagatgctgatgtggataatttattttgaaggg

SEQ ID NO: 30774 - DNA, 121 bp, Artificial Sequence
  Synthesized
  misc_feature (61): n=t or c
cccccttcttctattccaaaagcaagaggcccatgtggttgctatgttcccactcacctgnagccaggggaagatgtccaccaggctctccttggccacggtgtccacaatgccctggctg

SEQ ID NO: 30775 - DNA, 121 bp, Artificial Sequence
  Synthesized
  misc_feature (61): n=a or g
taaagacagtctgtagaagccaagtctcctgcaatttttgtgtccacagtgggaaaaagcngcacattgcatgccatcattaccacagaattacagtgtgctatgtaatactgcgactctt

SEQ ID NO: 30776 - DNA, 121 bp, Artificial Sequence
  Synthesized
  misc_feature (61): n=t or c
tctatattaatattcatcaagacactacagatggattgcataagcttcattggtgctgttntttatatctctaagaaagcaaacatttaatactcgatcctcccttgataagctatcgcag

SEQ ID NO: 30777 - DNA, 121 bp, Artificial Sequence
  Synthesized
  misc_feature (61): n=a or t
cccccattgcacaggttaagaccagcaacaaaaatactctgacagagacattaactcatgntaacaacctcagtactgtgccaggcactctggaggagtacttttctggctgcacccatgc

SEQ ID NO: 30778 - DNA, 121 bp, Artificial Sequence
  Synthesized
  misc_feature (61): n=a or t
aatatgattctatgaatgaggaactgtgaaagatgtggtaaaacttaagcatgttgagtgnttttttaaaataccaatagtgctaacatacatcaaaaaccatccacgctgttgaagactc

SEQ ID NO: 30779 - DNA, 121 bp, Artificial Sequence
  Synthesized
  misc_feature (61): n=a or g
gtgtgagcagggtcagtcaaaccctttgttgtctattgggcctactgcttcagataggtcntgttggcaagaacccatagaaccacagaaggctttgggagcatcccatttcggtaggatg

SEQ ID NO: 30780 - DNA, 121 bp, Artificial Sequence
  Synthesized
  misc_feature (61): n=t or c
ccagatttcaaccgagcaatgtccttccctccaaactggattttatagtaagtggctgcangtgtaataatttactaaacctcctttcaccgagcttcagaaataaggattccttgcattt

SEQ ID NO: 30781 - DNA, 121 bp, Artificial Sequence
  Synthesized
  misc_feature (61): n=a or g
actggcttaaaagccttgaggtgaaatgggctcagatctgtcgctcttagatgatgttgantagcagtgccaactcttggtcactgttcaaggttcaaagaggataacaggtccatataat

SEQ ID NO: 30782 - DNA, 121 bp, Artificial Sequence
  Synthesized
  misc_feature (61): n=a or g
ctcttttcctgctgtctcactgtgtttctctgtatgagaaatcccaccactttccaacacntgctgtccacagaagtgtgccacctcaccccgctccttatgtccccaccatgtgctttgt

SEQ ID NO: 30783 - DNA, 121 bp, Artificial Sequence
  Synthesized
  misc_feature (61): n=t or c
tcatattcggtggctttatgacacatgctctcacctctttgataagaatctcttcccttcnctatcttctgctccacccataacctggcatggatcaacagtatatttcaagggctgtcca

SEQ ID NO: 30784 - DNA, 121 bp, Artificial Sequence
  Synthesized
  misc_feature (61): n=t or c
tgtttgtaaacaacaaaaagatgttaacaccttgcaacccaggaaattgtaaccagagcantgaagttgtagttgagacagagtgtaccgttacgtaaataccaccgtgttcttttaatca

SEQ ID NO: 30785 - DNA, 121 bp, Artificial Sequence
  Synthesized
  misc_feature (61): n=t or c
ggattgacatcattaagattctgtgtggggtgctggaccccttcatctaaagcctattganggagtgaggcatttatctgttaggtaagtggtgagttttgattttgaatatgtaataaaa

SEQ ID NO: 30786 - DNA, 121 bp, Artificial Sequence
  Synthesized
  misc_feature (61): n=t or c
ttctgtagataagcaccatttctcagttgccagatattttttgacagatttttggaagtgngtagaacacatataaatcacatctaatcacaagggacccatttgtatttgttttgtaaga

SEQ ID NO: 30787 - DNA, 121 bp, Artificial Sequence
  Synthesized
  misc_feature (61): n=t or c
attgcctgtgcccattgtgtcagcagagacaaaacaactaccagcttccagaataaagaanggcatctccattaataagaacatatggatgaaagtattgaatagtaggtacttatatcta

SEQ ID NO: 30788 - DNA, 121 bp, Artificial Sequence
  Synthesized
  misc_feature (61): n=a or g
tcagcagtaaattcctgtaaaaaccctttgagaactgtgttgaagatgcaccatgctcaanccaagccttttcctcttttctccacatttcccactgtgtgtttatctcacataaagtttt

SEQ ID NO: 30789 - DNA, 121 bp, Artificial Sequence
  Synthesized
  misc_feature (61): n=t or c
tgctttacagtttacatcaaaatcatcagataaaatcagtccaagatgagacattaaaacngttttgcattgcacacacagtgtcttcgtgaggggattgcatttgttttcactgtcctga

SEQ ID NO: 30790 - DNA, 121 bp, Artificial Sequence
  Synthesized
  misc_feature (61): n=c or g
aacagaagacaaatcagacaggcttcagagacatcttggcaaagtcttgctagtacctgcnttatgtctcatttgatcaagaggactaattcattaaaaatttgacagtctcatttttctt

SEQ ID NO: 30791 - DNA, 121 bp, Artificial Sequence
  Synthesized
  misc_feature (61): n=a or g
gtcccaagccactgttgtcctgcttgagaaaaacttgagcaatttaggaaccaagaacacnatttaccatataacgcttctgcaacacagaatataacagacttaagtcatcagggaggag

SEQ ID NO: 30792 - DNA, 121 bp, Artificial Sequence
  Synthesized
  misc_feature (61): n=a or g
gtggcttttagtctgactgggaacatccttttggatacagctcaacctggaaatgacccanactgactccttcatagtccacggcaagctgctgggaaacatctgtacatgtagccattgt

SEQ ID NO: 30793 - DNA, 121 bp, Artificial Sequence
  Synthesized
  misc_feature (61): n=t or c
agaaacacattgtaaaacagatgcacaaagacagcgtggagcaggctgacccaagggctgngggacacagagatggggtagaatagaatcacagcataacccaagctggaagggacacaga

SEQ ID NO: 30794 - DNA, 121 bp, Artificial Sequence
  Synthesized
  misc_feature (61): n=a or g
gcatcctttctcctgaaatacgggagaaatattggtatgttacattctttaaacataatancaaaccttgtgagaaagctgaaagaaactataaacacatccataaaattacatttacagc

SEQ ID NO: 30795 - DNA, 121 bp, Artificial Sequence
  Synthesized
  misc_feature (61): n=c or g
tatgattaattatttcatcaccctacacagaagtaaaaataagctgcaattactggcttancaaaaccagatggatttcctggaaacacaaggaatttgtgcttggttacttcaacaaagc

SEQ ID NO: 30796 - DNA, 121 bp, Artificial Sequence
  Synthesized
  misc_feature (61): n=a or t
tgcagtgccacaactgcctgaagtcaacctttgggttttggaaatatgtacttggacatgnatctcctgacttccagtcatgatccaagctaacttgaactgattgaaatactgtagcaca

SEQ ID NO: 30797 - DNA, 121 bp, Artificial Sequence
  Synthesized
  misc_feature (61): n=a or g
agacaatcagcatacaacctctttagaaaatgctcagtttgatctatcttgcctctgcacnataatgttctaccaaaaacaaatcacttctttatcaatagtcctcctgagtgccttttaa

SEQ ID NO: 30798 - DNA, 121 bp, Artificial Sequence
  Synthesized
  misc_feature (61): n=t or c
aagatactcaagattcagacaatagcttgttcaaacagctggaacttgtgtagacactacnttgtatgtctcaggtattctcctctgcctcaataagcactccctccgtaagaacacagga

SEQ ID NO: 30799 - DNA, 121 bp, Artificial Sequence
  Synthesized
  misc_feature (61): n=a or g
tgaaaactttttgagctgctagactgagaagcagagaccagctggaggcagagtgctagtngagtatcccacggccaatactggggccagtatggtttaaaatcttctcgatgatgagaca

SEQ ID NO: 30800 - DNA, 121 bp, Artificial Sequence
  Synthesized
  misc_feature (61): n=a or g
actgcagatgaggaagaaagcattcaggatgccaagctgcttaatctgctgttgaatgtcngtgtaagcagaaattgacacttcttacaggtgttatggaagctagtttggcaaagaatag

SEQ ID NO: 30801 - DNA, 121 bp, Artificial Sequence
  Synthesized
  misc_feature (61): n=a or c
ccatgttcacacagtcaggattgcagtgctgtttccatatgctacttaggtaatgtcagcntattcgtatgatttgtctgcccgcagttaaggtgaagctttctggaaagcctcttaacca

SEQ ID NO: 30802 - DNA, 121 bp, Artificial Sequence
  Synthesized
  misc_feature (61): n=t or c
gcgtgatttacacactttattttatcctttgtctttagacagaagtacaccgtctggcaangagaaagtaaatggtgatttatattctgtcttaaactctcttcctctttcagggaagcta

SEQ ID NO: 30803 - DNA, 121 bp, Artificial Sequence
  Synthesized
  misc_feature (61): n=t or c
cagtcagaactgctcatgtgattttgcggtgagtactcctgtggtggttgctcaagaaatntgtgcacgtggtgtggatgtaagagctgtatacagtcaccctgctgcattgcaaatgtgt

SEQ ID NO: 30804 - DNA, 121 bp, Artificial Sequence
  Synthesized
  misc_feature (61): n=t or c
aagtgctgtttgtggaacttggcatctgaagtacttagattgagaagcagaaatatttatnggtacagaggcatattgaaaacgccagaccagatgcccatcctgccttttgtcacatctc

SEQ ID NO: 30805 - DNA, 121 bp, Artificial Sequence
  Synthesized
  misc_feature (61): n=a or t
tctgctcaaagggcagcacctgtgtgtgaaagaggagggcatagtaaaaaagtaatctacncttcacatcactgtcagaaggaaactgaattgcaaaatcctgaagttttttgggatctca

SEQ ID NO: 30806 - DNA, 121 bp, Artificial Sequence
  Synthesized
  misc_feature (61): n=a or c
gaaactgctaactggtagactggtgggtaaacaaaagctcaaatagtgatcttttctctgnttctcgctccttgatctattactatccagaaacacagatgtagcttaaactcagtgaata

SEQ ID NO: 30807 - DNA, 121 bp, Artificial Sequence
  Synthesized
  misc_feature (61): n=t or c
ggaaacactttgtgcatgggcagagctgtttacctcctacagactgcaaattaccaatagnggcgagtgttcctttggccccagcacggcgtgttggggcggtgtgtgcagaagctcttcc

SEQ ID NO: 30808 - DNA, 121 bp, Artificial Sequence
  Synthesized
  misc_feature (61): n=t or c
ctactccttcctagtaattaacacaagcagcctttaatgtatgttacaccaggggactgcngtccaaccgttaatagcacacagccaatgaatgtagcaatcatgagactctggcatggca

SEQ ID NO: 30809 - DNA, 121 bp, Artificial Sequence
  Synthesized
  misc_feature (61): n=a or g
cgagctgcaaccaataagttaagatgatgacttaaagtcattgtttacattaatttctagnacacataaggcaaccgatttagaaacatctttctccaagaaatttgatctgacaagatga

SEQ ID NO: 30810 - DNA, 121 bp, Artificial Sequence
  Synthesized
  misc_feature (61): n=t or c
ctacataggtggtaaagtctctgtggatttttctggtgaatgcccataaatccatgacacngtggttacagatattagcatgacttacagcttgagctgtgtgagcgttggtgcaaatgca

SEQ ID NO: 30811 - DNA, 121 bp, Artificial Sequence
  Synthesized
  misc_feature (61): n=t or g
tctgctgctgaaacaaaaaaggactgtgaaaggaactttctgaatgacatccttcatattngtatacttttctccagttgtgttcaggaataggtatgtgtttctttgaaatgataatgtt

SEQ ID NO: 30812 - DNA, 121 bp, Artificial Sequence
  Synthesized
  misc_feature (61): n=a or g
agcaagcaactcactcttctcccttgatccacatagtccagtcgtctcctctcatctaagncacctctttctcacatttcttccacacctcctatgaaaagtacctgaaatgtaaagaaac

SEQ ID NO: 30813 - DNA, 121 bp, Artificial Sequence
  Synthesized
  misc_feature (61): n=t or c
cagttctgatggctcagagtgggaggtgcccggtgcacgtggcactaccaaggcaaggtcnatttgccaggttacagccacgcacgtttttagggtcttctctcctttctcagcatcccca

SEQ ID NO: 30814 - DNA, 121 bp, Artificial Sequence
  Synthesized
  misc_feature (61): n=a or g
ctgatgtttcatttatgaagaggcaggagcatctttcaggctccgttcttctttttgcctnctctcatttgttgaatttgtctgtaacatgtcggtgaggtctagagatcgatgccattct

SEQ ID NO: 30815 - DNA, 121 bp, Artificial Sequence
  Synthesized
  misc_feature (61): n=a or g
attttttaatatattagcactacccaagaaaatttatcatagaatgagatgatttgatatncatgctaaatcccttaagctacagaggaacaatttgtttacagtaaaatgtgatggaaac

SEQ ID NO: 30816 - DNA, 121 bp, Artificial Sequence
  Synthesized
  misc_feature (61): n=a or g
tttttccctgaaatcctagaagtacatcagacagtatatttagccagatatgctaccatcnttattgataaagaaaatatacacaaacatattgctgactaatctacagtacattaggttg

SEQ ID NO: 30817 - DNA, 121 bp, Artificial Sequence
  Synthesized
  misc_feature (61): n=a or t
caggtataatttgagatgcttttaggtccctcttttcccaggccacgtgtcccgattcaanacagtttcaaaagccccatgaacaaggagccgccatctactgcatccatagcatcatact

SEQ ID NO: 30818 - DNA, 121 bp, Artificial Sequence
  Synthesized
  misc_feature (61): n=a or t
caagcgccgctctgcctcccagtgggtcgaatcccggggagcgtcctcttctgacctgtgngatttgcctccttgtcactgtgctgtgttcccatgtgccaggaaggatgcaaaggacagc

SEQ ID NO: 30819 - DNA, 121 bp, Artificial Sequence
  Synthesized
  misc_feature (61): n=a or g
tttcttacgtctaagagcagccgttaaagcagaacagcagaccaaggaacaaggtgggcanagagcagtctccactgaacaaggcagctacctgaagacatccaggtcacctatgccagcc

SEQ ID NO: 30820 - DNA, 121 bp, Artificial Sequence
  Synthesized
  misc_feature (61): n=t or c
atctgtcgtggtctaccagcaggctccagggaaaaactgagattagcgacaaatatcatcntctgggcttgactggattcctacgtttttctaatttcctagattgttttctttgaattat

SEQ ID NO: 30821 - DNA, 121 bp, Artificial Sequence
  Synthesized
  misc_feature (61): n=a or g
cccatctgcatgcagcagtgctcattcccgacaaggtgacatttagctatctacacagtangcaggtgcctaaagcagcaaacttcatgcagatgagcaggcagcacccactgattcttct

SEQ ID NO: 30822 - DNA, 121 bp, Artificial Sequence
  Synthesized
  misc_feature (61): n=t or c
agcaggtgatgcagcacccagccctgcagacacctccccatgctgaacaatcgtggtgacnaacatcaaagctccaagtaaaccaagcaaccaacactagggtttcccatctgtgaaggga

SEQ ID NO: 30823 - DNA, 121 bp, Artificial Sequence
  Synthesized
  misc_feature (61): n=a or t
cagatctggtcacggttttgtttccttacaaaaacattcacctcttgctacccaggtcctngcttagcattattcatgggggaggcacagaagtggatgctgcaaagcaagcactaacttc

SEQ ID NO: 30824 - DNA, 121 bp, Artificial Sequence
  Synthesized
  misc_feature (61): n=t or c
aattaaaccaatggggcaccctcagctgaaggtggaaggattagcagcagaagacagaacntgataagctgtttgcactcagtaaaagcgtggtcttgcacagtttccataggatgtgtct

SEQ ID NO: 30825 - DNA, 121 bp, Artificial Sequence
  Synthesized
  misc_feature (61): n=c or g
acaccgtaggctgaagtaaatgccaagtacaaatgtatcattgcttatctttattttgtcntaatgtagatgaaatgtaacacttccgcaaatataatattgcacaaagtaaatcttctct

SEQ ID NO: 30826 - DNA, 121 bp, Artificial Sequence
  Synthesized
  misc_feature (61): n=t or c
ttttaaatccacacgtgaagtgttttgcgttgcttcgtgctgttgtttttacggtcacttntttgagttgtggaaaagatgactgtgattgggaaaatgtgctcagagatgtacatctttt

SEQ ID NO: 30827 - DNA, 121 bp, Artificial Sequence
  Synthesized
  misc_feature (61): n=a or g
cagagaaaaggttggtcaaaccgcccttctgctttccagtgttgcaaaggcattaaaaaantacttctgtatttgcccttaatgctactttggggctagcaaaaaatgacctttgaaacac

SEQ ID NO: 30828 - DNA, 121 bp, Artificial Sequence
  Synthesized
  misc_feature (61): n=t or c
tgctgctccccagctgcccgggaggcagctgttctcaagctccccactcatcaccacatcntttggcttcccctccccgggatgtaccttccaaatcatcgatggtcttctccagcttggc

SEQ ID NO: 30829 - DNA, 121 bp, Artificial Sequence
  Synthesized
  misc_feature (61): n=a or g
tttttttttttttggacaatagaagagttttagtccaaaaatgtctcccctaaactaagtngttctgacaggagagaagcctaacatctctgttaaggttgcacttcttgcccagatttgc

SEQ ID NO: 30830 - DNA, 121 bp, Artificial Sequence
  Synthesized
  misc_feature (61): n=t or g
aaagtccctccccagttttcctgtagatcatgttagattcctcagaatgcacacttacagncttcacttcagttctttaagcatccacttcaaaataagagtgctgaaaaaaaataggtgc

SEQ ID NO: 30831 - DNA, 121 bp, Artificial Sequence
  Synthesized
  misc_feature (61): n=a or g
acagtaagagatcatctcctggcaatggaaatgggaaagaatcctggaaaactccagctgnaggcaaagattgcaaaggtttgggaagcctcctgcacagcaagcccagaggtgctaaaga

SEQ ID NO: 30832 - DNA, 121 bp, Artificial Sequence
  Synthesized
  misc_feature (61): n=t or c
tttgctgcaaagcagtgcccaaatcctggtcacccatggcggtgacacctatgctgtcccnatgctgtccccatgctgacagtctctatctctccccataggtggttccggtaccatgtgg

SEQ ID NO: 30833 - DNA, 121 bp, Artificial Sequence
  Synthesized
  misc_feature (61): n=c or g
ggacccatttacactgcacgttttacctggcacttccatctggaaggtccaacccatactncattctccttgtgggaatgacaggttcctgctccgagcccagcagcctgcgggacagaca

SEQ ID NO: 30834 - DNA, 121 bp, Artificial Sequence
  Synthesized
  misc_feature (61): n=a or g
gatttactacaatgaaaccttgaagagtgcaattacaggatctttatttggtggatgtggngaaaccacactaagtgatttgtctaatcatacaattggaatgtaagtattgcccgtgaga

SEQ ID NO: 30835 - DNA, 121 bp, Artificial Sequence
  Synthesized
  misc_feature (61): n=c or g
atgagttcaaggctgggaatttgttgaagtacttggttctactggggttgaatcaccttantatatttcaggaatgaaattatagattagtaaattttctatggggacaataactgcaaat

SEQ ID NO: 30836 - DNA, 121 bp, Artificial Sequence
  Synthesized
  misc_feature (61): n=c or g
agggtgagtgggagagaggagggaagcatctcccaccaacgttgaaaactctccacacatntttcaattctcaggagctgactctccagctcaaatgaactatccaacaaccaaagaaccc

SEQ ID NO: 30837 - DNA, 121 bp, Artificial Sequence
  Synthesized
  misc_feature (61): n=t or c
tgatgcaaatctttccctttttcctgttacttacatggcatatatttagtttgagctgatngctgataatccctaaacttcctctaatgaatgtccattctgtcactgccaattaataatt

SEQ ID NO: 30838 - DNA, 121 bp, Artificial Sequence
  Synthesized
  misc_feature (61): n=a or g
tccaagtctttcacttcctctgagaagtaatctctcattaatggttatagcacatcactancaattctttgtctttcatgacacccagaagacaagatatctaaggaattccctgtgacat

SEQ ID NO: 30839 - DNA, 121 bp, Artificial Sequence
  Synthesized
  misc_feature (61): n=a or g
atgaaatgaaagaaagtaagagaattttagtcaaatacataatgccagtaatgacagtgcnagcagaacacattaaaagaaaagtttggttttagctcaaaaaaataaaagtttgatagga

SEQ ID NO: 30840 - DNA, 121 bp, Artificial Sequence
  Synthesized
  misc_feature (61): n=a or g
gaatccagtattaatagcaagatcattttatcccaaagcaatgctgtgtacagaagaatanatgacagagatggttttgatttctattttgcttagtttgagtaagttaatcacttgtctt

SEQ ID NO: 30841 - DNA, 121 bp, Artificial Sequence
  Synthesized
  misc_feature (61): n=a or c
tatctctttatcttcttctcatcaaatgattcatatgtatccttaagcacattaaaacccnagatccacaaactaaagtgtggatctttgcagaggaacataacctcattatgcttaagtc

SEQ ID NO: 30842 - DNA, 121 bp, Artificial Sequence
  Synthesized
  misc_feature (61): n=t or g
acaccctgtcaaaggctttattttttcctcaggtaactagtgactctaaaaggctttcatnaggaaatgtattccttgtaaatttcaagaagttagataaaaacttctgaaacacatgctt

SEQ ID NO: 30843 - DNA, 121 bp, Artificial Sequence
  Synthesized
  misc_feature (61): n=a or g
tcacatctcagtcagaaaagagctattgtacaagatcaaaccaattgtctatctaaacttngttatcttcctcttttaatacttacttgtcttgtatccaattcatcaaaagaaagcaagt

SEQ ID NO: 30844 - DNA, 121 bp, Artificial Sequence
  Synthesized
  misc_feature (61): n=a or c
agctggaagttacatgaatggcagtctatattgcttgaattgctccaatccatctggcctnctcagtaggctgtagtggtcgagttccatcagtcaatttaatttaatgaggctacagagc

SEQ ID NO: 30845 - DNA, 121 bp, Artificial Sequence
  Synthesized
  misc_feature (61): n=t or c
ttgtacatcagcttgcatactaacatataatttctcaatggctttgcaaacaagtactganttatagagacaaaagcctgtcagatgtataatacatatgctactctagctaaaacatctg

SEQ ID NO: 30846 - DNA, 121 bp, Artificial Sequence
  Synthesized
  misc_feature (61): n=a or g
gaatgactggtaacaagtatgaaaatgactgaaacatttagtcaacatttctctaaagaanacatgacaaaacaaagtcaactacatcactcacacacacgcacaaaaatgcattttcact

SEQ ID NO: 30847 - DNA, 121 bp, Artificial Sequence
  Synthesized
  misc_feature (61): n=c or g
cagctttgttgttattcaccacaaggtggacatggaaatttgctacgcagcaatgttccanggttacatgtctacctctggaacactggggacagagctctgtctattttgaatgcagtcc

SEQ ID NO: 30848 - DNA, 121 bp, Artificial Sequence
  Synthesized
  misc_feature (61): n=a or g
catggtgctcacctccagcagcaaccgcaccacctctgttttgccatagagcgcggcctcntgcaaggctgtgcctgtctttgtctgcttattgatctcaattccagccttcagcagctgc

SEQ ID NO: 30849 - DNA, 121 bp, Artificial Sequence
  Synthesized
  misc_feature (61): n=t or c
tgattaatttctaatacagtacctatagcaatgattgattatttaaacattgtaggagtanatcccccagtgggaaagcaaaagaaatggtggtggaagaaataaaataccccatctgcac

SEQ ID NO: 30850 - DNA, 121 bp, Artificial Sequence
  Synthesized
  misc_feature (61): n=t or g
tagaggaaagtccctaacctatttctcagactccctaatccacagactctctctttttacngtttagcctctgatacttccatcaccacctaatctgctcttcagcctatgcttagatctg

SEQ ID NO: 30851 - DNA, 121 bp, Artificial Sequence
  Synthesized
  misc_feature (61): n=t or g
tatggcagcccccaagcagacccttttgcaactccacggtaagtcttggggtgcccaatgngagatcccacctctccccacacattccccatttgcagcagatctttggggcggaattagg

SEQ ID NO: 30852 - DNA, 121 bp, Artificial Sequence
  Synthesized
  misc_feature (61): n=t or c
caagcttcacttctttaggaagagactaagcccaaggatttcctctggaaagctgatcaangtacagctcagtacagagaacccagttgcatgggttacattcacacacaataacatgaag

SEQ ID NO: 30853 - DNA, 121 bp, Artificial Sequence
  Synthesized
  misc_feature (61): n=t or c
caattatctcaaacagttcttttattatctttgcccactaaaaagtcaattattataaaangccaacaaggccagtggtatatttcatcctactggttatcatatcaagattaaatttatc

SEQ ID NO: 30854 - DNA, 121 bp, Artificial Sequence
  Synthesized
  misc_feature (61): n=t or c
gtaactgcaaaatttgcatatgttaatcaaaatgctttgttggtggccttggaaaggagtncagcctattattctctgctggtagaataaaaattatcacaggaaaccttagtgggtatgt

SEQ ID NO: 30855 - DNA, 121 bp, Artificial Sequence
  Synthesized
  misc_feature (61): n=a or g
tttccttgtgtcaggaatttattttgcagaataaaccattattttaaaaaaggcaaaaaanaaagttggatttttaggttctgcaagaacgtaagctctgggcaccgcagccctgcgagca

SEQ ID NO: 30856 - DNA, 121 bp, Artificial Sequence
  Synthesized
  misc_feature (61): n=t or c
cactctcttactctacatcgtcctctttcatggaggcttttgtaccaggtcatattaattnctggtaaagcacagtactgatattctctgtaactgtgacacccaagctgctggttgccaa

SEQ ID NO: 30857 - DNA, 121 bp, Artificial Sequence
  Synthesized
  misc_feature (61): n=a or g
taaaaaataaacaaaacaaatatgtactgcttgcatggatacgtgattatagccacgctcntacaaggaaggtgaagagcagcctgtctgaaaggtttaaaggctaataagagtgagatgt

SEQ ID NO: 30858 - DNA, 121 bp, Artificial Sequence
  Synthesized
  misc_feature (61): n=a or g
gatcccggcttgaactgcccactagctgtagcttaaagcaaatgtcacccctgattcgtgntgagaagctccgtaacgctgctctgctcctctctgcgagcgctgaggggattctgcagcc

SEQ ID NO: 30859 - DNA, 121 bp, Artificial Sequence
  Synthesized
  misc_feature (61): n=a or g
aattgcccagagaagttgcagcatttccttccttggagatctctgaaagctgggcaacctnaacatgctatatgtccgtaattgagcagtgtttggaaagatagcttcctctggtcgcatc

SEQ ID NO: 30860 - DNA, 121 bp, Artificial Sequence
  Synthesized
  misc_feature (61): n=t or c
tgagcaaggaaaactgaagataaggctaacagcagagaaagaccaccaatcctccatttangttaacgtacaaagaaattctcttaggcttcatggactgtttcaacttgctatgaaccat

SEQ ID NO: 30861 - DNA, 121 bp, Artificial Sequence
  Synthesized
  misc_feature (61): n=a or g
tcagcctggaattctactcaactcccagttcactatattttgcattaactcacttactacngtgtgaaacacacactaaatcctgattatctctgcaggttagtaacactgctattggcac

SEQ ID NO: 30862 - DNA, 121 bp, Artificial Sequence
  Synthesized
  misc_feature (61): n=t or c
aacatatttgtatcttggaaaagtaccttgattgtaaaatgtgatgtgtgaaaaccagatncatgaattcacactgggacaatttagggaaacatggtgattttagcgaatcttcctagcc

SEQ ID NO: 30863 - DNA, 121 bp, Artificial Sequence
  Synthesized
  misc_feature (61): n=t or c
gtttgcatcgttgcaccgaactacaaactgcagccactgtgcagctgcaagggtagaagcntgtgagagaaacacaatgtgcttgcttgctcaccactgcacagccgtctttctgcatttt

SEQ ID NO: 30864 - DNA, 121 bp, Artificial Sequence
  Synthesized
  misc_feature (61): n=a or g
gaaacaggtagtccaggtcattgggtgctgtgctgtaggaatccagagcatcacagtgacntgcttaattgtgtatagagtgtgaaaaccctcacatgttatcgtaagtgaccccacccca

SEQ ID NO: 30865 - DNA, 121 bp, Artificial Sequence
  Synthesized
  misc_feature (61): n=t or c
ctcttttgtattgtagcagtaacaactttcacactaacaaattcactacaatcagtttttnccagacagagcacacaaaatattacaaaggaagaggttagatgttaagaaaatctttacg

SEQ ID NO: 30866 - DNA, 121 bp, Artificial Sequence
  Synthesized
  misc_feature (61): n=t or c
atattggtaataccattataaatagtagcaatttgtgttttcagttcttgttgtgtaccantgtcaaagcattaaagctgagatctagatgcatctaatggcaatctactgtttgcttgaa

SEQ ID NO: 30867 - DNA, 121 bp, Artificial Sequence
  Synthesized
  misc_feature (61): n=t or c
attagctccaaggtgctgtgttagcatggcctgcaaaggtttcgtgtgagaagaaaatgcngaggtcgtgggagcagcaggagtgagtcactcgataggatcacgtcctattcctgaggtt

SEQ ID NO: 30868 - DNA, 121 bp, Artificial Sequence
  Synthesized
  misc_feature (61): n=t or c
atgattttgagatgagccttattatttgactagccgtggtcctgtattcaagtgttcaaangagaacctgaatcaacatatggatcattcacatctttatagatgtgggtatgttaattat

SEQ ID NO: 30869 - DNA, 121 bp, Artificial Sequence
  Synthesized
  misc_feature (61): n=a or t
ggtcttattatgaaaaaattcaaatgatgctttataatctgcagaaccaaagagtcctgtnacttcagtaatgtcagtctcatcactaattagtatttgtcctcttcccaggctgagaata

SEQ ID NO: 30870 - DNA, 121 bp, Artificial Sequence
  Synthesized
  misc_feature (61): n=t or c
tcagaccccacacactatggatgagtcaatagaaccaatatgaaacctgcatatgtactgngttcccagcctcccctcaaccccagaggttaaaatctagttttctatattttgcaatgaa

SEQ ID NO: 30871 - DNA, 121 bp, Artificial Sequence
  Synthesized
  misc_feature (61): n=t or c
gttccactacctacagaggtgagttggatacaggatctccatcaagtctctggtcccacanataagcaggagggagaggcatagcctcagctaggtcacatttatcccctgctattactgc

SEQ ID NO: 30872 - DNA, 121 bp, Artificial Sequence
  Synthesized
  misc_feature (61): n=c or g
gatttcatattgctttgcctcaaaagcaatggaatcttgggaaaggatcagattgtccccntaaattggctaccaccgtcctgacttcacattgttttaaaatgaaatatctgacacattc

SEQ ID NO: 30873 - DNA, 121 bp, Artificial Sequence
  Synthesized
  misc_feature (61): n=t or g
tccttgtgctggtgcattcactcacctttaaaaggaagcaccttgccattctcaagttatnatttaaaaaaggcagtgtaaccaaaactgtgattttaaacatactgcttataaagtcaaa

SEQ ID NO: 30874 - DNA, 121 bp, Artificial Sequence
  Synthesized
  misc_feature (61): n=t or c
gctgtttactccctgattataccagttacaagttgggcacacttcatatgttgtgctgtanggtgtatcggtcatactcactaactaataatagatagtgtcactaaattgatagtgggtt

SEQ ID NO: 30875 - DNA, 121 bp, Artificial Sequence
  Synthesized
  misc_feature (61): n=t or c
tttggtctcgtatgaatgcaccatacttatttgcatgttatcacaacagattcctctttgngtttagttatccatataaagagaaaggtgctccacatgacctcgatattcaaaagaaata

SEQ ID NO: 30876 - DNA, 121 bp, Artificial Sequence
  Synthesized
  misc_feature (61): n=t or c
ccaggttcatctccatggccttcttggagtaagaaccaggtatcagctgcaaccacattgngtgtattgggaaaaagcactgacaactgatcccagctaaaacagtactacagaaactatc

SEQ ID NO: 30877 - DNA, 121 bp, Artificial Sequence
  Synthesized
  misc_feature (61): n=t or c
ataatgacataaaactttgttttagaagaatatgctgcaaaggcattgtctgaaccccaangtgggggtatgtgagccactgaactgtcattgtttagaatacaacaacattcgcaaagac

SEQ ID NO: 30878 - DNA, 121 bp, Artificial Sequence
  Synthesized
  misc_feature (61): n=a or c
gggacaacgtgctgttatcacaaagttgtgctcttagcgcagtgctcagtaagtgtgtgancacagtgggattttgtccactcaaactccaatgtacttttcaattaaaatttcttggtag

SEQ ID NO: 30879 - DNA, 121 bp, Artificial Sequence
  Synthesized
  misc_feature (61): n=a or c
acagcaaaaggcttgtgctcagaagaaaggctggaaatattagcccagtggcttctttacnaagccatgcagagaaagaagacctttccgtctgcctgaaaaatgctgaacacatctttgg

SEQ ID NO: 30880 - DNA, 121 bp, Artificial Sequence
  Synthesized
  misc_feature (61): n=c or g
ctgtaatgggtgagatcttcccaaccactcagtagaattcaccccactttcaatgcaaatntaagtattaatacatatttatgtagtgcactgaatatgctaacatagctagacactggtg

SEQ ID NO: 30881 - DNA, 121 bp, Artificial Sequence
  Synthesized
  misc_feature (61): n=a or g
cggatggcagtggggaggtgacacagccccgacgcgaggagggtcgtgttggataacaccnattcagcaacgaaaggatgcggatggagagcaccggtcagggagtgcatcccacctccat

SEQ ID NO: 30882 - DNA, 121 bp, Artificial Sequence
  Synthesized
  misc_feature (61): n=t or c
aaaagatcttgtcttctgtatggaaaagaggagttgagaaagatctgtggtaaaatgtagngagatcagacaaagagagacaaatatttaatacaaaataagggaaaaggaaacttctgtg

SEQ ID NO: 30883 - DNA, 121 bp, Artificial Sequence
  Synthesized
  misc_feature (61): n=t or c
ggttgcagcatgcaaccattcttctccatcagacctctcttcctgaaaatattggtactgngttgctattatttatttcaccagctgagcgggcttaaaagaagcactgctctccaggctg

SEQ ID NO: 30884 - DNA, 121 bp, Artificial Sequence
  Synthesized
  misc_feature (61): n=a or c
ggcataccttcactgcagcaacactgccagtacacacagcaaaagttcttgaacaggactnctagaatggcttctgataagatcaatctgacatctgcttgccttaggaaagctgcttctc

SEQ ID NO: 30885 - DNA, 121 bp, Artificial Sequence
  Synthesized
  misc_feature (61): n=a or c
aagcgtttttggtttttgaagatgtgattgccaattatttttgcactagtgcacataaacnggaaggacagattcttaggtatgagttatatattcctgtacaaaataattgtatattcta

SEQ ID NO: 30886 - DNA, 121 bp, Artificial Sequence
  Synthesized
  misc_feature (61): n=t or c
ccttggcatccaacagatatttaattactttaaatataacctgaggttgtctcatcactgnttcactctgtgtaaaatgactcaccagtaagtactgaaatatgtcaagagaagttaaaat

SEQ ID NO: 30887 - DNA, 121 bp, Artificial Sequence
  Synthesized
  misc_feature (61): n=a or c
aacaatataatttcaaggtctgtaccttatttttttagatcttccatactgttactgtcanataatctgtacaacagttgccatggaagacttccaagtcatttcactgaaataatacctt

SEQ ID NO: 30888 - DNA, 121 bp, Artificial Sequence
  Synthesized
  misc_feature (61): n=t or c
tcacttactggtaccaatggccattctttcacctatcttgcatcacatcattaactaatancactttgactgcttcacaaaaacgcaggtgacatatcatccccatctctaatagccttcc

SEQ ID NO: 30889 - DNA, 121 bp, Artificial Sequence
  Synthesized
  misc_feature (61): n=a or g
gatttgaatgccaaattcttttgtttgctaggatatacgtatcgcacagtatgcagggcantttcgtgcaatcaacaagacccacaattgcatacctatctttttgcagtaaggtcacatt

SEQ ID NO: 30890 - DNA, 121 bp, Artificial Sequence
  Synthesized
  misc_feature (61): n=a or c
aaaaaaataaggggaaaattacatggaataatctttaaagagatgttattacaagagactncagtgaagtctgactgtttctgattgcctcttctgttttgatggcacctttagtgcttct

SEQ ID NO: 30891 - DNA, 121 bp, Artificial Sequence
  Synthesized
  misc_feature (61): n=t or c
agtcgttttctctcctagattctctcggccgggtgcttacacatcctgctgagagctgcancaggccctggatgacagattttcctagctctaggaaacacatagctgtggtagagtttag

SEQ ID NO: 30892 - DNA, 121 bp, Artificial Sequence
  Synthesized
  misc_feature (61): n=a or g
ctgtaactgatcatttaatgtaaaggagtatattattacacaggtctcatttctattgatngtagctttactcttacttgcttctaggacaggataagtttgttccactgacttcagacag

SEQ ID NO: 30893 - DNA, 121 bp, Artificial Sequence
  Synthesized
  misc_feature (61): n=a or g
cttttgaaatggtggcacatttccttcaggttgctgcttttgcaccatctggctattgaanccttctcatcatcagagaggttttagaagacacaatacagtcttatttgtcattcaaaca

SEQ ID NO: 30894 - DNA, 121 bp, Artificial Sequence
  Synthesized
  misc_feature (61): n=a or c
actggaagataacgtgccaattccagctagccaccgaatttctgctcatctgcaaggaaantgtgcatctcctctgtgaccctgttgtttcatctgtaaaatagaggaggagtgctttcct

SEQ ID NO: 30895 - DNA, 121 bp, Artificial Sequence
  Synthesized
  misc_feature (61): n=t or c
gctgtcatttagttccagctgttgttgctattgggtgcttcaccgtatcaggacagaagangactaaaggacaaaggaagttgtgttgcaaaaacacgagtgagtctatgctaaaatttaa

SEQ ID NO: 30896 - DNA, 121 bp, Artificial Sequence
  Synthesized
  misc_feature (61): n=a or g
ctctagaccgtgttcccattgctttctacaggcccctgttcagcaaaaatgtaaacatatnttgaattatgtctatttcaacctcatgggttgttcataaagtgtgatgcttttggggcca

SEQ ID NO: 30897 - DNA, 121 bp, Artificial Sequence
  Synthesized
  misc_feature (61): n=a or t
gttcatattgttgtcactgcaaaatgccctcttggcattgagtggcagctaccagcagcangagtgggaggtggtagggctgtgtccttgggctgctatggcccatggcttgcttggtcct

SEQ ID NO: 30898 - DNA, 121 bp, Artificial Sequence
  Synthesized
  misc_feature (61): n=t or c
ggtagctgtgcacgtttctgaatctgagaagaaaactttgcgtcttcagccttccagagcngtgctcatcaagacacttgcacatacagaatccatttgctggaccaaaatcccagtcaaa

SEQ ID NO: 30899 - DNA, 121 bp, Artificial Sequence
  Synthesized
  misc_feature (61): n=t or c
atgtgcatgtctgcatgcactaaggcactagtgagtcagtggttcacttaaacgtgatgcngtatctctggaagttgcactggttttagattcatacatttcagtttgtgatttcaagttc

SEQ ID NO: 30900 - DNA, 121 bp, Artificial Sequence
  Synthesized
  misc_feature (61): n=t or g
agtcacaaccgctttacagcacatgaatgcatttcaatgcactgtattccatcgaagagtnataaccagggttttcatagttgagttgctcccatttctcctttacttcaggatgaacgcc

SEQ ID NO: 30901 - DNA, 121 bp, Artificial Sequence
  Synthesized
  misc_feature (61): n=a or g
cttacacacttgattactagatgctggcacaatctagagcagcctcaccttcatttgttgnattcatgaaagtttcctcaagtcagtagaaatatgaatgcaggaggacatatctgaacct

SEQ ID NO: 30902 - DNA, 121 bp, Artificial Sequence
  Synthesized
  misc_feature (61): n=a or g
tcatattcaggaagtcagacgtgaaataccagtgttggttagatagttacctgcatttctntcttgatagatggttttatattgctaatttatacattctttgaagaacatttaaagaaat

SEQ ID NO: 30903 - DNA, 121 bp, Artificial Sequence
  Synthesized
  misc_feature (61): n=a or c
agagtcattagaaatcttctaactccagagctggcaccattctcagaataaagtaccaatntctctctctatctttcaatttctattgactggggtttgacaccctaatcttcatgtccag

SEQ ID NO: 30904 - DNA, 121 bp, Artificial Sequence
  Synthesized
  misc_feature (61): n=a or g
attttgtgtaagaaaatatctaaattgtcagcatatatatctgaagtatgaattcatttcnagattttaggagaatgtaagcataagaatttcctaccattgtggccaggtctacccagag

SEQ ID NO: 30905 - DNA, 121 bp, Artificial Sequence
  Synthesized
  misc_feature (61): n=t or g
gtgaagcagaaaaatccctgcctgcctgctggattttgtacttggttttagggcctccctntatttcaactgttatcagaggaaattagtaagttctggggcactgatttggatcatatgc

SEQ ID NO: 30906 - DNA, 121 bp, Artificial Sequence
  Synthesized
  misc_feature (61): n=t or c
ggctgtgcaatactcttcttattcacagtacaattacactatctttgcactagctttatgnttttaattatttacactggacctattattgagacatacaaaacattctcaattgttcata

SEQ ID NO: 30907 - DNA, 121 bp, Artificial Sequence
  Synthesized
  misc_feature (61): n=a or g
gtcttgaggctggtgtctaatgtgggataaaagtgggatattataacttactgagataccnagtttgatgtacaatggcagttgaatgagatgtgaagttaaaagagaagatactgtaaaa

SEQ ID NO: 30908 - DNA, 121 bp, Artificial Sequence
  Synthesized
  misc_feature (61): n=a or t
aagcattgtttcacttttcaaatccattccaactgctttgtatgaggtagcattagcacangggtaaatcctagtatatttttcagaagttctgattctcagtttcaatattaaagaaaaa

SEQ ID NO: 30909 - DNA, 121 bp, Artificial Sequence
  Synthesized
  misc_feature (61): n=a or g
ggggaaaggagtgggttcaccaacacgggctgtgttctgagcatggcgggggctgccgaanggagcagagcggttaccccagggaggatggattaagtgccattctcccctgcctcctgca

SEQ ID NO: 30910 - DNA, 121 bp, Artificial Sequence
  Synthesized
  misc_feature (61): n=a or g
cctgccttacaagaacactccctccctcctctgtcagaaccactcacaagcagagaatggncccaaggttttcaaggcttgatgagagacaagagcaccattcccttctgattctgaaggt

SEQ ID NO: 30911 - DNA, 121 bp, Artificial Sequence
  Synthesized
  misc_feature (61): n=t or g
gttactatcagaaaatcaaaaatgtctgttggaaattacgaggaaagtaataagacaacancaggaaacaccattaatgctgtctttaaatctgagctgagtccatacagcacaagcatag

SEQ ID NO: 30912 - DNA, 121 bp, Artificial Sequence
  Synthesized
  misc_feature (61): n=c or g
ctatgtcagctttgctactgtgtctcctgctttggtagctgctactgtagcagaaaacgcntctcttgctaaagctgctggaggagatccaggagaacatcaggaacccagaaagtgatcg

SEQ ID NO: 30913 - DNA, 121 bp, Artificial Sequence
  Synthesized
  misc_feature (61): n=t or c
ccatgacaacacaggtaactatttcagaggcagctggacttcaataccaggcagatatttncttattctacagtttatatacttagcacacatacacacataaataggcaactcctcataa

SEQ ID NO: 30914 - DNA, 121 bp, Artificial Sequence
  Synthesized
  misc_feature (61): n=a or t
tgcatatattcattacttgctaaaagtaagtcaggacttgttgcttgtgttgtctacagtntagccaaagggctggctgggaataactgaaggcaggataaattgttttgctctcaacttg

SEQ ID NO: 30915 - DNA, 121 bp, Artificial Sequence
  Synthesized
  misc_feature (61): n=c or g
aatatagaggacaagagaagacagactcctagtgatgactgcattaattcagagatttacnaagttgttgttcaaaaagctagtcaacatgctaatttgaaacaaagagtatcacacaacc

SEQ ID NO: 30916 - DNA, 121 bp, Artificial Sequence
  Synthesized
  misc_feature (61): n=a or g
attggctctaaattgcatctctgtatgctgtcagcatatcctgggctctttgcctctcctntagtcacaaaagcaccagaagtctgtatctgttatcctgctgcacctataaaacctgact

SEQ ID NO: 30917 - DNA, 121 bp, Artificial Sequence
  Synthesized
  misc_feature (61): n=a or g
gaacatcaatgaaatccaagctgccattgcgctcctgtgcaatcctaacagacagacagcntgcagaatcctgtgggtgcaacacagttcctgaaaacagacaggagcattggatggagct

SEQ ID NO: 30918 - DNA, 121 bp, Artificial Sequence
  Synthesized
  misc_feature (61): n=a or c
atttctttcataagcaactatcaagggagatagtagctccttttaatattacagtccgagnttacatacagcacccctgtctcagaccatgtattcttcaggagagattatctctcctgta

SEQ ID NO: 30919 - DNA, 121 bp, Artificial Sequence
  Synthesized
  misc_feature (61): n=t or c
tatggtgggtgggaatattagggttgtgttgtgacgctgtggtcgttcatgtgtgacgccnggtgctctggtgttcccccagacacgtagccaggcttggggctgaaggtgctgcttcgga

SEQ ID NO: 30920 - DNA, 121 bp, Artificial Sequence
  Synthesized
  misc_feature (61): n=t or c
atagatgccctctcccagtgcaaggaaggcagtgtggatcctcatgagaaacagagtccanacatactgcatccactgcttctcagttttgaggctcaccccaggcttggtttgggttcgt

SEQ ID NO: 30921 - DNA, 121 bp, Artificial Sequence
  Synthesized
  misc_feature (61): n=a or g
acttcacctctgcagcactgcacgcacagggtgagctgggagctgaggagtgttttctgangcacttaaaaccctgcagagagtaggctgctgcctattactggcttaactatgtctgaat

SEQ ID NO: 30922 - DNA, 121 bp, Artificial Sequence
  Synthesized
  misc_feature (61): n=a or c
cagggctactagtaatttgcagaactcctgagctctctgtgagcagatccaacccactganaatgatggagcacagatctgctgccagagcagcttacagaagaggggaaatgatgttctc

SEQ ID NO: 30923 - DNA, 121 bp, Artificial Sequence
  Synthesized
  misc_feature (61): n=a or g
tctgttttccctgtaagcttatggtaccgtctgacagtgtttgataccgcactaatattcnaacttagatgtatcctcaagtttgggaattgggataagaattcccttttgatgactgaaa

SEQ ID NO: 30924 - DNA, 121 bp, Artificial Sequence
  Synthesized
  misc_feature (61): n=t or c
acccatatccttaaccaattaattatgatttaaatattgttgcttcgttgtaactggttgnatggcttaattccctcgtttttaatggacaaatcaacaggaattacccttctcaatggat

SEQ ID NO: 30925 - DNA, 121 bp, Artificial Sequence
  Synthesized
  misc_feature (61): n=t or c
aaagccacctttcacacaggcagtcagtatgcacagcacaattagtccatccaccatgaangatcttcccagacccttgtgctcttggagtaaggtgtgttatgtgggtgtttgctcacag

SEQ ID NO: 30926 - DNA, 121 bp, Artificial Sequence
  Synthesized
  misc_feature (61): n=a or g
tttacagttttaaaggcatggataatctttaggtaactacgtggtttataaatcactgacnttttagatacgagcatcagtgagtttccagatgcaaaagagaaggatgttgcaagaaaat

SEQ ID NO: 30927 - DNA, 121 bp, Artificial Sequence
  Synthesized
  misc_feature (61): n=a or g
tagaaatgtgagaattcatgaactctcaatatatgtgaaacagaaataaatgaatatgttnatttgcaatatatttgttcgagctaaaatacatggagacatcatcactatgttatcaact

SEQ ID NO: 30928 - DNA, 121 bp, Artificial Sequence
  Synthesized
  misc_feature (61): n=t or c
aagcaccagctatagcagcattggtaggctcttgatggctgcagtgatgcagctctgtatncttcacgtctgctgtcctgctggttccttctttttttcttgaaggaaatggagagatgag

SEQ ID NO: 30929 - DNA, 121 bp, Artificial Sequence
  Synthesized
  misc_feature (61): n=a or t
gtgtcacctcccttgggctcattctgctggcttgaattattatattcctattatagtctgnagtttttaaaggagtttgtatgcctttgcttttctgtttaatatgaacttatggtctctc

SEQ ID NO: 30930 - DNA, 121 bp, Artificial Sequence
  Synthesized
  misc_feature (61): n=a or g
gtatgaaaataaaaaccacacttagcacatacagaaaacagtttcaaaaaatgaccactgntcatctgttagaagacagtggtgatggctgtgcagctgccactaacccttgagatggaga

SEQ ID NO: 30931 - DNA, 121 bp, Artificial Sequence
  Synthesized
  misc_feature (61): n=a or g
ctatgatttgtcttacagaacatcctcagaacctttcctgattaagagtgatgtaaatgtntctattagaggctctttctactttttgaatgagtccaaaggaaagaagggaagaggagaa

SEQ ID NO: 30932 - DNA, 121 bp, Artificial Sequence
  Synthesized
  misc_feature (61): n=a or g
cgtgttcgtagcaccgcttctctgaaaacaacagaagaaaagattataacaggagcagaanaacggaaccgtccttcagagcttaagaaaatatctccctgggtaatgacagacaaatatc

SEQ ID NO: 30933 - DNA, 121 bp, Artificial Sequence
  Synthesized
  misc_feature (61): n=t or g
tccaggattatccaggattaaagctgaacacccttactagcttcctgccaaaatgctcctntataaagatataatgaaatcatatatacgcttctggacaaatacagattataggtaccaa

SEQ ID NO: 30934 - DNA, 121 bp, Artificial Sequence
  Synthesized
  misc_feature (61): n=a or t
ctgcccagggccccatccatagcctcaggcacctccagaaatgggccatatgaggtcatanttacactgctttactgtcagttctcctagagttaggaagtgatgctgttttgcatttgaa

SEQ ID NO: 30935 - DNA, 121 bp, Artificial Sequence
  Synthesized
  misc_feature (61): n=t or c
ggatggatcagtatgtgcaatagaattgctatcttgttttatacagagataatatacctanttggttatgaaaaagactaaggaacttgtatggattccatcatctggattccattccaaa

SEQ ID NO: 30936 - DNA, 121 bp, Artificial Sequence
  Synthesized
  misc_feature (61): n=a or g
gaaggctttgccttcctccagtcccctccaaccaactcatgttgtccaactcgagccctcncaccacctcagacactgggagctaaatttcaagcccttatgccagcagaagatgccagga

SEQ ID NO: 30937 - DNA, 121 bp, Artificial Sequence
  Synthesized
  misc_feature (61): n=t or c
ccccaaccaaccagttgaaaaaagcccaaagtgtgcattctggatagacattaataatgcntctccagaggtccaacaggtatgaaggtgctactcggagcataccaggcttggtttcagc

SEQ ID NO: 30938 - DNA, 121 bp, Artificial Sequence
  Synthesized
  misc_feature (61): n=t or c
aacaaaacaaatgaataaaaaacaaacaaacaaacaaaaaatccacatgccatgaatagcngaggctccttggtttgtttagcttaaagaaaagactgaaaggaggccttatggcatccta

SEQ ID NO: 30939 - DNA, 121 bp, Artificial Sequence
  Synthesized
  misc_feature (61): n=a or g
actgttccattgcagatattacagttctgctcagctaccacaagagggacgtagaaggaangctaagatagcccgggagaaaaaaacaaatcgaaagagcagcttcatgcaggttcttagc

SEQ ID NO: 30940 - DNA, 121 bp, Artificial Sequence
  Synthesized
  misc_feature (61): n=t or c
aatgcaaagggtgttttttggtgttgaagcgaggtgcaattgaacctcagtatatctgcanggtcatgtcaacaacagctcctcacccagccgccgcgcccgcctggcatcgcgcaggaag

SEQ ID NO: 30941 - DNA, 121 bp, Artificial Sequence
  Synthesized
  misc_feature (61): n=t or c
tctttgattggcttgagtttatctaggaggcgatctgcctccttttccaggtgttttatantagaatctgcatcagcaacttcgtaagaaagaacaaagcacaattttagagcggtgtcag

SEQ ID NO: 30942 - DNA, 121 bp, Artificial Sequence
  Synthesized
  misc_feature (61): n=a or g
tttgctatgccttataagcacacatcttagtcacaaaaaggagttcaatcatttcagagtntttctttaatctagtagagattctgcagaagacccccaaaaatgatactgacagaaaaat

SEQ ID NO: 30943 - DNA, 121 bp, Artificial Sequence
  Synthesized
  misc_feature (61): n=t or c
aattttctatttgagtctctgatttagatctgatgttttgccagcttattcattattaccnttttgattggagataataaattcattccttgaagaacaaaatcatgtctaatacattcat

SEQ ID NO: 30944 - DNA, 121 bp, Artificial Sequence
  Synthesized
  misc_feature (61): n=t or c
cagaaaaaaattttaggagatattccttgcctggaaggagcgtgccagtgtagacatacanggatactaggctgagatgatgggatatgcagcgaattacctttatacaggatattcctgt

SEQ ID NO: 30945 - DNA, 121 bp, Artificial Sequence
  Synthesized
  misc_feature (61): n=t or c
catatccagcattttttttcgcctcatatatcatcattttgctgacaggaaagctttaaancaaagtatttgtctcacttctaccagatcacacactgaaaaccagcagtaatatatcagt

SEQ ID NO: 30946 - DNA, 121 bp, Artificial Sequence
  Synthesized
  misc_feature (61): n=a or c
tatgcttgctccagtgtttggtgggacagggttgggtttgctttataaaaccagtacttcnctctccacaacaaaaacaccgatggatgtagagtacagcgtgaagcctacaaacagggca

SEQ ID NO: 30947 - DNA, 121 bp, Artificial Sequence
  Synthesized
  misc_feature (61): n=t or c
tccagtgattctgtgcaactcattaaactgggaccttgttgactgggaatgtttcattganctgtcagttaaacacggcattatttttcaaatttgcagtgatttggaaactaggagagct

SEQ ID NO: 30948 - DNA, 121 bp, Artificial Sequence
  Synthesized
  misc_feature (61): n=t or c
cgcaatctttgctatctaatggttatacatcactgcctttaatttgagaccattggagcanaccagcacgcctctgaaaaggtacactttacaggtcatgtccagctctggcagtcatttt

SEQ ID NO: 30949 - DNA, 121 bp, Artificial Sequence
  Synthesized
  misc_feature (61): n=a or g
gaggaggatctatgtgatagtgagccacattcaccgtttgttaagtttaaaggagaaatgntagacaatgacttatatgattcttgtacacagaactgtgtgaaagtatttccaagaacaa

SEQ ID NO: 30950 - DNA, 121 bp, Artificial Sequence
  Synthesized
  misc_feature (61): n=a or t
tctaaatagcttgtgggatttaggcaatcagtttctcagaatttcaaaagcatctgagtgnctgccgttcatatacttctttaaaaattcttgtccacacacttaggacttctcctacctt

SEQ ID NO: 30951 - DNA, 121 bp, Artificial Sequence
  Synthesized
  misc_feature (61): n=a or g
gatctgagggagatgctgcctccttcaaacttcaaacaaactttacttcagttgttttccngactgctccttccttaatcttatcctgactgttccagagaagtgattgtaagcaggacac

SEQ ID NO: 30952 - DNA, 121 bp, Artificial Sequence
  Synthesized
  misc_feature (61): n=a or g
caggtgttgtggaagagagctaagtaattagaatggggagagctaattacctgactcattntgcccagtggcgatccagtgcctggagacagcttttggagtctccctggaagaccaaggc

SEQ ID NO: 30953 - DNA, 121 bp, Artificial Sequence
  Synthesized
  misc_feature (61): n=c or g
ttatactgaaagattatgctgaacttaggcagtttaaagcttacgttccttttgtcttagntctagaatatgagtatggcagtttcttcaagtgaatagtcccagaatggcacactggaac

SEQ ID NO: 30954 - DNA, 121 bp, Artificial Sequence
  Synthesized
  misc_feature (61): n=a or t
tcaggcacataattgcagtttcctatgactgctagtctgagctttgactgtctctgctgcnccatagcttgaaataaaagcaaagactgaggttgtttcaagccactgctgcttcttgagt

SEQ ID NO: 30955 - DNA, 121 bp, Artificial Sequence
  Synthesized
  misc_feature (61): n=c or g
gagataccagattttttcccttggtcttattctttctcttaagattcgagcaagcacagtncttgcagatttgatgggggctgtgatgagagaccactgcagtcattttcactgttggctg

SEQ ID NO: 30956 - DNA, 121 bp, Artificial Sequence
  Synthesized
  misc_feature (61): n=a or c
ttattggcattatccacactgactatgttaaaaatacaacgtaaagtagtagttcttacanacatggtatattcctacctacagttccagaaggaataataccacaaaagagtgaatttac

SEQ ID NO: 30957 - DNA, 121 bp, Artificial Sequence
  Synthesized
  misc_feature (61): n=a or c
tcaagtggctggcatgcaatagcaagtaaataagagtatttgagagtcttgtttgcttgtntctctgccttttttcaaaaaggaactgaggggaaccaggatagcacactacaataagccc

SEQ ID NO: 30958 - DNA, 121 bp, Artificial Sequence
  Synthesized
  misc_feature (61): n=a or c
cagctgtgacctggaggtgcaaactgccagactgcaagaagctgggaagggaggaatccangttaagccccaacctgcagcaagaggcgtcagcaaacatgcttacagcacacatgacaat

SEQ ID NO: 30959 - DNA, 121 bp, Artificial Sequence
  Synthesized
  misc_feature (61): n=t or c
caaactgctgagtagttttagatattgccttttcaataggacagcactgtatttttctcanctctctctggattgaaggcataagatagaagatagttgtgaaatgcatctgtcaagataa

SEQ ID NO: 30960 - DNA, 121 bp, Artificial Sequence
  Synthesized
  misc_feature (61): n=t or c
atctccaaatatgtgggagacagcaatatcctacagggactgcaagtcctctctcatcctnttgaacagtgatttcacacttctgtacagattgcaatcttgcccataccacagattgtga

SEQ ID NO: 30961 - DNA, 121 bp, Artificial Sequence
  Synthesized
  misc_feature (61): n=t or c
tgcttatcggtttgtcttcaaacaggatttttacatatagtaatgagtggaaattactgangcagaaaactgcttgtggcaggcctccattggcaacaaactccagtataacccctggtgc

SEQ ID NO: 30962 - DNA, 121 bp, Artificial Sequence
  Synthesized
  misc_feature (61): n=a or c
gcgctctccatctccctgctgcctctttgcactttcaacccgagtatgtaaaactacaggnggaaagagaggttaaaataacagcagtcagtaattaaagacagagaatataccgacattt

SEQ ID NO: 30963 - DNA, 121 bp, Artificial Sequence
  Synthesized
  misc_feature (61): n=t or c
catgtgagtcattttgccatgcagcaatatggtgtcaagtgtatgcagttcaaagtgagcngtagtgttactgaaattggaaatttgcgacccatacccaacactgtaatccatgcagtgt

SEQ ID NO: 30964 - DNA, 121 bp, Artificial Sequence
  Synthesized
  misc_feature (61): n=t or c
acaaaagaatgtaaagcaattgcatgagccgcatcagctcagggatgaaaagcaccagtcnctagagctgtcaggttaaaacatgcagcaccattctccagtcagcctgaatttctcacca

SEQ ID NO: 30965 - DNA, 121 bp, Artificial Sequence
  Synthesized
  misc_feature (61): n=a or g
ccaggatggcagcaagaagcctgagctccaagcatcttattgtccgtcctagaaataactnctaataaaagtatcatggagaataattatttgatctgactgggacaattcttacccacaa

SEQ ID NO: 30966 - DNA, 121 bp, Artificial Sequence
  Synthesized
  misc_feature (61): n=a or g
accaccatgtcctcactctcctccaggacagcagctcagaccagcagtgagaacagctacntgaacatgccctccttgctgaatatcttctcattttcagaagtagactgcagtggtgttc

SEQ ID NO: 30967 - DNA, 121 bp, Artificial Sequence
  Synthesized
  misc_feature (61): n=a or g
ttaaacttaaggtgtgctgttcctagatgatatggttgtcatctgttaggcatcttgtgcnatgaaacacatctctgaaatgtggagttctgtacaagtttactgttaatgtcagtttgtt

SEQ ID NO: 30968 - DNA, 121 bp, Artificial Sequence
  Synthesized
  misc_feature (61): n=a or g
aggtgagaaggaaatgggaattgccctggaagttttcctaaaactttgaaaatctagttanacaacatcagtcacaataaagctcagattattttgcctataatttatcagactacggtat

SEQ ID NO: 30969 - DNA, 121 bp, Artificial Sequence
  Synthesized
  misc_feature (61): n=a or g
tgctgagccccagcactgactgacccacctggttcatcaaagataaacactgtgacaccancctggggaaggtaacccgttcaggccatgctcaccagaccccacacatgtgccctcagct

SEQ ID NO: 30970 - DNA, 121 bp, Artificial Sequence
  Synthesized
  misc_feature (61): n=t or c
tgaatctccatttttagtgctcctatgctgaaaggcactggcaattccagcaaagaactgnatggagcagaataggatacagctcagcatctcttaattatttctattttatttttgagta

SEQ ID NO: 30971 - DNA, 121 bp, Artificial Sequence
  Synthesized
  misc_feature (61): n=a or g
atcaaggatgaaataagagagctgcctgaagcttcatctctagctaggtacaaaatccacntatcctgcttttccatccattgcaaaggtcgtctctaaactacgtggctttttggtgtac

SEQ ID NO: 30972 - DNA, 121 bp, Artificial Sequence
  Synthesized
  misc_feature (61): n=a or g
tccttcttcgtgctcctgagtcttccagaagggagcaggattcagaaggagctgcagcacnacagccctatacccgcagtcagcccacagctggtgccatggaatgcacgcaccgaaggac

SEQ ID NO: 30973 - DNA, 121 bp, Artificial Sequence
  Synthesized
  misc_feature (61): n=a or g
taatgcatgatatgaaacaaagaaaatcctacctgctgaacatgcctgtgtcgcatgctanggactccgtgaggaagttagctcttagctgtgagtttctttcacactccaaagcagcaag

SEQ ID NO: 30974 - DNA, 121 bp, Artificial Sequence
  Synthesized
  misc_feature (61): n=a or g
cgtctcagtaatattacttggtggatctttctaaaaataatcataaagcctagtctgaacngattagtgagttacactggaatgtcaacaaattgtatagagtgattctattttgaaaggg

SEQ ID NO: 30975 - DNA, 121 bp, Artificial Sequence
  Synthesized
  misc_feature (61): n=c or g
aaagttgtcagtattttttttttcataaatgtattttttatatatgtgtataaatttattngtgtaggagacaatctccttcagtaatacaggaaatcaaaatatgtagataatatgtaga

SEQ ID NO: 30976 - DNA, 121 bp, Artificial Sequence
  Synthesized
  misc_feature (61): n=a or g
ggagaaaaaggaaaggagttatgcagaggaagccatttcagagaagcgtggctatccaacngcactcaaacctccagattcgggagcctttgagtatatccccaaccacaggagagaagca

SEQ ID NO: 30977 - DNA, 121 bp, Artificial Sequence
  Synthesized
  misc_feature (61): n=a or g
gagtacagactgggcagagaaagcagctctttacttcaccgagagggtaagtgaggttctnctaacgtgtgagtttgtagaggaggttgatggtaagtggagagttattctcagtgatgat

SEQ ID NO: 30978 - DNA, 121 bp, Artificial Sequence
  Synthesized
  misc_feature (61): n=c or g
cgattcgacgttttatcgcgaaaatcgacctctcccctttaaagtacctgaaaaatatcanggcagcgcgtgtcccagtaggaatgcagtgggactttcgttcttggtcataactacgttt

SEQ ID NO: 30979 - DNA, 121 bp, Artificial Sequence
  Synthesized
  misc_feature (61): n=a or g
aacaagaattcttgacatatttctgtagaagaggagtagaaatgaacatacgtatttcacngtggagttgctctcgtccatactgatcagatactgaatttctgaagtactgaatcagccg

SEQ ID NO: 30980 - DNA, 121 bp, Artificial Sequence
  Synthesized
  misc_feature (61): n=t or c
agaatataaaattagggactgatgcagatcttctgaaaaagaggggcagtggtcctgctcnatgaaggcactgaagcaaatatcaattttcaaaacaacatatttcctttcgtgcttcaac

SEQ ID NO: 30981 - DNA, 121 bp, Artificial Sequence
  Synthesized
  misc_feature (61): n=t or c
aaagtctcagaagcaaatggatctagggctgctgctatatggccaaaccattttatattcntgactcttctcctgtattcctcaagggctggtcagtaaaccagagagtgggggagaattg

SEQ ID NO: 30982 - DNA, 121 bp, Artificial Sequence
  Synthesized
  misc_feature (61): n=t or c
cacctccagaggaaatcctatgtctgttgctgtgctgtcccaggggggtatcttccttccncaaaccaaatctgggtggggagtgaattggatgcttgtactgacatttggtcctctgagg

SEQ ID NO: 30983 - DNA, 121 bp, Artificial Sequence
  Synthesized
  misc_feature (61): n=a or g
cccgacttccccaaaggcaggcgtgcggcaaagcggcgcggctccgagagtggcactcacnggaggacagctgttgagacgcagaaggatgcacagcttcctagcatgagctgtgggctac

SEQ ID NO: 30984 - DNA, 121 bp, Artificial Sequence
  Synthesized
  misc_feature (61): n=t or c
ttcccaagaacagaaaaatgagcagtgttctttacggctgtcagacacagaagaataaagnagctcagtctttaatgatagcaaattattctagaaaactctgagagtgaaagtgcatagt

SEQ ID NO: 30985 - DNA, 121 bp, Artificial Sequence
  Synthesized
  misc_feature (61): n=t or c
aaattcgaggggtttgctttgtgtacgaagtgagttaggtccacatgcaataggccagtgnagccaatgcagtgttattacctctctttctctaatgctcttctatttgtggctgggaata

SEQ ID NO: 30986 - DNA, 121 bp, Artificial Sequence
  Synthesized
  misc_feature (61): n=c or g
ccaggagttcgggcagtcctgatcatcacctgaaaggaccgagtccagaacatcagaaaancattgtcaaaacacctgaacagcaaaagcacagcagtagcagtccagaaactctcccaaa

SEQ ID NO: 30987 - DNA, 121 bp, Artificial Sequence
  Synthesized
  misc_feature (61): n=a or g
ccaggcacagcagcacgatgctccgggagaggcacggaggctccaggaggcgagcgaaggnagtggtatgatgcaaccctggtgtagtgaaatagccggatagtaggaagcgcttgccgtc

SEQ ID NO: 30988 - DNA, 121 bp, Artificial Sequence
  Synthesized
  misc_feature (61): n=t or g
cccatgtgcagaccccaaactagactcaagagccagaattctctctctgatccaaagaaanaaggtgttatttattaagtccttaacatgacccgcaggggcttaatctaccttttatttg

SEQ ID NO: 30989 - DNA, 121 bp, Artificial Sequence
  Synthesized
  misc_feature (61): n=t or c
ctggcatatctcctcctcccctgtgcctctgcccctcttcctattccagcctgtgcagttngctgcacttctgtcccctttactcttcagagctgtactcccttcccactgttcctgtctc

SEQ ID NO: 30990 - DNA, 121 bp, Artificial Sequence
  Synthesized
  misc_feature (61): n=t or c
atgccatcacagtcactcctaagcattctgtgctcattagggactggatgcaaatgcaagnctgcaaaaggagtggcacacaatactgctcaggggcacactgcagtgtgaggtctacatg

SEQ ID NO: 30991 - DNA, 121 bp, Artificial Sequence
  Synthesized
  misc_feature (61): n=a or g
gtctgaaaataaagactatgtgtgctatttaagtcaaatgtgactctttttggtatggctntaggtagcttaaacaacagcaagagataggatcctcagcctgactgctcatagcctggcc

SEQ ID NO: 30992 - DNA, 121 bp, Artificial Sequence
  Synthesized
  misc_feature (61): n=t or c
acgtaatcaaagtctctgtctgtgtcagctttcagaacacagaatgtgaaaaggttggcanggttattttgaatgatttaccaggtaaagaaatacaaaaaagctatttctcctgttgtgg

SEQ ID NO: 30993 - DNA, 121 bp, Artificial Sequence
  Synthesized
  misc_feature (61): n=a or c
taaagttagcctacggagagtctcagagcttcttcacccttccacttctgatctttggaancggtgttgaaaaataagaagaatgtggtagtctttttcacatctttgctgctctctctct

SEQ ID NO: 30994 - DNA, 121 bp, Artificial Sequence
  Synthesized
  misc_feature (61): n=t or c
aacaccattgccctgctatatctgatcaagataagacagtgctagttctattccaaacaanttacaagctactttctcatttgcactgaaagtctcactttgccattatgttatcttcaga

SEQ ID NO: 30995 - DNA, 121 bp, Artificial Sequence
  Synthesized
  misc_feature (61): n=a or g
ttcagccactgagaacacaggagaaaaactcagaaccatagagttgtatctgtccttcacnagcaatcccaggctttatcagtcacagtgatatttgtcccaaaataggaaattatggtgg

SEQ ID NO: 30996 - DNA, 121 bp, Artificial Sequence
  Synthesized
  misc_feature (61): n=a or g
ccaatctagtgggaaaaatgaactaggaatttgcaatctatcagctgaaaccagcactacnctgctcagaaacactcctacatacccaaagcagacaaattcatcatctgccaaggaaaat

SEQ ID NO: 30997 - DNA, 121 bp, Artificial Sequence
  Synthesized
  misc_feature (61): n=a or g
cagcattaaatgccagcagctcgttgaagtaggaaacatctgtatgttatttttttagggnttttttcatctgttgattttagaaatgaggattttatgagtccttgtgtacatagttgtg

SEQ ID NO: 30998 - DNA, 121 bp, Artificial Sequence
  Synthesized
  misc_feature (61): n=t or c
taatgtactgtccctttaagcctgaattctaaatgaagttacactgtttgaaaatagacancagcatagtttattaatcaaaagaaaaacacgtgtctattctatttagtacagattttgg

SEQ ID NO: 30999 - DNA, 121 bp, Artificial Sequence
  Synthesized
  misc_feature (61): n=a or t
tgcaagaaaccacaagcacaatcaggtgagtaaggaaacacgggagcaaagaaagaggtangttttacatccagggatacaggtaactgcaataaacattctgaattattcagaggattgg

SEQ ID NO: 31000 - DNA, 121 bp, Artificial Sequence
  Synthesized
  misc_feature (61): n=t or c
tagagatgtttgtttgatatacacacgaaggcatcctggaattgtcagcagtttttcatcnatttccctaactgaatccgagcggatcctccagctattccaaatacctgcttggtggtgt

SEQ ID NO: 31001 - DNA, 121 bp, Artificial Sequence
  Synthesized
  misc_feature (61): n=t or c
agacagactgagaaaaaatgccaaggcaattaattttcctttctgagcccaatcttaaatntctgctactctatttttccgtttgcctttccttattatggttttattcagatcttgaagt

SEQ ID NO: 31002 - DNA, 121 bp, Artificial Sequence
  Synthesized
  misc_feature (61): n=a or g
tgtcacgggaaagtgcctgtttaaaaacatcatattcacatcgctgaggactgaaggatcntagagaaggacaagaggtattttactccgggcttcactgaatgatggttttaggaaatca

SEQ ID NO: 31003 - DNA, 121 bp, Artificial Sequence
  Synthesized
  misc_feature (61): n=a or g
ctccctaactctctgcgttaagaagaccagaacaggaacattaggctgtgtctgagctgcnttgctagaacttggcaggggaaacatgcataatctgtctgagccatgcctgtttttgtga

SEQ ID NO: 31004 - DNA, 121 bp, Artificial Sequence
  Synthesized
  misc_feature (61): n=t or c
tgcatgtatattccaaataacatctgcagtttgctcctcccccattaaatgtaatgggagnccacagttgaaaaggtagaattttgctttgtaaatgtagaagaaaatttagttcagatac

SEQ ID NO: 31005 - DNA, 121 bp, Artificial Sequence
  Synthesized
  misc_feature (61): n=a or g
aatactaacttatgacggatcaaaactgtaaggtacgtcaataaacaggtttatctcagtnaaggttgttttaaaatttgtgacgccctcttaaaactcaaaatgaaaaaaaaaaaagaaa

SEQ ID NO: 31006 - DNA, 121 bp, Artificial Sequence
  Synthesized
  misc_feature (61): n=c or g
tggcctttccaaaacatccacctcccattgcatgttccactgttccaggatgcagagatanacaatttctagtactgtgactagcttcattaacaaacttgatttatattagtttaagtgg

SEQ ID NO: 31007 - DNA, 121 bp, Artificial Sequence
  Synthesized
  misc_feature (61): n=a or c
tccctttcctctagcgtatcaacagcgccactcagtttggtgttgtctgctatccacctgnacttggccttgctaatgcctatgtataaaatatcttgtcagctgggcatacccaggagat

SEQ ID NO: 31008 - DNA, 121 bp, Artificial Sequence
  Synthesized
  misc_feature (61): n=a or c
caataccgtgggcacatgggggaattaataccaccaccacagtggtgcaagaaatgatttntctcctattcatcacctagcaatgaaagactcagttattagcaaacagatatgtaatttc

SEQ ID NO: 31009 - DNA, 121 bp, Artificial Sequence
  Synthesized
  misc_feature (61): n=a or g
ctttctgacaagcacaacttacctgagctacactttgccccagaatacagcagactcaccngcattcactcatgagacatgtctcattaccaaacactgattttctcctaacttggcatta

SEQ ID NO: 31010 - DNA, 121 bp, Artificial Sequence
  Synthesized
  misc_feature (61): n=a or g
caggcagagttcagcccgtgttgttatgtgtcagaggacagggataccaaaaggaacaagngctgcgagctgtttacatcactggcaactagtggctgtgttataatggaggatgaggtac

SEQ ID NO: 31011 - DNA, 121 bp, Artificial Sequence
  Synthesized
  misc_feature (61): n=a or g
ctgcccttaccttcaaggataaagcagacaaaatgtttccctggtggagagctgtttccantgaccccaggccaggccttcaataagaaggctttttatcactctaccaaggactcctaca

SEQ ID NO: 31012 - DNA, 121 bp, Artificial Sequence
  Synthesized
  misc_feature (61): n=t or c
gcattttcctttgagtcagctggtactggtcattaatgcagatcaatccaggtgatcccanatggtcattccataatttctacctccaaaagctagctgccgtggtttttatggcagcaaa

SEQ ID NO: 31013 - DNA, 121 bp, Artificial Sequence
  Synthesized
  misc_feature (61): n=a or g
accagggagcagcactgtccagctctgacacagcctgtgaaagaccagggctggaaagatntcagcctcaccctgcaatctgtcatttttcagtttcattgaagtgtttggccaggagaat

SEQ ID NO: 31014 - DNA, 121 bp, Artificial Sequence
  Synthesized
  misc_feature (61): n=t or c
ttaaatacatagaataataattccttacatcttaaagggtagtccttatgatttgtaggtngtcttttatgtgcctcaaaacttttgttctttcatctaataaagccatcgtttttgttgc

SEQ ID NO: 31015 - DNA, 121 bp, Artificial Sequence
  Synthesized
  misc_feature (61): n=a or g
ccaggtctcagttgtaaagaaggtgatctaatgggaggtaattacaatgattgagccctcngtaatacagctcccactgtaaccttcagttagctgctctgacgacagcacaaactataat

SEQ ID NO: 31016 - DNA, 121 bp, Artificial Sequence
  Synthesized
  misc_feature (61): n=a or g
aacatatgtaattgcatataaaaatatgtggtcagtgcagatggacagagaacagattaanattttctcctttccactgtaaaagaaaaatcttttgggtaaagtcctggttcaagtcaat

SEQ ID NO: 31017 - DNA, 121 bp, Artificial Sequence
  Synthesized
  misc_feature (61): n=t or c
cgagctctgtgcatcccttcctgagccagtgcttccctctgcatgtgtacccggcctcctngctcctatatgccccatatatcttgccacactaaaaagtgcctagcacaccgctgcctga

SEQ ID NO: 31018 - DNA, 121 bp, Artificial Sequence
  Synthesized
  misc_feature (61): n=t or c
tcgaaaatcagaattttttttttacataaagtagctgctttcgactgaattttagccgagntcccaaagataatacattacacaatggtactataacctattgttgtaaaaattgattaaa

SEQ ID NO: 31019 - DNA, 121 bp, Artificial Sequence
  Synthesized
  misc_feature (61): n=t or c
aatactgggaggagttgggtagttaagcaagtcagtctctctcactgtagtaattctattntgccatacttgagcaagtagctgttccagtaatgagctgcctttgtctttgaaccatcct

SEQ ID NO: 31020 - DNA, 121 bp, Artificial Sequence
  Synthesized
  misc_feature (61): n=c or g
atgagatttttacgcttcctgctaagtctgaaatcagtaaaaacactgcaggattgatttncagcagctagctattgaaaacatccggtcttcggattgagtgtaagtggcatagctctcg

SEQ ID NO: 31021 - DNA, 121 bp, Artificial Sequence
  Synthesized
  misc_feature (61): n=c or g
aaactaaaagtggctgccctagctgagtgtttgtttctcatcttattgtgctttataacancaccaacttcaaagcccaattaacactttcgtgaacgcagtatgactgctgaagcagctc

SEQ ID NO: 31022 - DNA, 121 bp, Artificial Sequence
  Synthesized
  misc_feature (61): n=a or g
ctgaacggtgccgccgtggctttaagcgagaaattagaaacagcctcattgggttcccaangctttccatctgctcctttgaataccaatcggcgccaattaatcagcgttcggcccctgc

SEQ ID NO: 31023 - DNA, 121 bp, Artificial Sequence
  Synthesized
  misc_feature (61): n=t or c
ctccacagtgaaaaaacgattttgcctttggaggtaggtgcgacttgtcgtggagatcctngtctccccactctgggggtaaatataaggagagaggcggtgctccgatctacagagaaat

SEQ ID NO: 31024 - DNA, 121 bp, Artificial Sequence
  Synthesized
  misc_feature (61): n=t or c
tatgcctttacgtgaacttttctaagataatcttataaacgtgcacaggaatgaatctacngagctgaggttcaaaggttggcttatagtgttgaataaatattattaattctgtagtttt

SEQ ID NO: 31025 - DNA, 121 bp, Artificial Sequence
  Synthesized
  misc_feature (61): n=a or g
agaatatctgaaacaatcagaatttagaaggcaaacaacagttcagcattatttctggganggcatctatttgtatgtaggtgggaaagttaataactgaaatcaaggtagaagaattctt

SEQ ID NO: 31026 - DNA, 121 bp, Artificial Sequence
  Synthesized
  misc_feature (61): n=a or g
catctttctctctggtcagtcgcaatgtaagtcaaatcttaaaagtcatagcgtgcatcanttctccaacaaccaaatgaaacttgcttttcaggtgatctccattggaggacttgcattg

SEQ ID NO: 31027 - DNA, 121 bp, Artificial Sequence
  Synthesized
  misc_feature (61): n=a or g
cagaattttaagtagtttatgtataaattaatacattattcatgggttaagcttatgttgnattgcagggaaatggcaacagaaatgtcatggtctgcatttacttagtgaagacatttat

SEQ ID NO: 31028 - DNA, 121 bp, Artificial Sequence
  Synthesized
  misc_feature (61): n=t or c
tgttcactcaacctcctccctccttccaaggtcaagcggactggagatggcactgcactangtacctgcaggagcagaggtaatattgactgatctcaggttatgatgcagccatcgatct

SEQ ID NO: 31029 - DNA, 121 bp, Artificial Sequence
  Synthesized
  misc_feature (61): n=a or g
ggcagaaaactgatgcaagggcagccatgggaaaggctggattccaaacctgctccttgcngtagctggcaaggctcaacatttggtggatatgtggtaaccttctgtgttgtggaaaagg

SEQ ID NO: 31030 - DNA, 121 bp, Artificial Sequence
  Synthesized
  misc_feature (61): n=a or c
catgtgtatgtcagcaaatgttcatctcaatgctataaatagatgaccaggctgcccctancccaaaatgagacaagttctgcagtgcttagcaggagagggcttttggttgctattaaaa

SEQ ID NO: 31031 - DNA, 121 bp, Artificial Sequence
  Synthesized
  misc_feature (61): n=t or c
ggagatagcagtgatcagccagtactgcaacttggtgtcctttgtcctcttctacctgagngcagccatcaaccccatcctctacaacatcatgtccaagaagtaccgcgtcgccgcatgc

SEQ ID NO: 31032 - DNA, 121 bp, Artificial Sequence
  Synthesized
  misc_feature (61): n=a or g
gctgataggagaggaagaggcaccagaactgctgggcagtgactctgtgcaatgcaggganggatgctccctacccagcagcagctttagttacctctgacactgtgcgtgccgtgggaaa

SEQ ID NO: 31033 - DNA, 121 bp, Artificial Sequence
  Synthesized
  misc_feature (61): n=c or g
gtcttctgagatcccaatgtgcagtgagatactgatgacacttgctggcagagcatgtctnttcttccctaaccattcactcactgccactcttccaagggaatgtgtgtgggaccagccc

SEQ ID NO: 31034 - DNA, 121 bp, Artificial Sequence
  Synthesized
  misc_feature (61): n=a or g
tgtgatgcccaggtggggaggggagggaagcaaagaaattagagcagcaacggcaacatcntgcacttctagattgcagtagagccacaggcactcccaggagctcagctcttgggcaaag

SEQ ID NO: 31035 - DNA, 121 bp, Artificial Sequence
  Synthesized
  misc_feature (61): n=t or c
gtattctccctccctaccatctgaacacataaaatattataccaattacttaactgacttngtatagccttaaagcagcacaagtagataattttacaaagtcagaaaggtttgagcagca

SEQ ID NO: 31036 - DNA, 121 bp, Artificial Sequence
  Synthesized
  misc_feature (61): n=t or c
tcccccaaacaggcgctttgatggcatggatgtgtccccggttctcttcgggctgtcagangtgggacacaaggtaaggagagccccttcctggggacgtccctggatctatagggggctg

SEQ ID NO: 31037 - DNA, 121 bp, Artificial Sequence
  Synthesized
  misc_feature (61): n=t or g
aaatgcaatggcttcctgtagaatggtatgtcaacacaaagacacatgccctacctggtangtcagctccttcaccctcctctcgtacttgcgcacacccttcacggcttcagcgctgcgc

SEQ ID NO: 31038 - DNA, 121 bp, Artificial Sequence
  Synthesized
  misc_feature (61): n=a or g
cctctcagatgaaagatcagccttgctggaactatgggagcttcgcaggcaacagtatgancagtgcatggatctgcagcttttctacagagatactgaacaagttgacaactggatgagc

SEQ ID NO: 31039 - DNA, 121 bp, Artificial Sequence
  Synthesized
  misc_feature (61): n=t or c
aacagcaaaatctatttggccagaatgacagtgaggaaaaaaagctttgtttctttattgnagtctgaagatttccacccactgtcattttgtacttaatggagtgctataattgtacagc

SEQ ID NO: 31040 - DNA, 121 bp, Artificial Sequence
  Synthesized
  misc_feature (61): n=a or g
ggagatagtgaggctggcagcaggaaggagtccaacactcatgtatttgccacagcgcatntaagactggccaaagtttgcaggcacagctgcttaaatgcagcaggaggcagcccaagcc

SEQ ID NO: 31041 - DNA, 121 bp, Artificial Sequence
  Synthesized
  misc_feature (61): n=a or g
actgagctgagagaccttttgtacatgtgtttgcagcacattttcacaaaaggttgccagngtttggcccacgatgactagtgagtggatttattacattattattttagattgttatatt

SEQ ID NO: 31042 - DNA, 121 bp, Artificial Sequence
  Synthesized
  misc_feature (61): n=c or g
gttgctgcttgataacagtagcaaaacactgcagacagacgataaagcggtttgatgtganttcctgtgagtggcaccacggaagaaatctgtcccatgagaaccaaggaatctcagccat

SEQ ID NO: 31043 - DNA, 121 bp, Artificial Sequence
  Synthesized
  misc_feature (61): n=a or t
tgaaattaagaaatttcttttcttgcacactgaatgtacggcatgtaggctactaaaaaantggttttcatgtaaagataattattgcatagcagcttcatgtctgccaaggtcagtcaga

SEQ ID NO: 31044 - DNA, 121 bp, Artificial Sequence
  Synthesized
  misc_feature (61): n=t or c
aataacttacagaattttggtattgtaattgtatagaaatgtaattagttgtttaattcantttatctgcatttagaagaagtatgtaatttttgcccatgttcagtgttccagtttagac

SEQ ID NO: 31045 - DNA, 121 bp, Artificial Sequence
  Synthesized
  misc_feature (61): n=a or c
agtaagaagcagcgtgttggaagctgcagtgctgcctggccttggttacctcgtgccttcngaccagtgcactagtagaaataactagaaaactgcctttctgaacttagtagtcattcct

SEQ ID NO: 31046 - DNA, 121 bp, Artificial Sequence
  Synthesized
  misc_feature (61): n=t or c
ttgtcagcctcaacaagacaggcctactgtagattgacatgagaacaagatacagtttcangcttcaatgccagcaggaaagctgaattccaacataaaagcagcaggacacaccaaactg

SEQ ID NO: 31047 - DNA, 121 bp, Artificial Sequence
  Synthesized
  misc_feature (61): n=a or g
catcttaagaaaaaggtatgtctggttcaaagctttagttttgagaataatttaccccacnttactgaggatgtatcagtcaattctgaaagctaataatttagatagctttgatcatcac

SEQ ID NO: 31048 - DNA, 121 bp, Artificial Sequence
  Synthesized
  misc_feature (61): n=a or c
tccaaagtcttacccaacatcgatagatcctgggtaaataactgtatttgtaccaaagaanagaaaaaatgaaccatagctatggcttttatcattgctgctgctgtcatttcacaaaggt

SEQ ID NO: 31049 - DNA, 121 bp, Artificial Sequence
  Synthesized
  misc_feature (61): n=a or c
caaaaactggtggttcagaaagacaccaaagttgaggagagtatttgaatttcatgccccnaaaacatgtactcaaaacaaccaaccatgcacagaacaaactattttcaatgatcaccta

SEQ ID NO: 31050 - DNA, 121 bp, Artificial Sequence
  Synthesized
  misc_feature (61): n=t or c
cggccaagcctcaacatggacaggatggcacgatcagcaagacgaatgactctaccagtangtagccaaggcatcttactctccttcagtcagagcttatctttattttcagagtgcaaat

SEQ ID NO: 31051 - DNA, 121 bp, Artificial Sequence
  Synthesized
  misc_feature (61): n=a or c
agtataatagcacttttgagatgtttcctgatgatgtattgctatgccactgcagaaactnttccaaaatttgaggcaaaatggtaagtgaagtgaaaaataccctcaacactcctaccca

SEQ ID NO: 31052 - DNA, 121 bp, Artificial Sequence
  Synthesized
  misc_feature (61): n=t or g
aagcacagtcaggctgtcagtacggtcagtccatcatgtgccagcaccccatgttactagnggcctacttcagacctgcaagaaagagaatgattaaaaaactgcaacctgtgatatgcag

SEQ ID NO: 31053 - DNA, 121 bp, Artificial Sequence
  Synthesized
  misc_feature (61): n=a or c
acactcagggtgatggaagactgagagcattctgcaaaaaattcctgtaacaggtaaaaanacgtttgtaaccaaagcactccgtatcacgagcagaaccatctacaaggcaaaggccaca

SEQ ID NO: 31054 - DNA, 121 bp, Artificial Sequence
  Synthesized
  misc_feature (61): n=a or g
cccataaaaggggaacctctgagcactcttccaagcatctttgctcataagaggttgcagngcttaaagcaacccagctgagaagtgaacaggatcaccctaaaggaaagtgaatagacgg

SEQ ID NO: 31055 - DNA, 121 bp, Artificial Sequence
  Synthesized
  misc_feature (61): n=a or t
gactgaactgtgtaccttttaagtttgtgtggctgcattttaccaggctcattgcttttcnatttcaacttcacattctctactatcatttgtgtaactcctacttttacttcctaatttc

SEQ ID NO: 31056 - DNA, 121 bp, Artificial Sequence
  Synthesized
  misc_feature (61): n=a or g
ttctataggtttccacggtgtgcagcacttgtttctttttatgataagcaagaaggccctntctacatcccataatgctcaacactgagcacctaaccttcaagatgtccttaaaatggga

SEQ ID NO: 31057 - DNA, 121 bp, Artificial Sequence
  Synthesized
  misc_feature (61): n=a or g
gtggaaaaattagggtccaggtgaaagcgtggggcagtagattcacctttccaaatatcantttctaaaatgtgggaatatacctgtggctattttggagttcatgtatgaagataccatg

SEQ ID NO: 31058 - DNA, 121 bp, Artificial Sequence
  Synthesized
  misc_feature (61): n=a or g
taaacctcatgacttccagatcagtgattagttcctaagccctgcctcgttaggtgggtcngaaggttcactcatgtggtagctcagctgcttccaacctctggggttcaacccagaccga

SEQ ID NO: 31059 - DNA, 121 bp, Artificial Sequence
  Synthesized
  misc_feature (61): n=t or c
aagaccattagaaacttccaggcaaaccttgcagagacatggctgtctcataagactgtantgcagcttcagagacagcaggaaaagctccatcccactaacagcaaagggtagaaacttt

SEQ ID NO: 31060 - DNA, 121 bp, Artificial Sequence
  Synthesized
  misc_feature (61): n=a or g
gaagggcctggcagcagcctggcctctgttcagcttcccactccacacattgctcagtgtngaggccaaacaggagcagaatgagtacatctgagattgagcctattctctcactctctct

SEQ ID NO: 31061 - DNA, 121 bp, Artificial Sequence
  Synthesized
  misc_feature (61): n=t or c
tgctgtgtttgccagttgttagagactgttcatacccactggtcagtgtgtctgcagttcnggtcagcctcaccatgttaccttgtgaaaccaaatgcctctttgtaacggtccagaaaaa

SEQ ID NO: 31062 - DNA, 121 bp, Artificial Sequence
  Synthesized
  misc_feature (61): n=a or c
attcaatctgaagtatgctgtgtatttttggacgtactccagcaaaacagaaatgcgaaantacaaacggagtcaactcagatgaattcccatgtccttttaggagctgaattcttgaaat

SEQ ID NO: 31063 - DNA, 121 bp, Artificial Sequence
  Synthesized
  misc_feature (61): n=a or t
atttgagtaatacataccaatacctcatcactgtcagtggggtacagacggaggagtattnaaaaagctttgatttagatagaagcatttctagtgcttctcctgaatgtgtacaccagtc

SEQ ID NO: 31064 - DNA, 121 bp, Artificial Sequence
  Synthesized
  misc_feature (61): n=t or c
tgtaagtgtactcagtgttgacagtctgtttagctttcagaagtaatgacgtattcagcangttttagctcctaattctctttcatatttgacctcctgcatatactacatttgacttatg

SEQ ID NO: 31065 - DNA, 121 bp, Artificial Sequence
  Synthesized
  misc_feature (61): n=t or c
agtttattgctgaccattttatgcagtgtccctgggatcttgaatagagaggaaaaacagnaggttagagaaggcaatcctgcacaagcatacgagataaagatctggtcgttgtctagct

SEQ ID NO: 31066 - DNA, 121 bp, Artificial Sequence
  Synthesized
  misc_feature (61): n=t or c
acatatgaatggtttatgtcatcaaaagtaaaagcagtatacaacattttacaagtatttncccaaaactaggattatttgcctattaattcccacttcaaaattgtgcatttgtgggctg

SEQ ID NO: 31067 - DNA, 121 bp, Artificial Sequence
  Synthesized
  misc_feature (61): n=a or g
gctgcacagccaaagtagttaggtttttttcaagccagaatcaccactatgccatttcaanccttcatttaagcaggactgttttggcctagagtagtcagtggcatttaacaactcagga

SEQ ID NO: 31068 - DNA, 121 bp, Artificial Sequence
  Synthesized
  misc_feature (61): n=a or t
ttagctgcattctgggcactgccaaaacaatcgataagcttctgtctcgtgaggggggagnttggctggatgtattgctttcactcagattgccctgtgaccattcgttttccttcacata

SEQ ID NO: 31069 - DNA, 121 bp, Artificial Sequence
  Synthesized
  misc_feature (61): n=a or c
acacaacaaggttttccaactgtaaaggtaggcttttcagtattaggtgatatgaaagttntttttcaagggatgcttaagtaggtgggagctggttcagtctgtaatgactctaaaactg

SEQ ID NO: 31070 - DNA, 121 bp, Artificial Sequence
  Synthesized
  misc_feature (61): n=t or g
cctggagaaaacatgctgtttcccagcttgtgaatagctggatagctgctactacagttanaaacttcttactattttctgttttggaggactgtgtttcagtgctttgaaagctgtaatg

SEQ ID NO: 31071 - DNA, 121 bp, Artificial Sequence
  Synthesized
  misc_feature (61): n=c or g
gagaaagggaggatgatccaacagaaaatggctgggactgcaactcagaagaatctagttntagtcccagatgaacgagagtccagtgctggctcaggataaccagcagaactggtgcctc

SEQ ID NO: 31072 - DNA, 121 bp, Artificial Sequence
  Synthesized
  misc_feature (61): n=a or g
atgtacttaagtacagtgtattacaaaagattagtctctagtgcaataataagtcgaattnaagtatataataactttttgttagtttgagcttatagggtcctctacaatcctttgggat

SEQ ID NO: 31073 - DNA, 121 bp, Artificial Sequence
  Synthesized
  misc_feature (61): n=t or c
atctcaacactgggcattcttaatcactgggaagaatgcatggattcaagacaattcaaangtgttcttgtcttccaaattcatttagttactaattcagtttttatattctttgttgagc

SEQ ID NO: 31074 - DNA, 121 bp, Artificial Sequence
  Synthesized
  misc_feature (61): n=c or g
cagactgaacaaaaacaaaaacccaaaagcacaaacttcaagagttagtcactgacaagancaagaggattcatgggcttagatctattttttttatcttaatcacaacagaatttcactt

SEQ ID NO: 31075 - DNA, 121 bp, Artificial Sequence
  Synthesized
  misc_feature (61): n=a or g
attttttgtgatagaaagaatgcatcctgggaccatttagatatgtcaattttaattcacntatttatggtacaagtaggtgatgaaaaatctaaatcagtaaaaaacaagaggaactgca

SEQ ID NO: 31076 - DNA, 121 bp, Artificial Sequence
  Synthesized
  misc_feature (61): n=a or g
ctgttttccagttacaaaacaatgtcccctgtatgagaaccacggtggttgatgtttgtgntaaataccctgaagaaaaaccagatactaagcagcttatgctctatcccagtaacacaaa

SEQ ID NO: 31077 - DNA, 121 bp, Artificial Sequence
  Synthesized
  misc_feature (61): n=a or g
gcaaatggatgacagtaggacagtgatgtttccagcagagcttgccataagcttgccacantgcctttccccccacacgggcatttgaacgccagcaggacagtaatgactatttacagga

SEQ ID NO: 31078 - DNA, 121 bp, Artificial Sequence
  Synthesized
  misc_feature (61): n=a or g
cgcttttttcctggtattttcacgagtcaaacaaaacacgactgactctgcagcagctccntctgctcagaaaaacagttgatcaattgcaatttgcggaggaattctgtcccagacacat

SEQ ID NO: 31079 - DNA, 121 bp, Artificial Sequence
  Synthesized
  misc_feature (61): n=t or g
tctgaagttgcccaggataatctagacaaactgtcaacatttaatttgaatgaaagtaacntctgatttcacttcctttgtcgtaattctttactgtcatcttcattttaagctgtgtttg

SEQ ID NO: 31080 - DNA, 121 bp, Artificial Sequence
  Synthesized
  misc_feature (61): n=a or t
tcataggctgtatgtagtgtctgtagaaccatgttcagcccttgctggaaaccagcacagnagccattagccctggtacaacaggaactcaatggcctgaggagaaatcacagattcatgg

SEQ ID NO: 31081 - DNA, 121 bp, Artificial Sequence
  Synthesized
  misc_feature (61): n=a or c
cgtgggcctggctttacagacccaccatgttataacgtaaaccacctggcacatatgcacnagctcaggtcaagcaggttttgtagccagacctccagatttcagctctgacttgtgtacc

SEQ ID NO: 31082 - DNA, 121 bp, Artificial Sequence
  Synthesized
  misc_feature (61): n=t or c
cagtgatttcaagtgccagtcacaagaggtgggaaaactgcttcttgttacccactgggantgtgtttctgttaagcagaaccttgttttccccatccagaggctctgcaaactgccttct

SEQ ID NO: 31083 - DNA, 121 bp, Artificial Sequence
  Synthesized
  misc_feature (61): n=a or g
tgatgaatctctggttatctgtctagctctgaatgtcaggaaagctcaatactccagctcnatagacagaaaaccagtagcaagtcacattttccactgtagtcagctgaaaattgttgtt

SEQ ID NO: 31084 - DNA, 121 bp, Artificial Sequence
  Synthesized
  misc_feature (61): n=t or c
ctgaggaaaaacaagaatagaaagggatcatgaagaggtagaagcatggtccagcctcaantattttgtgattctatctcttgcaggtgcttctccttttctatcattttgtttctgtggc

SEQ ID NO: 31085 - DNA, 121 bp, Artificial Sequence
  Synthesized
  misc_feature (61): n=t or c
cggaggactagtagtttaattattactattgatttaaatcacagaatgattttaatcttanggtaggtgtttatcttggtttggcaaaacagtcggttctgacacactttccctatctaaa

SEQ ID NO: 31086 - DNA, 121 bp, Artificial Sequence
  Synthesized
  misc_feature (61): n=t or c
ctgtgaaacgttattgttaggtaacttgactgagatgatatttatcgaaactataagtcanacgagttgggctaatgagacatatttatgtacattttatgccctgctgaaccaaattgta

SEQ ID NO: 31087 - DNA, 121 bp, Artificial Sequence
  Synthesized
  misc_feature (61): n=a or g
gggatatggcgacattcaagcacatttggcagcaaattcatgaatgaagaagtagtgaagnaaagaggaataccagacaaaattcaaagtatattcagtatttgggggagtggagggtgag

SEQ ID NO: 31088 - DNA, 121 bp, Artificial Sequence
  Synthesized
  misc_feature (61): n=t or g
gatgtccacagaccactgagtggaacagataccctgaaatcacctttctcctgcccgcatngagcccctgggctgaatttagttcaaggttgctatctcattactaacattgtggtgtaac

SEQ ID NO: 31089 - DNA, 121 bp, Artificial Sequence
  Synthesized
  misc_feature (61): n=t or c
ttctgtatgtgccttcctcttgagcatgcttgtattccccagtacacagatctttaacccncaaaaagtcaatgaaacaaagccctttcagctcatatggtgtcatttgggaacagtgcct

SEQ ID NO: 31090 - DNA, 121 bp, Artificial Sequence
  Synthesized
  misc_feature (61): n=t or c
ataatcctttatgcttataaaatgaagttgaagacagggcacttagggcttttgcacccanaatgaaagtactctgtgactctaagggacattctaagctgttctgatccagattctctct

SEQ ID NO: 31091 - DNA, 121 bp, Artificial Sequence
  Synthesized
  misc_feature (61): n=a or g
tagtagttatagtaataacattaattgtaagtattagaaacaagcgcatccttcaaaactntgtaatatcagttagcatcaaaatgcgatgatgaattgtatctgcatataaaccctaaat

SEQ ID NO: 31092 - DNA, 121 bp, Artificial Sequence
  Synthesized
  misc_feature (61): n=a or c
aacgtgcctgaaagccttcctgagcttcaatcttacacctgctatctcaaaacagagtcanaacaggatctcacaggcaatgttttagacagttctcttcacaacaacctacattttagac

SEQ ID NO: 31093 - DNA, 121 bp, Artificial Sequence
  Synthesized
  misc_feature (61): n=t or g
tagtaaaattgagttttggaaattccagggcctgaaaaccacagtagatgtattttactgncagggtatctgtgcaaggaatactaaaggaaactgaacataaataagcccacttatttag

SEQ ID NO: 31094 - DNA, 121 bp, Artificial Sequence
  Synthesized
  misc_feature (61): n=t or c
gagcaacaaaagcactgcaaactgagcagacgactgagagccttttggggagcagcaaacncttggacttatgttggtgcaatgtcttcaccgggattcccaccccagatacactcctgta

SEQ ID NO: 31095 - DNA, 121 bp, Artificial Sequence
  Synthesized
  misc_feature (61): n=a or g
cttgtctgcctccttgtgcagcctggcctgcccatagcttttttctgtgctttgtgcctcntgcaatacttgatgctggtacacaaattctccttagtcccacacaggcatctctttgagg

SEQ ID NO: 31096 - DNA, 121 bp, Artificial Sequence
  Synthesized
  misc_feature (61): n=a or g
gtcttgaagttttacaacatttacctttcaaagagagaagtgtacaaagccattatgctcntcccttatcatctttaaggaaagcagattgccatgcaaacattgtttggtacatcaatat

SEQ ID NO: 31097 - DNA, 121 bp, Artificial Sequence
  Synthesized
  misc_feature (61): n=t or c
aaccaaattagagtacttctaaaagcacagaataaaatgaattaaaacgttctgtgttacntcaaggttggctggatcttatgaagccctggatggaggcagtgctgcagatgcaatagtg

SEQ ID NO: 31098 - DNA, 121 bp, Artificial Sequence
  Synthesized
  misc_feature (61): n=a or g
aagcattacagattaccagagcaattactaaatctcagaagtgactgacactcagaaaggngccccaggaatgggaccaaatgcatagaatcacagaataccccaggtttgaagggaccca

SEQ ID NO: 31099 - DNA, 121 bp, Artificial Sequence
  Synthesized
  misc_feature (61): n=t or c
cattaagtatatctcttcaaaggcagtattgctcctgctgagcagtatactgaagagtatnctgctgcctcaaccttttcatcttcttcagttagaaagactgtgttgatgcctgagtccc

SEQ ID NO: 31100 - DNA, 121 bp, Artificial Sequence
  Synthesized
  misc_feature (61): n=a or g
atgtaccatcagcagcctacctatgtgtttaaactgtgtgatagagaagtcagctgctagngaggcttgttttccctcctagaacaaaacaaaaattcaaagtattaaaccctgtgtagaa

SEQ ID NO: 31101 - DNA, 121 bp, Artificial Sequence
  Synthesized
  misc_feature (61): n=t or c
ccgatggcggtgtttgtgctgccgtaacacggccatgatgatgggctggcagacagcatgncttgggaagcagctcttctctgctggactgccgacaggctctgcaagaccatatgctgct

SEQ ID NO: 31102 - DNA, 121 bp, Artificial Sequence
  Synthesized
  misc_feature (61): n=a or g
ttatgagagataaaatacagacgtgtgcccttgtgttagaaattaattcagtagatgtgcncgcttcctactttctctgcaactgctcattcactttctcctttcagaagataaataggaa

SEQ ID NO: 31103 - DNA, 121 bp, Artificial Sequence
  Synthesized
  misc_feature (61): n=t or c
aaggagctgaaatgtcagaattcgtcctttcttttactcatccctacagaaactttcaggnctcaaataacagtggatgttggccatacttaaaaattacctttacagcagctacgtccaa

SEQ ID NO: 31104 - DNA, 121 bp, Artificial Sequence
  Synthesized
  misc_feature (61): n=t or c
ttctggtttagaggaagcaaaacatttatgctttgctttctgtggaaaagttaagccacantagaaaatgaccttgccctaattgtgactatttctcaaggctgatggttatggtagcaaa

SEQ ID NO: 31105 - DNA, 121 bp, Artificial Sequence
  Synthesized
  misc_feature (61): n=a or g
ctcttacataactattgctttatagtcctcacaatatctgctatattttgttttcctttanctctgaacaaatgagagctaagtagtccaggaaagggatcatcatattcagcagaacagg

SEQ ID NO: 31106 - DNA, 121 bp, Artificial Sequence
  Synthesized
  misc_feature (61): n=a or g
tcaagatattgggcaaactagtgatatatgtatgtatgtgtattatttattaaataaactnggttgctggctgtgtgtaatgaaggcattcatgtgtaaaatggacactttgctgtgattt

SEQ ID NO: 31107 - DNA, 121 bp, Artificial Sequence
  Synthesized
  misc_feature (61): n=t or c
aaatcatcatccgttctacagccatagcgggggaaaaatgctacatcaagatggaaatcanggagaatagaacaacaggaacaagaagtttccatccccaggacagatctatcctgcggag

SEQ ID NO: 31108 - DNA, 121 bp, Artificial Sequence
  Synthesized
  misc_feature (61): n=t or c
tggaaatttggatatatatgcaggtatttgcagggttttactcatgtatttatttttcccncggccaccagctgcaaacttaaaggcttgcttgggagttattaatagcttctgctgtaat

SEQ ID NO: 31109 - DNA, 121 bp, Artificial Sequence
  Synthesized
  misc_feature (61): n=a or g
gggaggctcatgctctgtagagtgagccctgggcttcggagctgcctgagggcttccctgnggtttcctgttggagcttgggaagcattcagaggggaggacaggaaggaaacccatgaag

SEQ ID NO: 31110 - DNA, 121 bp, Artificial Sequence
  Synthesized
  misc_feature (61): n=a or c
tttaacataggtagagaaccataactcattaaattcaactaatgtggaaatgatgacatangctcaaagaatgtgggttacttcatctgattgattttgttttctgccatgacttcctgta

SEQ ID NO: 31111 - DNA, 121 bp, Artificial Sequence
  Synthesized
  misc_feature (61): n=c or g
tgggcattactgtcagatgctaggccatgcattatgtgttcatgagggaatcagagcaatnagaagtctattagcaagtaagataaaagttgcagtgaaatgcatggctgttaccctcatt

SEQ ID NO: 31112 - DNA, 121 bp, Artificial Sequence
  Synthesized
  misc_feature (61): n=t or g
tgtgggttgaacacttctttttccagtgagctccaaagagaagccatggtgagatgtgcangcaacggctctactgtgctcgtggttcctcctgggaaaaaaaagaggccagagagctgat

SEQ ID NO: 31113 - DNA, 121 bp, Artificial Sequence
  Synthesized
  misc_feature (61): n=c or g
tttattctgttgtttgtttgtcttttaataattgtctgctaataaatttcccttcataccnattcctctagtaattacagtcaagcgtgcagtacatattcactgaacatctatagttcca

SEQ ID NO: 31114 - DNA, 121 bp, Artificial Sequence
  Synthesized
  misc_feature (61): n=a or g
ttttgtttatgctaggggatacgaggatatactgagaactatataatagctaaccaaatcnaagtgggttctgctgacatgtatataggtctgctaatggaggttgctagtggaatgcctc

SEQ ID NO: 31115 - DNA, 121 bp, Artificial Sequence
  Synthesized
  misc_feature (61): n=t or c
gtgttttggaatcacactgctgtcagcctgacagccctcaggaggttgcaagacattctangtgactgccaaaattgtggcaagcatacaattaagacggtaataaactcccttctcctaa

SEQ ID NO: 31116 - DNA, 121 bp, Artificial Sequence
  Synthesized
  misc_feature (61): n=t or g
cagttgaactgttaacagattctgatccctgtgacacatttaggagtaagggaagaccagnaggtgatagtatccgagataatagccattaattgtttttagatatggagaaagccacaca

SEQ ID NO: 31117 - DNA, 121 bp, Artificial Sequence
  Synthesized
  misc_feature (61): n=a or g
aagaacacagtgcttataccagcagcattcttctagtgcccaaattcacaacaagaaacantaatagtttttacaatagttgtgtatggaatacacatcagcaactctaaatggatataaa

SEQ ID NO: 31118 - DNA, 121 bp, Artificial Sequence
  Synthesized
  misc_feature (61): n=a or t
catgcgagaatttcaagttctgtggcagatctgaaacttctgagaaaagtaataatggtgnaaagcagaaaaaattgcatttggtctgatttgcataactgtcaaggcaagaggcaatgag

SEQ ID NO: 31119 - DNA, 121 bp, Artificial Sequence
  Synthesized
  misc_feature (61): n=a or c
cttgaagcattccccctcccattgcacagtcacaatttttattttgccatctggctacttntatttggttttacttttggcttttatttacagctccatcatttgcttttcacattttcct

SEQ ID NO: 31120 - DNA, 121 bp, Artificial Sequence
  Synthesized
  misc_feature (61): n=c or g
ctgggagcttcaatcttattttcagaagtgatgctaagattaaaagctgtagtatcgctgnctttcaatacgtcaaatgtctgtgctgcaactcaatggatgtatctgtgctggtgcagca

SEQ ID NO: 31121 - DNA, 121 bp, Artificial Sequence
  Synthesized
  misc_feature (61): n=t or c
gatgcaatgctctatgtgaggttcacaccatttgcatgcatgaatttcactccagtggctngcaaagccttcttggtttgctccagatgctcaccacagctattgtttaagagtttctcaa

SEQ ID NO: 31122 - DNA, 121 bp, Artificial Sequence
  Synthesized
  misc_feature (61): n=a or g
gcagtagaagcagatacaatactcttcgagctgccaacagttttttagtctagagcaagcntgcccaacctgaaggccacatgtggccccaagcagcttgtaatgaggccccacaaggtcg

SEQ ID NO: 31123 - DNA, 121 bp, Artificial Sequence
  Synthesized
  misc_feature (61): n=a or g
ctcaccccatcaaactgctggaagcatcggtgttacttaactaacaaggaatagagggaanctgctgcttgtcagaagctcagcaccaggagggcagccgcagtgcccatggattcagttc

SEQ ID NO: 31124 - DNA, 121 bp, Artificial Sequence
  Synthesized
  misc_feature (61): n=t or c
ttttttggcttacatcttttgattcagggtctcagttttcatataagtgaaattctgcatncctcatcacgacaaggataatattgaactggggaactttacagcattcctctgctccctg

SEQ ID NO: 31125 - DNA, 121 bp, Artificial Sequence
  Synthesized
  misc_feature (61): n=c or g
acctacacagagctgatgagcttcctatttgagtgtgctgtgaataggtatcattcctgcnagtaacttcccatgatacttgaaaaaaatgaaaaagatgatgtaagagagtggagaaaag

SEQ ID NO: 31126 - DNA, 121 bp, Artificial Sequence
  Synthesized
  misc_feature (61): n=t or c
gaatgtaaaaaataatacaattttagaatgataatggttctgggagagtctgaaaactctngagagaatgctatggcaatggtgccattctgcaatcaagagtaacaaaaggagacccctg

SEQ ID NO: 31127 - DNA, 121 bp, Artificial Sequence
  Synthesized
  misc_feature (61): n=a or g
ctctggtgcctcaccagccatcgtgatttatctgtgattgatgaagcattgaaagaagaanctaaagcactactgacagaagattgctagatttgattaattttagcatggaacatgttta

SEQ ID NO: 31128 - DNA, 121 bp, Artificial Sequence
  Synthesized
  misc_feature (61): n=a or c
gttggcatgtctggagaccagccagaagttaaagcctgccattgggtgaccatatggccancgagatctctgatctgtcagcaaagcagggaaaaagccaccagctttgcatagtgcctgg

SEQ ID NO: 31129 - DNA, 121 bp, Artificial Sequence
  Synthesized
  misc_feature (61): n=t or c
atgcacaccaaggccaaggtcaggcagagctattaaatctccagaacgtcatgaaaattanaaaggctaaattgcttggtagcctattttatcagtctcttttctgacaatgagctagtgc

SEQ ID NO: 31130 - DNA, 121 bp, Artificial Sequence
  Synthesized
  misc_feature (61): n=a or g
tgggataaggcaagtcctcccacttccatgcactgcaacagtgacacaaagtctggtacantgatggggagactcaagccaaactacttggcaaactactacaaactacaactcctatttg

SEQ ID NO: 31131 - DNA, 121 bp, Artificial Sequence
  Synthesized
  misc_feature (61): n=t or g
gattggggtggtaggatgcagagccaggtgtagtgatagagcaggaggcagggatggaggnacaacagtcagagtcacatcatgacattgtgcctgctgcaacagaggttagggctgggtt

SEQ ID NO: 31132 - DNA, 121 bp, Artificial Sequence
  Synthesized
  misc_feature (61): n=c or g
acctaattttcagaaattcaacaattattcattatgcaaccttacttcacaccaagtgccntgttcttcattttccttatgtatgcagctgtaggaagcatatgaaattccaagagctctg

SEQ ID NO: 31133 - DNA, 121 bp, Artificial Sequence
  Synthesized
  misc_feature (61): n=a or g
caggacaaacctgctttcaatgtgggtcactttacagtgaggaaggctgttccccatacanccctgccccgtttgtcctagcggtgaatcataaacgaggtgggaggctgcaagaagagct

SEQ ID NO: 31134 - DNA, 121 bp, Artificial Sequence
  Synthesized
  misc_feature (61): n=t or c
ccactaacgataccttcccacctctctggaagctctgtcggagctgagtccccacgttttnagccttaggatcaacacaacgcctggcaaaagctccccgcgcctcacaccggtacaaagc

SEQ ID NO: 31135 - DNA, 121 bp, Artificial Sequence
  Synthesized
  misc_feature (61): n=a or g
aattggtttcgttgtagtgctcggttttattttcaggttttcttttttcaattggttgagntggagaaacgaagggagaaacgacagcaaacgaagctgaagtttggccgggagagaattt

SEQ ID NO: 31136 - DNA, 121 bp, Artificial Sequence
  Synthesized
  misc_feature (61): n=t or g
ctttgaagggctaatgagtatgaatgatttggtgttggctctttgtagtggctgttattantgacgcacagggaaaggttaaaacactgacgtttttcaagttataaaaggtaaaagggca

SEQ ID NO: 31137 - DNA, 121 bp, Artificial Sequence
  Synthesized
  misc_feature (61): n=a or g
ggcatcacagcagccaagaatgcagcaactccacagacaagaagcagggcatcactgttcnagatgtttggctttttgtataatttatcatctatttgcttccaacaactgttgtttggta

SEQ ID NO: 31138 - DNA, 121 bp, Artificial Sequence
  Synthesized
  misc_feature (61): n=a or g
tcagcatatttgaagaaaaccaacacaaacgcctgttctcagtggaggactttcctctcanatttgttcttgtttatcttgcagtcagcagatccatgtggacacattcagaattaacagc

SEQ ID NO: 31139 - DNA, 121 bp, Artificial Sequence
  Synthesized
  misc_feature (61): n=t or c
cagtaaatggttcagggacaaggaagccagaggacctactgctatgggaaaacaagagaancaaacaccccatagtgggaaacaacacagacaaaggcatggctgacaggctcagcctcct

SEQ ID NO: 31140 - DNA, 121 bp, Artificial Sequence
  Synthesized
  misc_feature (61): n=t or c
aggatgctatgaagtgaataacactacaaattttcaccaagcaaaatgaatgctttagccngttctgtctgaaaaatttcatatattacctgcttgatgaaaaaaaaaaataaatgcagta

SEQ ID NO: 31141 - DNA, 121 bp, Artificial Sequence
  Synthesized
  misc_feature (61): n=a or g
aatggggacatgccataccaccttaacaggaggttggagtttgaggatactttactctgtnccagccatttacccagtctccaccacttttttccttagtaactcaattaccctatgaacc

SEQ ID NO: 31142 - DNA, 121 bp, Artificial Sequence
  Synthesized
  misc_feature (61): n=t or c
aaccccagagtacaaatatataggtttaaatgccatcaatttaagttgcctttcacaggangcagagagcactggagtagcgcaagataaattttagacctcaattacaacaacctaacag

SEQ ID NO: 31143 - DNA, 121 bp, Artificial Sequence
  Synthesized
  misc_feature (61): n=a or g
ctacatgggtatgagtagaaaccttttactcaatttgtcattttaattgatagttccaaantatccaaaaaaactatttgcttgacctgggtggaaaaactagattgaaatacatttctgc

SEQ ID NO: 31144 - DNA, 121 bp, Artificial Sequence
  Synthesized
  misc_feature (61): n=t or g
taaacacaaactgttacagaaatgcttgaccccttttcaccaagatattacaaaagcaaanaaatcccattacatcaaccagatttcaaagacgatatggagaaaaagattattcaggcat

SEQ ID NO: 31145 - DNA, 121 bp, Artificial Sequence
  Synthesized
  misc_feature (61): n=t or g
aaactttatctctggccctcttaaaaccatttttatctcctggtgtttatttccccacctnctggcatcattgctggaaaacaagcatacctccttggtaaaagagctcttcttctcctct

SEQ ID NO: 31146 - DNA, 121 bp, Artificial Sequence
  Synthesized
  misc_feature (61): n=a or g
gaacttcaagcagccaagaaagggctcacagaaaactaagtgagcaagctgattcctgggntgggcagcatttaaatgagctgtgctcatcagtgctgactgagtacagctggtgtgattc

SEQ ID NO: 31147 - DNA, 121 bp, Artificial Sequence
  Synthesized
  misc_feature (61): n=t or c
caatttttaagtcagtatcacagaaatcctagaatcttatctagctacttacctactctangcacccatttgactaaattagtgatattgttttctgcaaatacttttaaattgattttaa

SEQ ID NO: 31148 - DNA, 121 bp, Artificial Sequence
  Synthesized
  misc_feature (61): n=t or c
gaataaagctcttcaacaagacactgagaggctaaggtgcaggtagttgaaagttatatcngtagaaaatctcttctgcatgagggagatgagttacatgtgagaagaagtgttgtactgt

SEQ ID NO: 31149 - DNA, 121 bp, Artificial Sequence
  Synthesized
  misc_feature (61): n=a or t
cctggacctggctgtgttcctgcagcctgctgatacccttacgttgaggatgggctttgcngtgtgcaggctatcacaaaacgcaaacagctgtgctgaatctattgcccatctacaggat

SEQ ID NO: 31150 - DNA, 121 bp, Artificial Sequence
  Synthesized
  misc_feature (61): n=a or c
tgtgggaggttgtttttttcccctgcctttctccaatcacatttaactgctgctcttcctnctgtgttgcgtgcaccacccgggcacgtgctgtgtcccctagcagggcaggtgctgccag

SEQ ID NO: 31151 - DNA, 121 bp, Artificial Sequence
  Synthesized
  misc_feature (61): n=t or c
tttggtagcagagtaatttttctcgactcttcgagcacaaaagatgcatctacacactgcnaataacagtgattaacaaccaaacatccaagctggagttgtacagtacagcctgcccata

SEQ ID NO: 31152 - DNA, 121 bp, Artificial Sequence
  Synthesized
  misc_feature (61): n=t or c
attaaatattactttcctgaagcttgatcagttggtatgtcagttgagtgcttacatgagnctggagtaggcttgttttgggattcttggtgtctgtaccactgctgtaacacatgtattt

SEQ ID NO: 31153 - DNA, 121 bp, Artificial Sequence
  Synthesized
  misc_feature (61): n=a or g
ggtgtttacagaaggcttgcatttacgacctttcattttggatgagtgaagatggtctaanagattatttccaagtttaatgaatttgataaaaacgtcattaactgttttttccttgatt

SEQ ID NO: 31154 - DNA, 121 bp, Artificial Sequence
  Synthesized
  misc_feature (61): n=a or g
actggaattatattagacatactggcatattccttcagaaaggtttgttctgttctttcanaagactggaccaggactataggttaaggaataaaagtaggtggtaggtggttttatgcag

SEQ ID NO: 31155 - DNA, 121 bp, Artificial Sequence
  Synthesized
  misc_feature (61): n=t or c
tctgctcacctgtcagggaggagcaggtgtgaaccgttggggtttggttgagtcctcctgntcagaactttctctggaaagagcaaagcctgagccacacgctgactcgggagctgcatcg

SEQ ID NO: 31156 - DNA, 121 bp, Artificial Sequence
  Synthesized
  misc_feature (61): n=a or g
aaggtaagtggggagcttggagatgttctctaatctcttgaaaagatgtgaacttcagaanggctagtggtactgtaaagtgtaagagcaaatcccatctcatcctgctcctatcgaagca

SEQ ID NO: 31157 - DNA, 121 bp, Artificial Sequence
  Synthesized
  misc_feature (61): n=a or g
gaagatcaattctgagtcatacccaagatctcagcaagtaaagcacagctgaaccaaatcnttacaaaaactttggctgtagactgttcctgcagaggggagaggagacccaaggagagag

SEQ ID NO: 31158 - DNA, 121 bp, Artificial Sequence
  Synthesized
  misc_feature (61): n=t or c
ccatatgttaattatttctcgtaaatgattaactcgcttctcttttttgttacagcaaaanccatttgaacagccccaactcagcctcggctgagcaccaaattacgggacttttccatgt

SEQ ID NO: 31159 - DNA, 121 bp, Artificial Sequence
  Synthesized
  misc_feature (61): n=t or c
ctccccagttcacccatgaccatggctgcttaaatttaccatcaccagtttgaaacctctngtctttgcccagcaaattccttatagttgaaacactatgaaaagagattccggatagaag

SEQ ID NO: 31160 - DNA, 121 bp, Artificial Sequence
  Synthesized
  misc_feature (61): n=t or g
tggatcattgcaagtctcactgcatccacagttgtctgtgagagtcagaaggacaggacangctgtcgcattctccttgtctttcttctaccatatagtgcatgggggaaaggtcaaggaa

SEQ ID NO: 31161 - DNA, 121 bp, Artificial Sequence
  Synthesized
  misc_feature (61): n=a or g
agcaaatttcagccttagttgtggccattccttcagtgcaacaatcattttgagtccaacnagagcttactcagaggctgaattccaaactagtagcaactcatacctgtggagctgtcat

SEQ ID NO: 31162 - DNA, 121 bp, Artificial Sequence
  Synthesized
  misc_feature (61): n=t or c
tgcgtggttttaatgaagaaattataagcaaaagtcttcacccttctatttaaaccaaccnccggggatgtgagggtttcactgcttccattgccaaagttcccagatatatctgcacagc

SEQ ID NO: 31163 - DNA, 121 bp, Artificial Sequence
  Synthesized
  misc_feature (61): n=t or c
tggttagtagtaaactgctggacattttttttttacagaaaacctctgtttgctacatcancaagaggtgctgtatttaagagcttctttattcccagcatttttttttaatacttatgct

SEQ ID NO: 31164 - DNA, 121 bp, Artificial Sequence
  Synthesized
  misc_feature (61): n=t or c
ccaactgccaagagcccttgctcccactgctttaggaaccaacagggctcagcatgaattncagggctggagagaaaagttgtctctcttctcccttatggaaaacttctatgaagaaaat

SEQ ID NO: 31165 - DNA, 121 bp, Artificial Sequence
  Synthesized
  misc_feature (61): n=a or g
gaagcaagcctccgaaactttaatataaataagagatcaggacataaaatcagttttcaanaagagcacttgtagggaaagcttctgagccacgtgtcaggtctgtctgcagcttaagtta

SEQ ID NO: 31166 - DNA, 121 bp, Artificial Sequence
  Synthesized
  misc_feature (61): n=c or g
tggtccagttataaatgttcttcaattcctattttgttaatatttcagattcattaccaancataatttgtgatgtctacacactcaagagaaatcccaggctcaagttttttagttctca

SEQ ID NO: 31167 - DNA, 121 bp, Artificial Sequence
  Synthesized
  misc_feature (61): n=a or g
ctgctcctagccttaccaccagagagactccacacaaagcctgatgcctccttaaggcacntcatagcagctcttgttactgagctcgtgcataagtgtcatcacctggacttgttttcct

SEQ ID NO: 31168 - DNA, 121 bp, Artificial Sequence
  Synthesized
  misc_feature (61): n=a or g
cacaacatgcaaatgtacccaacaatttagaaagcttaagaagctaccttatttttcactnaaagcgtattctttggcttaattggtgaaagatttactgcaataaataactcttcactgt

SEQ ID NO: 31169 - DNA, 121 bp, Artificial Sequence
  Synthesized
  misc_feature (61): n=a or g
taccctcccacctaagctcacacatagcataagaacaagccgtatttcagtgcagggatcnttaaagcacaaaactgtattttaggagtgttgttttcattctttctctaaatagattccc

SEQ ID NO: 31170 - DNA, 121 bp, Artificial Sequence
  Synthesized
  misc_feature (61): n=t or c
ctaattgccagctgtgtcctatggattttatcctcatgctgtatttgtattttgtgttgantccaaaacaaaacaggatgtaagataatttggttgaacagaaacccataaatgaatgaag

SEQ ID NO: 31171 - DNA, 121 bp, Artificial Sequence
  Synthesized
  misc_feature (61): n=t or c
aaccttcctcatccccttgttcgatgctgccaaaacctatttatttcttgcaaatctctgngagctgctgctcatgaatagaaaatgcttttatcaaaaactgttcacattttccactgta

SEQ ID NO: 31172 - DNA, 121 bp, Artificial Sequence
  Synthesized
  misc_feature (61): n=a or c
gtgaaaactaccttggaaggtagagttacaggcagtaaggattctaagataaccttaattnactcccttgcattcatataattttgaatacagtctttaagcacgtaattggcaatttttc

SEQ ID NO: 31173 - DNA, 121 bp, Artificial Sequence
  Synthesized
  misc_feature (61): n=a or g
gacaagccatgttcatcttgtatgatctgtatgtattcgatggcagtcctgtgtactgagncaaaggcaagctgttgtggtgcacacagagctcagatagcttccatttcacatcagccga

SEQ ID NO: 31174 - DNA, 121 bp, Artificial Sequence
  Synthesized
  misc_feature (61): n=a or g
aaaaaagatgtaaaaatatctatcccaggatcttacaagttcaactttctctttgagtatnaagagttagttacagaagcagtttagtagaattgaccatgagtttaagagatattcaaag

SEQ ID NO: 31175 - DNA, 121 bp, Artificial Sequence
  Synthesized
  misc_feature (61): n=a or g
gggtggctgcggggcgcctcagccgggcccggccgcccatactgagcaggcagcacaaagngcctgggcagctgcggccaagttttcccagacgcattttctgtcctctcacactgctcca

SEQ ID NO: 31176 - DNA, 121 bp, Artificial Sequence
  Synthesized
  misc_feature (61): n=t or c
atatcaaagaatgcagagccacattttgttaatcgttatggaattaaattttcagtcttgnctgtatcatagcacctaatggtacagctaacggtggtgactgtgttgaaaaagagtgttt

SEQ ID NO: 31177 - DNA, 121 bp, Artificial Sequence
  Synthesized
  misc_feature (61): n=a or g
tgtttcccagtagtcacctcatggaaatttagctttttttccccttgtatttgcttttctnagtggctctggtatatttgactgctgtgaagtagtctctgtgccagtcagtttggttggt

SEQ ID NO: 31178 - DNA, 121 bp, Artificial Sequence
  Synthesized
  misc_feature (61): n=t or c
tctttttggacttgcctggattgctctcctatttaatttattgacgacggttctagaaganactgagaaaataattgtcaaggatcttcatcaaattggaaaggtgggtgaggataatgca

SEQ ID NO: 31179 - DNA, 121 bp, Artificial Sequence
  Synthesized
  misc_feature (61): n=t or c
atctcagatcgctaacttgaaggctgcagccctgcaagttcggggacggagtttaaaaatncctagatttcttctgtagctcattgggaagcttgggaaagtggccacgcgataaacatat

SEQ ID NO: 31180 - DNA, 121 bp, Artificial Sequence
  Synthesized
  misc_feature (61): n=a or g
ctttctctgaacgtatcggtctcacgcgttgccatgctggccggagacggatttgtcagcncagtcaaagcagttttgctgatgtttggtgctccggagaggtgaattgtgaagttagcct

SEQ ID NO: 31181 - DNA, 121 bp, Artificial Sequence
  Synthesized
  misc_feature (61): n=a or c
aacaatgcatctgtgatattgatgatgtcagcattcctcttgtagaagaaggtggaagtcnaagaaacacagtcatcactttgttcttacctagatacctaattttttgctatattgtgtc

SEQ ID NO: 31182 - DNA, 121 bp, Artificial Sequence
  Synthesized
  misc_feature (61): n=a or c
agcacagcagctgctgttctccttagctttgcatgagactgaagccaaaggggtggagagnaactgaacaaaagatgcttttcttctttttctatttaagagtatcttagatggtttttag

SEQ ID NO: 31183 - DNA, 121 bp, Artificial Sequence
  Synthesized
  misc_feature (61): n=a or g
cagaaaactttgttagttcagaatggacgtgtagaccatttgaaaataatgcttttactcnggagctatttttctcctgattaaaccttcttgcaaaggccagtgaaacactaagtcatgt

SEQ ID NO: 31184 - DNA, 121 bp, Artificial Sequence
  Synthesized
  misc_feature (61): n=c or g
ctttttatttcttgagatagtcacaggtgtccaggtcattaactattaaaataggccccantgacaattgtgcaacatcgaagtttgtttggtgttttatttgcacttcatttgaagttca

SEQ ID NO: 31185 - DNA, 121 bp, Artificial Sequence
  Synthesized
  misc_feature (61): n=t or c
cctgcagttcactgcttttcttggcatcaccatcgcaggtctggatttggtaccaataggntttctgcactcacagcagggcttggatgtcaccaagaagagcccccagctgcagtgtggc

SEQ ID NO: 31186 - DNA, 121 bp, Artificial Sequence
  Synthesized
  misc_feature (61): n=a or g
tcacagcaataaagtgtgcttgaagttaagcaacaattagagccatccaagttctctactncataagaactcataataaattattgtctttatgcttctggattgtttcagtaatatattt

SEQ ID NO: 31187 - DNA, 121 bp, Artificial Sequence
  Synthesized
  misc_feature (61): n=a or g
gcacagaaatgccaaattctaacttttcactttctgtgagaagtcctgtgaactggatganttacagtaattccatcttggagagctgacagcttggaaacggtctgcatgaaaagacagg

SEQ ID NO: 31188 - DNA, 121 bp, Artificial Sequence
  Synthesized
  misc_feature (61): n=a or g
taagttctggtttctctgcatgtacttcaggagtatctagtgaagcctttatgataataantgaatccctctgttatttcaagtttttctatgagaatggatgtcatttgtgaactgagaa

SEQ ID NO: 31189 - DNA, 121 bp, Artificial Sequence
  Synthesized
  misc_feature (61): n=a or g
ctccaggccccgcttcaaaggccgagcagccccgatgttttgagggctcattctgcggctnatgataggatgcaccatcccctccatcttcctcaggttctccagtctctgtgcctgctgc

SEQ ID NO: 31190 - DNA, 121 bp, Artificial Sequence
  Synthesized
  misc_feature (61): n=a or g
gtaatatataggatatattggatagcaaaatttccacctattttgggataaatacaacccnttaaaacttctgtacttgttcagcttgttgaaatgatgactgaaaacagagtacaagcag

SEQ ID NO: 31191 - DNA, 121 bp, Artificial Sequence
  Synthesized
  misc_feature (61): n=c or g
ttcagataacagcacttgcatgagctaagcctaacacacagacctgcagtaagcctgtctntgaaggcacaagtatttcaaaagcattttccagtaagaggacaaacgataaaacttatat

SEQ ID NO: 31192 - DNA, 121 bp, Artificial Sequence
  Synthesized
  misc_feature (61): n=c or g
cagtatacaagacataggttggtacatttgtgtgaattaaagagggccagctacaattcantctgtacagtaaatgcaatttgtaaagcagcaataaacaagagtgcaatctgctcttctg

SEQ ID NO: 31193 - DNA, 121 bp, Artificial Sequence
  Synthesized
  misc_feature (61): n=a or g
taatatagtatcagagatttaaaaatatagattgtcccatggaggtcattctctggagaanctttgacaataatgggagccacagtaagggcaagaatcaatactccccagaggtactgct

SEQ ID NO: 31194 - DNA, 121 bp, Artificial Sequence
  Synthesized
  misc_feature (61): n=c or g
caattacagctctcccttataagtatttaaatggcagctcagctttcagacagagtacagnagtgccaaagatcaagccttctgaccttctccgaatttgctcagtgaaataggatcccct

SEQ ID NO: 31195 - DNA, 121 bp, Artificial Sequence
  Synthesized
  misc_feature (61): n=a or g
tttcctgatggcatgcctacatcatgtgacactcttgtagccaccttcttggctaaccttnttgagaaaaacaaagcaaatccaggcaggtctgtccctgtgatccttctccttctctcct

SEQ ID NO: 31196 - DNA, 121 bp, Artificial Sequence
  Synthesized
  misc_feature (61): n=a or t
acagcatgagatattaaggaagaagctggcacacattcagttccattgcccttggataganctatgtcttaaaaaccctgtgaataaacaaacaagtcaggcaagttccccacatttcctc

SEQ ID NO: 31197 - DNA, 121 bp, Artificial Sequence
  Synthesized
  misc_feature (61): n=a or g
tctttcaaggtaattacatgttcctgcttggtataggttccaatgttcatgtgactaaacnctataagctgtctgaactacagtgcatgaataagcatacctagttaccacaccatgaata

SEQ ID NO: 31198 - DNA, 121 bp, Artificial Sequence
  Synthesized
  misc_feature (61): n=a or g
atcccttgggcatgctgactgcaccacacagctcggtgtcatccaccaacggctgaggacncacgcgatcccgctgttgatggcactgatattaagatattaaacagtgctggtaaaccat

SEQ ID NO: 31199 - DNA, 121 bp, Artificial Sequence
  Synthesized
  misc_feature (61): n=a or g
gtcgcactgctggaggaaagcagcctctctgcagctgcaggctctggctgggagcagcacngtgcccttacctacagcatttgaaacccattctttctcttcctagattgcaggaatgaag

SEQ ID NO: 31200 - DNA, 121 bp, Artificial Sequence
  Synthesized
  misc_feature (61): n=a or g
gagccaagaaaaggtttgggatgtttagtcaaaaggtcaacaacacagcaataagagaaanatgttagggacaatgctattttctatttaaataactaattgcttcttgtttcaaaaaaca

SEQ ID NO: 31201 - DNA, 121 bp, Artificial Sequence
  Synthesized
  misc_feature (61): n=a or g
tttctaaagtcattccccctcttccccaaaaaagttttgatcgtaattattgatcatcttnccttcagtgattatgattatcagacagaataggttttactgagttcacctatttattttt

SEQ ID NO: 31202 - DNA, 121 bp, Artificial Sequence
  Synthesized
  misc_feature (61): n=a or g
gattctgtcagggtactaggaatgacaatgagatgtaggccacaaacaccatgaggagggntactctacagacacagaatgttgaggacatgacttttattacacctggacatgaccccag

SEQ ID NO: 31203 - DNA, 121 bp, Artificial Sequence
  Synthesized
  misc_feature (61): n=a or t
ccaagaggaatgggcgctgggaaatgctggacagtggccctcgactcctcattcttgcctnaggaagggttctcatggagttttccagtttctaaaggcagatgtggtgatgcacagccac

SEQ ID NO: 31204 - DNA, 121 bp, Artificial Sequence
  Synthesized
  misc_feature (61): n=c or g
ctgcttgcagcctagtcatgaccaatgttggtttttcttaaattttaatttgctcactcangtgggatctcaagagccagctccaagaaacagtgctattccaagaagaaataagacagat

SEQ ID NO: 31205 - DNA, 121 bp, Artificial Sequence
  Synthesized
  misc_feature (61): n=t or c
tggagccgggaggcaagtaggttttgtgaaatctctccagtagctcagtgtgaatatcaangatggcagcttggtttttgcatgataaattcactcaactattaaattactggaaaggaat

SEQ ID NO: 31206 - DNA, 121 bp, Artificial Sequence
  Synthesized
  misc_feature (61): n=a or g
tatgaacacttacccatccacctgctcctctcccagaatataccgcaggttcttcaagaangacagggaaactaatgcatgggaatggcgaatcttcacatatcccgtcacggtctcaatc

SEQ ID NO: 31207 - DNA, 121 bp, Artificial Sequence
  Synthesized
  misc_feature (61): n=t or c
tcatcagtggtttgaatctggatagggaagaaaatattctagaaatgtgtcattctggtgntgttatcctactgctctttaattaaaaggagcttctccagagctcacttcctgcaaaccg

SEQ ID NO: 31208 - DNA, 121 bp, Artificial Sequence
  Synthesized
  misc_feature (61): n=c or g
atattttgctcatgccaaaagctggtgaaaagttcatctgacataaagcctttcttcagtncattgatagtgtgagtcaataaggctatcaatatacagactttccatctgtgtaaaatct

SEQ ID NO: 31209 - DNA, 121 bp, Artificial Sequence
  Synthesized
  misc_feature (61): n=t or c
accagagaaatgtgtcaaacacaaccctaaagtgaaatgaaacaaagcagagtaattctgnggagagatattttatagcattgtatgcatgtatcctcagattcttaaagataagatttta

SEQ ID NO: 31210 - DNA, 121 bp, Artificial Sequence
  Synthesized
  misc_feature (61): n=t or c
taagtatgggcacgggtaagggtatggatatggctttgggtatgggaaggggtttgacaangggaatgatgatgggtatgggtgtggggatggcatgatgaagggaatggggatggtgatg

SEQ ID NO: 31211 - DNA, 121 bp, Artificial Sequence
  Synthesized
  misc_feature (61): n=t or c
ttaaatgcaaaataccggtaatttaattaattgcagtacagattctttggtgtctgagagncctctgcattcttcgagttgcatattggtttaaagttctgcattaaacatactccaaccc

SEQ ID NO: 31212 - DNA, 121 bp, Artificial Sequence
  Synthesized
  misc_feature (61): n=t or c
ttaaaatcatgtgaaaacaattccatctgtgaataacatgtagttctgagaagttctatcngaaaaaatctccaaatcagatgcactgacaggagtgaggagattcaggaaggacgcagtg

SEQ ID NO: 31213 - DNA, 121 bp, Artificial Sequence
  Synthesized
  misc_feature (61): n=t or c
ctcaccccctcatatgtatcactaccacgaaggactgcgcagcagacatgcagaccatcancaccaccctcagtctgctctcgaagtcgcacctttaggactgcagtactaatagaagcag

SEQ ID NO: 31214 - DNA, 121 bp, Artificial Sequence
  Synthesized
  misc_feature (61): n=a or t
attcattttttaatcatttctgtctggtaaagagctgtgtcagtgtttccttctgtcctantccacacagccaaattccactgagtaatatcaaaggtatgtgggcgagagaatatcttta

SEQ ID NO: 31215 - DNA, 121 bp, Artificial Sequence
  Synthesized
  misc_feature (61): n=t or c
attctgatactagcatacagaacagtatcaacattgagacctgcttaggcattaagttacngttgtatttagagattctgcaaccgttaccttaatttgtgaggcaagaaattgctgcacg

SEQ ID NO: 31216 - DNA, 121 bp, Artificial Sequence
  Synthesized
  misc_feature (61): n=a or g
aagcggagattcatgctgcatttttaacattaagaaataagggtgatgtccttggtaggantgaatatcagaatttgttataaaccatggctttataattcctgctagcggttcctgtatt

SEQ ID NO: 31217 - DNA, 121 bp, Artificial Sequence
  Synthesized
  misc_feature (61): n=t or c
tatttctttctgctgctggataaaaatggttcattgcaatggtctgtctgcatacctttgngccaaagtgttgaggagttgttcaaggacaatctatgtaatgaatcgtgtacactatcaa

SEQ ID NO: 31218 - DNA, 121 bp, Artificial Sequence
  Synthesized
  misc_feature (61): n=a or g
cttttctctgtaacttcacctcttgagctcctgcagtttgagcctgtatttttagggtcanctactagctgttaccatactggtccttgtcatggatagttgtagctgctttagatattga

SEQ ID NO: 31219 - DNA, 121 bp, Artificial Sequence
  Synthesized
  misc_feature (61): n=c or g
tgatgatgagagtataaatgttttttcagagcactttttctctctcctcacctagcaaatnaaaatatgagtatatccatagtctgcagaatgctgcattgttgattttactgcaatgcag

SEQ ID NO: 31220 - DNA, 121 bp, Artificial Sequence
  Synthesized
  misc_feature (61): n=a or g
ttttagtgttttaatgcagatggaaccacttgtgggcatagcagcaagaacagcttggacncatttgagtagctctgtgtggtgttcttgaggatctgaataaggctagcacagatacagt

SEQ ID NO: 31221 - DNA, 121 bp, Artificial Sequence
  Synthesized
  misc_feature (61): n=t or c
ctctgtagcacaaacaagatgatgtattctgaattaggagactttggggactgaagaaaanattctggtttctaaaaggtttttttgcatttcttctgtttttcttttgctggaagacaaa

SEQ ID NO: 31222 - DNA, 121 bp, Artificial Sequence
  Synthesized
  misc_feature (61): n=a or g
gtacttcaatggtggtttttccccccgaaacaattaatgcaacatacattgacctcctgcnatgctgcgggtgctgacatgggaacccacccccagcttcacctggcctccctgaaaacca

SEQ ID NO: 31223 - DNA, 121 bp, Artificial Sequence
  Synthesized
  misc_feature (61): n=t or c
aaaacaacaacaacaaaaaaatattgtcaatgacaccttaaaagaaaatgtaaaaagtctnctgaagtgaagcaacactggacaccttgccgtgtttatttccatctcactgttcttgaga

SEQ ID NO: 31224 - DNA, 121 bp, Artificial Sequence
  Synthesized
  misc_feature (61): n=t or c
cacctcaccagcacagcagtaacgctgacacatttgatggcacttggtaaaatgagtcctnttgctttggaggtctcacccaccctctggctacaaatcacagcaatttacctgtcccctc

SEQ ID NO: 31225 - DNA, 121 bp, Artificial Sequence
  Synthesized
  misc_feature (61): n=a or g
tcctgtggccagctgaaactcagttctcttacaagctgtctttcatcttagcttctcttcngagttatgctttgtttcagggggtaggtgtttacagcagtctggcaatgctgttttttgt

SEQ ID NO: 31226 - DNA, 121 bp, Artificial Sequence
  Synthesized
  misc_feature (61): n=a or g
cattctgggcagagggagttgggagaaacatgaagacccctgacaaaaacccagtgcgacnaacacaagagcagagatccaggagcttgttcccagctggtgcattagtgctggggagcag

SEQ ID NO: 31227 - DNA, 121 bp, Artificial Sequence
  Synthesized
  misc_feature (61): n=a or g
ttttgtgccccaataccactgagtgccctccatttctgcaggatgacctcaggacaccagncctgcttccacacagacatgcagaaatccaactggatgtaacagcttgatttctgtgaca

SEQ ID NO: 31228 - DNA, 121 bp, Artificial Sequence
  Synthesized
  misc_feature (61): n=t or c
tcctgaagttgcaggcttatttcacttaagaacaagttggtttaggtccgagtatgccatncaaggctgacttctgcaagcagaccttccacatcccttaccaaaatgaagtctaaactaa

SEQ ID NO: 31229 - DNA, 121 bp, Artificial Sequence
  Synthesized
  misc_feature (61): n=t or c
ttaaataactttcctattgaaaaaactttgcctttctataaaaagcaaacagttacactgngttcagtgcaaatactcccaaacgacagcattgcactgcaaggggctgccacgtccacag

SEQ ID NO: 31230 - DNA, 121 bp, Artificial Sequence
  Synthesized
  misc_feature (61): n=a or g
tgataacaaatccagaattgcctgtatgttaaaccataacctctcaaattccttcttgatntgtggttttcccactgtaacttctagtcctcctcagaatgagaaccctatcttatatctg

SEQ ID NO: 31231 - DNA, 121 bp, Artificial Sequence
  Synthesized
  misc_feature (61): n=t or c
ccataagggtcatctaatccaactcctagctctgcagataaccaccctcaaatcagaccangtatctgagagcaatagaaattgggttaaattaagaagcgatacttttaaggcagagaca

SEQ ID NO: 31232 - DNA, 121 bp, Artificial Sequence
  Synthesized
  misc_feature (61): n=t or c
tcctggggttttcagcaagcagaagtgaatctggacacctgcactttctgttattgggagngtggtgcttaccaacctccttcaatgccccctctagcaaagaatgggttcagggcaatcc

SEQ ID NO: 31233 - DNA, 121 bp, Artificial Sequence
  Synthesized
  misc_feature (61): n=t or g
caacataggttgaaatttgttaattcttttgataggtatattaatttatttttacttagangttaattgtacattgtcttccttttcagatgctgttttattacagagttctgttccttgc

SEQ ID NO: 31234 - DNA, 121 bp, Artificial Sequence
  Synthesized
  misc_feature (61): n=t or c
ttaatgagagaatgatttgtaagtggtgtaagtaacttctcgttacgattgatatgctgantaggttggaatcagaagtagtgatggtttgttactgaagttgctaagatgatatatatgg

SEQ ID NO: 31235 - DNA, 121 bp, Artificial Sequence
  Synthesized
  misc_feature (61): n=t or c
tggagtattaagcagcgattacactataacatccttgttgtaactcctgtgttatggatcnagcagaaagctgtgcttaaactgcttgttacttgcatgcagcttatgagacacaggtggc

SEQ ID NO: 31236 - DNA, 121 bp, Artificial Sequence
  Synthesized
  misc_feature (61): n=a or c
tccattttctgctaagcaccctcttcttgcagtaatgaatgtcgtgctgtaagaggatttnaactggacagatgtaccttaatgtcttgtagcaggatttgctgttttgtaacactgattc

SEQ ID NO: 31237 - DNA, 121 bp, Artificial Sequence
  Synthesized
  misc_feature (61): n=a or g
tctatgattcatacaaataaaagcaggttatggctttttctgcaagaatttcatctctccnaaatccctaacaaagaaacatgacaagtgctttgaggaaggtgagtagaaactggagcag

SEQ ID NO: 31238 - DNA, 121 bp, Artificial Sequence
  Synthesized
  misc_feature (61): n=a or g
tgtaaagccttaaattgtggggaaagatactcaggaaaactgattaaccaatctgcagccntaacactgaaaactcaaaactacttaactttttgaacgcctgcatctttgtttaactcat

SEQ ID NO: 31239 - DNA, 121 bp, Artificial Sequence
  Synthesized
  misc_feature (61): n=a or g
ctactcttatcagctgacttcagggtctgaaagacttgttcttgctcagatttgctttagncctgctgcaccagaacaccagtgggagtataaagcacaatccaacctggccaacatctga

SEQ ID NO: 31240 - DNA, 121 bp, Artificial Sequence
  Synthesized
  misc_feature (61): n=a or t
taatgaatgcagattataaactacaactctaacaggcaatgttctttgttgctgttgaacntttgaacatgtttctataaaagtcagctgtcaaaataagtaatgttctatttcagttctg

SEQ ID NO: 31241 - DNA, 121 bp, Artificial Sequence
  Synthesized
  misc_feature (61): n=c or g
tttgttgttgttgtttgtgttttttaaatcacatctattaactgctaggttcagtacaggnctacaaaggaaagaaatgcagaaatgaaattcggtgtaagctattattttgatacatacg

SEQ ID NO: 31242 - DNA, 121 bp, Artificial Sequence
  Synthesized
  misc_feature (61): n=t or c
actgttttccatctaatacaattttctttttaaactagttgtcagttaagtaataggatangttacaaagattatggaattcactggaacagtaacatgggaagggcaaaaataattacct

SEQ ID NO: 31243 - DNA, 121 bp, Artificial Sequence
  Synthesized
  misc_feature (61): n=a or g
ctcctcactttcagccaacataatcacagtgctatgagcaacgggtattctaagagggggntgcagctgggctgtattggctgctgggtcagatttgtctggcaaagagattcagtgctac

SEQ ID NO: 31244 - DNA, 121 bp, Artificial Sequence
  Synthesized
  misc_feature (61): n=a or c
cctatctttcctgtcatttgaagaagctctaattcattattattaaggcagtagcagtttntgaaaaccatttcaaggaaattttagaaaagccaaagaaaatcaaacccctttcagcagt

SEQ ID NO: 31245 - DNA, 121 bp, Artificial Sequence
  Synthesized
  misc_feature (61): n=t or c
ggcaggccctgagtccttgccaagggattaggaccctgggacataccatgacacaagcttntgtgctccccagtaggcatgtacagacagcaacaaaaaaatatgttgtacttctggtttt

SEQ ID NO: 31246 - DNA, 121 bp, Artificial Sequence
  Synthesized
  misc_feature (61): n=a or g
tgtattgtaattagtacctttgggaggaaggaactggggggagctgagtataaggggggtnacattgatgtaaaagctgcctgtgaagaatgagtgaagaagtgtggaaagagatgaaagt

SEQ ID NO: 31247 - DNA, 121 bp, Artificial Sequence
  Synthesized
  misc_feature (61): n=t or c
cctctgcagctcccacagctgcagctttggccatagaactgctggctttggggctcagcanagttccaagttggtgacagagtccatgggctgacccacgtcagagctttggggctctggg

SEQ ID NO: 31248 - DNA, 121 bp, Artificial Sequence
  Synthesized
  misc_feature (61): n=a or g
aatggcgctgggggttccactggtcttgctatgtccacagccctctcattagcaaacaggnacaactagatgaggagtaaatcgccagctcagaagctaaagaggggaaaaagcccttcct

SEQ ID NO: 31249 - DNA, 121 bp, Artificial Sequence
  Synthesized
  misc_feature (61): n=c or g
agctgcaatagtcttggagtgaggcaggacaccaaaggaaaaaaggacagcagaatagctntgcagaaaatatcgtccccaaaataaaggaaaaggtacactgttctcagctgcccctgct

SEQ ID NO: 31250 - DNA, 121 bp, Artificial Sequence
  Synthesized
  misc_feature (61): n=t or c
aaggcaaaggcatgaagaatgccatgaacatgaaggacatgaagtcgggcaaccaggtgangtccttcgaggtgctgccaagggtctgctggtttggggtccccagggtttggggatctcc

SEQ ID NO: 31251 - DNA, 121 bp, Artificial Sequence
  Synthesized
  misc_feature (61): n=a or g
tccaccctgaatatttaacctctactgtctctgtctcttctagtctgtataaattgcctcnaatagtgaaataaacatatgcatatatcctgtctttgacagagtgcttaagcatatacag

SEQ ID NO: 31252 - DNA, 121 bp, Artificial Sequence
  Synthesized
  misc_feature (61): n=a or g
acctgatagaagctattttccactctgctatggaaaatgcaggtctttaaccaaggaagcnttctcagcactataagttatacatagtgctgtagtgcaacctcaggcagtagcttgagtt

SEQ ID NO: 31253 - DNA, 121 bp, Artificial Sequence
  Synthesized
  misc_feature (61): n=a or g
attccccccaggctctacctttctccttttatgtgaagggatactcagttttctcagagcncattttagcctgaataagtctttctgaattgcctgcaaaaaaattaagtctttagtcatt

SEQ ID NO: 31254 - DNA, 121 bp, Artificial Sequence
  Synthesized
  misc_feature (61): n=t or c
tgcccagggtaacctagcaactcctgatcttacgtgtcataccacagcctgccactctacngcacattcaagctaacaagcaagcagggcagcatttcacttgcatatcatagaattacat

SEQ ID NO: 31255 - DNA, 121 bp, Artificial Sequence
  Synthesized
  misc_feature (61): n=t or c
cattttcattttgtgctgcttccatgtcatgctaacacaagcgactgattgtcacttctgnttgcctgaaggctccaatctatcatgctgagacactctgtcctatcttttcaaattcggc

SEQ ID NO: 31256 - DNA, 121 bp, Artificial Sequence
  Synthesized
  misc_feature (61): n=c or g
tcagtacattcttgctaaaatttatagcatctacagttttccttaggagctcaatagcctncagtctagcctttgaaattctccaagtcttataacccaacctttccactgggaaggagag

SEQ ID NO: 31257 - DNA, 121 bp, Artificial Sequence
  Synthesized
  misc_feature (61): n=t or c
tctgaataataatcataaaaatataatgttctgctaagggaatgtctataatgatttccangctattaagctagtgtaaaaccccaggaactttgctggattcagacaaattagttacttc

SEQ ID NO: 31258 - DNA, 121 bp, Artificial Sequence
  Synthesized
  misc_feature (61): n=t or c
acatagcaatacctgaaatgttctttattcccattacccacagttgccaggttaacaatancccagcttgcagaagattcacttcctgatgagtctggctatgttttaactgtgcttttca

SEQ ID NO: 31259 - DNA, 121 bp, Artificial Sequence
  Synthesized
  misc_feature (61): n=a or g
cttccacagcactgccaaggatgatcttcagttcacaaaccctcagcagaagcgctaaccngaagtcccctttcctctgacaaggtggcagtgatgattcactggaagggaatcccaagaa

SEQ ID NO: 31260 - DNA, 121 bp, Artificial Sequence
  Synthesized
  misc_feature (61): n=t or c
atggaccgtttagtttgactttactgtgtgtgcatgtattatttgaacattaggcaagcangggttaactataaagtttaaggcagatctgtgggccggtagatgcactcttgccactgtt

SEQ ID NO: 31261 - DNA, 121 bp, Artificial Sequence
  Synthesized
  misc_feature (61): n=a or c
aaaagctgttgttttttccagggcttactttagagttctaacgagtactgtggctacatanaaaactactgccagtgagattccccgaaccgaagactagccggtcctgcatgcctccatc

SEQ ID NO: 31262 - DNA, 121 bp, Artificial Sequence
  Synthesized
  misc_feature (61): n=t or c
gtgtgtcttctgttaatttgcaaactgttacttcatcaaagttgagcaaaggattaccccngcattatttggatttctacatgatatagaatcataggatggtttgggttagaagggacca

SEQ ID NO: 31263 - DNA, 121 bp, Artificial Sequence
  Synthesized
  misc_feature (61): n=a or c
aacaaggtctccctgccaccccatttacccactctaactctttgctttctgcttctctgcnacatgaccaccctctaccttattccttaacattccattgctcttttctttccttgtgagc

SEQ ID NO: 31264 - DNA, 121 bp, Artificial Sequence
  Synthesized
  misc_feature (61): n=a or c
agccaaaatcacagattaccaaagcatatctagccctgcataggacagaacagaatggatnagtttgagaaagcgtgtcagtctttcataccataaaatggtaaataaatacattttaaaa

SEQ ID NO: 31265 - DNA, 121 bp, Artificial Sequence
  Synthesized
  misc_feature (61): n=a or g
ttcggcagaaaaaaaagcactgtttcctaaaagcatccatagcctaagacaaatgcattgnttacaaacgcactgcatcttcaaagccaccgaccccactttgacaaagctgactcctgga

SEQ ID NO: 31266 - DNA, 121 bp, Artificial Sequence
  Synthesized
  misc_feature (61): n=a or g
ttctgtgaacaattaacagatttttgtggggagcacttctgtggttgattatgctggatgntaaaccttagtcataaaatgtctaactgatatactttctttttttaatacatatatgtat

SEQ ID NO: 31267 - DNA, 121 bp, Artificial Sequence
  Synthesized
  misc_feature (61): n=a or g
ccttttaggttcctggctgaaggacacacacacagtcctcactgcaagtgataggaaaaangggcatccagagagggtcttgtatttttatccgaatagactctctaccattcaggacaat

SEQ ID NO: 31268 - DNA, 121 bp, Artificial Sequence
  Synthesized
  misc_feature (61): n=t or c
ggtcataaacactgttgtattcaagtcctgaagtcctctgatgcttttcattgcctcccanccaactggatgggtgaagccaatggcacctcccagtagtgctggggaacaggagaagtgg

SEQ ID NO: 31269 - DNA, 121 bp, Artificial Sequence
  Synthesized
  misc_feature (61): n=t or c
tatactcttctctaggtggatctatgaaaagaattataggttagattaataatttccattnttctttctgccttctcatagaatattgtataggattcaattggatcatacatagaaattt

SEQ ID NO: 31270 - DNA, 121 bp, Artificial Sequence
  Synthesized
  misc_feature (61): n=a or g
cctcaagatgattttcctttaatcccacccatggacacactcatggacacccctacctganagccccaaactttacgaatcagagctaaaatacctcccagcttacacttgctgtatattt

SEQ ID NO: 31271 - DNA, 121 bp, Artificial Sequence
  Synthesized
  misc_feature (61): n=t or c
tttctttaatacatataagtgttctgaaaaggatctgaaatgttacacaattttaaaactnatcaccacctctgagtaaattcataagatttccagatctctgctattattactgtacata

SEQ ID NO: 31272 - DNA, 121 bp, Artificial Sequence
  Synthesized
  misc_feature (61): n=t or c
tactagcctgattttactgcctgtctcagcagccctttaatgctcttccaggaggagctcnttcaagtatgcagtcaagattaaaacaatcaaaactcccagacacaatacagcaagagca

SEQ ID NO: 31273 - DNA, 121 bp, Artificial Sequence
  Synthesized
  misc_feature (61): n=t or c
ggaacactttccccccaaatactcaatgtattctttgctgatttgcacacaatttctgtanccaggttttgttgatgaagaaaaagcaaattttgtatttctaaactaaaggcctgtgaaa

SEQ ID NO: 31274 - DNA, 121 bp, Artificial Sequence
  Synthesized
  misc_feature (61): n=a or c
attctccctttcattttttcagctggattcatgggcaattaaatttacaactggattcatntctagaaaaaaataccagacccatataataaactgttcttgggagaaaaaaaaaaattgt

SEQ ID NO: 31275 - DNA, 121 bp, Artificial Sequence
  Synthesized
  misc_feature (61): n=t or c
cgtctctgaaaatgtcaggtgtaagatgttttacaaggaaactgcccttgctgcttaaaanggtgaagtgcatccaggtgtaagagtttctctactggcagcgtagtgacattctatagca

SEQ ID NO: 31276 - DNA, 121 bp, Artificial Sequence
  Synthesized
  misc_feature (61): n=a or g
ctgcccctttgtgtttcactggggaagctttataactgactaattggttagcaagtcccancccatgcagctatactggatgcatgcaccgtttggaaaggggtcaatacaactgctcctc

SEQ ID NO: 31277 - DNA, 121 bp, Artificial Sequence
  Synthesized
  misc_feature (61): n=t or c
cacacacacactggatcccccagcgtccttggcttgctcagtgttctgagtcatcaagganactcatgcatggtaaagacagttgacgtgtctgcttttggaagattcagtatttattagc

SEQ ID NO: 31278 - DNA, 121 bp, Artificial Sequence
  Synthesized
  misc_feature (61): n=t or c
caccagggaaggcaacaaccactccagtactgatttagcctcctgggcaagaaaggctctncaacacatctcccaacacaaactcaatcctacctatcccaccaccactgcaacgcattgc

SEQ ID NO: 31279 - DNA, 121 bp, Artificial Sequence
  Synthesized
  misc_feature (61): n=t or c
aacacgagtgctgaagttccttcaaatcatctgcaggacctgatgacattttggatcatcnaaattctcttttgtcactcaggcttactcttggtttaaaaacacaggattaaaaatgtat

SEQ ID NO: 31280 - DNA, 121 bp, Artificial Sequence
  Synthesized
  misc_feature (61): n=t or c
ttgcttttgctgaaaaactgacctgaatgtcagtgaggtcagtgatacccataagtactgnattttatgtttgtatgtagaaaacattcttattaccttcttcatcctcactatcctcttc

SEQ ID NO: 31281 - DNA, 121 bp, Artificial Sequence
  Synthesized
  misc_feature (61): n=t or c
acattgactggaagatgtggagtccagaaattattttcagaaagtgttacatctaatggcntttgcagaataaactggttttgatcatctgaatttaagtatcacttcaggtttaatttgg

SEQ ID NO: 31282 - DNA, 121 bp, Artificial Sequence
  Synthesized
  misc_feature (61): n=t or c
tgcgaggccatctctggtttacaaagcctgtaactaaaggtggtcccctccttggtgctgnggggctgcttgtgcttcgctcaggcagtgttaattgctgcccttgcggtgtcaaagcctc

SEQ ID NO: 31283 - DNA, 121 bp, Artificial Sequence
  Synthesized
  misc_feature (61): n=t or c
caaaacatcacagtctgtgtaactcagttatgggaacactgcacaattagatttttgtaanccagttgcttctgcaatataaacatctgacatctctaatcagattagatgtgattaagac

SEQ ID NO: 31284 - DNA, 121 bp, Artificial Sequence
  Synthesized
  misc_feature (61): n=t or g
agttaatgctatgtcagaagggagaacggtaggaaaacatgtttgtaaacacacttccttnagtgagttaagttaaacagttgaggaaccatcactatttttagactgttggctcctgact

SEQ ID NO: 31285 - DNA, 121 bp, Artificial Sequence
  Synthesized
  misc_feature (61): n=t or c
agctttgaggaagttgtttttctcttgcatagtagtatcagagaggtagattctgttatangaatgccccttttctagaagaaatgtttttagctcagattagaattttgatctttactgt

SEQ ID NO: 31286 - DNA, 121 bp, Artificial Sequence
  Synthesized
  misc_feature (61): n=a or g
gcagagattgattttaaaaagtttacacgaattatagtttattatttgaatactatttacntgctgtgactaccactttctaaagtattggttttgtatgattgaagaagagaatctcata

SEQ ID NO: 31287 - DNA, 121 bp, Artificial Sequence
  Synthesized
  misc_feature (61): n=t or c
cagcctttgtcaggcacagaagagcaaatgggtcaggatttaaatctccagaccccttcantccctgcatagctgctcctggagtcagcaaattgccactgcacagagcctgggctgcaca

SEQ ID NO: 31288 - DNA, 121 bp, Artificial Sequence
  Synthesized
  misc_feature (61): n=a or t
ctttctaatcccttatggaaggacaaccaatggtaagtaactgtccagtctccagattgcngcatgccttatgagcaaaaaacactgtttcaagttactcaggagggagtaagtaccgttg

SEQ ID NO: 31289 - DNA, 121 bp, Artificial Sequence
  Synthesized
  misc_feature (61): n=t or c
ttaaacatccgcaacttacatcaacgtcatttttcttttctccttcatattttctattatngaagagatgctttttctctctcgagcaattagaagacattaatatattctgaatcttggt

SEQ ID NO: 31290 - DNA, 121 bp, Artificial Sequence
  Synthesized
  misc_feature (61): n=c or g
ggggagctgaaacattattccttatccatgtggaaagacccagtgtggtactgctctcatnttgtgcctgtgccctttcctgcctcctccagtaggatgaaatgttcagatggtttcctag

SEQ ID NO: 31291 - DNA, 121 bp, Artificial Sequence
  Synthesized
  misc_feature (61): n=a or g
ttacaagctgtatttccattttatggacatgacatacatcaagttggaatataaataccantgagaagagactggtaggagagctgagtcaccaaagagatgattagcaacagctgcatct

SEQ ID NO: 31292 - DNA, 121 bp, Artificial Sequence
  Synthesized
  misc_feature (61): n=t or c
agaccatctgctttaatccccttgaatttgggaacattgcagtgtttctatgtgcttattnttctttaaaaaaggacttcttgccttcatgtctgcttatacatatggcttagaaatttaa

SEQ ID NO: 31293 - DNA, 121 bp, Artificial Sequence
  Synthesized
  misc_feature (61): n=a or g
gaaaatttagcaagggagtgatttgattggtatatgtttgtataagatccatatacaccanaaatcccaggaacatgtttggcagagagatagatgatgctgctatcaccaagtggtcttg

SEQ ID NO: 31294 - DNA, 121 bp, Artificial Sequence
  Synthesized
  misc_feature (61): n=t or g
gagagaaagcagcaatgcataagaaataatgggctctctgagtgtgattttaccaggcgangtaacctcaaagatttaaatagggcagagatgtgagggactgctacgttgtcattgtgtg

SEQ ID NO: 31295 - DNA, 121 bp, Artificial Sequence
  Synthesized
  misc_feature (61): n=a or g
gtagaaaattctttgtggatttcaatccacttaaggtaagccttctgaacctttcagctantgacagaatcagaatcccaacgtcataaagtgtatcaggaccatttgcttgctgattcac

SEQ ID NO: 31296 - DNA, 121 bp, Artificial Sequence
  Synthesized
  misc_feature (61): n=a or g
ggtgaagggcaaggagccgttcatcaagatgaagcagtttctctctgatgagcagaatgtnctggccctgaggactatccaggtgcgccagagaggtgagtggtggggtggccccattgcc

SEQ ID NO: 31297 - DNA, 121 bp, Artificial Sequence
  Synthesized
  misc_feature (61): n=a or g
atgtggtactgctacaaggtatgggagaaataatgctttgttctccattgctgaccagccnagttagtggacagttgcagaaataactacagtcagacagttcagtggactttttaagttg

SEQ ID NO: 31298 - DNA, 121 bp, Artificial Sequence
  Synthesized
  misc_feature (61): n=t or c
atcacataagtggaaaaagagctccctggggaagcccgggcagcagcaggtctgtcctgtncgtgttttgagagaagctagaggtcagccaagcctgataacgaggtaatacagaaaaaaa

SEQ ID NO: 31299 - DNA, 121 bp, Artificial Sequence
  Synthesized
  misc_feature (61): n=a or g
gctattatcttacctcaaatcccatgtagcagaatcaggcacacgcagtgtacaacagtancatcataaaacaatcaggaataacaagtcctgtaggtaataataccgttgcattaaatga

SEQ ID NO: 31300 - DNA, 121 bp, Artificial Sequence
  Synthesized
  misc_feature (61): n=t or g
acacttgtctatttccatctaaaaatctcctttcagacctctgaagtgtctctgcttcatncttcagaggctctaaatctacagtgctggagttcaagttggttcttcagtttttgaatag

SEQ ID NO: 31301 - DNA, 121 bp, Artificial Sequence
  Synthesized
  misc_feature (61): n=t or g
ggtaatgaaaagcaggcaggcttgaaggtgaacagatggctcctggcaagcatgaggaagncatagagatgaggtgtcagaaatggggtgatatgctcagactgaggggttaaggtaagca

SEQ ID NO: 31302 - DNA, 121 bp, Artificial Sequence
  Synthesized
  misc_feature (61): n=t or c
aggctgtacagaaggggacagaccaccaaatactcccacctgatgtgagccaaacataatnacacctataaacttactggcaccaagaacactactgctttgcaaaaagcaaaactttatt

SEQ ID NO: 31303 - DNA, 121 bp, Artificial Sequence
  Synthesized
  misc_feature (61): n=t or c
gtagttttagtacacatcgtttcaacccccagctctgtgcttggagcagcatctgggccangtttgatggcaaaacataatattgacaggatgagagttcttccttgaaacaaaggctggt

SEQ ID NO: 31304 - DNA, 121 bp, Artificial Sequence
  Synthesized
  misc_feature (61): n=a or g
tgattttctcagtcagagagctcacatttccttggagcctcttgtgactactgtgctcttntgggcaacgaacgaggcagagtaaagctgccctactcactcttcttcagtgcagtcttct

SEQ ID NO: 31305 - DNA, 121 bp, Artificial Sequence
  Synthesized
  misc_feature (61): n=a or g
ataggaaataaaaataaaagttaggaatggtagggtgggacaagaggcagaaaaggtgttntctaactgagtgacagttataacagaagagttataaccctataaaaagctgtttccaaaa

SEQ ID NO: 31306 - DNA, 121 bp, Artificial Sequence
  Synthesized
  misc_feature (61): n=a or g
ctgcaataggagacagtgctggataaatacaagcacactttcaccagctttattccctgancaaactgaaattgccacagagttggtacatcctaaaatcccatccatttctgtgttattc

SEQ ID NO: 31307 - DNA, 121 bp, Artificial Sequence
  Synthesized
  misc_feature (61): n=t or c
agctgtatctggtttctaggtagttgtgctgtaaaatatgtcaagagctgcctgaaatctnattcctttctgtccaccccaagacaagtgctcagttccttacattgtgaaagttgtgtac

SEQ ID NO: 31308 - DNA, 121 bp, Artificial Sequence
  Synthesized
  misc_feature (61): n=a or g
ggatgcaaaagttaggagatttcagcttgctgatctgcagggggcctgtggctgtgggacntttcaatggccctatgaagctttggtatctttgcctcaggttatgctgtaaaaaacaaac

SEQ ID NO: 31309 - DNA, 121 bp, Artificial Sequence
  Synthesized
  misc_feature (61): n=t or c
gtgtctgcagagcagggggagaactgcagctgagaagacaaactgtgaagcaggtggactngggtctcacacctgagcaagcattaagtgtctaattagctcaatacctccatttcaaaac

SEQ ID NO: 31310 - DNA, 121 bp, Artificial Sequence
  Synthesized
  misc_feature (61): n=t or c
atatttcaccaaaacgaaaacttctgacttactgcggctgaaaacagaatatcaatttccntgtgtaaagattggttagcactcttgtcagctagcgcaatgaaaaatgagctgtaggctt

SEQ ID NO: 31311 - DNA, 121 bp, Artificial Sequence
  Synthesized
  misc_feature (61): n=t or c
aactttatatttcatcgcgggatttactgaactaaatggggacgttcctcctaaagttggnttttgtgaatacctctgtgcctatcagctttctgctgacttgtttggaaatcccattaaa

SEQ ID NO: 31312 - DNA, 121 bp, Artificial Sequence
  Synthesized
  misc_feature (61): n=t or c
atcaaagttctgtgacttcaagaccgtaactgaaacgcccaggaagtgaatctggaaagantgctcatcgctgatctagtaatattgcactgggaattcttgcttgtagcaataattggta

SEQ ID NO: 31313 - DNA, 121 bp, Artificial Sequence
  Synthesized
  misc_feature (61): n=a or g
ccctacagcacatatgcatgccctgctgccaggacagacccacggggccctggggcttcantgaaaagcctccagttgcaagaccacagcctttgtgttggcagcccctgacagactaaat

SEQ ID NO: 31314 - DNA, 121 bp, Artificial Sequence
  Synthesized
  misc_feature (61): n=a or c
aagcatgcacataaaattttcatcttcagctgtagtctctatgcctccccctatttatatntggatattgtaatatctacttagagtaatgcaatattttctagaggaaattacagaacat

SEQ ID NO: 31315 - DNA, 121 bp, Artificial Sequence
  Synthesized
  misc_feature (61): n=c or g
taaccccaaaggctttcagtttactgatgggcactgtgttgtgctttgtctgcaagatggntatacttatgtgaaaaaaatctcaagttagtctttcatttatttaagcacatgacattct

SEQ ID NO: 31316 - DNA, 121 bp, Artificial Sequence
  Synthesized
  misc_feature (61): n=t or g
agcaggatttttggagttgtccagtgacctatcctccagtctgtaaatcagtagggcgatnactccagctgtgcacatgagagccagcacgaagattgcatggaggtaaaacattgtcagt

SEQ ID NO: 31317 - DNA, 121 bp, Artificial Sequence
  Synthesized
  misc_feature (61): n=a or g
ataattatcgaaaaaacttctctgctccaactgaatttaaagctcaatctatagtgatgtncacagaatgatttcaatcacaccaagtacattacatgtatttaattctgccgtgtcaggg

SEQ ID NO: 31318 - DNA, 121 bp, Artificial Sequence
  Synthesized
  misc_feature (61): n=a or g
tgttcaaagcactggtcaacactccatgctatgattaacactatatatactgttacccacngcagaattgtcagtcagacttcttagcaactcagagaatgaccacaaagacaaattagaa

SEQ ID NO: 31319 - DNA, 121 bp, Artificial Sequence
  Synthesized
  misc_feature (61): n=a or g
agccagctttccatatgtttgtactgcttgactccagtgcctttaaccagaatctgatttnaaaactctatagtagatgataacgttcttactgaattctgcaaggaggacaacaacaaac

SEQ ID NO: 31320 - DNA, 121 bp, Artificial Sequence
  Synthesized
  misc_feature (61): n=a or t
gaggctgtctcccaaactcttgttcactatgctttacctaaaaacacaacatcattcatangtgttacacgctaggggatgtcactgcatgaagaacatgtcctgcacatttgtaatgaaa

SEQ ID NO: 31321 - DNA, 121 bp, Artificial Sequence
  Synthesized
  misc_feature (61): n=a or g
cacagcgagctgcgctcaccttttcagtgtgttgaatatcgatggctccatgatgtagtcnggggttgaaaacttcttcaggcactcctgctggacttcagcatcgtcttctccctcccca

SEQ ID NO: 31322 - DNA, 121 bp, Artificial Sequence
  Synthesized
  misc_feature (61): n=t or c
tataaaaatatttatctgttagaaagatacaaaacaaagattatttttattcagtgagcantgtgacaaagagcaaaagaaaactggttgtttttgattttagaaggtagaaaagaagcac

SEQ ID NO: 31323 - DNA, 121 bp, Artificial Sequence
  Synthesized
  misc_feature (61): n=t or c
acttgaaatgggccgttctgttaacgtatattctgaaatactaaatctggtctaactctcngaggcaagcaagtgtccccttgagatacctgctgatgtcaattgcttaagttacaccaca

SEQ ID NO: 31324 - DNA, 121 bp, Artificial Sequence
  Synthesized
  misc_feature (61): n=a or g
tggattttgtgccactgatgatggccctccgagcctggcatgtcagtcctttttcagcacntaattccttggcttgtctatgagaattaatgggagtgctgacaggctaaagtcaagtcaa

SEQ ID NO: 31325 - DNA, 121 bp, Artificial Sequence
  Synthesized
  misc_feature (61): n=t or c
agaggggctgtctgatctgtgggacctctgcacatagggaagcaagctttaagcaaaaaanagtagatggaaaaagatctcttattgacaaagaaccgtcgcagtcacctgtctgggagga

SEQ ID NO: 31326 - DNA, 121 bp, Artificial Sequence
  Synthesized
  misc_feature (61): n=t or c
cattgtaatttccccttttgtaaaattagccatacttctagtaaactgtccttgaataagngttctttcagccttcttagctgtcttgaaacttgattctcatatgtatgttgaagtggaa

SEQ ID NO: 31327 - DNA, 121 bp, Artificial Sequence
  Synthesized
  misc_feature (61): n=a or g
atgcacatcgctgcagcaagggtcccaaccagtgtcagcagcagatgggggagatcagacncatgtgaactgagagcgaatttcatcttgctaagaacatgctgaatcagattaatgctat

SEQ ID NO: 31328 - DNA, 121 bp, Artificial Sequence
  Synthesized
  misc_feature (61): n=t or c
agcaggagcatgatttccctctttctgtgggaagcactgctaaaagatttatgcacttcantggtgtgaaacgaattaaagaaatactgctatttttagcttttgtgagatattttgttta

SEQ ID NO: 31329 - DNA, 121 bp, Artificial Sequence
  Synthesized
  misc_feature (61): n=t or c
cagctgaatggtcatagtccgtgagtggcggggagtgaagactcctgtatatgcactaatnatgcctggttgactgtttgcaggtttcctggtaggtaacttgattacagaggaacaatag

SEQ ID NO: 31330 - DNA, 121 bp, Artificial Sequence
  Synthesized
  misc_feature (61): n=a or g
aatgatacaatcttaaaaaaaaaaataaataaacacagagtgaaggagtaaatgcagtatntgtggaagaggaggatatctgacaagtctagtaggctgctctggttaggctgtattatgg

SEQ ID NO: 31331 - DNA, 121 bp, Artificial Sequence
  Synthesized
  misc_feature (61): n=a or g
acatccattttaaaatgtccttcgaatcacgtctgatttggcatgagatggcaattcccantgagataaacagtttgaaagatcacataaacagctgggttttggctcaactctgcattgc

SEQ ID NO: 31332 - DNA, 121 bp, Artificial Sequence
  Synthesized
  misc_feature (61): n=a or g
attaacgtattaattaatatgtgtggattgcttcagagagagaaagcactgcaggggaacnttaattcctaattgttgttaattgaattttgctgctaggtcagaggcaggtcagagagac

SEQ ID NO: 31333 - DNA, 121 bp, Artificial Sequence
  Synthesized
  misc_feature (61): n=a or g
tggttaattatccgatacagttgcacatgagtaataacagcatagcagcaggcttgctttntgctctgccacgcagctcccagaaggatgctgtgttaaagtcagtgcagttactctagtg

SEQ ID NO: 31334 - DNA, 121 bp, Artificial Sequence
  Synthesized
  misc_feature (61): n=a or g
ttctgtaattcactactagaatggcctttttaaaatataaagttctatatagtaaaggtcnggttttcaaacctagtcaactacttaaacagtgtaagagactcatctaagcacatgcaac

SEQ ID NO: 31335 - DNA, 121 bp, Artificial Sequence
  Synthesized
  misc_feature (61): n=a or g
atataaaggatagacaaaggatagataaactgataaaggaaggtctcagagaagtttgaanaacttctgaaaaatcctgaaagttttcaggttcttgctgttacttagacaaagctatact

SEQ ID NO: 31336 - DNA, 121 bp, Artificial Sequence
  Synthesized
  misc_feature (61): n=t or g
aaaaaagggaggagatgttctccttattaaaagggtgggttgcataccttatctgcctctntatgacattgctgacatcaacactgaaggcatgactacagttctggtgttttggtgtgtt

SEQ ID NO: 31337 - DNA, 121 bp, Artificial Sequence
  Synthesized
  misc_feature (61): n=t or c
gacttcccatttatatcctaaggcatttcattttatttatttaattcactcttctagtganctgtgttttctttccaggaaggtatttatacactgtaattaagccctccctcatgcgtct

SEQ ID NO: 31338 - DNA, 121 bp, Artificial Sequence
  Synthesized
  misc_feature (61): n=c or g
gtgtgtgacatttatcgtgtaatggaataaactcactcatgtaatggaataaactcacttnaaatggcttttgatcattttaccacttccattagctattcagtgaaatcctcctctattc

SEQ ID NO: 31339 - DNA, 121 bp, Artificial Sequence
  Synthesized
  misc_feature (61): n=a or g
ctacaggagagtgtggagagggatcaacgctgcatttccatagttcatacactgtcaggtnccagtgctgggttcaaacacctacccaggaaagctctcaccagtcccttaacagatggta

SEQ ID NO: 31340 - DNA, 121 bp, Artificial Sequence
  Synthesized
  misc_feature (61): n=t or c
caatgtcattgttttcaccgaagtctagaaaatgtgacaagtctattgagcatctctatcntctattcaatctccctgaaaatgaaagtaggatttaacataggaggtgtctggaatataa

SEQ ID NO: 31341 - DNA, 121 bp, Artificial Sequence
  Synthesized
  misc_feature (61): n=t or c
ttggtgcctccttaaacttctagtctgatcactagctcaaagtgatagtagaggcacgtgntgaaggaagccagatagaaggctttctgcctcttaaaggaactatgaatgggacaccaaa

SEQ ID NO: 31342 - DNA, 121 bp, Artificial Sequence
  Synthesized
  misc_feature (61): n=a or g
ctcgttgcaaagcacaaaaatccccttggactccatttccccttgcaatgctctccagtcncatgaattcctttcccctgctgcttgtgctcacagggactcagacacggtggagtcagtg

SEQ ID NO: 31343 - DNA, 121 bp, Artificial Sequence
  Synthesized
  misc_feature (61): n=a or g
caggagctaatggggagagaataaagaaggctatgaactatcccactggctagcacagctngtacaccagtagaattagaaaggaccaatctatttccactccaagccaacactacacttt

SEQ ID NO: 31344 - DNA, 121 bp, Artificial Sequence
  Synthesized
  misc_feature (61): n=a or t
tgctgggttccccaggtctcagccccaggaagcttttaactggagtcaaaaaaggcattangcactggggaggaatcagggtgacataaaacagaaatcagggtttaacacggggccatga

SEQ ID NO: 31345 - DNA, 121 bp, Artificial Sequence
  Synthesized
  misc_feature (61): n=a or g
gctgctgctggcctggtgcaaggaggctgcactgactgaagctctgaggctaacccgttgnccacttgactttggtaggcttggcaggctttacattggcagctcttcagtttgagaattg

SEQ ID NO: 31346 - DNA, 121 bp, Artificial Sequence
  Synthesized
  misc_feature (61): n=a or t
atcactgccaggttcatcccttctgcctcttctttggtgatagcagtggcttctcttgttnagccattatgacccaaaagtttctggctacgcccctggagctccagctcttgggttttct

SEQ ID NO: 31347 - DNA, 121 bp, Artificial Sequence
  Synthesized
  misc_feature (61): n=a or g
gcttttgggatcagagtctgttcctgtctgcgttttgtgggtaggtagaaagaacatcatntaaaagacaagttttggttccaaatatacaaatatgcaaaggaaaaaaaaaaccaataag

SEQ ID NO: 31348 - DNA, 121 bp, Artificial Sequence
  Synthesized
  misc_feature (61): n=a or c
cttctaatattttccaaggaggatcattttgctcaaacacaagtatgtgcctgacacttantgcttaatttacctgcaatttgctgcaagtatttgtggaagcatgtatatgcatgcaagt

SEQ ID NO: 31349 - DNA, 121 bp, Artificial Sequence
  Synthesized
  misc_feature (61): n=t or c
gcagttacagatactcatttgccagccctgttattaaatacagtagctctcaatgctatgnataaagaacatgcaaacatctctcccctaccttctgtaccacgaacagtgcatggaggaa

SEQ ID NO: 31350 - DNA, 121 bp, Artificial Sequence
  Synthesized
  misc_feature (61): n=t or c
ttacaaaacacgagagactctcccattaacactgctcaaagattactggcaataaataagngagagctaagcaaagttaaaataaaggactggatgtctgaaaagacagtgggtttgacac

SEQ ID NO: 31351 - DNA, 121 bp, Artificial Sequence
  Synthesized
  misc_feature (61): n=t or c
cccaaaacaatcagtgaacatctgcctttggtaaaattgggcgctgctgttttcccacttntcctagaagaaatgttttgaaagtacttaaaagccactatcacattagaaggtcctgagc

SEQ ID NO: 31352 - DNA, 121 bp, Artificial Sequence
  Synthesized
  misc_feature (61): n=t or c
aggaggaaatccacaaactaagttcaggttgaatcttcacaacagtttgtaaccattcaanactacaacccacaaaaacggtgtaagatttattcatgacaagggctggaacctgagagga

SEQ ID NO: 31353 - DNA, 121 bp, Artificial Sequence
  Synthesized
  misc_feature (61): n=a or t
tgtttgactcctccagatcgcattgtaaacagatctacaaatacatcagtaggctaactcnactctgtacaaaagatgatcacattttcctggaacacacagtaatttatagaaacgcatc

SEQ ID NO: 31354 - DNA, 121 bp, Artificial Sequence
  Synthesized
  misc_feature (61): n=a or g
ctacttttgttccacttcagatctccggcaattacaatgttcatatcctttctcactttanagcagatggaaaatcctacctgttcatctcccccctcgatatgtgacataaagcaagtcc

SEQ ID NO: 31355 - DNA, 121 bp, Artificial Sequence
  Synthesized
  misc_feature (61): n=a or g
aagccatatgaaaaagggggaaaaaagatggaaataagagaagacacaaagggcttggaanaaatgcacatccttgggaggcctcacctaggggcagggtcaaagtgccttacccacccct

SEQ ID NO: 31356 - DNA, 121 bp, Artificial Sequence
  Synthesized
  misc_feature (61): n=t or c
taaactgtaggcggagaccctgaggagaggaggaacacatccgtggtgagggatgggcaanagaacagcacggagagctgaagaggtttggcagagctgcaaaggagaatgatgggatcat

SEQ ID NO: 31357 - DNA, 121 bp, Artificial Sequence
  Synthesized
  misc_feature (61): n=t or c
tccctctatacgagagattctcgtgaccatatgtagcatctgtgcttgactgcactttcanacaaaccgtcaccagcagggctatgggctgtttgtttgattctgtacaagaacggtctac

SEQ ID NO: 31358 - DNA, 121 bp, Artificial Sequence
  Synthesized
  misc_feature (61): n=a or g
ttgccatgggtaaaaaagagcacctctgactactctgcactggctactgacaaagaaaacntgacttccctggggctttattacataagaaacacattggcagaaattaagctgctccttg

SEQ ID NO: 31359 - DNA, 121 bp, Artificial Sequence
  Synthesized
  misc_feature (61): n=t or c
tttaataaagagaaatcctgcaggtgagtcactaagaattatctttcaaaccccaaacttncctaatccgtggcttcaagcttttaaacactattctgcatcaaaattctcagcataccac

SEQ ID NO: 31360 - DNA, 121 bp, Artificial Sequence
  Synthesized
  misc_feature (61): n=t or c
ttgctttcttttattatgctgattttgtatattttggtaggtacaaacggtgttagataangtgcaacatctgattagtcatcattatctgggcatagcattaaaataaaatgctgcttaa

SEQ ID NO: 31361 - DNA, 121 bp, Artificial Sequence
  Synthesized
  misc_feature (61): n=a or g
aacatggaaatgacgtacatgcaaatttctggatcaataatcatcaatttttataagccanatttcataccagctaccacggatccactgagaatgtgtatatcatgaggacttattattt

SEQ ID NO: 31362 - DNA, 121 bp, Artificial Sequence
  Synthesized
  misc_feature (61): n=a or g
agtaatgagaataaagcatgaattggtttcataatgtgttccccaatctgacagcagcacntaagaaatctgattagaaatacctaacattaagccaggcccaaagcatcaagtgaaattt

SEQ ID NO: 31363 - DNA, 121 bp, Artificial Sequence
  Synthesized
  misc_feature (61): n=t or c
atttcttccaattttctctctctagcaaaaacagtaacctcacaggtcacaattcagagangcaccaatggtagaataaattataacttctaaaataaacattttggtttccactgtaggt

SEQ ID NO: 31364 - DNA, 121 bp, Artificial Sequence
  Synthesized
  misc_feature (61): n=a or g
taaatgagcaaaacgctcaggaattaatcactaagtcggtccataccccactttctcactncactttctcactctcagacacttccatcatccacagctcagaaattcctcagccctctca

SEQ ID NO: 31365 - DNA, 121 bp, Artificial Sequence
  Synthesized
  misc_feature (61): n=a or g
atcatgctgcacataacttctgcattttctctggtctcatgcttggcttcatagaaccacntgcaagaaggagtgtcaaggcccatccccagctcccagcaaaccattctgcagggcagct

SEQ ID NO: 31366 - DNA, 121 bp, Artificial Sequence
  Synthesized
  misc_feature (61): n=t or c
ttagttactatgcataggatgtggcagaagcggaggtgcttgtctgggaggtgagcccttngtgtgcccacttgaatggctgggttgtcatctaagctcctctgtcctggaaggtatctga

SEQ ID NO: 31367 - DNA, 121 bp, Artificial Sequence
  Synthesized
  misc_feature (61): n=t or c
attttgcctttgctttccacagggttaggatttcacccaggaggtctgtagccttcagcantttccactcctaagtgatgataagggcttataatttaatttctgtcaaagtaataatgcc

SEQ ID NO: 31368 - DNA, 121 bp, Artificial Sequence
  Synthesized
  misc_feature (61): n=a or g
gctcattgtcccctctttagtgccttaggcactggtagcaggaacatgcaaagcattaatngggaaagagcaggaatttgggaaggaatctaagcctccctgcctagcaaataactcaagc

SEQ ID NO: 31369 - DNA, 121 bp, Artificial Sequence
  Synthesized
  misc_feature (61): n=a or g
gaggaaaaatccagtgtggcttgctgggatgtcatatcctacacacccagttctttgttcngtatctgcgcatccactacaggtgggaggtttaggcatgattttggctctattttccagg

SEQ ID NO: 31370 - DNA, 121 bp, Artificial Sequence
  Synthesized
  misc_feature (61): n=c or g
atgtatgattgagttctgctcatttagggaagtgtaactgacggtaacagccttcttagantttgtgctgttttctctatgtattctaggtctagggtattggggaaatgagcacacgata

SEQ ID NO: 31371 - DNA, 121 bp, Artificial Sequence
  Synthesized
  misc_feature (61): n=a or g
ctgaaaaattccctccctgtgcacgggaactctaaagatgctttcccctgcaatgggagtnaaggcctatggaggatgcatagcttgctgggcatggcacttacccagcaggggggggagg

SEQ ID NO: 31372 - DNA, 121 bp, Artificial Sequence
  Synthesized
  misc_feature (61): n=t or c
ataccacatgtaggagacaccagaattttggtactcatgtaatttgcacaaaataatatgnttagatcttcttaagttgatataaaatccaagtttgttcaacttctaataaaaatttctg

SEQ ID NO: 31373 - DNA, 121 bp, Artificial Sequence
  Synthesized
  misc_feature (61): n=t or c
ttacttgaatgactagaataaatagattgaaaagaagctgtgtatcacaaacaagtttgcnctgtgaaaaggtacatatttacatgtcccctgtgtcacagttaagctgatagcagaagtt

SEQ ID NO: 31374 - DNA, 121 bp, Artificial Sequence
  Synthesized
  misc_feature (61): n=t or c
gtgaccccgccactttcctgggcagcctgtgccaacacctgaccagcagataaaacagagntcagtgcgtgcatttgctgcaatcctcctgcagcatctgggctccaacttgttgcatttc

SEQ ID NO: 31375 - DNA, 121 bp, Artificial Sequence
  Synthesized
  misc_feature (61): n=a or t
gataagcaaagcaacaacacaaattgagaccagattttaaatcatgcttttaatctatctnaagtcactgtaacacccacagaaacagaagggaaattccagcctgcaaggacttatcatt

SEQ ID NO: 31376 - DNA, 121 bp, Artificial Sequence
  Synthesized
  misc_feature (61): n=a or g
ttacagagccgtcagatcagctgttatttgtataacacccttctgcatatttattttggtnctattccattttgaggaagaaaagttaggaaatcagacaaggaaagaaaggaagataaag

SEQ ID NO: 31377 - DNA, 121 bp, Artificial Sequence
  Synthesized
  misc_feature (61): n=a or g
atccctccttgcgttcaacccatctattttcgtcagtgaccaaaaaaatactttgctgccntttgtgaatgccttcctgtgcatgttagccctgctccttaaccaaagcacctcaggcatc

SEQ ID NO: 31378 - DNA, 121 bp, Artificial Sequence
  Synthesized
  misc_feature (61): n=a or g
taccataccagtgtagaagacctaacaggctgcagtaaaaccaccttaagctcacttaacntcaaacagtggtgtgcattttagtatgctggtcagtaagataaatggtaattattgtgct

SEQ ID NO: 31379 - DNA, 121 bp, Artificial Sequence
  Synthesized
  misc_feature (61): n=a or g
ggacttaccttcctcttgccttcatgtctatactggagtaaaaattctgaaatgtagcagnagacaaaaacagtggattttttcaatagtttaaaaagcaaaccattggcatgttgttgtt

SEQ ID NO: 31380 - DNA, 121 bp, Artificial Sequence
  Synthesized
  misc_feature (61): n=t or c
aaaaaataataagaaagcagggaaggaaaatcagaattgattcctaaatgttgcattgatnggttagttgcaaactaaatgtctcctgtaaattaaacatgtgtaggttatttctgatgct

SEQ ID NO: 31381 - DNA, 121 bp, Artificial Sequence
  Synthesized
  misc_feature (61): n=a or g
ctcactctcaaacaaaagagtgcgattttgacctgcaagacaaaaagcagtatcatcaaanatcagtcatgtatcctgtatgaactatccagaaaatttttttcaagacattcttcagttg

SEQ ID NO: 31382 - DNA, 121 bp, Artificial Sequence
  Synthesized
  misc_feature (61): n=t or c
tcagtccagcactgccacaatttctataagaaaatgatgttgaatattatcaaagatgtantttcttaaagagcttgagtctccttttagctgaagcgcagcttcactgctctgtttcaga

SEQ ID NO: 31383 - DNA, 121 bp, Artificial Sequence
  Synthesized
  misc_feature (61): n=t or c
gcaatcaaatcctagtaaaacttgaattattttagcctaattccaggaaaaagcgatgcgngcttacatttacacttctcactttatcaggaaatatgaacaagtcttctctatttgtcca

SEQ ID NO: 31384 - DNA, 121 bp, Artificial Sequence
  Synthesized
  misc_feature (61): n=t or c
aaacttcctgcatttggcaagcaatcgtgtcctcctgtttccttctgtcattttgtgtaantaactttgctaccctttttctgagatgatttgggtggaaacacccatgggtgcttatcag

SEQ ID NO: 31385 - DNA, 121 bp, Artificial Sequence
  Synthesized
  misc_feature (61): n=t or g
cctaaaggaaatatattcatcacttatacatccacctaatacttggcaagagagtgtgctngcaatctgaagaaaaagaaaggtagtttgggatgacagctgaactcagagggagctgcac

SEQ ID NO: 31386 - DNA, 121 bp, Artificial Sequence
  Synthesized
  misc_feature (61): n=t or g
ctcaagagaaacacagccacctgtaaggcaaatcttattcagcgctacattcagcttgtcnggcaccatgacattcctacatgtcacctccacaagcagctctacaattccgctgaataat

SEQ ID NO: 31387 - DNA, 121 bp, Artificial Sequence
  Synthesized
  misc_feature (61): n=t or c
ttcttattttttccttgtatgttttcacttctgtgcttatcttgatttgcagaggaaacantgctggattttctctgaaatatgccacatgcattaaggagttatgcaaaatatcagttac

SEQ ID NO: 31388 - DNA, 121 bp, Artificial Sequence
  Synthesized
  misc_feature (61): n=c or g
catggcttttccagcttggaaggctctcgagagactcatctggaccaatgatttatatctnaagttcagaattaaagaaccactcaattcccttatgatttatccttttttttttttcagc

SEQ ID NO: 31389 - DNA, 121 bp, Artificial Sequence
  Synthesized
  misc_feature (61): n=a or t
agttacattgtcactggaaaacaggaattggaatcttttaaaatgctttgaatgttgtatngaccttatgcttataggtgctctgctgacagtgttagagaagcaacataaatgttactct

SEQ ID NO: 31390 - DNA, 121 bp, Artificial Sequence
  Synthesized
  misc_feature (61): n=a or g
ctgagattcttttgcttaatgaaactgaggaagagggaacctcacagcttctgttttatgngtaaaagtcgcctaccctccccttcctttttctttacagccttcccttttagccttgtag

SEQ ID NO: 31391 - DNA, 121 bp, Artificial Sequence
  Synthesized
  misc_feature (61): n=t or c
tgccaggcaaataaaagcaggatacatatatgtacataaaatccattcacgttaagcttcntgtacttaagtaaaccttacttaaaagttcatctcgtactttacttttctacttgcagaa

SEQ ID NO: 31392 - DNA, 121 bp, Artificial Sequence
  Synthesized
  misc_feature (61): n=t or c
aggggtagaacgagggttatttttattggctggctgtactgactcaaaggcaggtgctggnggttctgctgtgcaaatcataagacatctcaaaggcaaaggcctaggaggatttgtaggg

SEQ ID NO: 31393 - DNA, 121 bp, Artificial Sequence
  Synthesized
  misc_feature (61): n=a or g
atttttctactcttactatttagattaggattttagatattaggagtttagacattagatngaaagctctccttgttaatatttgtgcactccatgtctctctgtctacacatatcaaagt

SEQ ID NO: 31394 - DNA, 121 bp, Artificial Sequence
  Synthesized
  misc_feature (61): n=a or g
caggaatttcacaatactttacctctcccatgtactaaaaagtgtattagataatgtaatnctgcataatcaggcattaattgacagagaataccatgtcatcttttttctgtttttcaat

SEQ ID NO: 31395 - DNA, 121 bp, Artificial Sequence
  Synthesized
  misc_feature (61): n=t or c
cgcattcagcttatcactagtacaggaacagatttatctgtgtgctctcacatgaataacnatggggttttctgccaggataaagtggtagttacctgtgaaaagctgggtcgtgaaggtt

SEQ ID NO: 31396 - DNA, 121 bp, Artificial Sequence
  Synthesized
  misc_feature (61): n=a or g
tgtcttgttccttcctggcaaagccttgtagcatgtctccccttggtaaataacatatctnttaacatggtgtggaaatagtgactgtgcatgatgagaaatcctgattaaaatactggcc

SEQ ID NO: 31397 - DNA, 121 bp, Artificial Sequence
  Synthesized
  misc_feature (61): n=a or g
actggggtttgccttaagatctttgaagaggcaatgagatgaggttgtatctgcatcctcntgtccaacagcagtgctgaaaagagtgggactgttgaaatcagcaaaggctggagacaaa

SEQ ID NO: 31398 - DNA, 121 bp, Artificial Sequence
  Synthesized
  misc_feature (61): n=a or c
ggcattgctctgcagtattatcgaattccaatcatccattttgccactgcttaaaattaangtgctagtttctgcttaatgtcttcatacttcacctcacccataaacttaagaataaaca

SEQ ID NO: 31399 - DNA, 121 bp, Artificial Sequence
  Synthesized
  misc_feature (61): n=t or g
tagttgttaaaaccaaactgcttctaatgttgctagtaagtaaaggagaaatggcttgttntagcagctgatttctgtcagactggagtttattctgggaagcaatccctcagattttgaa

SEQ ID NO: 31400 - DNA, 121 bp, Artificial Sequence
  Synthesized
  misc_feature (61): n=t or c
agttgtcacgtgtgtgctcgagattcactgtcacagaggtgcatttctgtagggcctcttnatggagcagctttcagagcgtgctctgatttcattggggttggatttcccatttctgacc

SEQ ID NO: 31401 - DNA, 121 bp, Artificial Sequence
  Synthesized
  misc_feature (61): n=a or g
attaatttattcatgtgtttctctgtgatggcccacaggcaattaacttattttcatactntaactatgagatggcagcttttgttattttcactttacatacagaggattaaagtgatac

SEQ ID NO: 31402 - DNA, 121 bp, Artificial Sequence
  Synthesized
  misc_feature (61): n=t or g
gttttttggttttttgttatgttttgtatttaacctgggataagacataatgagaaggtgngatgatattaacagccttgttagttaacaaaggcatgaaagacatgaaaagtgtggacta

SEQ ID NO: 31403 - DNA, 121 bp, Artificial Sequence
  Synthesized
  misc_feature (61): n=t or c
tcctactgacttcagtatacctgggatcagacaagaaattactactttcttgttgattttnaaccttattgaacctgaataatggctcttgttttatttctcttttgaacttgtgcatgtg

SEQ ID NO: 31404 - DNA, 121 bp, Artificial Sequence
  Synthesized
  misc_feature (61): n=t or c
tgtaatgcaatctggaagtcagctttgtatagagacttcagctcaggcccccttattatgngatctgaagtaaatcaactttctattcatttctctctggagatccttgagtaattttcct

SEQ ID NO: 31405 - DNA, 121 bp, Artificial Sequence
  Synthesized
  misc_feature (61): n=a or g
aactaactcaaaccttttggcaagagccagaatttgtctttgttgagtgctggtctatctntgtacgaatgatcctgtataataacagaagtgagatactgcttgatacctttagaatagg

SEQ ID NO: 31406 - DNA, 121 bp, Artificial Sequence
  Synthesized
  misc_feature (61): n=a or g
ttctcaccttcagtttaatagcataagtctctttttttgccagctgagatctgcaattganctgtttttattttggtatgaagttgctattttctcgagcagtagtttttatatgtagcaa

SEQ ID NO: 31407 - DNA, 121 bp, Artificial Sequence
  Synthesized
  misc_feature (61): n=a or g
tgtgtgccattcactctggccacagaggaactgttcttcgtcatgtgttgatgagatctancataccaacgctcacatcgtaaacaccagcactatgttaaatgtacttgtgtaaaaaaat

SEQ ID NO: 31408 - DNA, 121 bp, Artificial Sequence
  Synthesized
  misc_feature (61): n=t or c
atctgggatggcacccacttttgagggtggcacatgctgtgcacaagcaccctacaatgcncagtgagcacaggaagagggtcagagctgcgatggggctgctctgggcaagggaccagca

SEQ ID NO: 31409 - DNA, 121 bp, Artificial Sequence
  Synthesized
  misc_feature (61): n=c or g
gaagtaatagactccaaaacatcaagtagccataataccacaaaccaccacggaggaacangttcagccccagggcagaatcaggttcccctgcccagtttttggcgctggcttttggaca

SEQ ID NO: 31410 - DNA, 121 bp, Artificial Sequence
  Synthesized
  misc_feature (61): n=a or g
gatatatagggagaaaggcagaggtgaggaaagagagtgctaaacagcagttttgagtggnaaaaagaaaaagtaaggaatgagtccacaataatggaattaattcgtttccagagaagat

SEQ ID NO: 31411 - DNA, 121 bp, Artificial Sequence
  Synthesized
  misc_feature (61): n=t or g
actatcacaacttggcaggtagacattaagagatcaacagacctgaagattttcacaaaanctgagaagctccttattaaggacatcagtaaaaaaagagattactttaagcattagacaa

SEQ ID NO: 31412 - DNA, 121 bp, Artificial Sequence
  Synthesized
  misc_feature (61): n=t or g
cgtgtctagtttcaagtctaaagaaaagctctcctggtgatctgtttatgtgtatatgttnatctgtttatgtttatatgtttattcatgtgctcctcgttatggatatgggagtatgagg

SEQ ID NO: 31413 - DNA, 121 bp, Artificial Sequence
  Synthesized
  misc_feature (61): n=c or g
gctgtgtttctggattctgaaccagcaacgcagttgtctgtccacctctcttagtcctctntgattataactctcattacaaacactcattgttataagtgaaagggagagtgtaataaac

SEQ ID NO: 31414 - DNA, 121 bp, Artificial Sequence
  Synthesized
  misc_feature (61): n=t or c
tgtgttctactgcccacatttgctgttacagtgcacctcactggaagcaaggttttagcanttagcagagcgacaagacccacagagtagggacccacaacatcttaaaatctctcatcaa

SEQ ID NO: 31415 - DNA, 121 bp, Artificial Sequence
  Synthesized
  misc_feature (61): n=a or g
aataaatctggagggtttaggatgagcttggtctgtttcactttcaaagcaagcagggctnggaggtactgagagaggtcgtctgggccattccactgcccaccatatggactggtaacag

SEQ ID NO: 31416 - DNA, 121 bp, Artificial Sequence
  Synthesized
  misc_feature (61): n=t or c
tgcagccctggtgttcccgttacgccagcagcagaagtctctgtgtgcagtatggggcagngttcctcactggaggggggttgtgctgctttgatggcccagctgcctcaggaggagtaag

SEQ ID NO: 31417 - DNA, 121 bp, Artificial Sequence
  Synthesized
  misc_feature (61): n=t or g
ctgccccggcctcagtcccatggattccacgtgagactggaggggaacggagtgctcccangctgtgccagatgggtctcttagcagctcataaaggctcacattttcggatgttaaagca

SEQ ID NO: 31418 - DNA, 121 bp, Artificial Sequence
  Synthesized
  misc_feature (61): n=t or c
aactgattcatagcgatgggcactgggttaggctcagcttaattacagttatcctataggnaccctctttgctgaaattccttaaagatgcaccaaaatgtctgccatactctcatcagag

SEQ ID NO: 31419 - DNA, 121 bp, Artificial Sequence
  Synthesized
  misc_feature (61): n=a or g
ttgcagagtggaaagctacaagcaacttgaagaaatgtgtcttcttgtggaaaacattacncagtcttaagtacgagtggctcattctgtgccagctataagatagaaaggtaagttacat

SEQ ID NO: 31420 - DNA, 121 bp, Artificial Sequence
  Synthesized
  misc_feature (61): n=c or g
tgcaacactgggctaatgaaaaggagagaagcctaaaatcaaatctggtttctaattcaanaacaacaaaactggagccttagcttagaaacagattattttgactaaaaaattgatcacc

SEQ ID NO: 31421 - DNA, 121 bp, Artificial Sequence
  Synthesized
  misc_feature (61): n=a or g
acactcagaaacataagatcctcagtttcaaagatcggtacagactatgcctctaatagtnaggaattggagcctgcacacattcagagattttaaaagcaaacacacaccaaaaaccaag

SEQ ID NO: 31422 - DNA, 121 bp, Artificial Sequence
  Synthesized
  misc_feature (61): n=a or g
ttcaaggagaaactggtcagtgaagtgacacactcttgtgttttttccaggagtttatgantatatccctctggaaacaggagaaggatcaagactgcagataaatgctcagaactgtgtc

SEQ ID NO: 31423 - DNA, 121 bp, Artificial Sequence
  Synthesized
  misc_feature (61): n=a or g
gctgatgggaagagaggagtgacctttggtaacattacccaacacttttcctcgtggcacntctacaattagcaggaacagcatgaaatccaagtggggaaatgtcccactgtcagtgcag

SEQ ID NO: 31424 - DNA, 121 bp, Artificial Sequence
  Synthesized
  misc_feature (61): n=a or g
ccctgatggctgtgttctttcagatttatccacgatgattaaaaagtataaccatgcctcntatggaaattaagttgtgtccttgaggttattttacagtacattgagtctgaccgcagtg

SEQ ID NO: 31425 - DNA, 121 bp, Artificial Sequence
  Synthesized
  misc_feature (61): n=t or c
ccattctattctatagtcttggaaatttttctgtgggattgttcctaaaaagcaataattnactataaattgtgtaaaatgctacatttcttgatccattttatcatggatttgttctata

SEQ ID NO: 31426 - DNA, 121 bp, Artificial Sequence
  Synthesized
  misc_feature (61): n=a or g
tggtgtgcagtgagctcccagccctgggtgtaccttttcctgaagtcaaggcactcaaagnggctttcccttgccttgtttcagtgaggtctactgactgtggagatgcagctgaagctct

SEQ ID NO: 31427 - DNA, 121 bp, Artificial Sequence
  Synthesized
  misc_feature (61): n=a or g
catcaagtttgacctcaggaaaagcaaaaatgtattctaaagctactgtggtaaggaccanatggatgtacatggcaagaacacacaagccctgtttctttagaaaaagtaaattaatgaa

SEQ ID NO: 31428 - DNA, 121 bp, Artificial Sequence
  Synthesized
  misc_feature (61): n=a or t
agaagagttcatcagcaaggaaagcaacgtctctagtgttaattttcctaacttcctattngtcattcaaactaagatcaccttagctcctgtgaccatgttgtccaaaacctttcaaatc

SEQ ID NO: 31429 - DNA, 121 bp, Artificial Sequence
  Synthesized
  misc_feature (61): n=a or g
aaaaattttcattctcccttttgtcaaatgtattgtgatatttattttactgaatgccccngcagctgcaatcaaacattttggtttaaatttcaagtaaagagagacagttctagcagcc

SEQ ID NO: 31430 - DNA, 121 bp, Artificial Sequence
  Synthesized
  misc_feature (61): n=a or g
ggaggggctttgtggtgcagtgccacggtgtgcctgggactggtaataatgggaaggaacntgaactttggaagatttttgtgaagtactgaaaagattttcatgttcccttttaaaagct

SEQ ID NO: 31431 - DNA, 121 bp, Artificial Sequence
  Synthesized
  misc_feature (61): n=a or g
tagcttctaacttctctcatggaaagcagataggttttttttcagtaacaaactgtattcnttgagttattgctacatagaaataaatatgattttgatcaaatggaatagaatgcaaaaa

SEQ ID NO: 31432 - DNA, 121 bp, Artificial Sequence
  Synthesized
  misc_feature (61): n=a or g
aagccatgctagagaattatgtttcttggtctcagtgcttccctacattaattatttgccnctaaccaaagcatctgtcttgaactgttcttgtgtgttttcagtgtgttttgggtttcat

SEQ ID NO: 31433 - DNA, 121 bp, Artificial Sequence
  Synthesized
  misc_feature (61): n=a or g
tcattttctcaaacttactaccacttatttctacttggcttggctgtaggctatatgtgcnggtaaatgccataaaataacagggatatccacaacaattaaataatctgcatgtgaaatg

SEQ ID NO: 31434 - DNA, 121 bp, Artificial Sequence
  Synthesized
  misc_feature (61): n=a or g
tggctgcagagcagcagcagagggaattgggagcgagccctgataggaaatggggaagccntaagcaagcattgtgcaggtgggcttggaagcagcagtgccagccttctcctttcagttg

SEQ ID NO: 31435 - DNA, 121 bp, Artificial Sequence
  Synthesized
  misc_feature (61): n=t or c
aaagggaatcgctgccaagcagagaactggagactgaattctgaattgtatgagagcaggnggtccatgcttcaagcaagaagtcaaacgtgttgcatgacaggacttctcccacttcatt

SEQ ID NO: 31436 - DNA, 121 bp, Artificial Sequence
  Synthesized
  misc_feature (61): n=t or c
atttctcatctccatgtatctttgtttataaagatgttacttatgtagacatctcttcctncaaagcttttctgcctcaaaaagctcacaattccctaagcacaatatcccctttctcata

SEQ ID NO: 31437 - DNA, 121 bp, Artificial Sequence
  Synthesized
  misc_feature (61): n=t or c
cagaaaacagtcagtcactgtccccttggtaacaacttttcacgtgctaggaagctggagncatttacagagctacgacaggttcttgtgcctctactctaggcactgcaatacagcatcg

SEQ ID NO: 31438 - DNA, 121 bp, Artificial Sequence
  Synthesized
  misc_feature (61): n=a or g
atggagatgtgggatgtgatgggaatgcagaatgcaatggggatacagggtgtgatagggntgtaggatgagattaatacatgagatgtaatggggatatggaatgagatggagattgaga

SEQ ID NO: 31439 - DNA, 121 bp, Artificial Sequence
  Synthesized
  misc_feature (61): n=c or g
gctgcaggtattggggcacggattgtaaggcacaaattcaccctttggagatcagcatctnggcactgccttcagccacccttccttcactgctttttacatgtctgaagaatataactca

SEQ ID NO: 31440 - DNA, 121 bp, Artificial Sequence
  Synthesized
  misc_feature (61): n=t or c
tcagcatgctttagcgtagctgcactgagggagcattttcagtaagttgcaagcttactanagctacccaaggagaagtgcattcaagcaaagaaattagagaggtttttttttctgggtt

SEQ ID NO: 31441 - DNA, 121 bp, Artificial Sequence
  Synthesized
  misc_feature (61): n=t or c
aacatttcagaccactcaagcacgttgttcagagcttgcctgtcaaggcttagcacaagtntggccatggttcaccctgtcattagtcttgtggtttttttaagcaatgtttttcttgttc

SEQ ID NO: 31442 - DNA, 121 bp, Artificial Sequence
  Synthesized
  misc_feature (61): n=a or g
atggaaattgttctaaaatgagtagagatggatatccattgcaaggttttgtttggatctngactatgtgtgctgtggactttcatagcactccggcacaccaaggctggagctccaacca

SEQ ID NO: 31443 - DNA, 121 bp, Artificial Sequence
  Synthesized
  misc_feature (61): n=a or g
cctgcaaaccctgctccgagcacataacttggatccagcaccaaacctcgcttaaatcttncattcttcagcctcaaaccttgcttaagtcttgcgtttaccagcaccaaaccttgccacc

SEQ ID NO: 31444 - DNA, 121 bp, Artificial Sequence
  Synthesized
  misc_feature (61): n=t or c
gctgcagaatctggagcgcagtgaagctcagcataaggcagaggtggaatgtatcaaggancaactgaaagaactgaggcagaaggcagaccgtgataaagatgccctgaagagagccctc

SEQ ID NO: 31445 - DNA, 121 bp, Artificial Sequence
  Synthesized
  misc_feature (61): n=a or c
tgcagccctatctgaaaagctttcacgtgtttgcttctgttattaccttcccagatggagnagccacatccatgcgggcagcttcatgacgttgtctcaaatacaggtagctaaagccatc

SEQ ID NO: 31446 - DNA, 121 bp, Artificial Sequence
  Synthesized
  misc_feature (61): n=t or c
tggctgaggaagagtcagaggggattagataatgcttgaagtctgaagtgaaagaaggaanagcgtaagttacagacagatcggatgtgtgagactgagcatgcacttgcttgtttgtgtc

SEQ ID NO: 31447 - DNA, 121 bp, Artificial Sequence
  Synthesized
  misc_feature (61): n=t or c
ttttagccacagaaattctgcagacccaatccacttttctaacttgcaagtccttttgtgnactgccttcttttttcccagctctgaattcccatatggccattttacagcatcaaaacag

SEQ ID NO: 31448 - DNA, 121 bp, Artificial Sequence
  Synthesized
  misc_feature (61): n=a or c
tttgaaaacaccagatctagaagcttgtagatgatacacaataggtcgcaacaataatctnttaaggtcaatcccactgatctgtgtgcaggcacagagtaatgtatataactatttttag

SEQ ID NO: 31449 - DNA, 121 bp, Artificial Sequence
  Synthesized
  misc_feature (61): n=t or c
ctttcactccatgcaattgttacagggatatgcatgcttgctttccgaagaattcagaacnatgtgttttcctaaagtgacacaatgtgtatcaaatggtgttgcttcccataagctcatt

SEQ ID NO: 31450 - DNA, 121 bp, Artificial Sequence
  Synthesized
  misc_feature (61): n=c or g
ggagcactggcctgggttggtacatgttgggaggaagtgtatgtaaccaccattgctactntcttgccagatcagatgtttgcacaatgaattcatagtcaaggttagtaaaggctaatcc

SEQ ID NO: 31451 - DNA, 121 bp, Artificial Sequence
  Synthesized
  misc_feature (61): n=a or t
tcctctctggatcaggctttgcatgtcattccacaagaagggaggtgacattggaaatacngcctgacctagatttctagcactgaagggaaaatgggaaccttcaagctctaacttctat

SEQ ID NO: 31452 - DNA, 121 bp, Artificial Sequence
  Synthesized
  misc_feature (61): n=a or g
tttattaccgttgcaaaagtaggagcaaatgaataaacatgcatgaaaggatcatgaactnttctgaatgtacaagggattacttccaaggcttttacttccttggatttctgagcttgcc

SEQ ID NO: 31453 - DNA, 121 bp, Artificial Sequence
  Synthesized
  misc_feature (61): n=a or c
ttcaagagaagcacaagggaatttctaaggtagagacttgatggatcaataatatgaatgnattgatcaatagaaaataaggtaaaagacacactgacacattatattccattcctataca

SEQ ID NO: 31454 - DNA, 121 bp, Artificial Sequence
  Synthesized
  misc_feature (61): n=a or g
ttgcagctctctccctcccaattcatctgagaaggtgccctcggtttgcccttgctcctcngtgtctcagatctcacacgtttccctggcactgagatgccagcgataatgtcctgagaca

SEQ ID NO: 31455 - DNA, 121 bp, Artificial Sequence
  Synthesized
  misc_feature (61): n=a or g
ttccacacagctggggtttggtgtagttattgggtccctctcctgcactgagggtcagctntgcaagaggatgggctcgagggcaaaaaatccccaacttttctttaaattgtaaaaaaaa

SEQ ID NO: 31456 - DNA, 121 bp, Artificial Sequence
  Synthesized
  misc_feature (61): n=t or c
aaacatggtttcttttccctctacttaatgtagctgttccaaacattattttactaaatgnctgaaattaaacattctctgtcaattatggattatagagatctgctacagtaatgagtgc

SEQ ID NO: 31457 - DNA, 121 bp, Artificial Sequence
  Synthesized
  misc_feature (61): n=a or g
ccctgcctatgtgctccccacacatacatgcatatgtgatttgaagtacaaaccaattttnatctctgacctaaaacagactatttggcgaggttagctacaaatttacctgcaaatccag

SEQ ID NO: 31458 - DNA, 121 bp, Artificial Sequence
  Synthesized
  misc_feature (61): n=t or c
cttctctcctctggcattaacaccatcttccaaagtgttactgcatcagcattgtcttcanagaacttctccagcagagcaaattgattctgaaacactccatgttgttagtttactaatt

SEQ ID NO: 31459 - DNA, 121 bp, Artificial Sequence
  Synthesized
  misc_feature (61): n=t or c
agtaggcaaggccccagctgagctatgcaagctcctgcatctgggccctgtccatgctcanaagatggcctgtaccagctctgacctgtgctgccttgcagtgagatagggaggtattcat

SEQ ID NO: 31460 - DNA, 121 bp, Artificial Sequence
  Synthesized
  misc_feature (61): n=t or c
aagaatgggtttttgatttcttgctcaaattgccccacagtgatactgtatagtgtagctntgtttgtataactgtttcattgcaactgcaaggaagatcggagaatcataaaatgatttg

SEQ ID NO: 31461 - DNA, 121 bp, Artificial Sequence
  Synthesized
  misc_feature (61): n=t or c
atcatctccaataatggacgcccagccttaactttcttcaagtggtctgatttcatccctnagcttcctctggttttcatttactggtagaactgttaaactgcatttttccagtttgctt

SEQ ID NO: 31462 - DNA, 121 bp, Artificial Sequence
  Synthesized
  misc_feature (61): n=t or c
agcacacactgttgagaagttctagaagtaatttaagactgcacaaagcaatcacacagtncagcacggagttttcacagactttcaaatgtttgttcaccacagctaagaacctccgtgc

SEQ ID NO: 31463 - DNA, 121 bp, Artificial Sequence
  Synthesized
  misc_feature (61): n=a or c
ctgtgcttgtgcagttcccagtgtctctttgcttggggtagtagcagagggactgtaatanatacacatacccaggccatgtgccatccagctgcatgtacacatgcacacttcaagcacg

SEQ ID NO: 31464 - DNA, 121 bp, Artificial Sequence
  Synthesized
  misc_feature (61): n=a or g
aaatattcccatcttcatttcattagctggcgatttcccctctggttaagcagatggtgcnccagcagattaggcaatttatagcacagaaggaaaaggtaaacagtgatattataaccat

SEQ ID NO: 31465 - DNA, 121 bp, Artificial Sequence
  Synthesized
  misc_feature (61): n=a or g
actgtcgcatttcagtgctcccaaacgcattctgtagtgaagaggtattctgaatgaagcnactactccaaagcagccacatgtaattagcactactgtgtaacatatcttctgtcctccg

SEQ ID NO: 31466 - DNA, 121 bp, Artificial Sequence
  Synthesized
  misc_feature (61): n=a or g
gccatacaaagagcattgaaataggacaaaacctctacaaaatataaaacccacccctacntattcgcatgaaaagaccacccaccaagcaaaaaagtttcaaaagttatctggaggctct

SEQ ID NO: 31467 - DNA, 121 bp, Artificial Sequence
  Synthesized
  misc_feature (61): n=a or g
atcatcaaaaacgaagaaatacagtgaagaagaatcctctaataaaaagggttttgtttgnctaactgaaattttgaagtaaaaagttttctctctttctgcgatctacagagagaaatta

SEQ ID NO: 31468 - DNA, 121 bp, Artificial Sequence
  Synthesized
  misc_feature (61): n=t or c
agaagtcctacatcatcccattccatatgctgcatgcctgcatatatgaatgaatttatanatgcacaaaaatggaaatgtagagctatctgaaatttcaacacttcaaagaagaaatgtg

SEQ ID NO: 31469 - DNA, 121 bp, Artificial Sequence
  Synthesized
  misc_feature (61): n=a or t
aggctatttttaagaacacagaacataaagcaagaaggtttgggagctgctcctttagaanatagatctagtcctttatgactcatttcagttctttcattacacatttaattctagaaga

SEQ ID NO: 31470 - DNA, 121 bp, Artificial Sequence
  Synthesized
  misc_feature (61): n=t or g
tctgtgttggctgttctagttcaagatcccaggagtgaatggtttgacttttctctcagtnattttcagacttcatgacgagtaggtcatattttcctttcagaacagagggatgggaagt

SEQ ID NO: 31471 - DNA, 121 bp, Artificial Sequence
  Synthesized
  misc_feature (61): n=t or g
cacagtactctggtttattcagtgatctgatctgacaacctttgattcgaatcatagaaanctggaaaactcagttgtattttcaacatccaaagtctgtacagtattgaactatcatctg

SEQ ID NO: 31472 - DNA, 121 bp, Artificial Sequence
  Synthesized
  misc_feature (61): n=a or g
ctgctctttcactgttagtcccttccgagatgtccatatagcagagcaagtgctgtctatnttcaggaaagagtgagcctgaagtacaagtaatgtcacaatggcatttcccaaagcaaga

SEQ ID NO: 31473 - DNA, 121 bp, Artificial Sequence
  Synthesized
  misc_feature (61): n=t or c
agctgctactgaattgctacaaatttatatctgagagtattaaccagaaaggaatggtggngctacttaggctgttgcatggttgtaaaccctgcagatgaggtaggggaaaactttaaga

SEQ ID NO: 31474 - DNA, 121 bp, Artificial Sequence
  Synthesized
  misc_feature (61): n=t or c
tcccaactgctttcttgctttcactgaccagcaaatcccttattatgaaaaagaagcaganttctgatgctgaaggacaccgtcgtcgtgtttcttcacttcttctagctgaatcattggg

SEQ ID NO: 31475 - DNA, 121 bp, Artificial Sequence
  Synthesized
  misc_feature (61): n=t or c
ttattcatgctctctgtattgttgttgcccttgagcgccagttagtgttctttcaatctgnagacaagatgtgattaaatgcaatggtcattctaatgacagttcttgtaggctgttcttt

SEQ ID NO: 31476 - DNA, 121 bp, Artificial Sequence
  Synthesized
  misc_feature (61): n=a or g
tagcacacggtagtttctatcaccagtgtcaagctcttacatatctgtaatataagctcancctaccatgctaaactccagttatgcctatgaacctcattaagaacggggcagtacagtc

SEQ ID NO: 31477 - DNA, 121 bp, Artificial Sequence
  Synthesized
  misc_feature (61): n=a or t
cagaagtttcagtttcctttgtgttcaccaccagatttcccatgccaagtgataacaccantgcaaatttttagacacaagattgaagttcatttcattctgctactatattcccaatcta

SEQ ID NO: 31478 - DNA, 121 bp, Artificial Sequence
  Synthesized
  misc_feature (61): n=a or t
ttgacaattacagaaacatgtaatattcattgaagtgtagaagttagcactgtatttctgnctgggtgcattttgcaacccactacaagttacttttctctgtgattttaagcaatttcag

SEQ ID NO: 31479 - DNA, 121 bp, Artificial Sequence
  Synthesized
  misc_feature (61): n=a or g
tggatggagctggatgtacctacccagggtttgagatgcagcaatgccgcatctttaatcngcattcattttgtttgccatgcatctcaccgtggcagctgacaccctggatggaaccact

SEQ ID NO: 31480 - DNA, 121 bp, Artificial Sequence
  Synthesized
  misc_feature (61): n=t or g
tgagtaaaagtgagtttgatttaggaagttatgcatgcaatggccatgatcctggctgcanttaactgaattttccagctgctacttcacactagtcaagcccaggacattcacaataaaa

SEQ ID NO: 31481 - DNA, 121 bp, Artificial Sequence
  Synthesized
  misc_feature (61): n=t or c
gaagagcttaagtcagtgcagtatctggtaatctgtgtgctttgaagcacatattccctantgccccctgccaccctgatgctgcactcactggctttgataccagatggtacagtatcaa

SEQ ID NO: 31482 - DNA, 121 bp, Artificial Sequence
  Synthesized
  misc_feature (61): n=a or g
tcacagctctgcctgggaaggggtgaagaagcagcaatgattattaaagctatagaaaatngcatcatatagagaaatatgaacacagagctgtcactgttgggacgcatcaggaagggat

SEQ ID NO: 31483 - DNA, 121 bp, Artificial Sequence
  Synthesized
  misc_feature (61): n=a or c
agtctaaacacacttgagtttatatgctgcacacaaaggtaaatcaggccttttagcaaantggtgtcttgctcttactggttaattgatcttccacagagcatacattggaatacacact

SEQ ID NO: 31484 - DNA, 121 bp, Artificial Sequence
  Synthesized
  misc_feature (61): n=t or c
tctattcagaagaggctgttcttagtcatctttgtgatgacttacagatgagtagagctgngtctactaacagccctggagttcaacatagtgaagatgccttttactgcagtagccttct

SEQ ID NO: 31485 - DNA, 121 bp, Artificial Sequence
  Synthesized
  misc_feature (61): n=a or g
aataaaattgatgggacagaactgaagcacaaaggggaaaatgagaaaatcctcatttccnactgtaaacccatggtcctgctcttctcctcacccaagacaatcctaaccatcgctgtat

SEQ ID NO: 31486 - DNA, 121 bp, Artificial Sequence
  Synthesized
  misc_feature (61): n=t or c
attacagcataattcacagaatgaaaaagcagacaaaagaaacatggagcatttttatcanctcaggtagattatttctcaagctgccacagttatgttttgcaaaaccttccagcagaaa

SEQ ID NO: 31487 - DNA, 121 bp, Artificial Sequence
  Synthesized
  misc_feature (61): n=a or c
aatgatttttttgttgttgttgtcctaatgttttggctggcagaaaaattgtctatgtatngcatttctcagtttagaagctaaagagttgaaaataaaattttttactttcatgcctttt

SEQ ID NO: 31488 - DNA, 121 bp, Artificial Sequence
  Synthesized
  misc_feature (61): n=a or g
ggaagtgtcacaggtaaaggtgcgcgaaggcttggaagaagctgtaaggtgtgcaagtgangatcagggaaatgactgaaattggtgctgtacctcagcagggaattgtgaagaagggtag

SEQ ID NO: 31489 - DNA, 121 bp, Artificial Sequence
  Synthesized
  misc_feature (61): n=t or c
ggggggggggggggtgagctacatttagctgagatcgatttccaaattcattttcttgcanggacagctgagagagacctgaaagaaagcattaactgtctggcagaagagaagctgcaaa

SEQ ID NO: 31490 - DNA, 121 bp, Artificial Sequence
  Synthesized
  misc_feature (61): n=t or c
taaaggttgcatcttgcttctctcaccccttcccttggttgcttaggatgagctatgcatnacaagagcaggcactgtgcagttctagccaagaatcccaagctacattcgcaaatgcact

SEQ ID NO: 31491 - DNA, 121 bp, Artificial Sequence
  Synthesized
  misc_feature (61): n=a or g
atggcctgcatagctacaggtgaaataaatgctccgaaaattatccagctggctccttcgngcagctgctgcgctgacactgcctcacagtgccccatgacctgcagaagagctggtggca

SEQ ID NO: 31492 - DNA, 121 bp, Artificial Sequence
  Synthesized
  misc_feature (61): n=a or c
cttccagggaggggacattcactacctcgctgggcaagctgttccaaatgttccttcttcntcagttcccagctgctgttttgctttttatacctttagtcccattcagtatcctgtccat

SEQ ID NO: 31493 - DNA, 121 bp, Artificial Sequence
  Synthesized
  misc_feature (61): n=t or c
acccttttctttgcagaaatatacttatttctataaagaagctcatggcaatgtgtgcatngctacagctacacaaccatgctgactgggctgcattgattgtgtcagtggcttgttcctg

SEQ ID NO: 31494 - DNA, 121 bp, Artificial Sequence
  Synthesized
  misc_feature (61): n=a or g
ggaataaaattgtacaactgtttttgttgtaacataagtgggtttttaacttcttgattcncagatatctatatacgttttccagtggcacatggaatagctttgattttagttactgaat

SEQ ID NO: 31495 - DNA, 121 bp, Artificial Sequence
  Synthesized
  misc_feature (61): n=c or g
ggcagttagagaaagaaggtagctcctacatttccaaaaactgaaactactaggaaagaanggaaacagtgacatcccatgagacttatcccattggcacagaaggaaaaagattaggctt

SEQ ID NO: 31496 - DNA, 121 bp, Artificial Sequence
  Synthesized
  misc_feature (61): n=a or t
acgcagatacagactttcaaagattggataaaataggtagaacttctgctgttttatggcnaattccctaagcataaggagagataggcactcctgtcaactgccaagtgaaaggaaatat

SEQ ID NO: 31497 - DNA, 121 bp, Artificial Sequence
  Synthesized
  misc_feature (61): n=a or c
atacccttacaaacagcagtgcagcacttcaatgcctttaagcactgctgcacagttctcngcaaatgagagctgtcaggactaaggcaacctgtagctcttaattgtaaaagaaggaaac

SEQ ID NO: 31498 - DNA, 121 bp, Artificial Sequence
  Synthesized
  misc_feature (61): n=t or c
gttcatatctgacagtcttccttttggttttattttctgtttttgcattctaacgttaggncagcttcttaataagtgttgatttgcatcagttttggtggagcttggctgacatttaact

SEQ ID NO: 31499 - DNA, 121 bp, Artificial Sequence
  Synthesized
  misc_feature (61): n=t or c
aaacaattgggcagaagctgttccttaagggcgactaagactgactcagtcactacagagngtttctgttcttacatctctagagggccagtcatagtagtctcacagggtcaggttgggt

SEQ ID NO: 31500 - DNA, 121 bp, Artificial Sequence
  Synthesized
  misc_feature (61): n=a or g
agacagtcagacaagtgatatcaaaaaagccacagcatcctgatgttggaagaggtatccngaaccacacggacccattccttacctccccactcacatcaatacacgtgcaagggatgag

SEQ ID NO: 31501 - DNA, 121 bp, Artificial Sequence
  Synthesized
  misc_feature (61): n=t or c
ttgcacacaagctgcgtgcacctgaactcctgtacaagtggaagcagcaagtcggcagagngggatttgcagatagctctggtacgaagtggtgcacaggttgtgttttaaagtctagaga

SEQ ID NO: 31502 - DNA, 121 bp, Artificial Sequence
  Synthesized
  misc_feature (61): n=c or g
aatgttgatatctttttttttttttttttaacttacggaactggtactatgtaattgtgtntcagcttcccagtttctaacaggattttcccaagaagagactctcattgttcccttcatg

SEQ ID NO: 31503 - DNA, 121 bp, Artificial Sequence
  Synthesized
  misc_feature (61): n=a or g
attttgttttatttttctcttctcttctttaagaggggatattgacagtgtaaaaagatcngtagttaaggatggaacattaaagcttatgtggtctccagttacaacaaatagccacata

SEQ ID NO: 31504 - DNA, 121 bp, Artificial Sequence
  Synthesized
  misc_feature (61): n=t or c
aactagttatgtgattcagttgccttgtgttgaaattaacaggagatgcatattatgagcngtcaagtacttttaagacatttattccattaattttttcttcttaaataaacacagccat

SEQ ID NO: 31505 - DNA, 121 bp, Artificial Sequence
  Synthesized
  misc_feature (61): n=t or c
tctgtaaggtaagcattcagatcatctcttctttttgctgtgtggaggtagtaaatgtttntatcaggacagccaattaagcagccattgtgcactgaatacggtatatccgtatatgaac

SEQ ID NO: 31506 - DNA, 121 bp, Artificial Sequence
  Synthesized
  misc_feature (61): n=t or c
ttttggcatggaatcctctttgcagtatatctcatctaccactagtgtgttttctgaatgnccctgcctctatttctcttatcatcctactaccaccacctttctctctttttgaggccct

SEQ ID NO: 31507 - DNA, 121 bp, Artificial Sequence
  Synthesized
  misc_feature (61): n=a or g
aattgcacactactgatattagcttttgatgcaatggccaatctctattaaatccaaaagngtcatggagtttcagataacagcaacatatacactctgtctagctcattttgcttctgtt

SEQ ID NO: 31508 - DNA, 121 bp, Artificial Sequence
  Synthesized
  misc_feature (61): n=a or t
aggtgtgatagtaatttgcatttcaacagaactcgttatctaagccagaacactaacaagnactaactgaacttcacaagatgattgtgaattgtgttagtgtagtcaatacagcaatatt

SEQ ID NO: 31509 - DNA, 121 bp, Artificial Sequence
  Synthesized
  misc_feature (61): n=a or g
ccccaccactcgctacacactgcacttgttatggtgcataaccatgtatatactcataacntggcttgtgtctttccacctgcttgaaagtgctgcattcatttaggtattttccaccttg

SEQ ID NO: 31510 - DNA, 121 bp, Artificial Sequence
  Synthesized
  misc_feature (61): n=a or g
tttttatttttgatagctcttaaaaaacatttctattaaattaataggattaacatggtangttaagtttcttctcttacagtaggcagctaaagctgttaaacttacctttcctgtaaaa

SEQ ID NO: 31511 - DNA, 121 bp, Artificial Sequence
  Synthesized
  misc_feature (61): n=t or c
aattcttcatgttatcaaatgcagaagagacaaagctggacttccataatcatggtgaagntgggaaaatgcaagacttggggtacattaagaaggaatgggccctttccctttttctctc

SEQ ID NO: 31512 - DNA, 121 bp, Artificial Sequence
  Synthesized
  misc_feature (61): n=a or g
aaaggttacaactataaaaatatgaaggaataagaattaaaagcctttagtctaagtgacnttttgttgtgcaactctttaccagttctgagtgtaaaaaactacgagaatcccttttctc

SEQ ID NO: 31513 - DNA, 121 bp, Artificial Sequence
  Synthesized
  misc_feature (61): n=a or t
atacaaccacagattgaaatacaataataggattagcttaatccaaagacagataaagctnaacatttttgtaagacataactgtaccttgtcttatagccagacagttcaaggacagatt

SEQ ID NO: 31514 - DNA, 121 bp, Artificial Sequence
  Synthesized
  misc_feature (61): n=a or g
atcagatgtaccactgcaaaatcaagcagttgttttctctcttataaattcttattggccntgaggactgtccctgtcattcagtgatcacttgttttttctaatagccttagctctcatt

SEQ ID NO: 31515 - DNA, 121 bp, Artificial Sequence
  Synthesized
  misc_feature (61): n=t or g
ccttctctgtcaccacactacccagactcatgaaggttccacttcttcagtgaggaccatngtgtatggctcttggccatcctgccagctgtgctgtgtgactgttgctaagcacccatag

SEQ ID NO: 31516 - DNA, 121 bp, Artificial Sequence
  Synthesized
  misc_feature (61): n=t or c
caattcagttatattggaattacatcagtttccattacttcgagcgtgacttctgctgttnggtgaacactgtagcaacacaaaggtgagtttctggaagcaaatctgaacttttctgcaa

SEQ ID NO: 31517 - DNA, 121 bp, Artificial Sequence
  Synthesized
  misc_feature (61): n=a or g
agtccatggagggttctgctgtgttggctgacttcactaagcaatattctcatgtggaaantgcgttacagcaattggcatcagcaaagcaactggaagaatgtgccgtgtcctatgcgtg

SEQ ID NO: 31518 - DNA, 121 bp, Artificial Sequence
  Synthesized
  misc_feature (61): n=a or g
tcacacctccatgccatatttctggggagggtgggtgttctttttgccttttattccgacngtccgtgtgtaaatgtaaagttaaatgctgctaccaaacaccccaaaggctttgcaaagc

SEQ ID NO: 31519 - DNA, 121 bp, Artificial Sequence
  Synthesized
  misc_feature (61): n=t or c
gaagggcctaaattgaagttcttggcaagtggttagagacaacccaaattaaagcctcccngagggaaagatggttaaagtcatatcctttccatcctgccagctggtcactcagtatgca

SEQ ID NO: 31520 - DNA, 121 bp, Artificial Sequence
  Synthesized
  misc_feature (61): n=a or g
agaccaagtctggtagagaagacaagtcatctcctcagttgcttgaaaggattaagaagangatgcagtcagcaattagtagatacacataacatttgcctggcatctggcagaatggaat

SEQ ID NO: 31521 - DNA, 121 bp, Artificial Sequence
  Synthesized
  misc_feature (61): n=a or c
tcatcatctattattaaagcaaaacattattttttacttttaaatattctctgaaacattnttccacgtggtcaagatcacctgatccatggtctatgaagctggaagtctcagcaactct

SEQ ID NO: 31522 - DNA, 121 bp, Artificial Sequence
  Synthesized
  misc_feature (61): n=a or t
catgtgtttcttttccaacacagctctttcatccttcattttcatgactttctaaccaganctgatatttatcctaatgaacttcattaaatgttatttatgttatacaactagtaaattt

SEQ ID NO: 31523 - DNA, 121 bp, Artificial Sequence
  Synthesized
  misc_feature (61): n=t or g
aatcagggccaagaaacaacacagaactcacagacactttgctctgagcctcccagcaaangtctgtgaatgcagaattttgaaatacgcttcagaaaagagcagacagagcccatgatcg

SEQ ID NO: 31524 - DNA, 121 bp, Artificial Sequence
  Synthesized
  misc_feature (61): n=t or c
tgggataatccgtggtataaatgattagtctaagaagttacatgaccacgtaatcaagtgnagtctttaaactgtcataaggataagcaagaatttatcctaaatggctgtttaaggtcaa

SEQ ID NO: 31525 - DNA, 121 bp, Artificial Sequence
  Synthesized
  misc_feature (61): n=a or g
agaagcacaccaggttttctgaggtggcaagccaggctgatggagaaggcttttcacaganctgagctctctgagggaattagcaatagggcaagagataatggcctgaaattgcaccaga

SEQ ID NO: 31526 - DNA, 121 bp, Artificial Sequence
  Synthesized
  misc_feature (61): n=a or g
ccaggaacactttgtctgaatagtcacttattatatgtaggctggctggtcttggatgcanaaaaggtaatgtgaaatcaagaatagtcttttacagtgtctcccctgactgcctctcttt

SEQ ID NO: 31527 - DNA, 121 bp, Artificial Sequence
  Synthesized
  misc_feature (61): n=a or g
attaccattgagctcaggcaagtcctttggacagcagtctctgtgtgaagaggatagtggnatgagcactgagcacaaaccagctcttagcacctctggtttcctttgttaatgagcgaag

SEQ ID NO: 31528 - DNA, 121 bp, Artificial Sequence
  Synthesized
  misc_feature (61): n=a or g
ctgccttgataaactgactcccagccactgataatctcgttcttccatacaagtcttcccncagtactccccgctcggatggcctaggacacaaaaaccaatgctgagcatgaggacaagc

SEQ ID NO: 31529 - DNA, 121 bp, Artificial Sequence
  Synthesized
  misc_feature (61): n=a or g
tttagtttgcagatgacttcaaactgtgatggcacatgtgtaagaagtgttacacctcccntaaaaacactgagtagaaatgactacagcctatggctaatagcgtagaactgcatcttac

SEQ ID NO: 31530 - DNA, 121 bp, Artificial Sequence
  Synthesized
  misc_feature (61): n=c or g
ttctacaagtgataagggaaaaatatattttgtcgtgtgtattgccttctaaacagcccgntctcttgaggaagctttgttggagtaaagcatgctacaagcattattttgatagtctatt

SEQ ID NO: 31531 - DNA, 121 bp, Artificial Sequence
  Synthesized
  misc_feature (61): n=t or c
gagcagcattctgggaatgggatgacagagtacagcagagaatggcagatggctgcacaanggtcttaagccatcacagccagcaggaagcccaaaaagtcaaaaatgaacacctgggctg

SEQ ID NO: 31532 - DNA, 121 bp, Artificial Sequence
  Synthesized
  misc_feature (61): n=t or c
ttgattggttcattttgtttgttttgctgaaagtcagcctccaactcaggataaacttganaggattagaggtaatggctccaattacaccagggaggttcaggttggatatcaggaaaac

SEQ ID NO: 31533 - DNA, 121 bp, Artificial Sequence
  Synthesized
  misc_feature (61): n=a or g
gggaaaaaaaaaaaaaaaaaaaaaaaaaaagaaaagaaagcaatattaacagccagctacnaaggtgtcattccatgatccaaaccagagaggacaggaagaccgagcaatcattttttat

SEQ ID NO: 31534 - DNA, 121 bp, Artificial Sequence
  Synthesized
  misc_feature (61): n=a or g
caccttccaaataaccttagctgccttttttcttttaacttgagaaagaatgtaattttcnaagatggctaaatgaaatgcccattttgctgacctgcttgagtaaaagtagttgcctgca

SEQ ID NO: 31535 - DNA, 121 bp, Artificial Sequence
  Synthesized
  misc_feature (61): n=t or c
aaggtctatgccacccttgttggctgttttactgggatcaaataacatctgctcaatccantggaagaaatccgttgggaattcagccactctcaggtttagtcctccaccagtccagtca

SEQ ID NO: 31536 - DNA, 121 bp, Artificial Sequence
  Synthesized
  misc_feature (61): n=t or c
tactctttgaatgtctcagtgtcactctccggactaatgatggtgatgggaacggttgcgnggggtggatcgcagctttgatcctccgctggagatgaggaagtgctgtccctgcgctggg

SEQ ID NO: 31537 - DNA, 121 bp, Artificial Sequence
  Synthesized
  misc_feature (61): n=a or g
attggataaacacagtcctacgagcagtgaaaatcagccatgcttgataaaggagtttgcnaatagatttcaagactgttgaaaaaactgccttttttttttttttttgaacatgtgactc

SEQ ID NO: 31538 - DNA, 121 bp, Artificial Sequence
  Synthesized
  misc_feature (61): n=t or c
agacatggttttctctgtgagaggcagtgcattcaatccagaaggatctttgtcatgcttnagcaatatctgtacagttgtggtgattagcctttatctctgcctccttctcttttgtaat

SEQ ID NO: 31539 - DNA, 121 bp, Artificial Sequence
  Synthesized
  misc_feature (61): n=a or t
caaaatctggtatctgttatggttttggacatgttatagaagggaacaaaatcagaactanagtacaatttcaagtgtaacaaccatggaattattgttaatgcttcacagtatttaccaa

SEQ ID NO: 31540 - DNA, 121 bp, Artificial Sequence
  Synthesized
  misc_feature (61): n=a or g
atctctccagtggaaaggcataactgtgatttaagagctcagccatttgaaagaccaaccnggcaaccgtgatctattcccaccccacaaatgaggatgttgctaaggcagtttctcaatt

SEQ ID NO: 31541 - DNA, 121 bp, Artificial Sequence
  Synthesized
  misc_feature (61): n=t or c
agaaaacagaactgtgtgttctcttttagatttgaaaaaatgtgggcaagtacaaaaacanaaaacatccgtggtgtgttcggaaacactctttttaaaaactgtccattatttgagtgtg

SEQ ID NO: 31542 - DNA, 121 bp, Artificial Sequence
  Synthesized
  misc_feature (61): n=a or g
tacgagcgccagttcatgagatatgggtttggtacagattcacccctattcctttggaaantcctatgaaatgcacttggaaaggtgtcggtgaggttttacagcaggtaattgaggtgca

SEQ ID NO: 31543 - DNA, 121 bp, Artificial Sequence
  Synthesized
  misc_feature (61): n=a or g
tatatgtaggtactcttgatatcaccttgccttgcatctgttctcaagcttctgtcacacntgatccttgcttgtggaatggcctcatcaagaaggaactggagtactttatgctttatga

SEQ ID NO: 31544 - DNA, 121 bp, Artificial Sequence
  Synthesized
  misc_feature (61): n=a or t
agtgtcagaaatgtagcagtaccctcatgtattcatctatgccattgatacttcatagtanaaatttgtagagtttaaaaatcaaaatgctttctgaacttaatgttctgcctagaaacaa

SEQ ID NO: 31545 - DNA, 121 bp, Artificial Sequence
  Synthesized
  misc_feature (61): n=t or c
tatatgtccaagtatatggctaaaagtttgttagcccagcatatccacagcacagctctangatttctgtacctttaagtgactaaagtatgaatagcttggcccagttttacaaagtgat

SEQ ID NO: 31546 - DNA, 121 bp, Artificial Sequence
  Synthesized
  misc_feature (61): n=a or g
tgttaagactatgagttgcaagggaggcaccgcatcagccttcttcagcctctttttgccntggattacaacagcagggaaagaatcacataggcagggagtaaagaggggaaaagtgcac

SEQ ID NO: 31547 - DNA, 121 bp, Artificial Sequence
  Synthesized
  misc_feature (61): n=t or c
atatcaaactcaacacactcaggtgccaaatttgattcttaactaatgccaatgtctcacntttcaggcataaaaataaccaaatgcaaatgctttattttgtttttcactctacaaccat

SEQ ID NO: 31548 - DNA, 121 bp, Artificial Sequence
  Synthesized
  misc_feature (61): n=t or c
taaaaacatacctggaaaattaacatctctgatttaaccttcatacatgcagattcaatgngtatcagttaatgcaagtcactggaatatacacgaggatacgagaacagcaagaccacca

SEQ ID NO: 31549 - DNA, 121 bp, Artificial Sequence
  Synthesized
  misc_feature (61): n=a or g
agggggctttttcagggctagagatttactgaaacctgttttctagcaggggttttcaacntctacgtctccttaacaaagatatatgccaggattaaaggatcttgagttaacctcccca

SEQ ID NO: 31550 - DNA, 121 bp, Artificial Sequence
  Synthesized
  misc_feature (61): n=t or g
tgacacagcagtactgtacgtggtagtggtcatcccttctgggctcttcactagcaggtangcgtcatcccaaagggattaaacacaggcttacacagtgaccacagtgcttgccatttat

SEQ ID NO: 31551 - DNA, 121 bp, Artificial Sequence
  Synthesized
  misc_feature (61): n=t or g
gcgaacctgctccccccgggttcctgctcctctagcgtgcaaaagttgtgccagccttagnatgccattcggcttccaagccgagatgagatactcacaccgcccggcttctgtgccacca

SEQ ID NO: 31552 - DNA, 121 bp, Artificial Sequence
  Synthesized
  misc_feature (61): n=a or g
ttggagagggaggggagccttcctgaaactgaagaaatgttagtttgtattaaatacctanaagtttagtgctgagtccccttctcctaaataaatgctgtggaatattatgtgcaattac

SEQ ID NO: 31553 - DNA, 121 bp, Artificial Sequence
  Synthesized
  misc_feature (61): n=a or g
tcccgcagaggctgtctgataagcttgtctgtccctcatacctacccaggcactttgctgncagcacacgatgctcttagaggaattctccagaacttctgcccgcggccataaatgcggt

SEQ ID NO: 31554 - DNA, 121 bp, Artificial Sequence
  Synthesized
  misc_feature (61): n=a or c
gcccctttaaaaataacctaaacaagtgattttcgggaaagctgtgacaggatcaactctncctttcatgcatgtaagcacacaggtttagtgaggtcactcctcatgataatttgcttca

SEQ ID NO: 31555 - DNA, 121 bp, Artificial Sequence
  Synthesized
  misc_feature (61): n=t or c
tataaaccgttcagcgctgtacagtttgaaatgctgtgcccaagctcagcagggcctacanacaagatgcaaggatgcgggaagcagctaggatgaatgggctctgcttccctagctcttc

SEQ ID NO: 31556 - DNA, 121 bp, Artificial Sequence
  Synthesized
  misc_feature (61): n=t or c
cattgatactaatggacattaccaagtcattgtaacaagatcgttcacatctcttgttttnccaaatggcgttgacagaaaagatgcaggattttacattgtttgtgccaaaaacagattt

SEQ ID NO: 31557 - DNA, 121 bp, Artificial Sequence
  Synthesized
  misc_feature (61): n=a or g
tcttcagaaagtggtggaagtaaatgtggaggtaccgagggtggctctgaataaaggagcncttcagtaaaggtctgctgtgggtatccaaatatctgctctgtgaaacgctgcgccctgg

SEQ ID NO: 31558 - DNA, 121 bp, Artificial Sequence
  Synthesized
  misc_feature (61): n=t or c
tgagtcatctgtgatggagaatttgaggaaaggtggggttattcttagttgcttctctctngggagttattgagctgccagtcacattggcttaaaatatacttctctatatcttaatgtg

SEQ ID NO: 31559 - DNA, 121 bp, Artificial Sequence
  Synthesized
  misc_feature (61): n=a or c
gcaaggaatacactccgtgttttcatcacttcaaaaccatagttatttatataagactganacagcctatttcacgttacctgaaactgcaaaagaaagaatcttagaagggagctgctga

SEQ ID NO: 31560 - DNA, 121 bp, Artificial Sequence
  Synthesized
  misc_feature (61): n=t or c
agtaattagtaaggccataattagagccatcagcagtacagttctggataagtacttcacnttgctgaatgaggcagctaacaccttgcacagccattgctttgggctgctgcttctttgt

SEQ ID NO: 31561 - DNA, 121 bp, Artificial Sequence
  Synthesized
  misc_feature (61): n=a or g
aagtgaggccattaactgctatgcaaagaactcacaagagctggtaaatctctttaaaagnacaacccaagccatctgacactacctccaaagtattctcacaagctttacgccatttgtt

SEQ ID NO: 31562 - DNA, 121 bp, Artificial Sequence
  Synthesized
  misc_feature (61): n=t or c
ccatgaggcaagagtctcccaagaacagttaagctcagtatcctaagagcttggtgaatcnaaggcctttagcacatactagaatcaattaatcagtgttagcaccactccgaccataccc

SEQ ID NO: 31563 - DNA, 121 bp, Artificial Sequence
  Synthesized
  misc_feature (61): n=t or c
ttgcttgacacttccatcttgttctgatggcagcctatcaccccagaagttctccaactgntatgaccctatgttaactcagagattaggaaaaacagtacttaatatttcaattatgcct

SEQ ID NO: 31564 - DNA, 121 bp, Artificial Sequence
  Synthesized
  misc_feature (61): n=t or c
ggtgtgatgaacacaactgaagtgctaaataccaagaaaataaggaagggccatattgggngagtctatatgtttatctacctgaacatgccatctctgacaattgctaaacacaaataat

SEQ ID NO: 31565 - DNA, 121 bp, Artificial Sequence
  Synthesized
  misc_feature (61): n=a or g
ttctgtacttacactgcccttcttcaaagctgactgaaaatggcactttaagcaggccagntccttagagcattcaatgttcattcacagcttgaatttaaaactagccttctcacttgca

SEQ ID NO: 31566 - DNA, 121 bp, Artificial Sequence
  Synthesized
  misc_feature (61): n=t or g
cctggtagtgtgatactaccttgaaaaacaaaccaaacccacatcctcctcttcagtctcntcttgactattcaacagccagaaaattcaagaatagttagtacagaaagcagaccaacca

SEQ ID NO: 31567 - DNA, 121 bp, Artificial Sequence
  Synthesized
  misc_feature (61): n=a or g
tcacttgcttcctgctcagtgccccttggatatacacctaaattaattggcctccacaggnctggagttgttctgtctgtttatattcagatatgctccaatgaaacaagtgtgggacacc

SEQ ID NO: 31568 - DNA, 121 bp, Artificial Sequence
  Synthesized
  misc_feature (61): n=a or g
aaggttttgtaaagggaatatggagatgccagtcttggcttagccaaagtgtgtgaccacntgccctggtctccactggtggtgtcatggacatgtcccagcaaaggtcatacagccagaa

SEQ ID NO: 31569 - DNA, 121 bp, Artificial Sequence
  Synthesized
  misc_feature (61): n=a or g
cagcactgttctatgtgacttcttccacctcatcaccctgcatgcagcaagctcagacaanacgagaggtatcccttggtcagacccaaagtgggcatcaggaatacagtgtgaagggagc

SEQ ID NO: 31570 - DNA, 121 bp, Artificial Sequence
  Synthesized
  misc_feature (61): n=t or g
ggaaaaaaaacaagaagaagaagaaggctcaaaacaagtgatgcattacatgatcactcancactgatacctagctcagtccctgagcagtggcagacacgcagccaactcgcccagctct

SEQ ID NO: 31571 - DNA, 121 bp, Artificial Sequence
  Synthesized
  misc_feature (61): n=a or g
agcttgacagctggccaaataaaaaggggcacggcaaatgatcactgctcagcagagtgcnagccctgtgcagaaagctagaaatgctctcgtggctccctaacttggtgactaaaaagaa

SEQ ID NO: 31572 - DNA, 121 bp, Artificial Sequence
  Synthesized
  misc_feature (61): n=a or c
gtagaccaaacacatgggacataaatcagaacaaactaaccacagaagaaacatggctgcnaaggaagattttattataataaatcgtacatttgagatgtgtctgagtggaacatgtcga

SEQ ID NO: 31573 - DNA, 121 bp, Artificial Sequence
  Synthesized
  misc_feature (61): n=t or c
tttttttcttctcatataccataattcattgcagaaacctgagactccctttttagtaatntgttaagtcaacagacagcttttttattattattatttagtacaacaacagatctgccta

SEQ ID NO: 31574 - DNA, 121 bp, Artificial Sequence
  Synthesized
  misc_feature (61): n=a or c
gaaggtaagctttcaccctggaattgctggggttattcttcttaaagaagatgcaaccaanccatgtatctgcatgccagacagggtcaggtttggtccggcccaacttttgcaggtctcg

SEQ ID NO: 31575 - DNA, 121 bp, Artificial Sequence
  Synthesized
  misc_feature (61): n=c or g
aagcactggtgcaagtagtacaaacacatctagagttctagagtgacggaacacaaaaaantgcttcctagaggtacctgaaagggtctcaatcctgaaaaataaagtgcttttcttatcc

SEQ ID NO: 31576 - DNA, 121 bp, Artificial Sequence
  Synthesized
  misc_feature (61): n=t or c
ctaaatgataggctctgacccagttttcatcacatctctggtctggtattctgtatgcctngatccagatgtgcattggtgctgtgaagtagcctaactgtaccaacagctgatcaaaaat

SEQ ID NO: 31577 - DNA, 121 bp, Artificial Sequence
  Synthesized
  misc_feature (61): n=t or c
tatcagtggaataaccacatttaatttggaaatccaaagcttgttagaaactacctagtgnagatccacaggcagtaaccgtgtttttaaggtggccttgatttggggacttcattccgtt

SEQ ID NO: 31578 - DNA, 121 bp, Artificial Sequence
  Synthesized
  misc_feature (61): n=t or c
tattttatgagagattattcaattaacagagatgcttctaagcttttaagtatctgcactngtcttgtgcagatcttctgtagtttccaaacactattaaattctacagtgtgacctgaga

SEQ ID NO: 31579 - DNA, 121 bp, Artificial Sequence
  Synthesized
  misc_feature (61): n=a or c
ccgtcttaaacctattactcatctataaggaataaataactggtcatgggacttttttttntgtttgtctgtacttccctgggtacttttattgtttgtctgtgctgctactggtacatct

SEQ ID NO: 31580 - DNA, 121 bp, Artificial Sequence
  Synthesized
  misc_feature (61): n=t or c
ggttccagagcccactgtggtttttttttggcatatcccatgcgtgaagatgtgatgtcantccttatttctccctccagttgcccagcgtggctctggtaaggactttgttcttcctgaa

SEQ ID NO: 31581 - DNA, 121 bp, Artificial Sequence
  Synthesized
  misc_feature (61): n=a or g
gtttgaatggttacatggaagcattcagataccataatcacacactcactgtagaagaccnatttggctggaatagacagttcccaagattacaaagacaaaaactggaagaaaagaatta

SEQ ID NO: 31582 - DNA, 121 bp, Artificial Sequence
  Synthesized
  misc_feature (61): n=t or c
gccataaaaaaaaaaaagatgaaataaaaggaagacatgacgaaagttaaagaaaggaagnttcatttaatggagaatgagaatgccattgaaaactttgaatccttgtacaaaacatcag

SEQ ID NO: 31583 - DNA, 121 bp, Artificial Sequence
  Synthesized
  misc_feature (61): n=a or g
aaaaaatatggccttttccttaaagaattgtaggcaactctgcagtaagtagagagaaccnagcaacctttacacaaacacaggtatattcactgaaaacaaccttgaaattttatcaaaa

SEQ ID NO: 31584 - DNA, 121 bp, Artificial Sequence
  Synthesized
  misc_feature (61): n=t or c
attttcagactcctttctccttcctcactgcaggactgagggcagtagcacagctggctcncagctcagcccttattaccaacaccaattattggttagaaaaccctactgttagtatctg

SEQ ID NO: 31585 - DNA, 121 bp, Artificial Sequence
  Synthesized
  misc_feature (61): n=a or t
gtcatctccactcgagcttttttaatttttcattttattttttgtgtacagtttcatttcntttggcaccagcgagcttaataatatagctgggtgaacaacgtatcttaacgaacaattt

SEQ ID NO: 31586 - DNA, 121 bp, Artificial Sequence
  Synthesized
  misc_feature (61): n=t or c
gagcagggagcctctttttagcaggaggctggaccaggaggcacttatgatgcactgtttnggcaaaccacatgcttaggatgaaggggagaggagacccttccaattcctccattccttt

SEQ ID NO: 31587 - DNA, 121 bp, Artificial Sequence
  Synthesized
  misc_feature (61): n=t or c
aacgccaccccaggatgcagctcaagaaatgttctccagctggaaaacgtatcacttcgcncaataatactgctaaatgtcaacctgtactgaaaatgccacactaacattataacatatc

SEQ ID NO: 31588 - DNA, 121 bp, Artificial Sequence
  Synthesized
  misc_feature (61): n=t or c
gaaatgcaagaacacagcctagttcccacgtccaacaggagagaaggagaaatgaagacangattccagccctataccatcccctcacatcccaggctctggaatactcacttggaataga

SEQ ID NO: 31589 - DNA, 121 bp, Artificial Sequence
  Synthesized
  misc_feature (61): n=t or c
gctgtatatcttgcaaatattgcagcctgaactctgtagctgcccagaaggaacataaaangtctgcagatgttgagaatgtgaaatgtttcctatctcttaacctttgcctctcctcaat

SEQ ID NO: 31590 - DNA, 121 bp, Artificial Sequence
  Synthesized
  misc_feature (61): n=a or t
tctgtgtccttcacatttcctcagtagtgtagtgaagaattctgttcatgttttactctgnttctttaaatagcatttttcttcactactaacaaccaaactaaacatttactttgtgcta

SEQ ID NO: 31591 - DNA, 121 bp, Artificial Sequence
  Synthesized
  misc_feature (61): n=a or g
tagctggcagaagtgtgaaacctagtggaaatggagcagagcactggttactgtctggttngagcctgcattgttgcgttagtaacaaactgagtttatgcactctcctagatgcctatgc

SEQ ID NO: 31592 - DNA, 121 bp, Artificial Sequence
  Synthesized
  misc_feature (61): n=a or g
gggtagatgctcccagtcctagagcacgccatactatggtaggagttagagcttcctttcntatcgcattcctacttctctttctcctgaagaaccaagcagcatttcaaacatgcctagg

SEQ ID NO: 31593 - DNA, 121 bp, Artificial Sequence
  Synthesized
  misc_feature (61): n=t or c
aaggggactatgtagactatgtgttggactgcgacaaccctcaacatcccacattcttccngagtacaaacaccataatcagacatactgatctactttctctcatgtgttcttcattcag

SEQ ID NO: 31594 - DNA, 121 bp, Artificial Sequence
  Synthesized
  misc_feature (61): n=c or g
caaggcctctggaggcattggatgctggtggttaggcaaggtgttggtgataatgggctgnctttctgtgcagggctgtttccccttcttccctgcagccctgtctgcctggggctgctgc

SEQ ID NO: 31595 - DNA, 121 bp, Artificial Sequence
  Synthesized
  misc_feature (61): n=a or g
aacgtgtaacacaagaagaaacagttatgtgtcaaggcaaaaattagggtgacttgtgaanaaatgccattggaaatacttaaattactcacaatagtatggtgaaaacatggacatgaat

SEQ ID NO: 31596 - DNA, 121 bp, Artificial Sequence
  Synthesized
  misc_feature (61): n=a or c
gtagtcactgttaaccaagttcaaactacctggggagtgactcgctgagatacacaagacncgctgccacacatgggacaccacaagatgaatttagtattaaacctttctatccccaggt

SEQ ID NO: 31597 - DNA, 121 bp, Artificial Sequence
  Synthesized
  misc_feature (61): n=a or t
caaaaatgttcatgtctcttatatgaacacttgtatcctccactggaatgtctaacaactnattcctgaaattacaatttctttaactagcattaaactacccaacgttctctgaagctta

SEQ ID NO: 31598 - DNA, 121 bp, Artificial Sequence
  Synthesized
  misc_feature (61): n=a or g
gtactgacatcagggaccagcacatccatcccaggccctgtggaggtggaaaatctatcanttcctgcctttgcaattcgactactttgctccaacccacggcgtgtgtccagccagatgg

SEQ ID NO: 31599 - DNA, 121 bp, Artificial Sequence
  Synthesized
  misc_feature (61): n=a or c
gttactgtttttacgttcttaacatgcagaggcttgcagtaaacaacaggtaggaaagggntagtgaagacctaatgattactgcattaacagtcagatgtgcctgttggttgaaaaagat

SEQ ID NO: 31600 - DNA, 121 bp, Artificial Sequence
  Synthesized
  misc_feature (61): n=t or c
actatcaggcagaggaaggtagtattcagatctctgttattattgccatacgctttccgangcttccctttttgacatttttacttctttttttgttgcagcagaacatgtgttctcagct

SEQ ID NO: 31601 - DNA, 121 bp, Artificial Sequence
  Synthesized
  misc_feature (61): n=a or g
gggatagtgcgttatttgtcataattcagattcctccctgggggccattagcagccaaacnctatcctagaatgtcaccttttctaactgtgtaggcatcatagcactgcaaagaagtgca

SEQ ID NO: 31602 - DNA, 121 bp, Artificial Sequence
  Synthesized
  misc_feature (61): n=t or c
actccatcctctaagagtcactttcctcagatgtagaaataaggaagaaaatgttgcgtangatccctcaatagcagagaaaactactggaagtttgtgcagtatgctgttttctataaag

SEQ ID NO: 31603 - DNA, 121 bp, Artificial Sequence
  Synthesized
  misc_feature (61): n=t or c
taattccaaatcacaactacaaataaataatacagaagaatatatacagcaccctgacttncaaatgctcatccaggtgaaagatctcaatgaagaggatttcctgttttttttttttttt

SEQ ID NO: 31604 - DNA, 121 bp, Artificial Sequence
  Synthesized
  misc_feature (61): n=t or g
gcttttgaacagtattttatgtaaattatgatttttgaatgttttgctagctatgggaatnaagttttatctcttctgaacattctctagaagtggcaaatatataggccggagattcttg

SEQ ID NO: 31605 - DNA, 121 bp, Artificial Sequence
  Synthesized
  misc_feature (61): n=t or c
cagcaagcctaaggagccatgcaaggttgtgctcaagcagagaagtcttggcagaaaaagnctcactggctgttagctacttctgtataggaaaataaaaggaagttgtgaagcttcaagt

SEQ ID NO: 31606 - DNA, 121 bp, Artificial Sequence
  Synthesized
  misc_feature (61): n=a or g
actattgacaaaaaatctttaaaatcaaattaaaagtaataaaatcatgtaccaaaatgancacctttgaaaatagctacacagcataacgcccagtgccacgctgtatgggacagaggat

SEQ ID NO: 31607 - DNA, 121 bp, Artificial Sequence
  Synthesized
  misc_feature (61): n=c or g
cttgttccaggactcacgaaagatccccgcacactgagaagtactgatgaccgaccacccncttctccaaccccgctgtatcaggaagtcacatttccttcatccacacagcacagggctg

SEQ ID NO: 31608 - DNA, 121 bp, Artificial Sequence
  Synthesized
  misc_feature (61): n=c or g
tctctctgagataggagagacagtgtggatgcttttgaagtgattcatatgtttacatctnataattaaatctcttgatttaatgtaggatggtaacattgtgcacagatgaactctttac

SEQ ID NO: 31609 - DNA, 121 bp, Artificial Sequence
  Synthesized
  misc_feature (61): n=a or t
gtttttttgttttttttttttttttttttaagatggattttaaaaggcatatctcacagcngcttatcaagagaaccccagcaagtgagaaatgcatgcaactcctcacgtaggtaaagga

SEQ ID NO: 31610 - DNA, 121 bp, Artificial Sequence
  Synthesized
  misc_feature (61): n=c or g
gtggtgcctaggtcatctcatggaatccatttaactttgctttcaagttactctttttagnatatagccagtattttagagtttgttcacagatgggtggtcttgccacataaattgaacc

SEQ ID NO: 31611 - DNA, 121 bp, Artificial Sequence
  Synthesized
  misc_feature (61): n=t or c
gaagcatcccaagacgtcatttggaaacctagcattaaaagacaccattagagctctgtcngaagccaagggtcacttagcccaaagcgtggcaacttggaacatgattgccaggcaagga

SEQ ID NO: 31612 - DNA, 121 bp, Artificial Sequence
  Synthesized
  misc_feature (61): n=t or c
ctgctctactgcttggcagggacagccatgctacagaaagcggagggaatggcagtggganggtgctgagcaggctgtgcagagcatatatggatctccaggaacatccccccccattgcc

SEQ ID NO: 31613 - DNA, 121 bp, Artificial Sequence
  Synthesized
  misc_feature (61): n=a or g
gtgagtcctttgcacgctgctctgatttgctccatcaccctggggtgggcagaagagatgngctttgggtggattgtcatcccaaatggtggttaagaagggaatctgccctgtgaaggtg

SEQ ID NO: 31614 - DNA, 121 bp, Artificial Sequence
  Synthesized
  misc_feature (61): n=a or g
ggatctgaggatcagttctgcaaggtctgtgcaactttttgggttagtgttgggtagtgtngttgatatgagtatgaaaggtgtaagtagcttgaatgggcaaacagtgcatactaactcg

SEQ ID NO: 31615 - DNA, 121 bp, Artificial Sequence
  Synthesized
  misc_feature (61): n=t or c
ggtcctgttgtctgcctgctgctgtggggtgagctcctcctcttccagcagcatgtacagntccttcatgctgttcacctgcaggagatgccgtgggcagactgctgaggatcccagccag

SEQ ID NO: 31616 - DNA, 121 bp, Artificial Sequence
  Synthesized
  misc_feature (61): n=t or c
aaactcctcagggttctacgacataaaacaatgacgacaaaaactgtaactacagtcctanagaacccttctgtcttggagatgctgcaaggggcaactcacatcatattatataacatca

SEQ ID NO: 31617 - DNA, 121 bp, Artificial Sequence
  Synthesized
  misc_feature (61): n=a or c
tcaaacctccagccaccaaacattgcttttgaatcacagggagcaccaaggaccttcatgntacccaacgtgaaggtgctgagtgccttctctgaaggctttctttcctttgagcacagca

SEQ ID NO: 31618 - DNA, 121 bp, Artificial Sequence
  Synthesized
  misc_feature (61): n=c or g
caatcaattacttgtatgctatcaaatagctttttgctatgtaaatgactacaggttaaanaagactacagagatctagtgtttcagaataccttttccacaagagtaaataaacttctgt

SEQ ID NO: 31619 - DNA, 121 bp, Artificial Sequence
  Synthesized
  misc_feature (61): n=t or g
actgaaaaacagtgctctgagagatcaaagattacagtctttcagcagaaccacactgaantgtgagaagcaccatgacagcgtgaaaagtgctgtatactcgtcagcaaagtgtgcacca

SEQ ID NO: 31620 - DNA, 121 bp, Artificial Sequence
  Synthesized
  misc_feature (61): n=c or g
gtcagaaagaagtagattcctgacaacacatatagagtccactctcctggctgcatgctgntatatgggataacacaacagcttcttcatgtctatgcctgtaacagttatggacatacaa

SEQ ID NO: 31621 - DNA, 121 bp, Artificial Sequence
  Synthesized
  misc_feature (61): n=a or g
ttggaatttcatctcacattgcacctctgttttcaggtaagtcactgaagaggaaaacttntggtccacagactaacagagaaacttccatgtgcacctctcttcatcattgaaatccttc

SEQ ID NO: 31622 - DNA, 121 bp, Artificial Sequence
  Synthesized
  misc_feature (61): n=a or g
tctctgacagaatgagtaatgtgaaccaaatagttcttctatattctaataaagtctctcnactacttaattaaaatgcttgttatagagactgacctcagagctggtcactgacagtttg

SEQ ID NO: 31623 - DNA, 121 bp, Artificial Sequence
  Synthesized
  misc_feature (61): n=c or g
tctgttggtactttttcctgagagtccattacttcaacatcttgtctcaactgaaagcctntttctgctgctcagttcctatgctctgcctggaggctgttgtcaaggtgtgtttcttgta

SEQ ID NO: 31624 - DNA, 121 bp, Artificial Sequence
  Synthesized
  misc_feature (61): n=a or g
atgaaaagactccttaagacgtgaagtttattttgtctttaaattgaaaggggtgccatcnggttgagagacttttaagcaagagatttacaagcaagtatattacgttgtgggcacaagc

SEQ ID NO: 31625 - DNA, 121 bp, Artificial Sequence
  Synthesized
  misc_feature (61): n=a or g
aaggtaacacactggattggtgtacttaaccctcgtgtaccaaaatcaagctagaaaaccnaatgaaaagagacattttccctaatatacagggtctagaaactacagttctaagtgacct

SEQ ID NO: 31626 - DNA, 121 bp, Artificial Sequence
  Synthesized
  misc_feature (61): n=a or g
gagcagcaagagaatgctcttcccctagcacaagaggaagggcttacaattaaagctcaanctgtactctgactcaaaggggaattgttgcagttttccatgctctatgacgttgcaaaga

SEQ ID NO: 31627 - DNA, 121 bp, Artificial Sequence
  Synthesized
  misc_feature (61): n=a or g
aaacctccttcaccctaggagaaagttgtatggtaagcctatactataaacaggctatggngcagcaaggtaaaagagagagggactcaaaaactgctgtccaccactggttgtgttgaag

SEQ ID NO: 31628 - DNA, 121 bp, Artificial Sequence
  Synthesized
  misc_feature (61): n=t or c
ccatagaatgattcctgttgtgatcctgacattaaagggctggctctttatgtggctttcntattattattattgtcacatttccacagctatttcttactgtacccttcagaatactcat

SEQ ID NO: 31629 - DNA, 121 bp, Artificial Sequence
  Synthesized
  misc_feature (61): n=a or g
ttagagcaggtatgtatttgaaacattgggatttgggctatgaccaggaaaattggagacntggcgaattcattccttaataatgcctgctcctgagtgtatggatctttttgtatttgat

SEQ ID NO: 31630 - DNA, 121 bp, Artificial Sequence
  Synthesized
  misc_feature (61): n=a or t
cagtaccaatcagatcttgcctgagagttggcacgttagcctggtataggtagatttgagngttttggacacttcccacattgaaaggtgttttacctagggaaagttacatagaagtata

SEQ ID NO: 31631 - DNA, 121 bp, Artificial Sequence
  Synthesized
  misc_feature (61): n=t or g
ttgatcaaaaggatttatattgagctatttccataaataacatggtgatgcgagtgtgtgntttaatcctcagatgtatattttacaaaaacttaaacttatccctgatgactacagcaat

SEQ ID NO: 31632 - DNA, 121 bp, Artificial Sequence
  Synthesized
  misc_feature (61): n=a or g
aaaggaaattcaatatatttcctctaaaacaggtggaaaataggcatatacacatcttcantacctaccttgtaagtcagaaagccttgtactgtatgaagataaataggaaaatgtctat

SEQ ID NO: 31633 - DNA, 121 bp, Artificial Sequence
  Synthesized
  misc_feature (61): n=a or t
caaatgaagacacaaccagtatggaggcttgcagctttgcatggatgtgtcagtatgtcangtctccagcacatctctttaagcccagaggccatggtgctttcaaaacaaaagcaacgtg

SEQ ID NO: 31634 - DNA, 121 bp, Artificial Sequence
  Synthesized
  misc_feature (61): n=t or c
tacatgatctcaaaagaactaacgagtaaataattcaatcttgataaagggagtgatgagnggtcagtagattaggaagtcaagaaataaatgttcttgtgagtgacatgaacttcagtct

SEQ ID NO: 31635 - DNA, 121 bp, Artificial Sequence
  Synthesized
  misc_feature (61): n=t or c
ttctaacacagaaggaatggcttgtggtaaccacttacttgaacagatgatactgaacacngtgcttaaacataggttagacaaaggcacaaaataaacctgctgtaaactatttgtctac

SEQ ID NO: 31636 - DNA, 121 bp, Artificial Sequence
  Synthesized
  misc_feature (61): n=t or c
ttatttcatcctgtgatatagtaccttttaaaagtacatattttttacacactaatacagngttcttgcagatcataaggtgtaagttgaatttgtgttgagcattcaataattgcactga

SEQ ID NO: 31637 - DNA, 121 bp, Artificial Sequence
  Synthesized
  misc_feature (61): n=t or c
cgacgaaggaacaaaccatctcagtgaataattttacagtttattagcatacggaagtgtnttgattaattttgcttaaatgaatgacaaagaaacagttttatcatgtactctgctcatt

SEQ ID NO: 31638 - DNA, 121 bp, Artificial Sequence
  Synthesized
  misc_feature (61): n=a or c
tatttgggaggattatatgacctttctttctctgattactcaattggtcacttgaaagctncagtttcagtaggctattctcacatttttagctttgctagagtgaagtatgatcaactca

SEQ ID NO: 31639 - DNA, 121 bp, Artificial Sequence
  Synthesized
  misc_feature (61): n=a or c
catcgtagatatacgaaatacctctgagtgacttaaacgtataaatgggataaaataactnacaggcttgtttgcattgtagctaatttcccagtgacacaaagcagatctgaaaatggtt

SEQ ID NO: 31640 - DNA, 121 bp, Artificial Sequence
  Synthesized
  misc_feature (61): n=t or g
gtaagttgtaagtttagtgttaaaatgcgtatttgagacatggcaacttgcattatctganggcattagcctgtctgcaaattcttattcatggtagtgtgactcctacccagagcaaact

SEQ ID NO: 31641 - DNA, 121 bp, Artificial Sequence
  Synthesized
  misc_feature (61): n=a or g
cttagcatctctgtcttcccatataatttttaaaaccacatgttagtgttgttaccaagantacagttgccatctgcaatcttgaatgtacatttccttctattctaggagtgaaaaatgt

SEQ ID NO: 31642 - DNA, 121 bp, Artificial Sequence
  Synthesized
  misc_feature (61): n=a or g
atcatagacatgcaagtatatgcaggtgttataagcaaactacatttactgcctgccaaanagacctctctaatctccaggttagtgagaatgttctcattgctccaatattttccctgta

SEQ ID NO: 31643 - DNA, 121 bp, Artificial Sequence
  Synthesized
  misc_feature (61): n=c or g
tgtatgtttatttctgtgaggcacttttgagcaggacaacataacaacccaccaagaatantaacgttagtaacttaatggttggcaattgatagtgagcaaatattgtatggatgggaag

SEQ ID NO: 31644 - DNA, 121 bp, Artificial Sequence
  Synthesized
  misc_feature (61): n=t or g
tatgcactgatttacacacattctatctgcatgaccgattctttgaaaactttttttgtantggattaagtggtcacaggttctcccaagctgtgacatccagccctaaatagaaaaagaa

SEQ ID NO: 31645 - DNA, 121 bp, Artificial Sequence
  Synthesized
  misc_feature (61): n=a or g
atttacataacggccagcttcagggtctctcatgtgagggatagggagcacagggcggtgntaggtggctgcaatacagggcatttggtgagagcaaagtggtggatttgatgtgtccttg

SEQ ID NO: 31646 - DNA, 121 bp, Artificial Sequence
  Synthesized
  misc_feature (61): n=t or c
ctactattatgagaaagttctcactcccatgagaagtctcatgagaggtcagtgggaaaantctcacaggtaacattactcactcaggcaaatgtttcaaggttcatttccttcatttgct

SEQ ID NO: 31647 - DNA, 121 bp, Artificial Sequence
  Synthesized
  misc_feature (61): n=a or g
atagcatataacataactagtgttaaagattaggctatataaagaatatatgtgtcacccntaatttctaccaatatagaatctacagttaggcatttgtctgccctgtaaattacttact

SEQ ID NO: 31648 - DNA, 121 bp, Artificial Sequence
  Synthesized
  misc_feature (61): n=t or c
gctcttaaacaccttacctactatctaaatcttcccaagtctgaagtcaccatcgttaccncttaaactaattctctaatgggagctgtcagcacccacatcgttgttttttttttttctg

SEQ ID NO: 31649 - DNA, 121 bp, Artificial Sequence
  Synthesized
  misc_feature (61): n=c or g
gatggcgttgtgttgctgttgtctgagcttttcatttgttgtctcgggcttctgaaattcntgagacttgagaagagctctcctgatagagttgggtttgttcctcgaggccagcctaaag

SEQ ID NO: 31650 - DNA, 121 bp, Artificial Sequence
  Synthesized
  misc_feature (61): n=t or c
agttcttgatgggttaggggagagttgtacatacatgtagactcaacaggatcacaggcangtcagccatgaccattgcaagctctagagcaaaactcctggcaagggtaccacaggaggg

SEQ ID NO: 31651 - DNA, 121 bp, Artificial Sequence
  Synthesized
  misc_feature (61): n=c or g
agttgcgggacttgcaaatttttctcttcattggtgacccagaagagaggaaatcttgaanaaaggaagctggcaagaggcatgagtgaaggaacagcagtatatgctgggaaatgcacca

SEQ ID NO: 31652 - DNA, 121 bp, Artificial Sequence
  Synthesized
  misc_feature (61): n=a or g
tcctactgcaaaaaaattcaaacacaaatgttgttgcaggcctttgtcaaagagatgacancaactattaaggactacacagttaatacttaacacaggctaaaaccaacacacagcacag

SEQ ID NO: 31653 - DNA, 121 bp, Artificial Sequence
  Synthesized
  misc_feature (61): n=a or g
acactttatacaaggtcacatccgtaactttggctaaaatcatagtcaggaacaactagcnagacaagaacttacaggctagagcacctgaggctccaaagacaactgatcaaggttcaag

SEQ ID NO: 31654 - DNA, 121 bp, Artificial Sequence
  Synthesized
  misc_feature (61): n=a or g
tgtcatcatggcaagacgagttccaccagggaaagtgctggaagtgctgtgcagttacatnagtgggctgagggtctctcagcaatggcgcgctgctccttctggactggaggctcacctg

SEQ ID NO: 31655 - DNA, 121 bp, Artificial Sequence
  Synthesized
  misc_feature (61): n=a or g
gaaggttaggaggcattactggtgtgtacttctttatttcccactacttgagctgctctantctgagtgatcatctgccttcatagctttacattccccatttctctgacgtgtatccttc

SEQ ID NO: 31656 - DNA, 121 bp, Artificial Sequence
  Synthesized
  misc_feature (61): n=t or c
agagcagagatctgagctgagaacagtgggacaggagcctcagggcactgcaagaatcaanctcatgctgtaacattacctgccaaccaaaaccatgtggtgtggtgtgattgcctggcag

SEQ ID NO: 31657 - DNA, 121 bp, Artificial Sequence
  Synthesized
  misc_feature (61): n=a or t
ttggcttggacttgcgaggctttgccatgtccctaagcacatggggcaacatcaggccagncttcagtctgagtcctggtttcaggaatgacctttatttagagctctcgcagctaaaatt

SEQ ID NO: 31658 - DNA, 121 bp, Artificial Sequence
  Synthesized
  misc_feature (61): n=a or g
tgttttggaatagaaacctgaggccggggttggtttccaagagctgattctagctggatantggaaaataatcctattgttaatgctttttctatctgctgcatgtgtttctcttgtgcat

SEQ ID NO: 31659 - DNA, 121 bp, Artificial Sequence
  Synthesized
  misc_feature (61): n=t or c
cttttagtgggacaatgtggagaaattaataatgatttatctgccagagatatcatccatnctaaacaatttcacctatgcaaactgcagatgctaacagaaaactacacaagaaagtcct

SEQ ID NO: 31660 - DNA, 121 bp, Artificial Sequence
  Synthesized
  misc_feature (61): n=a or g
taaaagttatcagacaaagttaagaaaaagctttcctatctgtctctgctcttgtcatttnaatttcctgtgttttattccagccttatatttcaattttcatgttgcagttgcatttcca

SEQ ID NO: 31661 - DNA, 121 bp, Artificial Sequence
  Synthesized
  misc_feature (61): n=a or g
gtgacaaatacctcagcaccacttaacacagtaagaagaaaactcttgcacgctcactgcncagccaagcagagccagctgagggcattccatcggtacacaccaatgcagctcggatgcc

SEQ ID NO: 31662 - DNA, 121 bp, Artificial Sequence
  Synthesized
  misc_feature (61): n=c or g
gcaaagtcaggaggaatgaagtagaaatggtgtcacattggaaagttcagaactgctttanaaggttttttggcaccttccccctctctggtagcacctaacaggaactgaggcctcacag

SEQ ID NO: 31663 - DNA, 121 bp, Artificial Sequence
  Synthesized
  misc_feature (61): n=c or g
gcattaaactaaaagaggggagatttaggttagattttaggggaaattttttcgctcaganggtgctgaggcattaaaacaggctgctagttgtcgatgccccatccttggaaatgttcaa

SEQ ID NO: 31664 - DNA, 121 bp, Artificial Sequence
  Synthesized
  misc_feature (61): n=a or g
aagaaatgctggctggggtatgcagtgtgctggcagtgactgctctgccgctccctatgcnaggttttggcctcagacactctccggagaggagacccacagcatccagcagctccagcaa

SEQ ID NO: 31665 - DNA, 121 bp, Artificial Sequence
  Synthesized
  misc_feature (61): n=a or g
cttcctaacacctaaatgtggcaaaactccatgcaaactacaacaccccaacgtgccaccnaggctggggacctgttctgatgtgaaataccaacgaaaagccacaaaaccacaacagggc

SEQ ID NO: 31666 - DNA, 121 bp, Artificial Sequence
  Synthesized
  misc_feature (61): n=t or c
tttccaactgaagaatgtccaagcattttgtttaggtcaaatgaaacatctcgacgtttcngaacacactgttccccagcagctgaattaatgaagcctggtttctaatgactttttctct

SEQ ID NO: 31667 - DNA, 121 bp, Artificial Sequence
  Synthesized
  misc_feature (61): n=c or g
agcagcatataataaaaatagttcaccaatgagtaacaatcaaccaacctttccttgtaantgctggaaactgccaggaaatgatttccacatcccacagtaatttcgtgtaaggttaaat

SEQ ID NO: 31668 - DNA, 121 bp, Artificial Sequence
  Synthesized
  misc_feature (61): n=a or c
ctcagagactgctaaaatgaatctatactttcaaatcagggaagattattcctcccatganttacctatgaataaggaagttaagtaattgtgaagctgtgccctacatctcctacccttc

SEQ ID NO: 31669 - DNA, 121 bp, Artificial Sequence
  Synthesized
  misc_feature (61): n=a or g
gtaaggaagaggcagcacaaagaacattaacagaacaatcacagaaagagaaaagtctatnaaatacaagaaatgccattaagatttgcaattgcatatcatttatgatattaaatgccat

SEQ ID NO: 31670 - DNA, 121 bp, Artificial Sequence
  Synthesized
  misc_feature (61): n=t or c
ttatacattgattgaaatgattttgccagtctgttccttcttcaaagtcatttttaagccnaactcctattgaaattcagtcatttagatttaccatgaagcaaaatgtttgctttctgac

SEQ ID NO: 31671 - DNA, 121 bp, Artificial Sequence
  Synthesized
  misc_feature (61): n=t or c
gtattcttatgtgagaacaatagattgaatatttatagtagtgagattttagaaaatgaanaacatacagcatctacacagaaagaaaatctagtagttattccttgcaaagacatactgt

SEQ ID NO: 31672 - DNA, 121 bp, Artificial Sequence
  Synthesized
  misc_feature (61): n=a or t
atgtaccaagtattcctctgaaacctggtcacgtgtataccttgcagtcttatagttgttnaagagagaaatgattccatgcatccatatttgtgaaaatgaaggcagattgcttaattgt

SEQ ID NO: 31673 - DNA, 121 bp, Artificial Sequence
  Synthesized
  misc_feature (61): n=a or g
tgacttcttagtttctgttgctctaaatttatattgaattttgagaacatctcctcccatnttacatttcagcagcaggattcaatgactgattagtatgcagagatcgttttggtcctgg

SEQ ID NO: 31674 - DNA, 121 bp, Artificial Sequence
  Synthesized
  misc_feature (61): n=a or g
gtttacaataaaggagaaaggatggcttttcagttttccccagagaccccctaggagaaanggaagcttctcaagcatcactccaagctgcaatctaggcaattataggggattcagccct

SEQ ID NO: 31675 - DNA, 121 bp, Artificial Sequence
  Synthesized
  misc_feature (61): n=c or g
gttaattcagtctgaaatggttgtccagtacatggcagacagtgcaaagacataaaataanttacacagacatagcctacatgaggaaatcctctcggcaacaccagagaaaacaagcttt

SEQ ID NO: 31676 - DNA, 121 bp, Artificial Sequence
  Synthesized
  misc_feature (61): n=a or g
gtttgtctgcatgtgcaggcagtgagggatcacaaaaacaactttaaataacaacagtatntagttagaataattatacattatacagcaaagtacttctcagtaactagaacattaatta

SEQ ID NO: 31677 - DNA, 121 bp, Artificial Sequence
  Synthesized
  misc_feature (61): n=t or c
ttggaattgaaagaatagaactggctatagaaactgcttttgtcaagacttgcgtagctgntgcttctcttgtttttgttccagaggataaatgacgtcttcagattcagagcaatcattt

SEQ ID NO: 31678 - DNA, 121 bp, Artificial Sequence
  Synthesized
  misc_feature (61): n=a or g
tagcctctaaaatacaacattcttcttgtaacttttattaccctccccaattctgtccttntttcatccccttctagtgtcttacctcaaattagctctgggggacaatttctgtggacct

SEQ ID NO: 31679 - DNA, 121 bp, Artificial Sequence
  Synthesized
  misc_feature (61): n=t or c
atggttatttttttttatctggccatagagtactcaggtggccatttaacacataattccncacttaattgcataaccacaagaattaatatgcatgttgtaattacaagtacacatccat

SEQ ID NO: 31680 - DNA, 121 bp, Artificial Sequence
  Synthesized
  misc_feature (61): n=t or c
taactaaattcagaatccatctttagcccaagaatttggatttcacaacatttccaaagancgtggttttttgacacttccaccaaatgcgtatatcagacatctttgtcagaacccagta

SEQ ID NO: 31681 - DNA, 121 bp, Artificial Sequence
  Synthesized
  misc_feature (61): n=t or c
tcccagcccattgtagttgagcttcagctttctttgctgcagataattgatgtggtaagtngctggctgtactgttctctacggcacccattcagcataactaatctgacctctcatgaag

SEQ ID NO: 31682 - DNA, 121 bp, Artificial Sequence
  Synthesized
  misc_feature (61): n=a or g
gctgtaatgtcagccatcaccctataagtgacaccagagctcaccgagaggtaaaggtctnatgtgggcctgatgggttaagtgaacaccgtcccagttcactcagtctgccctttgctac

SEQ ID NO: 31683 - DNA, 121 bp, Artificial Sequence
  Synthesized
  misc_feature (61): n=a or g
attgtttttacttcatttcactgtctgatggacatttgtcagtgagcaacttcttattccnaattcagaaacccttagtgactattttagttcaaggtatatattaaaatctgtcttataa

SEQ ID NO: 31684 - DNA, 121 bp, Artificial Sequence
  Synthesized
  misc_feature (61): n=a or g
tcaagaactgaccaagggaggtgggacacagctgggagtacttcacaggtgggagataacntccacaaggggcaagagagacatatgcacctgcgttgtggtgtgtacacagccaggcagt

SEQ ID NO: 31685 - DNA, 121 bp, Artificial Sequence
  Synthesized
  misc_feature (61): n=c or g
tcccgtggggtgctggggttgagctgtgctcactgtgggctggattgtaacgcaggtgctncctcagctcaggagtaaatctagagctggtgcctttcttggcactctccggaaagcagcg

SEQ ID NO: 31686 - DNA, 121 bp, Artificial Sequence
  Synthesized
  misc_feature (61): n=a or g
ataatcaaataactgcaatttttgtcattagaccactcaaattcctttcacagtagtcagntatatcatcttcaaagagtgtatgtcatttttacgtgttagaagacagttgagtttcaag

SEQ ID NO: 31687 - DNA, 121 bp, Artificial Sequence
  Synthesized
  misc_feature (61): n=a or g
ggaccacagcatgaacataacaagttatctttttgctgtatttcaacccattgccaacctncactgctttaagttagacataatagctgaacaaaaggagagaggcttctgtagggctatg

SEQ ID NO: 31688 - DNA, 121 bp, Artificial Sequence
  Synthesized
  misc_feature (61): n=a or c
aattgtggttatcattattttattattgttttccctctagacattgcaatgatgagaaagncttggatagacttacctagataattacttgtataaatttcaccacattcctaagaaacag

SEQ ID NO: 31689 - DNA, 121 bp, Artificial Sequence
  Synthesized
  misc_feature (61): n=a or g
ctcctgtaaaagcagctgagggtgaggaaggccccactgaaaaactgctcaaagtccaccntttcctgtcactcccaaaatactgtcctcagcaaagttactgtttacaaactatttcttg

SEQ ID NO: 31690 - DNA, 121 bp, Artificial Sequence
  Synthesized
  misc_feature (61): n=a or g
caacagacctctcaggaagcagggcctggggattcagggagacagataacacagcactcangattcataatgctggcagaagaagggaagcttggagcaaaggaaatgaattaccagttta

SEQ ID NO: 31691 - DNA, 121 bp, Artificial Sequence
  Synthesized
  misc_feature (61): n=a or c
ggagcccacaccttcatgtataactggagaaggtgtattttttctccaaattgtatttctntgtgttttcagtcttgttaaggcctaaactgacaggagtaaagacaagggaagtattggt

SEQ ID NO: 31692 - DNA, 121 bp, Artificial Sequence
  Synthesized
  misc_feature (61): n=a or g
tcacattaacagtggcattacagcttcccctctctgcaggcactttgaattcccacttcancttcaccagcaaaacaaacccgcacgcaggaacgtcgtgtttttgtattcctcgggcatt

SEQ ID NO: 31693 - DNA, 121 bp, Artificial Sequence
  Synthesized
  misc_feature (61): n=a or t
aggaacagagcaattttatcatatcacaaaagtcctggtctaaggttgtctgcaagaaganggcttgcttgtgcttaccctgctggaagggctgttatgctctttgtatagcctgtttccc

SEQ ID NO: 31694 - DNA, 121 bp, Artificial Sequence
  Synthesized
  misc_feature (61): n=a or c
ggagaagaaaagctctgctgtatgcagtcctcctcaaatactaaaagaatccagcaaaaantgctggatactgcttgtttagatagaagaattggtcatagaattatgcccctattctttg

SEQ ID NO: 31695 - DNA, 121 bp, Artificial Sequence
  Synthesized
  misc_feature (61): n=a or g
gtgatttttagcccacagactttcctgaactatgcctgatcagtctgtaaaagataatagnagcacctgcttccaggtagcttatgcttctcctatgaggacagagaggtgtggggagtcc

SEQ ID NO: 31696 - DNA, 121 bp, Artificial Sequence
  Synthesized
  misc_feature (61): n=t or c
gtgcaaccacagtgcaggtgcctctgccccacagcaggtgcacatgcaaagcagatcctgngctgggagaaaaggagccattctcctgacttgtcacacagccagtttgtatttctgcggt

SEQ ID NO: 31697 - DNA, 121 bp, Artificial Sequence
  Synthesized
  misc_feature (61): n=a or c
cacagtggtcagtgcaggcgcttggcatgcctggaaagaggctgtaacaccaggctgcagnaccaggtctggctgatgctggaaatgagtgctttaaggttacattttatgctggcaaaac

SEQ ID NO: 31698 - DNA, 121 bp, Artificial Sequence
  Synthesized
  misc_feature (61): n=a or g
aattaggtaagtgagcacatctcagaaagcagcaaaacactgtggtgtaccgtagcattgnctggtttaaataataagtaaaaaatgatagctgaatttggcttgatgatgtctaggcatg

SEQ ID NO: 31699 - DNA, 121 bp, Artificial Sequence
  Synthesized
  misc_feature (61): n=a or g
gtgatttctgctggaaatcactggcactgttaaaatagcagatgcagaactaatgtatctntggccctttgttttaagcttcgtgtttcttactctagtatccaacactgtagctcataag

SEQ ID NO: 31700 - DNA, 121 bp, Artificial Sequence
  Synthesized
  misc_feature (61): n=t or c
taggctggaagggatttctggaggtgatcgagtcttagcccctgctcaaagcagaggtaanggcaacgttagatcagtttgcacatcttgtccatgcctgattttttgaatctcagaggac

SEQ ID NO: 31701 - DNA, 121 bp, Artificial Sequence
  Synthesized
  misc_feature (61): n=a or g
ttcaaaaatcacatgcatgtcatgaaggctttggtatcaaagttctttcctcgattttccnggtttatctgtcactgtgctttgaatacaatttcagaataagatatcacttcaggagaaa

SEQ ID NO: 31702 - DNA, 121 bp, Artificial Sequence
  Synthesized
  misc_feature (61): n=a or g
tatccactggacagtagctacactgagactaccttcaacagccactgcatgagcagtgcanctatacaagccaacagcttgcttcccctgtaaacagtggtgacaattcattaggaacact

SEQ ID NO: 31703 - DNA, 121 bp, Artificial Sequence
  Synthesized
  misc_feature (61): n=a or g
cttgtgtcaccactgcacagaccaagggacgtgtgtttgtaccacagtcactgttgttccntattgctttcatacatgcaaccttggctagatcttaaagtaagcccttctgaattacgat

SEQ ID NO: 31704 - DNA, 121 bp, Artificial Sequence
  Synthesized
  misc_feature (61): n=a or t
ccagtatgccattccctacattttcttggattgctattaagcagttaaaagttcccagagngagaacatgcagtcccatctgccagaactaaggctggagcagctcagacaggagcacatg

SEQ ID NO: 31705 - DNA, 121 bp, Artificial Sequence
  Synthesized
  misc_feature (61): n=a or g
cagctgtcagctcactgcttggggccagggacatgcacttctaacggcgtgctcacgcacngtaagaatcaaaattcacggctgtttttgaaagcttgggcttaacatgttgcattagctg

SEQ ID NO: 31706 - DNA, 121 bp, Artificial Sequence
  Synthesized
  misc_feature (61): n=a or g
gaagactgaactgttcctgaacagaaagatattcgtcacggatgagaggtgacatttcacntggacaaagatattttaatcctcaaagcgcagcggaatcaaactcaaaaattgcagattg

SEQ ID NO: 31707 - DNA, 121 bp, Artificial Sequence
  Synthesized
  misc_feature (61): n=a or g
ccagtgccaatggcctcccagtgccattcctgcctgcctgcatcccactgcacacacagancctcacagcagcatcccatagaaacagccccacatcccatagcagcacccccacatcccg

SEQ ID NO: 31708 - DNA, 121 bp, Artificial Sequence
  Synthesized
  misc_feature (61): n=t or g
agatagtgtaccacataaccctgtgactaaagctatgtgacattctggtgttaacacagcnggtcaatatacacttgttagcgctctatctctttgaaacaggtacattaactatctctgt

SEQ ID NO: 31709 - DNA, 121 bp, Artificial Sequence
  Synthesized
  misc_feature (61): n=a or g
tgctttgtgaattggcaacagcactgtggtctactgaaacaaatgagagtaacattaattntataaatttacaggcagaaaatcctttgagttggctgtatgttaggagtagatatcagca

SEQ ID NO: 31710 - DNA, 121 bp, Artificial Sequence
  Synthesized
  misc_feature (61): n=t or c
agctcctctgccttcctacacttcccacccaacacaataaattgaaatgccctcaagtttnccagccttaactgttcaatgacagcaatttgtttccagctatgagttaaaaacaaacaca

SEQ ID NO: 31711 - DNA, 121 bp, Artificial Sequence
  Synthesized
  misc_feature (61): n=t or g
atgcttcttcacatggctgaacacttacgttcctcttcataatctgtaacatatgtcttgntctgctagtcaaagaatagaccatagatatggacctcttgtccaataaattaaaatcagc

SEQ ID NO: 31712 - DNA, 121 bp, Artificial Sequence
  Synthesized
  misc_feature (61): n=t or c
tggaaagtctgtctgtgctccaagagttatctggggaagttcctacaagctttccctcatnctgacagaaatgggtcacataatggaaaaacaaagcctacgaatgaacagaaaggacaag

SEQ ID NO: 31713 - DNA, 121 bp, Artificial Sequence
  Synthesized
  misc_feature (61): n=c or g
tgggcacggagctgctccgagtgctccttcccaaggactgcatttacctctctgcattcancgaactacgcagaagagcagtggttttgtgcaggcttagagatgcgataagtatttgctg

SEQ ID NO: 31714 - DNA, 121 bp, Artificial Sequence
  Synthesized
  misc_feature (61): n=t or c
aaatgcagtatcattagaagaccattacatgggttctgttcctcccatatgaattagaacngaattacttttaacaaggctggctgtggacacgtggatccatttaaaacaagaagtaagt

SEQ ID NO: 31715 - DNA, 121 bp, Artificial Sequence
  Synthesized
  misc_feature (61): n=t or c
ggattactcatgtgacagatgtgggcagcagacagagcaatgcttcaccctcagcctctgnaccaacggtgaggctcaaaggcagcagggattcaagctggtaaaatgccagtgcagatgc

SEQ ID NO: 31716 - DNA, 121 bp, Artificial Sequence
  Synthesized
  misc_feature (61): n=a or c
caaaccccagctattttctttaccatttgtcttgatttttcaactcctcacaaaagtgacnatagcaattccagcagtgcagatctttaagtgaaaccctacatgcacacaaatcttaaat

SEQ ID NO: 31717 - DNA, 121 bp, Artificial Sequence
  Synthesized
  misc_feature (61): n=t or g
tttcatcaaaaaataagaatgttccattttaacttttctgagtggagcagtagaattttcngtttcagaaaacagtttctttgcaattttattaactctatgaaatactaaggctaaggtt

SEQ ID NO: 31718 - DNA, 121 bp, Artificial Sequence
  Synthesized
  misc_feature (61): n=t or c
ccagcagccgttagccaggatctgcccaaggaagcacctgctacctggacagaaatgttanagtctcttgcataaatttctcacctacttctgcagctcaggaatacaggacactgtgcca

SEQ ID NO: 31719 - DNA, 121 bp, Artificial Sequence
  Synthesized
  misc_feature (61): n=a or g
tttcaaataaaccacgacaatttttaaaatatgcaaattccttgtgtaaaatacttagtanggagcccgaacaaaatttaagagtttgagagcaattacaataatcaccccaaaataactt

SEQ ID NO: 31720 - DNA, 121 bp, Artificial Sequence
  Synthesized
  misc_feature (61): n=t or g
tgtaaacagcattattagagaacataactaccaggaacacaatctcacatttaaaatcctnctttgtgagccactgcgtaccagttgcagtaataatgggtcatagaccacagttggcatg

SEQ ID NO: 31721 - DNA, 121 bp, Artificial Sequence
  Synthesized
  misc_feature (61): n=a or g
caatatgcagtagatgcagttgttaggagagaattacattttgtattggattttctaaatnggaatttctgtctctggtggacaagcaggaggacacgacgtcctgttatctcctttccac

SEQ ID NO: 31722 - DNA, 121 bp, Artificial Sequence
  Synthesized
  misc_feature (61): n=a or t
cgtaatttcatgcacaagtttcatcctaaaggtttcatcctaaaggtcaagccaaatttcntgctatctgtctctaaaaacactgcaaaagaccttctcaaacaattaacctaacataaat

SEQ ID NO: 31723 - DNA, 121 bp, Artificial Sequence
  Synthesized
  misc_feature (61): n=a or g
caagggtatacaggactttagcccaaaagcctttggaaaattaaaattaaagaaagcatgngtttgagtatttgagtgacctgtatatgaggatatatcagttcctagttggggtttaata

SEQ ID NO: 31724 - DNA, 121 bp, Artificial Sequence
  Synthesized
  misc_feature (61): n=a or t
catctttcaatagctgcctgactttcttcctccctgcagcttttccgttactgtgagggcnacgtgcacacatagcactacctataaaagatgtcgtgatcatcagaagtaaatggaatag

SEQ ID NO: 31725 - DNA, 121 bp, Artificial Sequence
  Synthesized
  misc_feature (61): n=c or g
ggcctttatgaacttctaatcataactgttgctgagtaccactttttttcttattgcctantgctcacaaacgtgtttctcattttcatcctgcctggtttttgagaaacacaatctaggt

SEQ ID NO: 31726 - DNA, 121 bp, Artificial Sequence
  Synthesized
  misc_feature (61): n=a or g
ctattagctatgacttgtaatgtttcccccttttcactgacccttcagttttttatgcacncgtaaattgcctcaaatgtatctagtacctttaagacacatctatactagcattttaatt

SEQ ID NO: 31727 - DNA, 121 bp, Artificial Sequence
  Synthesized
  misc_feature (61): n=a or g
gtattgaatttattattgttctttaatagatgcctgatgatgggttttgatttcacttatnagtcctttaccttgagagaggtgagatcatgtatgtgttctgtcatttgccaaggaaaag

SEQ ID NO: 31728 - DNA, 121 bp, Artificial Sequence
  Synthesized
  misc_feature (61): n=a or g
tgcagagattgctcttctgaggtatatctgggaaccacaggggatttttttctctccctcnggtgcaaagtcagtaacatccaaagtgaagcaagccccttagatattggaaaacaactgt

SEQ ID NO: 31729 - DNA, 121 bp, Artificial Sequence
  Synthesized
  misc_feature (61): n=a or t
agaagctgcttgtgagtctcctttcacagagaatcatgcttttcagactaggcatcatgtngtttgaaagcagatttgtgacaactgcattgctagttatagggtgaagagggatgcaatg

SEQ ID NO: 31730 - DNA, 121 bp, Artificial Sequence
  Synthesized
  misc_feature (61): n=a or c
acctgaattcttctagttctactgtagtgtgagggcaaataccaaaaaataagtaaagaanagtgtaaaaagctaagaggtatgaggaactgaagagcaggagggaggctcatttctaaag

SEQ ID NO: 31731 - DNA, 121 bp, Artificial Sequence
  Synthesized
  misc_feature (61): n=t or c
tccaagattatagcactgcttgtcagggaagtagcagaggagtttggcattctccccttangccttttggctacacagaagtactgcatttgataggcataaaaaaaaaaaagaataactt

SEQ ID NO: 31732 - DNA, 121 bp, Artificial Sequence
  Synthesized
  misc_feature (61): n=c or g
cagggaggctgcagggcagggcgctgcatctggcttctacagagctcaccctattctacanccgtcaagttggtaacaaaagacatcaggctttgttcatcggattctctacgcctcccac

SEQ ID NO: 31733 - DNA, 121 bp, Artificial Sequence
  Synthesized
  misc_feature (61): n=t or c
ggactagaggtgtctgaagtagcaattgtccacctccagttttgaaggtagattctaagangaactcgcaaaaacctcacatatcattggaactgttctcagataaactgcatttcacagg

SEQ ID NO: 31734 - DNA, 121 bp, Artificial Sequence
  Synthesized
  misc_feature (61): n=t or g
tgcagttaatacagaaagacctcgatgagcctcgtggaaatcaaacccaactcctgtcctntgcgacctagactggctgcagaatttttgccatggatttccccccctccctccccccccc

SEQ ID NO: 31735 - DNA, 121 bp, Artificial Sequence
  Synthesized
  misc_feature (61): n=a or g
ttgaacatgctttatgtaagaacataatattccatggatttatattttagcatatgttacnctgtgaaagcaattctagagttcagtacagttgtttccacagagctcacaatactgggca

SEQ ID NO: 31736 - DNA, 121 bp, Artificial Sequence
  Synthesized
  misc_feature (61): n=a or g
aggacagggccatccgcactcctccttcaacctggcactgggagctctcagcaacatgacngtggcactggaggacaggtaaccgagctgctcctgccccttcccgctgcagataaggatc

SEQ ID NO: 31737 - DNA, 121 bp, Artificial Sequence
  Synthesized
  misc_feature (61): n=t or c
tctcatcctgtcaaaatctctgcacgccttctgaaacttccgtggtgttactgaatttggnaagaaccaaaatcagtgatccatgatcaattttttccccaaagagaaagaaatttgaagt

SEQ ID NO: 31738 - DNA, 121 bp, Artificial Sequence
  Synthesized
  misc_feature (61): n=a or g
caaaaacatgaactggctataattaatatttcaattataattgatcaacacctaatacacnagccagtgccacacatgggtgcactttatagtgccatattactccctggcaaggtccctg

SEQ ID NO: 31739 - DNA, 121 bp, Artificial Sequence
  Synthesized
  misc_feature (61): n=a or g
tcccttgcttgtgcttgcaaaccacccagcatacctacgtttacctccaaaggtttcacanctgctacctctcgtcatccacaaacttttgaggaacaggataagataatctctttcataa

SEQ ID NO: 31740 - DNA, 121 bp, Artificial Sequence
  Synthesized
  misc_feature (61): n=a or g
tgccagccttgccctctccttggtcggagatatcagaatgttacaaccctgtgtgctctancccagccgggtgtggtcctggactacctgccgtattgctccagcttcggtgcgggtccag

SEQ ID NO: 31741 - DNA, 121 bp, Artificial Sequence
  Synthesized
  misc_feature (61): n=t or c
agtgtgggtttttttctgcttcaggaaaggaaagaataaaaatcttacacacggaaagatntatcttccactcactccacttcaaagctgatccagccaacgttcacaagacacagagaac

SEQ ID NO: 31742 - DNA, 121 bp, Artificial Sequence
  Synthesized
  misc_feature (61): n=t or c
acatctgcagaagaaaaaggcacaacaacaaggctgccacagctaccacttcctggacagnctgaccctccccagcaggctggcagaaacagctcattatctggtatgaagtatcacaaag

SEQ ID NO: 31743 - DNA, 121 bp, Artificial Sequence
  Synthesized
  misc_feature (61): n=a or g
aaaaactagactgacttcgcattaaaaatacagttctgcttctgagtgatggaggaacagnctacatcactggaactgtgaatactcttggagtaccttggcatgactctctgtgcctaga

SEQ ID NO: 31744 - DNA, 121 bp, Artificial Sequence
  Synthesized
  misc_feature (61): n=c or g
tacagttgaagttttagccaaattctgtgactttggaagtttagtttgaaagaagctttcntctgctaagaaacaacaaactgagagttgctcacaaatgaaatgaagccaagatggtcca

SEQ ID NO: 31745 - DNA, 121 bp, Artificial Sequence
  Synthesized
  misc_feature (61): n=t or c
gaagcccccacgctcggaggtgcggtggtgaccagagggacactcagcctaacactgtccncttgatccaacacagcagagctgcccaggctgtgggctctcattgctccttgcagcagaa

SEQ ID NO: 31746 - DNA, 121 bp, Artificial Sequence
  Synthesized
  misc_feature (61): n=a or g
cattcagaaggtagttttgaccttattcctgttaatactaagtctatcctggcaatgcaancatcattttgacagacctatcaacaggtcttttattcagtggggagcaaaaatatacttt

SEQ ID NO: 31747 - DNA, 121 bp, Artificial Sequence
  Synthesized
  misc_feature (61): n=c or g
gggcaaagagttcctgcagtaaatgtgaatacttgcatgcacatcatctgcatatgttcantaagatggagtcatgcttacgttaaggatacggggttacctttttgtcctataaagtttt

SEQ ID NO: 31748 - DNA, 121 bp, Artificial Sequence
  Synthesized
  misc_feature (61): n=a or g
atctctctgcaggtttgagctgcatggtaaggtagatgttctcaggcacttacacagtagngtctccaagggaaaggaacaaacgttattattggagcacccagtggttctcttcctgctg

SEQ ID NO: 31749 - DNA, 121 bp, Artificial Sequence
  Synthesized
  misc_feature (61): n=c or g
aaaacaacagccaaagccagtacaaccatggccaaagtcacccgccctgcatgcatcacanctcctgagtccctgcccatgaatgccatgttcctgtcccacacagccccatcctgggtca

SEQ ID NO: 31750 - DNA, 121 bp, Artificial Sequence
  Synthesized
  misc_feature (61): n=a or g
tctgagtgattctgtggctctacgattaaagaatgcaggtcctagacccttgttgcatgangatccctgattgggaagccaaccagccttcattttcctttccaaacttaaacatcaactg

SEQ ID NO: 31751 - DNA, 121 bp, Artificial Sequence
  Synthesized
  misc_feature (61): n=a or g
ggaacatgctggttgtgtgagggacgcttccagaaatgctgtagggaagtctgtctgatcngtgatgtgagtaatgcatataaccccagcagtagctgctgtcctgacgtattgagcaact

SEQ ID NO: 31752 - DNA, 121 bp, Artificial Sequence
  Synthesized
  misc_feature (61): n=a or g
ataactccctagcaactacacagctgcagatgttgaagagagcaaattgttttggctgagntcgttgttaatttatattcagaacgttccttccagacatgccattttttgatgctatgtc

SEQ ID NO: 31753 - DNA, 121 bp, Artificial Sequence
  Synthesized
  misc_feature (61): n=a or c
actgatgcatcacagatcactttaagcctgtgatgtccattccttcccatcacacacaagntgagctgtattctcagccccccatctgcagaggcttactggcctgtttgactttaaatag

SEQ ID NO: 31754 - DNA, 121 bp, Artificial Sequence
  Synthesized
  misc_feature (61): n=t or c
tgtgttccctctggaccttcaagcgttgttccccatcagacagactacttggtttccctangcatctcttggacggtatttgtcctggaaactccttcttgatggggcgcagccctggtgg

SEQ ID NO: 31755 - DNA, 121 bp, Artificial Sequence
  Synthesized
  misc_feature (61): n=t or g
ttacatcttgtagaaaacacttgcatatatgactaggtatccatatatatgagttagtggnttcaggggagccttagtagttctctgtcaggctgaagtccataacaagagaacaggaaca

SEQ ID NO: 31756 - DNA, 121 bp, Artificial Sequence
  Synthesized
  misc_feature (61): n=t or c
ttagcccagggatcagaacagcatagatgcagggctctgaagtggtggttgctcagtgagngaggcttgttggtttacagttcctgcatccctgagctcttctttgagctttgtgttggtc

SEQ ID NO: 31757 - DNA, 121 bp, Artificial Sequence
  Synthesized
  misc_feature (61): n=a or g
cttgtcacagctttttaagttgccttctccctcttcagcatgaattacaggatcctacacntctttatggtttgtatgcagctgcaacaagcacgtgctgttggctattaccgaacacaac

SEQ ID NO: 31758 - DNA, 121 bp, Artificial Sequence
  Synthesized
  misc_feature (61): n=a or g
agaaagatgtgagtctgtttttctgaagttctgaaagagatactgtttcacacccatacanctgaaaaatagcatagcccatccaggcttggagaggcactgagggatttgctaaggggtg

SEQ ID NO: 31759 - DNA, 121 bp, Artificial Sequence
  Synthesized
  misc_feature (61): n=t or c
cagactccaagatcccgttgccaggatgcatttggaattatagtgatttcctccttcactnagcaaactcatgtataatgccacccacttggtttttcctgtgctgaatgggcataacatg

SEQ ID NO: 31760 - DNA, 121 bp, Artificial Sequence
  Synthesized
  misc_feature (61): n=a or t
aaatgtaaacagtttaacatgagatattaaagcatattgaagcatagagctaagcctactngtcaaattgtcaagggattgcacctttaatgattaatctcaccggctgatgaaccacagt

SEQ ID NO: 31761 - DNA, 121 bp, Artificial Sequence
  Synthesized
  misc_feature (61): n=t or g
tattcttaaaatacaccaacacatcatccgtatggttacccaatatgtaactatttacttnccaggataacaagaggtaacaaaaactgctgaaagcttcaaaacttcacaagtcaccgtc

SEQ ID NO: 31762 - DNA, 121 bp, Artificial Sequence
  Synthesized
  misc_feature (61): n=t or c
tggatctgtaccgatggaactgagcacagctctgtgatttatgcactgcggacttggaggnaccccatgtttaaagcacgcagtgccggtagtgcttctgagacacaacgcaaccacggca

SEQ ID NO: 31763 - DNA, 121 bp, Artificial Sequence
  Synthesized
  misc_feature (61): n=t or c
ttctctgagaaacatgatccagtacttaaccattttgacagcaaaaaagacttttttactnatattttaatggaatttcctctatttcagtttttgcccattgcccattttcttgtcactg

SEQ ID NO: 31764 - DNA, 121 bp, Artificial Sequence
  Synthesized
  misc_feature (61): n=t or c
acatacatatacgttcatgtctctgaaaaatgatggatagctatctcaagtaaccaagtangatttggcagtttaaatccatattttaatccttaaatcatagaattagataaatatttgg

SEQ ID NO: 31765 - DNA, 121 bp, Artificial Sequence
  Synthesized
  misc_feature (61): n=a or g
tgtaagagaggaatggctttgaatgatctaatgaagtggatcttacatggaataatgtgancagaattcagagaagattagattgaatagcagtgagaggaaaaaaaacccacaattagca

SEQ ID NO: 31766 - DNA, 121 bp, Artificial Sequence
  Synthesized
  misc_feature (61): n=t or c
agccatcccgttgctcctgccagcacactgaatgccatgttgtttgaggagctgaactgcngagctaggttgagcccccccacagttaatggttggtcaaaagtgtgggttcagtcagtgg

SEQ ID NO: 31767 - DNA, 121 bp, Artificial Sequence
  Synthesized
  misc_feature (61): n=a or c
ggacattttttgttatgacttttgtctgtctcccagtgatgcgtacgttcagtcagtcaanatgaaaaagtctttaatacccaaaaatagaatgagcatacccttcatttaaaatgtcttt

SEQ ID NO: 31768 - DNA, 121 bp, Artificial Sequence
  Synthesized
  misc_feature (61): n=a or g
atgtcccatacatatctatcggaatagaattttaggaaataaataatatagaacatgctanctttcacccactgtgtagcactccatgttactcaatatgaaggtaatataaataagcatt

SEQ ID NO: 31769 - DNA, 121 bp, Artificial Sequence
  Synthesized
  misc_feature (61): n=a or t
ccaacaaagaagagggtcagacctctttgcttctgaccccgagtcatttggaaacaagaanaaagcccaatagggttttttctccccccagagttcctctgaattgctacttgcacaagtg

SEQ ID NO: 31770 - DNA, 121 bp, Artificial Sequence
  Synthesized
  misc_feature (61): n=a or g
atgaggaatagtgctacaagttctagttgttatttttaacttaacagtaccctattcctgnctgagaaatatccatgaggtgacaggtggatgtagatggagcattaggaaacatggaggt

SEQ ID NO: 31771 - DNA, 121 bp, Artificial Sequence
  Synthesized
  misc_feature (61): n=a or g
ttttcatactgactataaggtccactataagctctcacaatatacaactgtatttataccnaaacagatgcttttgcaaagatgccacagagaataactccacataagttttagtgcctac

SEQ ID NO: 31772 - DNA, 121 bp, Artificial Sequence
  Synthesized
  misc_feature (61): n=t or c
ttgtcttgactcatacaatgttctttaccatcatgctgtgcccatggctggtacactttgnaggagcctttgtcacattcttgaaggatgcttttcagtgatatgttgtggttatcaagaa

SEQ ID NO: 31773 - DNA, 121 bp, Artificial Sequence
  Synthesized
  misc_feature (61): n=t or c
gaagagaacgaagcgctgcacaagatgatggccagcgagcagaagacatccctccagaacntgttccacgacaaatgccggccttgcttgggcagctggccgcaggtaggggccaggggga

SEQ ID NO: 31774 - DNA, 121 bp, Artificial Sequence
  Synthesized
  misc_feature (61): n=a or g
taatggcgaaggaaatgcatgtgcagtcagaagctcccctcaaaagacaagataaacaacncaggtgtctgcatttatcagctgagcacatctggggagaaaaatacaacaaagggagccc

SEQ ID NO: 31775 - DNA, 121 bp, Artificial Sequence
  Synthesized
  misc_feature (61): n=t or c
aaaataaccaatggaacaaagcagaaaagccacgttcccttggggacactgagctggtgangtgaaggaacagggccaggtggctgaatgcagcctcacagctctgccccccgagctgggg

SEQ ID NO: 31776 - DNA, 121 bp, Artificial Sequence
  Synthesized
  misc_feature (61): n=a or g
tggcaacagtaataggaaacaaagtgatggggtaagactgtggtaagatttcagagatttnttatacctcaaattcagaaagagattgacattcatgcttgtaatgagaatattattaatt

SEQ ID NO: 31777 - DNA, 121 bp, Artificial Sequence
  Synthesized
  misc_feature (61): n=a or g
agaaaggaaaaataaaaaggtagccatttccatgttacacagcagctcgtgccacgggtgnagaaacattcaacatggattttaataagcaaattttaagtcaaaatcagactagtcacat

SEQ ID NO: 31778 - DNA, 121 bp, Artificial Sequence
  Synthesized
  misc_feature (61): n=t or c
tgtctgtttctcgaagggcagttactgcaaggattatgaaggagcaggtctgcttttgctnaggaatgacctgaagcagaagttcttccatacaacatacatgtgactgttctgtcaaaca

SEQ ID NO: 31779 - DNA, 121 bp, Artificial Sequence
  Synthesized
  misc_feature (61): n=a or g
ccatcaccatttagagagagaaagagagatcccaggagagcagcccacctaacagaacacnctaccttcccatgactatcaatgccagccaaggccagagacgtccaggagagctgcatgg

SEQ ID NO: 31780 - DNA, 121 bp, Artificial Sequence
  Synthesized
  misc_feature (61): n=a or g
catcatggatgtgaaacatgggacacggggaacaatagcagttgtacttaagctgagggtnaccaggtcagtgctgaaaatgaacaagatctagctgattattcttacatgttacttacta

SEQ ID NO: 31781 - DNA, 121 bp, Artificial Sequence
  Synthesized
  misc_feature (61): n=t or c
ccaaagagggaacagaactgagaagaaaagcactttgctttctcacttgtaaggaaacacngaaacagtccactcagtgagcacagatttgttctgagctggagcaggctgggatgtgtcc

SEQ ID NO: 31782 - DNA, 121 bp, Artificial Sequence
  Synthesized
  misc_feature (61): n=t or c
gcatggcactttgcaaattaggatgtggagattagggttctgtggaggaaaaaacaagtanaaaagtgtttgggagaaagagaaaatgatataatgggaatgtgatggaattagataacat

SEQ ID NO: 31783 - DNA, 121 bp, Artificial Sequence
  Synthesized
  misc_feature (61): n=a or g
cttcagtgattccacttctcttcacctcatgcaagaggaagaacaagaagaatttgtttcntcaactgaggtcatctcatacctgtgcttttctcaatgagaaggaacatcattttaagag

SEQ ID NO: 31784 - DNA, 121 bp, Artificial Sequence
  Synthesized
  misc_feature (61): n=t or c
ctctcgcggggtttgcaggaaaaagggttttgcaagctttcttttgatggttgcctctcantgaaggatcctccgcaccttttatttctttagcaaagaaataagaactaccttgctcctg

SEQ ID NO: 31785 - DNA, 121 bp, Artificial Sequence
  Synthesized
  misc_feature (61): n=a or g
tgagcaaacaaaactaagatagttactctgttttagctttactataaaacaagacctaatntatcagctcctacattttgcaatatgcctttccatctggccaaaggattttaagtttgca

SEQ ID NO: 31786 - DNA, 121 bp, Artificial Sequence
  Synthesized
  misc_feature (61): n=a or t
tgagactctcacgcgtaactcataacttgctcagcagagaacactggatttttcacacctngaaacaaaacaaacttgtcttctacgctctaagctaagagcagctttgtttaagtggtta

SEQ ID NO: 31787 - DNA, 121 bp, Artificial Sequence
  Synthesized
  misc_feature (61): n=t or c
gaatacctcagaatactggtactgactgaactagcgtatctggagacagcagtgacctggngtgtacagtttgagagcccaatttgaggctattaggcagtaacctacccctgctaacaca

SEQ ID NO: 31788 - DNA, 121 bp, Artificial Sequence
  Synthesized
  misc_feature (61): n=t or c
aatgtagctattaatcatcacgcttaattgatggaaaaccaacttcctgggctttgaccgngctgctggctgggttttgcatgcatttctacactagggctgaaaaaaaccaaaactactt

SEQ ID NO: 31789 - DNA, 121 bp, Artificial Sequence
  Synthesized
  misc_feature (61): n=a or t
aactcctagattgctgttggaaagtaccatggacaattaaaggaggtttttatggaagtgncagaaatatctgtaacaccaggacattggtcagagcattttttccccgtaatttgtattt

SEQ ID NO: 31790 - DNA, 121 bp, Artificial Sequence
  Synthesized
  misc_feature (61): n=t or c
tcctttctttctttttcaaaggtggctgtttggtttggagggctcagctctgagcgttttnggaataagttcactacagacccttaaacatcttacttctgaaagcaaaaaacaagcagaa

SEQ ID NO: 31791 - DNA, 121 bp, Artificial Sequence
  Synthesized
  misc_feature (61): n=a or c
gcgttctttaggagaagcagtaaaattaaggatgccagaaaatctgccaacagttttccanaatttacttgagagtgaaaatgaattgacatgcaaaaggcttcatctgaatcagtccgga

SEQ ID NO: 31792 - DNA, 121 bp, Artificial Sequence
  Synthesized
  misc_feature (61): n=t or c
ttctaaccacgtgctggaataaaagtacatttctcccactaatacaattttgtgttggtangtaatcttacagctcttgtatgtgcagtgtaagatgtaccacacagcgacgcgtctcacg

SEQ ID NO: 31793 - DNA, 121 bp, Artificial Sequence
  Synthesized
  misc_feature (61): n=a or g
actggcttacagaaaacttcacaggtacttgtatttgaagacaaaacttatttgaaaagcntatcatacaattagcttgcaaaagactgcaagtcagatagcttcagacatccttcagaac

SEQ ID NO: 31794 - DNA, 121 bp, Artificial Sequence
  Synthesized
  misc_feature (61): n=t or c
gacagcaaatcatatatttgcaaccttctactctaaattgccataaggttttaagtatatnacaagggctgtattatgttctttatgtaccttctgaatggtaacaccaagagactgcaat

SEQ ID NO: 31795 - DNA, 121 bp, Artificial Sequence
  Synthesized
  misc_feature (61): n=a or g
gctttatgagtcttcaggaataaatcttcagaatggcagcagagtaacagagcagcggtancatttcacacattttctattattcaattcctttataaaattgacctttttgttaccattt

SEQ ID NO: 31796 - DNA, 121 bp, Artificial Sequence
  Synthesized
  misc_feature (61): n=a or g
acttgtaaagtgaaactgcatcttcacagttctgtatagtgaactcaatcgccttagtacnagctgtgggtctgcttatgatgtctttgttttgctgtgtgggacatagcttaggctgcat

SEQ ID NO: 31797 - DNA, 121 bp, Artificial Sequence
  Synthesized
  misc_feature (61): n=a or g
aactgcaggagaccctctggagggactcgtgtgtttggaaatcacagggtataaatctggntgcagttaggaagcagcccacagagagagcaaaaaagatctggtctttggctgagttaaa

SEQ ID NO: 31798 - DNA, 121 bp, Artificial Sequence
  Synthesized
  misc_feature (61): n=a or t
tattgctttcttcaatcgtacaataaaccactgttaatcatactgccagccaactgcttcngaattaagcagagaacactttattcaaaactcaggctaacaaaaccaaatgaacatctat

SEQ ID NO: 31799 - DNA, 121 bp, Artificial Sequence
  Synthesized
  misc_feature (61): n=t or c
gataatattcacagctctcctcatctgccaaactagacatttcattgtagaagctttccangttgattgggtacaattctgcctctattcatgtgagtctgttgctggctgcttctgtaac

SEQ ID NO: 31800 - DNA, 121 bp, Artificial Sequence
  Synthesized
  misc_feature (61): n=c or g
tagttacagcaaacatgaacgttatctgtataaacaaacaccttcctcgcactctattctntcttctttgaacccatactgtcacagcagtgtatgatctgaataattatgttggcggaag

SEQ ID NO: 31801 - DNA, 121 bp, Artificial Sequence
  Synthesized
  misc_feature (61): n=a or g
acagcagaaaggcacagcccccagctccattgaattacaacctaatacatgatgaaaaacnggtcaagggcaataaaagccagacaggaaatgggagagctaataaattagcatacaaggt

SEQ ID NO: 31802 - DNA, 121 bp, Artificial Sequence
  Synthesized
  misc_feature (61): n=a or c
acagcacatcaccttctggggatttcaggaggtgggaggtcttcagggctctatttgaagnagtagaaagaaacttttgagttatggatggctgctggaacagttaccagcttttgttgtt

SEQ ID NO: 31803 - DNA, 121 bp, Artificial Sequence
  Synthesized
  misc_feature (61): n=a or g
gcaggctaaaatactcaaggaggtgaagccaagaaaaccaatgaagtaactggacatgccnatgagttatgtcagacaggtattccctttattactgcactgggtgaatgggggatcgctc

SEQ ID NO: 31804 - DNA, 121 bp, Artificial Sequence
  Synthesized
  misc_feature (61): n=c or g
acagaaatttctgcgaagaaagtctgatacagaaattgaaaggctgcagaacctgggcagnagtctcgctctctgaggagacaaaccctcccttggggcgctctgctgcacaccatgcctg

SEQ ID NO: 31805 - DNA, 121 bp, Artificial Sequence
  Synthesized
  misc_feature (61): n=t or c
cttggtctggagaaacagaatggcacctgaactgctgttccctcaaggttggtctcattantgcacacccccaccacaaacacagccccatctgctgccttcccttcccaagtaccttgat

SEQ ID NO: 31806 - DNA, 121 bp, Artificial Sequence
  Synthesized
  misc_feature (61): n=a or g
ctccagggaagtgaggttgcagaacatcactgtgcgtttttcaccacgtggctgcacaganggacttggcccagcactgcttcacagggtgggatgggatttgtcctaacgttccagccat

SEQ ID NO: 31807 - DNA, 121 bp, Artificial Sequence
  Synthesized
  misc_feature (61): n=c or g
agtgagaaatatttgtataaaactactcatgacacagagaaggaactatgcgaggtcccantgggctgtgtgaagtcccagcttggtagttgtcaaacgatgtgtgcttacagccctgagg

SEQ ID NO: 31808 - DNA, 121 bp, Artificial Sequence
  Synthesized
  misc_feature (61): n=a or g
aagaatcgtgtcatcctaaacaaggagagaacagtacagcacttatattctgtctgagganaggaaaatggacagaagtctgggtgcgaaaagcataggagttcttcacagctgtctctta

SEQ ID NO: 31809 - DNA, 121 bp, Artificial Sequence
  Synthesized
  misc_feature (61): n=a or c
atgtatgtgaggattatgataattctgacaaaattaataggaatcagccctctgcactttnggaaaaggcaacacattattaaaatatactgcagataacactaatcaaccatgccagcat

SEQ ID NO: 31810 - DNA, 121 bp, Artificial Sequence
  Synthesized
  misc_feature (61): n=t or c
aaagtccataaacatccatctttgttgtcaaggctgccttcgggccaccggttcttttgcntctgaagttgttcctattaaactgactgatgatccaatttgttcaccaaccgagtgctgc

SEQ ID NO: 31811 - DNA, 121 bp, Artificial Sequence
  Synthesized
  misc_feature (61): n=t or g
tatgtgaaatcacataaggaaacaagggatatcttcatgacttcctataatcactctgttntctgttatctttttagatattctttcatagctttggaactgatcacaggtctcttctgat

SEQ ID NO: 31812 - DNA, 121 bp, Artificial Sequence
  Synthesized
  misc_feature (61): n=a or g
cctttccaagacactgcttttcagtgacatggtgctggatctgggaagttagaggtgttgncagtcggtgaagcacatcagctatccagggatttctgcactatgccaggtatcagccatg

SEQ ID NO: 31813 - DNA, 121 bp, Artificial Sequence
  Synthesized
  misc_feature (61): n=t or c
tcggctcttgactttgtgcagcactttcagggatttttgggggggtgatgccccagggtanagcatgtgctgtcagtgatggagggccacgaggaggtatagctcccatggacctgatgga

SEQ ID NO: 31814 - DNA, 121 bp, Artificial Sequence
  Synthesized
  misc_feature (61): n=a or c
tacagttactggtttccttctgttgagaattagatcagcgagttctagtgtcactagttcnattgccatattcctgctatatttggtgacatttctcacagaactccagctccaacttcta

SEQ ID NO: 31815 - DNA, 121 bp, Artificial Sequence
  Synthesized
  misc_feature (61): n=t or c
cttaagtacttcactgtcttttgtcttgaaaaagttcttcctaatttaaataaactttacnttaaagacttccctagttcttaccctatccaccatggaatgtggatattccctcttccct

SEQ ID NO: 31816 - DNA, 121 bp, Artificial Sequence
  Synthesized
  misc_feature (61): n=a or c
ccatggggaagccccagcgtctgtactaactgggtggcaataaacttttaggacatcttanagctgtgtggttgcattcctccaaagcttattgggtaaggctttctgaagagctgctcac

SEQ ID NO: 31817 - DNA, 121 bp, Artificial Sequence
  Synthesized
  misc_feature (61): n=t or c
cagcaagagccagacctcttaccccttcaggctgctcagcagtgtttgagcaaaccccatngatgcacaaagtccagctcaaatgtagaagcaggatgtgtttatagatttcctaatgaac

SEQ ID NO: 31818 - DNA, 121 bp, Artificial Sequence
  Synthesized
  misc_feature (61): n=a or g
tgcttgagtgtggcttaagtttcagatgaagtagtatgggctctctaaaccagtattttanagttatagtccaccttattttatccaagagcttccaagcttactgttaataaatgtcaac

SEQ ID NO: 31819 - DNA, 121 bp, Artificial Sequence
  Synthesized
  misc_feature (61): n=a or c
gatgctccccagccagggcacaagatgccacagctacacagcatggtacctaacaagccangcaaaggacttccagagaaggcagaaaaatcctggtgctggttatttgaagtctgcccct

SEQ ID NO: 31820 - DNA, 121 bp, Artificial Sequence
  Synthesized
  misc_feature (61): n=a or g
cccagaccaagggctgcagaaaagagaaactaccatctcctgtgcaggccatcatcacagnatttattttttggacaaaatgcccatgctcttattccactgtcaagccacagaagtttac

SEQ ID NO: 31821 - DNA, 121 bp, Artificial Sequence
  Synthesized
  misc_feature (61): n=a or g
tcgaagtgtatgaagatagcagatcttaaaatgtgtatttttggcttgtttgcagattacnttgtacccgggcttaaaggtatcattctggagttgaattacgctggcactgtgctggaag

SEQ ID NO: 31822 - DNA, 121 bp, Artificial Sequence
  Synthesized
  misc_feature (61): n=t or c
gtgaggtttgggtgcagtccagcatgggggagtcactagggcagtccgtgggcttgaaggnatgtctctaagcattttgctgagtaaaaccttttcttgtggaacataactatgggaaagc

SEQ ID NO: 31823 - DNA, 121 bp, Artificial Sequence
  Synthesized
  misc_feature (61): n=a or t
agagcaccacaaagacagaagggaacctcttcccacaagagattccgcagaaataccagtntgggacagaatgagagagcattactggaaatcctaatacacagtacagagcaaagggtga

SEQ ID NO: 31824 - DNA, 121 bp, Artificial Sequence
  Synthesized
  misc_feature (61): n=t or c
ctgttctatttcggtatagcatcatgtgtggatgctgtgtcttccagaatgagtgagaganggggaataagaatgttggtctatggaaaagcaaaacaggaagcagggctggatgctattg

SEQ ID NO: 31825 - DNA, 121 bp, Artificial Sequence
  Synthesized
  misc_feature (61): n=a or c
attcttctcccattctttttgaaatctcaagaaagtctatgtgaacactttcagcaacctngaagtaaagaatctatcacattcctatataagggcataacttcttgtcttgccaactctc

SEQ ID NO: 31826 - DNA, 121 bp, Artificial Sequence
  Synthesized
  misc_feature (61): n=c or g
atgccccaggtcagcttgtgcatctgacaaggcttgcaagttcctcttcctaaattccctntgtgaatgttttagcatgtctccgctcccccaagttcccactgatagggactatcttaaa

SEQ ID NO: 31827 - DNA, 121 bp, Artificial Sequence
  Synthesized
  misc_feature (61): n=a or g
acatctccttgatctaggtgtaagcataaacatagcagcttttctggattaaagccacaancctcagttggcaaaaccaccagtcttggagttcagaacgtacctacttccaaaaaatgga

SEQ ID NO: 31828 - DNA, 121 bp, Artificial Sequence
  Synthesized
  misc_feature (61): n=t or g
taaagttcagtttaaattgggtgacgttgcatatatggaaagcagctatttgcattcttanaatcaatatactaaactctaaacattctagaaattaatagtcttcaaaacatttcctaga

SEQ ID NO: 31829 - DNA, 121 bp, Artificial Sequence
  Synthesized
  misc_feature (61): n=a or c
ggcagaacaagctttgcatactaagacctcagtcttcagaaatgtcacagtggcaccttcntaagcagcaaattcacttgcaaaagtgaaacccttaatggctccaatgacataacttcat

SEQ ID NO: 31830 - DNA, 121 bp, Artificial Sequence
  Synthesized
  misc_feature (61): n=a or g
ggctctgcacccggcctgcttgcttcacagctaccaccacagagctgcagaaaagataccnagaggaaggaaaaatagaaatagagactaacaatctgctctggactgaatatgtttctat

SEQ ID NO: 31831 - DNA, 121 bp, Artificial Sequence
  Synthesized
  misc_feature (61): n=t or c
atttgatgtttgacttaattctttttcaaatatgtaaattttatagcttacaattctgctncaaaggattctgccttgctttgactgacatttgtcacacagatatggtagagaaaaatta

SEQ ID NO: 31832 - DNA, 121 bp, Artificial Sequence
  Synthesized
  misc_feature (61): n=t or c
caggcatatagcattctctttatgcagtgtgactttgtctcagactgaaatagggcacagntgaatttgtaaatagtccagcattcaccctttcgtccttgtgtaaatcaaaacacaaacc

SEQ ID NO: 31833 - DNA, 121 bp, Artificial Sequence
  Synthesized
  misc_feature (61): n=a or c
tctgttgtctcagttttattacatctgtggctaacgtgagtaagaaactgttgtgttgtanacagatgtttaaagctgatgctgtcaaaaaatgccaaaggttcacacacaatctctgtta

SEQ ID NO: 31834 - DNA, 121 bp, Artificial Sequence
  Synthesized
  misc_feature (61): n=t or c
ttaatgcacatcttaaaggatgtaaggaaatctaaatgggagaagggaactggaagtattntgaatatatttagaagcactgagcaaaaggtgacacgagtattttcatatcgccagccag

SEQ ID NO: 31835 - DNA, 121 bp, Artificial Sequence
  Synthesized
  misc_feature (61): n=t or c
gttttattgtcctttcagtgttccagtgtgctcattttcacgacttaaagaacctattttnactgccgagcaaatgttttgtggtcaacattgtacaaatgctgtagccgagcccttgtct

SEQ ID NO: 31836 - DNA, 121 bp, Artificial Sequence
  Synthesized
  misc_feature (61): n=a or t
gttcttcagttgaacttcataaaggaccagaattccacttcatttggggtttgaaacctanacgctcagcaggcatcacacatggaagtctgcaccctacactcaatgcctgctacattca

SEQ ID NO: 31837 - DNA, 121 bp, Artificial Sequence
  Synthesized
  misc_feature (61): n=t or g
ctgcagcactgacgatgtgctcccaagtatggctgcagctggaatgcttataataatgatnctgttgaatttgaatctcatcttttaaacacaaagggaaatggcagcaaatgtgatggtt

SEQ ID NO: 31838 - DNA, 121 bp, Artificial Sequence
  Synthesized
  misc_feature (61): n=c or g
cagtcgtctctcatgaattaaaggagcaacatcattaaagtttgggaaggtgagcagaagngatctgctcctttagtaaaaaccctgctgggataacaagataaagctgaaatatggaacg

SEQ ID NO: 31839 - DNA, 121 bp, Artificial Sequence
  Synthesized
  misc_feature (61): n=a or g
gacttaaacccaaaagtcagatattcagatgagagtttccctccaggaagcacagcacaanacccgttcaaactagcttaaacctactgtgacaaggcagctgctttccagtggactctga

SEQ ID NO: 31840 - DNA, 121 bp, Artificial Sequence
  Synthesized
  misc_feature (61): n=c or g
acagcatggaaaaaaggaggggggaaaatgaaagcgagagaatgaagctgagacagaaggntgctgactgaaagcacagcgagcaaatagaggcagaagaactgggtttcttttttcctgg

SEQ ID NO: 31841 - DNA, 121 bp, Artificial Sequence
  Synthesized
  misc_feature (61): n=a or g
cctgcacagagctatccagacccacaaacatcggttgcagtttgccactcactctgttgancatttgggcagtgacatgagtgtttcatagcgttcaacccagaaggttcctgctcttccc

SEQ ID NO: 31842 - DNA, 121 bp, Artificial Sequence
  Synthesized
  misc_feature (61): n=a or g
cagagccagagctgggaaaagagagcatgactaatgttctgtatgtcctgagcaagtgacnctcatgtctggatcttctcccatccacttcaagtactactacttctcctgcatcacattt

SEQ ID NO: 31843 - DNA, 121 bp, Artificial Sequence
  Synthesized
  misc_feature (61): n=c or g
gctcttctcattacatcggggttgataattcagaacatgaaaaaactcagactgccttttnctgttacacgttcccatgcaccatctcactgctttagcaaagcttaaaacattttttttt

SEQ ID NO: 31844 - DNA, 121 bp, Artificial Sequence
  Synthesized
  misc_feature (61): n=a or c
gttgttgccattctctggggtggtcccagtcctcacgtggacttggtactggttttctaangagagctgacagccgtgggcacagcagatgaatgccagcagaggcgtgtgctaggtttgc

SEQ ID NO: 31845 - DNA, 121 bp, Artificial Sequence
  Synthesized
  misc_feature (61): n=a or c
ccaaacgagctggttgaggcagccacatcacttccatacagacaaattaactgctggaaancacgacagtgatatgaaatacacatgaaatatctgttaatgcctatacacgagatatgtg

SEQ ID NO: 31846 - DNA, 121 bp, Artificial Sequence
  Synthesized
  misc_feature (61): n=t or c
ggtgagtaaaataaaaaacccatccttatctctgtaactcagcatttctggatgtataagngatagtttaagagcacaattccagacctttttaaagttctctgatctaaataacctaaaa

SEQ ID NO: 31847 - DNA, 121 bp, Artificial Sequence
  Synthesized
  misc_feature (61): n=a or g
cataacaaaaacacaaggcctctatgtgcctgactcaaacagtctcttttctatgtggacntcttgactttcagctattgttagtgtctcagacatttgttcatgacttccaccacatgct

SEQ ID NO: 31848 - DNA, 121 bp, Artificial Sequence
  Synthesized
  misc_feature (61): n=a or g
gactgcaggctcccctggcagaaccaagcatcctcaagtcatgatgtgtttcaagagcacntaacatgccaatctaaacatgaatccttgattcatctctccttgatcaaattcacactta

SEQ ID NO: 31849 - DNA, 121 bp, Artificial Sequence
  Synthesized
  misc_feature (61): n=a or g
ctgctcttttgcctgtacactaaaagaaagttatcacttggggtccagttttggagaagcncttagcatttgccacaagacattaacgtaattaataattaagtaaagcaataagttatta

SEQ ID NO: 31850 - DNA, 121 bp, Artificial Sequence
  Synthesized
  misc_feature (61): n=t or c
taacagcttacacggggcttggggctccaagtgcttgagggagaaaaccactacggactgngaaactcactgtatgagggaagcatctgaaagctctgtacatggcagttggttatgcaga

SEQ ID NO: 31851 - DNA, 121 bp, Artificial Sequence
  Synthesized
  misc_feature (61): n=a or g
gtagtgtgaatgaccctgatttaagtaagtacctctacacatacaactgaccaaatgctcntagtggtgcagagaggtaacacagaatgtatcctctattcatgggctttaatgccacatc

SEQ ID NO: 31852 - DNA, 121 bp, Artificial Sequence
  Synthesized
  misc_feature (61): n=t or c
tattttctatgttggctttctaccctacgatgaagcttttccccagtgagtgaccctatgngattgataaaacttccagtggtgagctttgtttttgtcaaagatataatcaccacatttg

SEQ ID NO: 31853 - DNA, 121 bp, Artificial Sequence
  Synthesized
  misc_feature (61): n=c or g
tgtaacataactacacttgaaattcctctactgagtactgaaaagactccttgcaagtatntaaccaaaaaacaaagtcagaaagacagttttctggtcttattacaataacttgagggat

SEQ ID NO: 31854 - DNA, 121 bp, Artificial Sequence
  Synthesized
  misc_feature (61): n=a or g
gtgctgccacgtccgtgctcaggcagaggttgctggctgtgagcagcgtgcggccagaccncgtccgagatctcatttaagaagctgtacgttgctcaagtcgctttgtgatgctcgaggg

SEQ ID NO: 31855 - DNA, 121 bp, Artificial Sequence
  Synthesized
  misc_feature (61): n=a or c
gattaacagccaggctgagacagctaaggccacaagaggtatgagaggctacacaactcanggatttcaaccttcttggattcgagattatgtgtcccagcagaggtgccaatctctgtat

SEQ ID NO: 31856 - DNA, 121 bp, Artificial Sequence
  Synthesized
  misc_feature (61): n=a or g
ttgggtgctttttaaatgttagctgggagactggagccaaccagaggtctgtggtcaagcngacagagtcagagaaaacattacacctgagtgggccagctaatacagcataaacttaaag

SEQ ID NO: 31857 - DNA, 121 bp, Artificial Sequence
  Synthesized
  misc_feature (61): n=t or c
gctttcacttttggagttccacaaaactagaactcaggaaagttttctttcaaatatagangcatgcttcaactctcagacaaggccaaagcaacttttagtcaacaggtaagcaaaaacg

SEQ ID NO: 31858 - DNA, 121 bp, Artificial Sequence
  Synthesized
  misc_feature (61): n=a or c
ctgaggttagttatgtttttgtgtccttacaacttgcagaatacttcgagcattgctgcancataaatgccaccagcatgctggtagcagggatggcttacctgcatggactgtgtgtggt

SEQ ID NO: 31859 - DNA, 121 bp, Artificial Sequence
  Synthesized
  misc_feature (61): n=a or g
aagaatatgcaaaaccttcttccctgggagcagagtgtgccaaatttggtgggacttagcnaggaaacagcatctggctgtgccctccagccttgtgcagcaatactcaaacagccttttt

SEQ ID NO: 31860 - DNA, 121 bp, Artificial Sequence
  Synthesized
  misc_feature (61): n=t or c
aatgtgggatttaactcattatcatcccagtcatagcagtcatctttctaattatcatccnaacaagaatatctaagcagatgtcttctttggggggacatggtgaatcttggtcccttgt

SEQ ID NO: 31861 - DNA, 121 bp, Artificial Sequence
  Synthesized
  misc_feature (61): n=a or t
gaatttctaccaccatgacgatgaacttttctaagaactgatgaccacgttttcagtaagnacaaagctacctttgaaagctttacctgaagttgatcctgatgcttaatctgaaaatcat

SEQ ID NO: 31862 - DNA, 121 bp, Artificial Sequence
  Synthesized
  misc_feature (61): n=a or g
ctttcagtttcagccttctgttgacaagagatctcaactcaagcactatatttgatatgcngccttctagaacgtgtactttgaccacctgtgtgcacatgaaaacttagttttaggatct

SEQ ID NO: 31863 - DNA, 121 bp, Artificial Sequence
  Synthesized
  misc_feature (61): n=a or t
gggctttgaggcttggattttgcttctgcccatgcagtgtgtagcacacaaggagtcctgnctgcccatcaggatgtatatatatttgatatattcttactgcgtcaggcacagttcccat

SEQ ID NO: 31864 - DNA, 121 bp, Artificial Sequence
  Synthesized
  misc_feature (61): n=t or c
gagcccaaaggatgtcccggagctgacagagactgtccgcaacatcatggttgatgttttngctgagatgtctgcaaatccctgcagggattggcctgcagagcttcctctgctcccaagc

SEQ ID NO: 31865 - DNA, 121 bp, Artificial Sequence
  Synthesized
  misc_feature (61): n=t or c
tgttgggtttgtttttttcctcaagtttgaaatgaacttatgaaaatggatgtattgctanccagagaataaagctttcttttttctcagttcaaatatgtcttcttgaggtgggctggat

SEQ ID NO: 31866 - DNA, 121 bp, Artificial Sequence
  Synthesized
  misc_feature (61): n=a or t
aagctggtatcccagaagctcgttatcttgctgccgtataacacgtggcaagatacagacnttctagcagaatcaagggtcctcaaagattaaagaaaatgacagacaaatgttcatagtt

SEQ ID NO: 31867 - DNA, 121 bp, Artificial Sequence
  Synthesized
  misc_feature (61): n=c or g
gctcccctgttttgagaattattttacataagaaagattaagaacatcacacaacaaacantaaccagagaaaaacctaaaactcttaaagcccaatcagaaattcaagggctttttctga

SEQ ID NO: 31868 - DNA, 121 bp, Artificial Sequence
  Synthesized
  misc_feature (61): n=a or g
gcaaaattacatggaggagcttctttctgctttgggttctatagttcagtctgcaaatacntacttagctgggttgacgttgttacaggcaattctcttgtggaagaaggtatttctacaa

SEQ ID NO: 31869 - DNA, 121 bp, Artificial Sequence
  Synthesized
  misc_feature (61): n=t or c
ggtagtgtaacaagaaaaggagagatgcagctggagaacactcctgcctgagcacaaaacnccttcagctatttgcattgatagaaactgctagctgattttctgtccccgcccgagcaca

SEQ ID NO: 31870 - DNA, 121 bp, Artificial Sequence
  Synthesized
  misc_feature (61): n=c or g
tgagcgatttgcgcacctccaggagaggcggcggttccttcttttggggggggtttctgtntgtgttttgtttggggtttggctctgatccttttatgtatttttttccttttttaagctg

SEQ ID NO: 31871 - DNA, 121 bp, Artificial Sequence
  Synthesized
  misc_feature (61): n=a or g
tcataaattaaagcaactatacagtaaacttttgagcagccttactgaaatatgaattacntaaaatagagaagtacagtgggacctaaagttgcacttgccttatctccaggtctcgtgc

SEQ ID NO: 31872 - DNA, 121 bp, Artificial Sequence
  Synthesized
  misc_feature (61): n=a or g
ggactggggcacctcatcgacccaggctcccagttgggtgcacgtctttctaggagccgcngggactgaccgtatcatgcaggttgggagcgtgaacaggctcttggctttgtgtcctccc

SEQ ID NO: 31873 - DNA, 121 bp, Artificial Sequence
  Synthesized
  misc_feature (61): n=a or g
gcaatctttcttataccttcaaagccacgcttgctaaatgttactcagggttttagctgtnccagctcatcttgtgagttttcacaattttaccaatatacaaaacatgtaaaaagaagca

SEQ ID NO: 31874 - DNA, 121 bp, Artificial Sequence
  Synthesized
  misc_feature (61): n=a or g
tttgcagtgggaagacacaaggttagatctttgtcctgtaggctcagtgacagaacttcancctctcacaccaagagagccgtgatttcatcagagactggatacttaatgcaatattcac

SEQ ID NO: 31875 - DNA, 121 bp, Artificial Sequence
  Synthesized
  misc_feature (61): n=t or c
tatttctgtaccaaacagaattcccaaattaggtgtgtatacagtctcaactctgttaacntttggttctgcatggggcatctttagttcatcttgtagacaagacagattgagaaggagc

SEQ ID NO: 31876 - DNA, 121 bp, Artificial Sequence
  Synthesized
  misc_feature (61): n=a or g
gtgatgtgaccctaaccaagtaggaagaatttatgctggataatgctgccggaggtacagncctcatgcttaccaccatgactgcaaggcaaaacacacgaaaacaaaaaacaaacactga

SEQ ID NO: 31877 - DNA, 121 bp, Artificial Sequence
  Synthesized
  misc_feature (61): n=t or c
aataaacttcattaaaatctgttttttacttattcttagtgcactgttgcaatcactgcanttctatttcttagatgcaattgattaaatttactccatttacagtgaaggactgagaggc

SEQ ID NO: 31878 - DNA, 121 bp, Artificial Sequence
  Synthesized
  misc_feature (61): n=a or g
gtcatcatcaacccctcagatcatatttgtgcagaagcccaaaaggctctaaatatgcacntgcactgcaattatgaggtaatcaaactaaaatgtaacaattttggagttaaactgaaaa

SEQ ID NO: 31879 - DNA, 121 bp, Artificial Sequence
  Synthesized
  misc_feature (61): n=a or g
tggcttggcagcatgcactgtaagaaaacgtgtcagaatctcatcccaaagaacctggggngaaaaaatcccccacgctttcccatatgtgtgaagaagagtatttggctgtttttatttc

SEQ ID NO: 31880 - DNA, 121 bp, Artificial Sequence
  Synthesized
  misc_feature (61): n=a or g
ccacgagctgcagatgaatgactccaccgtggactttgccgaggatgtgggcgtgcagctnacagtgcatcgtgcccgcatccaactcaatgccacctggcaagcacagctgggcgcatgg

SEQ ID NO: 31881 - DNA, 121 bp, Artificial Sequence
  Synthesized
  misc_feature (61): n=a or g
taaaacagagcttagcctgaacaaattatagacttataatgctgctgcaagtacagaggancatgaaatgaaaaccttcccattcaggtagtacacagtgaaatataaccaggactgatta

SEQ ID NO: 31882 - DNA, 121 bp, Artificial Sequence
  Synthesized
  misc_feature (61): n=t or c
agggtaattacctacatgcagttcttgtttaatagatcttcctagccttatcacagtttcntgctactctacatctggtgctaaatagtagctatataagccacctgtactaatgttatac

SEQ ID NO: 31883 - DNA, 121 bp, Artificial Sequence
  Synthesized
  misc_feature (61): n=a or g
gcacttataaatgagtattctggagtatttccttgtgtcaaggccaagtaaatgtgtgtcngttatagatacctaatagacaaataggagatatgttacttgcttttaccatgataaattg

SEQ ID NO: 31884 - DNA, 121 bp, Artificial Sequence
  Synthesized
  misc_feature (61): n=t or c
gaagctaaggtatggggtactgatttagaaagaatgcatgctgatttcccagtagtattanacactactatccatgctatgatcaaactcctatactgatgattgaacttgaagtacccta

SEQ ID NO: 31885 - DNA, 121 bp, Artificial Sequence
  Synthesized
  misc_feature (61): n=a or g
cttctccacaccgcttccttcttgtgtttaatgtgcatgttaatattgaagtacctttggnggatttcttgttctattggtggtcggagcgtagtggatttaaggagaggaagtttatcaa

SEQ ID NO: 31886 - DNA, 121 bp, Artificial Sequence
  Synthesized
  misc_feature (61): n=c or g
tttccattcacaactctgtgtttaattcaagtgatgttataccccccaagagatggctttnttactctaagtaccttggatagtgattgtacttgctattctattatttggtttgcaaaag

SEQ ID NO: 31887 - DNA, 121 bp, Artificial Sequence
  Synthesized
  misc_feature (61): n=a or g
tactaataacccctcgataatctcttgctttatgaaatgtttaagattgagtatcaagaantattaaaggcgtgacagttggtactgtaataagttgtcatagctacttgtgatgctgcca

SEQ ID NO: 31888 - DNA, 121 bp, Artificial Sequence
  Synthesized
  misc_feature (61): n=a or g
agccacgctgatgggacacactgagcaattaggtaaggaggtctagacacccgtgtgcagnttcagatggagactgtgctaatgaggactggggacaacgaggtgaggcagcagtcaggct

SEQ ID NO: 31889 - DNA, 121 bp, Artificial Sequence
  Synthesized
  misc_feature (61): n=a or g
taactatactttgctcctacacatttcagccaaaaccaaccatacagaaaagtggcactcnctgggagatgtttgactttacttagcctaaggcagttgcaactgcttctcttcaaactca

SEQ ID NO: 31890 - DNA, 121 bp, Artificial Sequence
  Synthesized
  misc_feature (61): n=t or c
tatgtttctgtagtcctttcgtggcttggaaaccaaagctgctgcaaaggtgtttctgaanggtgcatttttagaagtaaactgcagtgctgttgttgacacatgaaatagcagtagcctc

SEQ ID NO: 31891 - DNA, 121 bp, Artificial Sequence
  Synthesized
  misc_feature (61): n=a or g
gtggatttgggactcaggtcaaaaaggaggtgcagcttctccatgcccttggtaccacccntcctctgtgctccaggacatggtttttgtgctgggaggactgcacggcgcagttgggctg

SEQ ID NO: 31892 - DNA, 121 bp, Artificial Sequence
  Synthesized
  misc_feature (61): n=a or g
caattcctcaactcagtgcataattggagaataaactgtgaagtagttctggaaatgagcnacattccactgcctgaagagctttaacattcaggtggaacctacccatggtaatcagtgg

SEQ ID NO: 31893 - DNA, 121 bp, Artificial Sequence
  Synthesized
  misc_feature (61): n=a or c
attttcattatccagattcttttcacgaaaaagatatgacaggttgtgatattggactgtngtgaagtcccagctgtgctattctactatttagatggaacagtgctggggccatgcagtt

SEQ ID NO: 31894 - DNA, 121 bp, Artificial Sequence
  Synthesized
  misc_feature (61): n=t or c
cattacccaataattacgtgctatacacttcttcttacataaaaaggtagtaagttacttnctacctactgtgtccacagcatttagagattcataattttacaaatgtatttcagttctg

SEQ ID NO: 31895 - DNA, 121 bp, Artificial Sequence
  Synthesized
  misc_feature (61): n=t or g
gagtatacaaatagcttaaaaggggggtcaggaaagggaaagcctaaaatagcaggcagtncagatgcttgcaaatttgagctggttctccctgtctttcctgagcgcaggtgctgctctg

SEQ ID NO: 31896 - DNA, 121 bp, Artificial Sequence
  Synthesized
  misc_feature (61): n=a or c
taggctcagtgtcacagccatggcttggctccctcttgtcccatcttgactgtgaatgtgnagttaaatgatgccagcgttgtcttgctggtcctgacagcatcgttctgtatctcccccc

SEQ ID NO: 31897 - DNA, 121 bp, Artificial Sequence
  Synthesized
  misc_feature (61): n=t or c
aagcacctgggtttgttcaaaagttatttcttacctgactctaaagccagatgatgctctngggacaggggatgactgtgtcgaagtcctcatgtccaacatttgattcatgaccttcatc

SEQ ID NO: 31898 - DNA, 121 bp, Artificial Sequence
  Synthesized
  misc_feature (61): n=a or g
cagctccgttacgggcacggtgggtcgggtttttttaagcgagtaaagccacgaaatcagngtgcacacgttgtaagcacgcagcgactgatactttttaaaatcgacgtccgaacgtcaa

SEQ ID NO: 31899 - DNA, 121 bp, Artificial Sequence
  Synthesized
  misc_feature (61): n=t or c
aagcctgaaaaaatgcagcagaaaaatgagggaacagagtcactgacatgcacgtaggacntatgttccaatatgcactctcagactgtagttgcagtaacttgttttacagttggatatg

SEQ ID NO: 31900 - DNA, 121 bp, Artificial Sequence
  Synthesized
  misc_feature (61): n=a or g
cacaatgcattactgctgatttcatcacggaacctttgcaaaatgaatacctggaagctcnggtcgtcctgatacatacactgaatcaaacactggagatgatgtgcttggaacatttact

SEQ ID NO: 31901 - DNA, 121 bp, Artificial Sequence
  Synthesized
  misc_feature (61): n=t or g
acgaatcacaaggtatatgaggccagatgctcatctaaagcaaatcagcataagttgtctnacctgaacagagttgcactctctcattctggctgaggatttctcatttttaatgtcattt

SEQ ID NO: 31902 - DNA, 121 bp, Artificial Sequence
  Synthesized
  misc_feature (61): n=t or c
agagaggagagtttgcaaggagtgatcagttgaagaccacagaactagagaagaggaattngagcagtgtgaaaaacgcgggcatcagaaaacatagagtgcagagttgccttgcttagag

SEQ ID NO: 31903 - DNA, 121 bp, Artificial Sequence
  Synthesized
  misc_feature (61): n=t or c
aaccacagagtaccttctgttgtcacatagtgatacaccttgacctctgtaatcacagtantggggctgtaatttgcagatagctattggcactttcagcgaacaccatctcttatgcaat

SEQ ID NO: 31904 - DNA, 121 bp, Artificial Sequence
  Synthesized
  misc_feature (61): n=t or c
atgaaagaaaaaaaaaagttttatgaatttcaatactcaaatgattagatgcattcacccngtaactgtggaaggaggttatatgagatccagtagcgtggagcttctggaagtcaggctt

SEQ ID NO: 31905 - DNA, 121 bp, Artificial Sequence
  Synthesized
  misc_feature (61): n=t or c
aatacaaacaaatatatcagaatctaataagcaatgggagaagaactgtacatgaggcagngtaactacagaagtaaaaaaccgttctattagtaaatctacctttttatatttttaatta

SEQ ID NO: 31906 - DNA, 121 bp, Artificial Sequence
  Synthesized
  misc_feature (61): n=a or g
aacagtggagccactcaggcatttggcacatcgcggccttgcgaggtcgagactcaaagcnggcaggtttttcaacctggcatatttttacatccccggatttacttactctgcaaagttc

SEQ ID NO: 31907 - DNA, 121 bp, Artificial Sequence
  Synthesized
  misc_feature (61): n=t or c
atggaggccttccttctagcagtacgccgcttcctaaatggagcaagcagcagccttcccntcacatacagcacgtttagtagcctaggctgaggacttggggaactcggtatttcttcct

SEQ ID NO: 31908 - DNA, 121 bp, Artificial Sequence
  Synthesized
  misc_feature (61): n=t or g
agggctcactcaccagcaagcaggtcaggccacttactgccataagggtattttattgctntattcacaggctaatctaaaattcctctcgcattgggtgatgtacaaacatgctccaaaa

SEQ ID NO: 31909 - DNA, 121 bp, Artificial Sequence
  Synthesized
  misc_feature (61): n=a or g
ggggcacgttgcagggtagggtttgggtttgctggggcttcaatgtatacatacctggcanagggactctgacttgggcattcatgcagaggaatctgaatgttgggtgtatgtgcatctt

SEQ ID NO: 31910 - DNA, 121 bp, Artificial Sequence
  Synthesized
  misc_feature (61): n=t or c
tctggcaccgcagacacgactactggctgctggcagggattgtcacgtaccctttggcttngtgggtgatggctttcccatgccaggcggagggggctgtgagggcagtggggagggaggt

SEQ ID NO: 31911 - DNA, 121 bp, Artificial Sequence
  Synthesized
  misc_feature (61): n=t or c
ttttctttacagcctcttttcctgtcactactcccgctgacaaagagtcctctccatcttncctatagactcccctaagaactggaaggctgcaatgacgttgttccaaaatcttctcttt

SEQ ID NO: 31912 - DNA, 121 bp, Artificial Sequence
  Synthesized
  misc_feature (61): n=t or g
ttccatttcagaatgcagctatctaacttcagctcttagtaagtgcaccttggcacatttngtctgctatattatgtagtccagttctaccaagatcatctgtgtgctctgattgagccag

SEQ ID NO: 31913 - DNA, 121 bp, Artificial Sequence
  Synthesized
  misc_feature (61): n=c or g
tacataacttcttggttggcaggcaggattgttagggtaaaggggtttaaatggactctanaaatcaaacttttaagcaagcctctacagaagagcaaaattgttgttgaagaggatagga

SEQ ID NO: 31914 - DNA, 121 bp, Artificial Sequence
  Synthesized
  misc_feature (61): n=c or g
aagaggatgcagggctagtgaaaacctgagtggcatacagtgcctggttttctgtctgtanagaataatccatacctggcatagagccactgggatcagtgtagttacgctagcagaactc

SEQ ID NO: 31915 - DNA, 121 bp, Artificial Sequence
  Synthesized
  misc_feature (61): n=t or c
ccccttccttctgaaaatatgccttactgctcaccttaagctcttaaaatataatcacccnaataaaatgcgtggcttttaatgtggctgttacattctgatgaactccagttgctgatgt

SEQ ID NO: 31916 - DNA, 121 bp, Artificial Sequence
  Synthesized
  misc_feature (61): n=t or g
gtcagctgctgctgcttaggaggaaacatcatagtttatgccaaagcttacaaatttacanatccatactgacaatcaggcaactgtaatagtaaatcactttaagaaaagctcatttcct

SEQ ID NO: 31917 - DNA, 121 bp, Artificial Sequence
  Synthesized
  misc_feature (61): n=t or c
aaactattttacatttaggtttccagcaattcagttcattccagccttctcaccaaccacntgacaattcactacaacaaacatccaagtcgtgtaagaattccagtttctcattcctatc

SEQ ID NO: 31918 - DNA, 121 bp, Artificial Sequence
  Synthesized
  misc_feature (61): n=a or g
ctccttcttcctccctcatcatcctctgcacccgttggcagcatctggacatacgcagacnaagagttgctccttccattcctgctggtttaacgggtctgaacacctccctgctcttgct

SEQ ID NO: 31919 - DNA, 121 bp, Artificial Sequence
  Synthesized
  misc_feature (61): n=a or g
ttacaaagaacattgcattttatgcatatgttatctgtttctgtaggaaatccaacttcanaaagatacatggcaaaactgtcttatcaaagactgtagctacaatcactggcccttaccc

SEQ ID NO: 31920 - DNA, 121 bp, Artificial Sequence
  Synthesized
  misc_feature (61): n=t or c
gtacaaaatgtttaatagctgcattaaacagtacttaaccagaaatattctgttcagcagnactgctttggggagtatgagtgagagtttcccatcttggatagcagactgaattttgcat

SEQ ID NO: 31921 - DNA, 121 bp, Artificial Sequence
  Synthesized
  misc_feature (61): n=t or c
gaggaaaaggagggagaggatggttggaagcctggaaaagttgccgcaaagttttgcatgngctggcaaagttgttcggcggaataggagggggagagcagggcaaggagagccctggggc

SEQ ID NO: 31922 - DNA, 121 bp, Artificial Sequence
  Synthesized
  misc_feature (61): n=t or c
tttttttttttttttttttgtggtttcaaaaagaagtgcatgggggaagaacttctatctncgtgacccctcttgtctacgtgctctgtggaaccacctacaggagaggggtgagcccaag

SEQ ID NO: 31923 - DNA, 121 bp, Artificial Sequence
  Synthesized
  misc_feature (61): n=a or g
gatatacctgactttgcgattcacgatgtccaacaaggtgaacttctttctgctccggganccgggaatgtccagctccagctctccatgccttgggtcactggtgatgctgaagaggatt

SEQ ID NO: 31924 - DNA, 121 bp, Artificial Sequence
  Synthesized
  misc_feature (61): n=t or c
acccacggtggtgaaagcacatgctggtggcatctcccttgacagctgcttatctcctaanactccctgcaggccttcccacaacagcttgtgcacagtagtcttttgcagcattgtggcc

SEQ ID NO: 31925 - DNA, 121 bp, Artificial Sequence
  Synthesized
  misc_feature (61): n=t or g
cgttgctatctgctatgtcaaaaatattgtagctttggtaagcatttcaaattcttgactnttaagccacataatttttaaaagcagtgattccatggtaataatcccttattttgaatgc

SEQ ID NO: 31926 - DNA, 121 bp, Artificial Sequence
  Synthesized
  misc_feature (61): n=t or c
cctgtcctgggcaatgtgcttcgtgtttcgggccatttggtggatgggagctaatgcctgnttaagtcttagcagtgccgtgggcaatcttctgtgttgtcccagtaatgctttcaaactc

SEQ ID NO: 31927 - DNA, 121 bp, Artificial Sequence
  Synthesized
  misc_feature (61): n=t or c
cttttttttttctctctttctttctcttttttttcctgttgggggatgtcttttctccgangctcacatacccgttatttcagtggggtgaagaggaggacggcacagctcagaggatccc

SEQ ID NO: 31928 - DNA, 121 bp, Artificial Sequence
  Synthesized
  misc_feature (61): n=c or g
aagcaagcaaaaacaataaagcaatcctaaagcttccagttgctgtagatgaacaacttanaactagcagaagggttgtccttgaattagatgtttttttattccaaatttcccaataaat

SEQ ID NO: 31929 - DNA, 121 bp, Artificial Sequence
  Synthesized
  misc_feature (61): n=a or g
ggctgccttcggtccggggggtttcctacagctcaaccatcttctccagtgagcagcggcnactttggacgactgtaacccttttactcttcagagacctctctaaggatgcaataaagcc

SEQ ID NO: 31930 - DNA, 121 bp, Artificial Sequence
  Synthesized
  misc_feature (61): n=t or c
agtaacctgtacgaactccctgctgatggagaggtacacacctgctttcatttcccagagnaaattctagtggaaacagaattcagacaaaaaaaaccccgatatctcgggtattgattaa

SEQ ID NO: 31931 - DNA, 121 bp, Artificial Sequence
  Synthesized
  misc_feature (61): n=t or c
tgcaagctctttgcatcagcacgggagcacgtgaggccacgctacaagccaatgaaggaanaggtagaactgaagattagccttgggaagaaaaaaaagcagcagcttagagggacatgaa

SEQ ID NO: 31932 - DNA, 121 bp, Artificial Sequence
  Synthesized
  misc_feature (61): n=a or g
gcctgcgcaaaaacagctctgcaaaagcgtggggcatttaaacaagaggaaagattcaccnccaaggagagcagtaataagggcagctctgtgcttctcagctggtggtggtatggctaat

SEQ ID NO: 31933 - DNA, 121 bp, Artificial Sequence
  Synthesized
  misc_feature (61): n=t or c
atctatcatatttagcatttatatgtatatattttaggaaaaaggtgaaatgaaagagaangggaagaaaacttcaggtaagtgtagaaagagctttttttttctggtatttttgattcta

SEQ ID NO: 31934 - DNA, 121 bp, Artificial Sequence
  Synthesized
  misc_feature (61): n=t or c
tgtcagggtctgttccccttctacttgcacgtgaaaaacttcagaagaaccaccaatcacntcaggaatcctaagaaataagaccggagactcaagattttccacacagcttctctgagga

SEQ ID NO: 31935 - DNA, 121 bp, Artificial Sequence
  Synthesized
  misc_feature (61): n=t or g
attgaaagcactggcatctcagagccggcatccctccttgcaatctgtttttcctctaatnacgcattaggcattttcactcgttaactgatgtcacctgtgctctgcaggaaaggcagca

SEQ ID NO: 31936 - DNA, 121 bp, Artificial Sequence
  Synthesized
  misc_feature (61): n=t or c
tgaaacagttattctggatccaaacagctctcagtacacattccttatgtgcaaagaaaancaaattcaatgctcagtatcttgcctctggtacagagagtcctcttctgttttattctaa

SEQ ID NO: 31937 - DNA, 121 bp, Artificial Sequence
  Synthesized
  misc_feature (61): n=a or g
ggtatacagttggtcgcctcctgtgcacatcaaactaatagcacgttgagcttgtatagcncagtgcaaaagccagtctgccaaaggccgtgggctagatggatgaggactgcaacaaata

SEQ ID NO: 31938 - DNA, 121 bp, Artificial Sequence
  Synthesized
  misc_feature (61): n=a or g
atttgccacaaatgacctgtagcctctgatcattacttgggctgcgttccataggaccatntaagagcacacgagcaaataagataagagtcatttgtggatacagagcctgaaatctgac

SEQ ID NO: 31939 - DNA, 121 bp, Artificial Sequence
  Synthesized
  misc_feature (61): n=t or c
gatagtcatttagtggcattgtccagggagttagcattccccccagctggtgagttcctangtggatctcctcgtgatgcagtcaagtctcccttcagagctccactggggtaagctttcc

SEQ ID NO: 31940 - DNA, 121 bp, Artificial Sequence
  Synthesized
  misc_feature (61): n=a or g
tgcaggaaggacaggggaaaagcaagtgcccctttaatgtagtcttcacatcacttcagantaatgaacaaactctgcacgtgacatttgtagcattctcctgttaaaatttttttcttcc

SEQ ID NO: 31941 - DNA, 121 bp, Artificial Sequence
  Synthesized
  misc_feature (61): n=t or c
ccacaaaaaacccaatttgaagtgcaggtgataaaagatggtgtttctagaatctgcttancagaacttgaaaagaggaggaaattgttcacacaaagggtggtgacacactggaacaggt

SEQ ID NO: 31942 - DNA, 121 bp, Artificial Sequence
  Synthesized
  misc_feature (61): n=a or g
tccattatgcttgaattgtttttccttctaccttccacttcccagcaccttggtgatgtgncacctttcaggtttggtacgtgtcaggggtggggacatatcccacctgcatggggcagaa

SEQ ID NO: 31943 - DNA, 121 bp, Artificial Sequence
  Synthesized
  misc_feature (61): n=a or g
tttgttgggtttgcccggcccatgagttgcccgtcaggcccagcaggtacctccgctcccntataatgggcgatattggttaaaccagagaattttccagcggcatcgaggcaggatgtga

SEQ ID NO: 31944 - DNA, 121 bp, Artificial Sequence
  Synthesized
  misc_feature (61): n=t or c
gctgtgtgagctgctctgctgctgccccatcactcctctgaggtttggttcacacatgccntcgaggcagagccgttttttggatgagattggtcagctttgctttacatgacattatgtg

SEQ ID NO: 31945 - DNA, 121 bp, Artificial Sequence
  Synthesized
  misc_feature (61): n=t or c
catactgattcgtgctcatgtactgttctgctcttgctaataatgcacatgataacactantttcctaactacccatttttatctctagtagagccaaacaataagattttggtactaatg

SEQ ID NO: 31946 - DNA, 121 bp, Artificial Sequence
  Synthesized
  misc_feature (61): n=a or g
aacgtgaacattttggctagcacttaaaagcacatgtgattaactagcaatcagatacatnattattacctattctatttctctgtttctaaaaataatttgttttgggctagtgatgaaa

SEQ ID NO: 31947 - DNA, 121 bp, Artificial Sequence
  Synthesized
  misc_feature (61): n=a or g
ctgcagaaagagcattaacctcaaggtgaagtaaaagccagcaaacagctggaagtgctcncttcttgaaccagcacaactacatctggtaaaggatgactgcttgtgcccaaacggatga

SEQ ID NO: 31948 - DNA, 121 bp, Artificial Sequence
  Synthesized
  misc_feature (61): n=a or t
aattgcagccatggtttcttgtggaaggagttgaagagctggaagatcacagagaggatcngcgcccctctctattaagtctttgatgattagtatgctttggttatatctctataaagtc

SEQ ID NO: 31949 - DNA, 121 bp, Artificial Sequence
  Synthesized
  misc_feature (61): n=t or c
aaataaacggaacaagcatgacgtttcttgcttgtgtacttgtaagtggaggagaaaatgngcattgtgatgctgtttagtctgtcaaactagttcaccttttttgccaaacctcacacgt

SEQ ID NO: 31950 - DNA, 121 bp, Artificial Sequence
  Synthesized
  misc_feature (61): n=a or g
ggggccagcttcagagcgcagaaagtttctcctttccagtagcgctggtactaatttttgncttgttcgtttgctcgtggttggtttgtagtctggttatttatttaaccaattacggttg

SEQ ID NO: 31951 - DNA, 121 bp, Artificial Sequence
  Synthesized
  misc_feature (61): n=a or g
atctgtccccacatggtagacattcagatgcataagagaggttggaccttgattcccactnagattaaggcagtgcgagcttcaccttgacaagttcagctaaattattagtgcttgattt

SEQ ID NO: 31952 - DNA, 121 bp, Artificial Sequence
  Synthesized
  misc_feature (61): n=a or g
cgaagcggtttgggtaaaaaaaaataaaagagtcccagccttgcatctgagatttatgtcntatttgcgtctgcgccgctcactgaccggtgtttgcagggaaaaaatagccgagttggac

SEQ ID NO: 31953 - DNA, 121 bp, Artificial Sequence
  Synthesized
  misc_feature (61): n=t or c
caaaccaacaaccagcatcatgatgtcagaggtacagcatcaggcaggaccagacccacantgaggtagggagcagagagcatcagttggttgtcagtgtgcagtgctggcccccctcact

SEQ ID NO: 31954 - DNA, 121 bp, Artificial Sequence
  Synthesized
  misc_feature (61): n=a or g
tatgaaacagttcctgtgatggggacctgtggatggagatggcagtatccttcccaatggntggttaagaggattgtgagaagggacataaggtcatcagtacactcaatgtggagcccac

SEQ ID NO: 31955 - DNA, 121 bp, Artificial Sequence
  Synthesized
  misc_feature (61): n=a or g
gtgaaataatgttatgcctgctgagtgcagcagtggtgttaaatttattgtgcaagtttgnagagagggaggaagatcctttgctgaacacaatgctgactttgtactaacttaacaatta

SEQ ID NO: 31956 - DNA, 121 bp, Artificial Sequence
  Synthesized
  misc_feature (61): n=t or c
actgctgtactggattagagcaacaagatcactgacatggacggaaaagaaggccttgggnatgacattgggagatataaagtaagcaacaaaataatgttcaataaaatatataacattt

SEQ ID NO: 31957 - DNA, 121 bp, Artificial Sequence
  Synthesized
  misc_feature (61): n=a or g
tttccattctgtctcagacatattttattgcatttcttcaagggagtcactattttccacnaaggtaaatctgctgtcacttttcaaggcttctgttttttccttatttcccttctaaata

SEQ ID NO: 31958 - DNA, 121 bp, Artificial Sequence
  Synthesized
  misc_feature (61): n=t or c
ttgcctgcccacctctactatgctctcatgagaccccacctacagtactgaggttaactcngggacctccaacgtaagaaggatatggatctgttgaagaaggtctagaacagggccatga

SEQ ID NO: 31959 - DNA, 121 bp, Artificial Sequence
  Synthesized
  misc_feature (61): n=t or c
gtcaaaccttccacctgttaccagatatctccagaactgactttcagatgcctctaccaanggtcttacactcagccaaggaacaggacagctgggtaaagcctaaccctccttgctttcc

SEQ ID NO: 31960 - DNA, 121 bp, Artificial Sequence
  Synthesized
  misc_feature (61): n=a or g
tgatgagggactctcatgatgtgtgtataaaaaaattaacaataaatgcccaagctttacntgactcaacatacgctccacattttctgagtctttgcaactacactgtatcctaaccttc

SEQ ID NO: 31961 - DNA, 121 bp, Artificial Sequence
  Synthesized
  misc_feature (61): n=t or c
tgcgtagttcatctgctgtagcataatgtgcagtcaagcctggtgcaaaaatgtggtgcanaagaaaagccataacagcccccacaccagggcaacacagcagcactgcttaagcaatgcc

SEQ ID NO: 31962 - DNA, 121 bp, Artificial Sequence
  Synthesized
  misc_feature (61): n=a or g
agaaatggggagtcagtcaagcacactgtctagatatagcctctgaggtgaacaaaatacntagtgaaagataagaaagttgccaacataagatgatacagtagaacaactatctattgcc

SEQ ID NO: 31963 - DNA, 121 bp, Artificial Sequence
  Synthesized
  misc_feature (61): n=a or g
cgatgtgctctatcctcaccccacccttacccaggcaaaggtgcctggttcctgccctgcnctgctggatcttcaaggcaagcttgtaccactgtctggtggaaggaatgcagcttcagag

SEQ ID NO: 31964 - DNA, 121 bp, Artificial Sequence
  Synthesized
  misc_feature (61): n=a or c
cattgtatttggtaggatctggtacataatttagaatgacttctaaatcaatctttctggnaacaatactttagactaagaagagggtataaacttgattaatggacttgtacagaaggat

SEQ ID NO: 31965 - DNA, 121 bp, Artificial Sequence
  Synthesized
  misc_feature (61): n=a or t
ttttgaaatataccataatggaccatgcagaatgttagcattcaaaataccttcagcttgnatgtttattataacactgacaaaatggaagggtcgcaggaagagagacagctgaacattc

SEQ ID NO: 31966 - DNA, 121 bp, Artificial Sequence
  Synthesized
  misc_feature (61): n=t or c
tgctatgctgttctgcagaagaaaaataattgcaagtgtagcaatgactatcaagaatganggcatagtgttctgcagatagcagtaaaatactctgcattccccttttcaccttttaagg

SEQ ID NO: 31967 - DNA, 121 bp, Artificial Sequence
  Synthesized
  misc_feature (61): n=a or t
gcagcaacctgttccagtgcgggtcttagacagcatgcaaacaatgctataaaaacaaagnaagcactacagttaaagcatgagtaggaataaaagtatataaatataagcatttctgcat

SEQ ID NO: 31968 - DNA, 121 bp, Artificial Sequence
  Synthesized
  misc_feature (61): n=a or t
tgagtccattcataacacacagaaaagaggcacaaaggaagatcaaagttccccttttggnacctttctattcttttacagtttagaactgtctagggcacagccaagcaactgtgaattg

SEQ ID NO: 31969 - DNA, 121 bp, Artificial Sequence
  Synthesized
  misc_feature (61): n=a or g
cacttaaaaaaaaaaaaaatccctccttctgacagtaagtatagtcagcagttcaggttgnggcttaaggagttgctagtgactgaatgttttcacatatgcttgtaagagctgtccatga

SEQ ID NO: 31970 - DNA, 121 bp, Artificial Sequence
  Synthesized
  misc_feature (61): n=t or c
aacacttatcacttgagggcaggacaccattagttcagcaggctagaaaggacacatatgnaggactcagtagtttggtagacataagtatcatgagggcaaacagagaagcttttgataa

SEQ ID NO: 31971 - DNA, 121 bp, Artificial Sequence
  Synthesized
  misc_feature (61): n=a or g
ctagcccaggcttggagagctcaaagcactctccaaggaggttttccccctacaaaaagcnctcacaggatcgaaaactcctccccacccctgctctgggggctccaggaggtgttctggt

SEQ ID NO: 31972 - DNA, 121 bp, Artificial Sequence
  Synthesized
  misc_feature (61): n=a or g
actgtttgctagcagctgtacttcagagatgaaggattcatcagctgcatcattctacaancagatgaacctaaagggcagaacaaaatacagcagcagagttcctgccttgcctttgata

SEQ ID NO: 31973 - DNA, 121 bp, Artificial Sequence
  Synthesized
  misc_feature (61): n=a or g
ccactggagaccttgttacttgaggagggatacaacagcttccagacagttggtctctagntgaggagtatgacaaggaaggacctagagtggaatttgtgcactgtgtaaaccaagatga

SEQ ID NO: 31974 - DNA, 121 bp, Artificial Sequence
  Synthesized
  misc_feature (61): n=t or c
ggtcctgagtatggaaaaagcaagacctaaagtgcctgggagcccttgtgccaagggagtntccagttttctggaataaaagtgatctctggggaacagccttaaagctttatctttagga

SEQ ID NO: 31975 - DNA, 121 bp, Artificial Sequence
  Synthesized
  misc_feature (61): n=a or t
gatcaaagaagtgatttaagaggtaacacttgttggagcgattccttctagaaaacctacngggtcctctcccttggccaaactaaagctgtggcagaacctaacacaatgtttttgagag

SEQ ID NO: 31976 - DNA, 121 bp, Artificial Sequence
  Synthesized
  misc_feature (61): n=t or c
ctaacaggacatacccagtctggatttggactcgtttattacctcagccacttagtctccncacttgtacttaggacatttcttcattaatactctttatgaaactctggcattttaaagt

SEQ ID NO: 31977 - DNA, 121 bp, Artificial Sequence
  Synthesized
  misc_feature (61): n=t or c
gaataggctcaagcccttcttcaagaatgggcatgaagctgcagctgtgcacattggaaanacatggtctgtccacgatgacaagtaacactgcaagagctcctatgcaataaatgcttta

SEQ ID NO: 31978 - DNA, 121 bp, Artificial Sequence
  Synthesized
  misc_feature (61): n=c or g
tttaggtgtgcaaaaagcaggagggactgccaggaaccttcctaagcccttccagcattgnttgtaggcatcttttggacctggaagttaagcaggagtagtccttcctctagtgagatga

SEQ ID NO: 31979 - DNA, 121 bp, Artificial Sequence
  Synthesized
  misc_feature (61): n=a or c
atgcttttcagagtgacttaaatatatgtcaaaaatcatactaaaagaacattacagatanaaagtcaatcactcaaaactgacaaccttccaagatttcacagacaactgtatttcagtc

SEQ ID NO: 31980 - DNA, 121 bp, Artificial Sequence
  Synthesized
  misc_feature (61): n=a or g
aaaaacaaaaacaaaacagcaaacaaaagcccgtattttatcaaataaggtgtgtacagangcactcttagtggagatgttaccataagttaaggtaatcctctaattacagtccccaagt

SEQ ID NO: 31981 - DNA, 121 bp, Artificial Sequence
  Synthesized
  misc_feature (61): n=a or g
tgaaaaattctgttttagaagagaccgtgaaacaaaagatttctttcctgagacctgcagnttttgtgtgactcgtgttgaattcttacccaatgccctggatctgcaactgaggttgggt

SEQ ID NO: 31982 - DNA, 121 bp, Artificial Sequence
  Synthesized
  misc_feature (61): n=t or c
cacgttaagagaagcacctacttatctttaataaccctcccccttgaccatttctaaattnagattcttttcacttttttcatctagaagatacttttcacagtaaatttctcaattttcc

SEQ ID NO: 31983 - DNA, 121 bp, Artificial Sequence
  Synthesized
  misc_feature (61): n=c or g
aatcccttttgagctgctcataaaaacagaccttaatactacatgaatgaatcagctgggnatttctttcctctggataaattgtaatgctggagaagaatgtcatccatatgtctaatag

SEQ ID NO: 31984 - DNA, 121 bp, Artificial Sequence
  Synthesized
  misc_feature (61): n=a or g
aggaggctttcaggtcttctttttatgttgctcatcagctaataaaagaaatctccatccngagatctagccaagaaaatccaggattggagctccagacgacattaatccatgcagacta

SEQ ID NO: 31985 - DNA, 121 bp, Artificial Sequence
  Synthesized
  misc_feature (61): n=a or g
acagagacccttcctcaccactgcagatgctctgaggtaaaagacaggaggctctgtcccnctcactcttcaagccgaggcctgtgaaatctgacagcagtagatcacaaaatcttgtttc

SEQ ID NO: 31986 - DNA, 121 bp, Artificial Sequence
  Synthesized
  misc_feature (61): n=a or c
agcacagctggaccccagaggtgaagggaagaggagatgctgcatgggataatgggtaaantcctgctctatcctaacaggattttaggcaatgcccatgcccccacagcattcactgagc

SEQ ID NO: 31987 - DNA, 121 bp, Artificial Sequence
  Synthesized
  misc_feature (61): n=a or g
tatactccaggcattcctttctgcccaccaaatgctctgtctactagtctaggcagtcaancatcacactgagttctctgtgacaattcatttctcattctaccattaaaagttctgctcc

SEQ ID NO: 31988 - DNA, 121 bp, Artificial Sequence
  Synthesized
  misc_feature (61): n=t or c
ttaaggtaggaaaagtcattcaaaccccaagactggctaactttaaagctctgatactaanctgcataacaggagattcactacagaagcactacaatataagccaagtgttacagaaaga

SEQ ID NO: 31989 - DNA, 121 bp, Artificial Sequence
  Synthesized
  misc_feature (61): n=t or c
ctcctcacgtgtgcagcccctttgctgtgcccactcctcgtggttcccccctttttgatanacatgaaatggaacacggagaagaaccccaatgaaacatttccattcaaactccccgata

SEQ ID NO: 31990 - DNA, 121 bp, Artificial Sequence
  Synthesized
  misc_feature (61): n=c or g
taaagtctgtcttcttcttcttcttgttctggggagaggaagcagaaggtcaggctgtcanactgcctgctctcctttttgccgaaatgtacagatcctgcctgcaaaacgcactgcaaag

SEQ ID NO: 31991 - DNA, 121 bp, Artificial Sequence
  Synthesized
  misc_feature (61): n=t or c
gcaagaaaggaaaaaaaagaacccacactcacatgcagtttcctggctacaccagcacgcntcaattctgacctgcagggaccatctttagatgcaagaatgcagtttggtttccacgctc

SEQ ID NO: 31992 - DNA, 121 bp, Artificial Sequence
  Synthesized
  misc_feature (61): n=a or c
ctctatcactgagatgtggaactccttgctggaggatccgtgttgtgtaacataaagtttnacagctgtaagcacactttctggtctgtttctggatgaaagtctgaggtggctgtcccca

SEQ ID NO: 31993 - DNA, 121 bp, Artificial Sequence
  Synthesized
  misc_feature (61): n=t or c
cagcagattggtgccttgatattttttaattctagctgtatagagaaataagcatatgcanacaatgtgtttatttcactcaatcaaatgtaattttaacaaacacgacaattattactgt

SEQ ID NO: 31994 - DNA, 121 bp, Artificial Sequence
  Synthesized
  misc_feature (61): n=t or c
tgcattaccaaattgttgttcttgcatgggaggcagaggtaaaaatcttcccttagagcantgtctgttactacctggtaactaattcattgttaggtaaagctccacactgaagtcattg

SEQ ID NO: 31995 - DNA, 121 bp, Artificial Sequence
  Synthesized
  misc_feature (61): n=a or t
catcaggtaggcagccttgtcagcaactgtatacggagggaaagagtgacacaggggcagngatcagtgaactgtggattttctctaagagctaggtacagatctgcaagttttgtaactg

SEQ ID NO: 31996 - DNA, 121 bp, Artificial Sequence
  Synthesized
  misc_feature (61): n=t or c
aaccgcctccattctccaactgcacagagcacctccttgcctagacgaggtcaacagtttnccctcattgcctgattcaacactttaccttcaacagagagcttttcaatagcccgtctct

SEQ ID NO: 31997 - DNA, 121 bp, Artificial Sequence
  Synthesized
  misc_feature (61): n=t or c
cactttctttggaatgcacagtattggcctgttaacacagaaatttatcatgttacctttntatatttgactgttgcgttgatgacgcattctagagttacagcttgtttctctcagaatc

SEQ ID NO: 31998 - DNA, 121 bp, Artificial Sequence
  Synthesized
  misc_feature (61): n=a or g
acaacaacaacagtaatataaccacgtgcctcaccaaatcctgtctcccaaacaaaccccntgactttgtttccatcacctacaaaaagtacatactgtgtaacctgtgctttgcaggaaa

SEQ ID NO: 31999 - DNA, 121 bp, Artificial Sequence
  Synthesized
  misc_feature (61): n=t or c
tcaatcagagatgtccaaagtcaagtgcctcaagatgaagagtcataaataaccaggctcntcaaggttatgtgatactctttaccaactgctgtatgtggagagggatttacagatgtct

SEQ ID NO: 32000 - DNA, 121 bp, Artificial Sequence
  Synthesized
  misc_feature (61): n=a or g
catatgaatcagaacttttaaagatgaggaaaataccaaagcaaggagagactttgtatcncatattgcagcccaggacagacttggagtgcagcaaccaagaaggggttgaattgcagat

SEQ ID NO: 32001 - DNA, 121 bp, Artificial Sequence
  Synthesized
  misc_feature (61): n=t or c
atacccatgtacctacaagctacatttttaaatggtatggatgaataatccctttgctctngtagagggttttttatggcttctctaagctgtgcatctattttcacttgactttaaagca

SEQ ID NO: 32002 - DNA, 121 bp, Artificial Sequence
  Synthesized
  misc_feature (61): n=t or c
ttacacaggacaagaaagtgagatgctagaataatccatcacgtagctgctgaaaaactgnttttaatgtactgttaccctgtggtcattgcctcgctgtcagtgggatctagaaaagccg

SEQ ID NO: 32003 - DNA, 121 bp, Artificial Sequence
  Synthesized
  misc_feature (61): n=a or g
ttgctccaaaaatgaagctgagcaaggagggtggaaagggaaaatggcacacttatcacantttacaaacagaattcacgttcttactctcaattgttccaaaattcaacagatttcaatg

SEQ ID NO: 32004 - DNA, 121 bp, Artificial Sequence
  Synthesized
  misc_feature (61): n=a or g
accatgctttttgtgttaaggatgcttcagttgtttctgctggtcagggggtggattgtgnatttgaccccacttttggatgcagattctccctgatgtctgttggcatcacttcatccac

SEQ ID NO: 32005 - DNA, 121 bp, Artificial Sequence
  Synthesized
  misc_feature (61): n=a or g
attttcaagggggaaaaggagtggaaagatgttcaggccatcatataatgttagtcagacntgaatacaaggtgctgtcagccagtgggagcctggaggtgaattcagaagggcaagacca

SEQ ID NO: 32006 - DNA, 121 bp, Artificial Sequence
  Synthesized
  misc_feature (61): n=a or g
cctacagtatgtatgttctacagaaggcaagcagcaggtcgcagactgggcaggaataccnttctgtcgcctgaatgcaataagccagggctttacctattggcctcagcctcgcagtcag

SEQ ID NO: 32007 - DNA, 121 bp, Artificial Sequence
  Synthesized
  misc_feature (61): n=c or g
ggtttaggcgtatgaaatcctggttctgttggagtcagctggacctctgcctcagaaccangactttgtgaggaaatagtgaaagcactgacattagtttacttcagattcccatttctct

SEQ ID NO: 32008 - DNA, 121 bp, Artificial Sequence
  Synthesized
  misc_feature (61): n=a or g
tattggagcctctaccctttcaaatcccacaacctaaatagcgtgatgcctgggagatgtntagattagacacacttggccaagtcttacttcaggaagtagattaactaacagatctgtc

SEQ ID NO: 32009 - DNA, 121 bp, Artificial Sequence
  Synthesized
  misc_feature (61): n=t or g
tgcgtgcgtaaaagtgcaggactgggtttcaggtgtttggctttgtgtcctaaatgatatngtttttctgttgcatttgtggatgcagccctgttctgtctccatgctgatatcaaggcct

SEQ ID NO: 32010 - DNA, 121 bp, Artificial Sequence
  Synthesized
  misc_feature (61): n=a or g
tagacatggcaaaacaaaaacatccttgatttcttcttgcatgttttggaggacatgagcnagtagtgcctgaaataaagagtccgtttcacaggtaattcttatcagtttttttatagta

SEQ ID NO: 32011 - DNA, 121 bp, Artificial Sequence
  Synthesized
  misc_feature (61): n=c or g
gttctttgcttgaatgctcacaggacataaatattgaatttcaaatcttcagaatagaaantaatagtgacaaaatcatttctgacatgtatgctacaccacttacttgcaagatttaaaa

SEQ ID NO: 32012 - DNA, 121 bp, Artificial Sequence
  Synthesized
  misc_feature (61): n=a or g
agaggcagtagttcttggaatggcacagtgtgtggctgtcttgatccattttagcctctanaacaaagcttatgaaggaacctagaagccttctaccatggcaattgtatttagagcccca

SEQ ID NO: 32013 - DNA, 121 bp, Artificial Sequence
  Synthesized
  misc_feature (61): n=a or g
gccgtgtatatttataattccagggtagcacctgttatacagctgccaccagattcagtanggtatctccagaaaaatagtattatttcttatgcaatgtagatttgaatgtcagcatatt

SEQ ID NO: 32014 - DNA, 121 bp, Artificial Sequence
  Synthesized
  misc_feature (61): n=a or c
accttttggaaaaggaaagcagtttgacctctgtcagtggtcattataccttcacagtgantttaacagatcaggtggtctaagaactccttgtgtgcttcagtgcaaactcacacgtacc

SEQ ID NO: 32015 - DNA, 121 bp, Artificial Sequence
  Synthesized
  misc_feature (61): n=a or c
acttgtggtccacttaggcatgggaaaaaaggtggcacagaagtgatatcactgttcacantggacaaaatcgaattttttgcaactattttaaactaaaaatcatttaagaaagccataa

SEQ ID NO: 32016 - DNA, 121 bp, Artificial Sequence
  Synthesized
  misc_feature (61): n=a or g
tacttgtttccccacgtctcttcccctattttcctcttcatctttatctcaggtctctgcngggaaggaatacagagctattttcttctactttcacagtttctcagagagacaatcatcc

SEQ ID NO: 32017 - DNA, 121 bp, Artificial Sequence
  Synthesized
  misc_feature (61): n=t or c
ctatcttttgctctctttctcactgatatactctgtacacctctctcaacttttcttcttngatcctgtgctacagcactggtacaacttgtgtctcaaacctcttccatgcttgcagaag

SEQ ID NO: 32018 - DNA, 121 bp, Artificial Sequence
  Synthesized
  misc_feature (61): n=a or g
atgctgggatccttgcaatcaactagcaaagatgtcatgcttgctttaaactgcttatacntgaaacacctggtggcagacaagtacagtaaataggcaagcagagtgctaggtgatagga

SEQ ID NO: 32019 - DNA, 121 bp, Artificial Sequence
  Synthesized
  misc_feature (61): n=a or g
aggagtctgcaaagaacggctgttcactaataatagtaccttctccaggataggaagcatnctactaacaaccacccacatgagcaaactggaaacttctccacagctagaagcagtctta

SEQ ID NO: 32020 - DNA, 121 bp, Artificial Sequence
  Synthesized
  misc_feature (61): n=t or c
tttttagcatcactcccttatttactcaggttatgcaacactttaccttctccttaatgcnatttctttacatcaacattttctaatatgggaattggagcagaagggagacaggttcaat

SEQ ID NO: 32021 - DNA, 121 bp, Artificial Sequence
  Synthesized
  misc_feature (61): n=t or c
gaacctcatagcatgcttaagacccatcaagtagtactctttctgagaaaccccatacacntcctgtcttttcttggagtcccttttctaccatcgggtttatcaccccctctaagcattc

SEQ ID NO: 32022 - DNA, 121 bp, Artificial Sequence
  Synthesized
  misc_feature (61): n=t or c
tttgggccaagttttgaaatcatcagacctttctctggcaaatctgccgatgagattggtntgtatgattgaagtcagaatataagcagtagaagcagtgctataggaattggcagcatgc

SEQ ID NO: 32023 - DNA, 121 bp, Artificial Sequence
  Synthesized
  misc_feature (61): n=t or g
ttaaaaaattaaaccaccccttatttatttctctttgggctattgttatactgatgtaccnaattgctattcgaatgcgtgtaattgctgtttgcaaaaataaagtgtgatcaaaaccagt

SEQ ID NO: 32024 - DNA, 121 bp, Artificial Sequence
  Synthesized
  misc_feature (61): n=c or g
tccactttctttctgtgtacagcgcagctttagaaactcagttgtcttcctgttgcctggnttgtcctcctgtgccataattctgacttcctgtcttctgcactccctcattcagcacata

SEQ ID NO: 32025 - DNA, 121 bp, Artificial Sequence
  Synthesized
  misc_feature (61): n=a or c
ttagccttaaacacaatgtggtccttactgacaaagccagccagtctaccaaatgtacttnacattttcagaactacaaaaaactccaaaataataacgtctttgtcattttgtaatacac

SEQ ID NO: 32026 - DNA, 121 bp, Artificial Sequence
  Synthesized
  misc_feature (61): n=t or c
attaggagcatacacttcagaatcttcttaaatatgtttctgagttctgatctctttctgnccctctcataactatgatgccaagcttttgttccttacatcaaagatctcaaagccagcg

SEQ ID NO: 32027 - DNA, 121 bp, Artificial Sequence
  Synthesized
  misc_feature (61): n=a or g
aaagacttaccttaaccagtaatttatgttcctctttctctaaagggtagtctgttagtgncttgctgtatatatgaaaattagacactatcttttctggaaagtaaaatgttctggatgg

SEQ ID NO: 32028 - DNA, 121 bp, Artificial Sequence
  Synthesized
  misc_feature (61): n=a or g
catttcccacagatcacagcactggttatcaccacctgtcccatgcctaaccgtgctttangctttataagcttgggtaagaactgcaggcctttacatttgaagtgtagactggcagctc

SEQ ID NO: 32029 - DNA, 121 bp, Artificial Sequence
  Synthesized
  misc_feature (61): n=c or g
tatacaacagtgctgtgtgttgactcctctttgcttcttagtgctgttttgtgtaccttgntgaaacaattactaattgcgctcttccatttttgtgtaaatttgtcatctgctgtatgtg

SEQ ID NO: 32030 - DNA, 121 bp, Artificial Sequence
  Synthesized
  misc_feature (61): n=t or c
tgttttttaaatcactgatccactggagtggattgcactacagccaaattctagctatgcnggtggaattctgtattaaaatagcagcacctaaaaatctaaccccacagtcacccttagc

SEQ ID NO: 32031 - DNA, 121 bp, Artificial Sequence
  Synthesized
  misc_feature (61): n=a or g
gttcaagtaggtgttattcacacaagccattagtacgtggcccactttcaaacaaaagatncttccttggcttttccaaacctcatattgatctgtattaacatgtaaacacaccgttttc

SEQ ID NO: 32032 - DNA, 121 bp, Artificial Sequence
  Synthesized
  misc_feature (61): n=t or c
ccccagcaggactggccctctgttcatctgcttggctcactggctatcccagggctgtgtncagctgccagtgctcccccccacttgcatgctcctcactaacatcttgctggcagtgtgg

SEQ ID NO: 32033 - DNA, 121 bp, Artificial Sequence
  Synthesized
  misc_feature (61): n=t or c
ggaacagtacataaaatcaccacattacacagaaaggtggggtatgatcccttaactatgnacaccagtgtagtagtggtcaaacttttgatctatttagcacccagagactgactttcat

SEQ ID NO: 32034 - DNA, 121 bp, Artificial Sequence
  Synthesized
  misc_feature (61): n=t or c
gcaatattgttttacaagcaagcgtcatcagacaccatctcagcagacaaaggttaaattncatctgcatattcagtcatctcctttgactggagaatttatttttctttcaatctaaaga

SEQ ID NO: 32035 - DNA, 121 bp, Artificial Sequence
  Synthesized
  misc_feature (61): n=a or g
atctgtgcttgcaaagtacatctgtctgtctgtctaggctgagaatgagtctgtagttcanagtagctaagaaataattacatcttttttttaaagataaaacaaaaccacaatttctgtt

SEQ ID NO: 32036 - DNA, 121 bp, Artificial Sequence
  Synthesized
  misc_feature (61): n=c or g
tcccaactacacagggactgtggaagcgcagcccagctgccagccacgcagagatttccantgataacaattatacttaaaagcgccactacacgtttggatgcatttacacattctcctt

SEQ ID NO: 32037 - DNA, 121 bp, Artificial Sequence
  Synthesized
  misc_feature (61): n=c or g
gaacccacaaacaagagaagagtaaaattatctgtccatgttaattagcagccatttactnctttttaagtagcgaaggcatataaaactgggagtcactccatcatcacaagatgtgtta

SEQ ID NO: 32038 - DNA, 121 bp, Artificial Sequence
  Synthesized
  misc_feature (61): n=a or g
ctagaacaatacacaagaaatatactatgtcctttatagtgctacagagaagttcacatgnaagtccctaatagccctctaaaaaatcatccattataaccagttttcattagattttagt

SEQ ID NO: 32039 - DNA, 121 bp, Artificial Sequence
  Synthesized
  misc_feature (61): n=t or c
gagtcagaattgggcttttcacatcgtaaattatatctctgacttccattcaaatgacttncttacaatgtgtgacattcagttgggcacttatcatttggaaaaactgttctatgaaagt

SEQ ID NO: 32040 - DNA, 121 bp, Artificial Sequence
  Synthesized
  misc_feature (61): n=a or c
agcgaaaagcagtgtaaatgagtttatttagtcagaataaaatgatacctttgaaaaaaanctgagtgttgtgtcatgagaaacagaaaaggaggtgcactcctttctttggtgatctgtc

SEQ ID NO: 32041 - DNA, 121 bp, Artificial Sequence
  Synthesized
  misc_feature (61): n=a or g
cctcccaacaacaggaggtgctgctccatggcagaactggtccctgcatgagctacccaangccttctgcatggtgctgccagcgctccacagctggggtgggatgtccaaatagcaacag

SEQ ID NO: 32042 - DNA, 121 bp, Artificial Sequence
  Synthesized
  misc_feature (61): n=a or g
ggaactgcaggaattgcagactcccactttgctgagctgacggggaggaacaataggcacngcctcctgaagaactctttccttaagaagggtttcaaccccattttcggccttaataatt

SEQ ID NO: 32043 - DNA, 121 bp, Artificial Sequence
  Synthesized
  misc_feature (61): n=t or c
tctcattctgttagtgcatcacgatggtgagaagaaaactacctcttatcacagtcaattnggagcatcccaaaacatgggaagatgactagggaaatctagttctcattcacctcttgat

SEQ ID NO: 32044 - DNA, 121 bp, Artificial Sequence
  Synthesized
  misc_feature (61): n=t or c
ttcaaaatgagaaagaaggaagtaggggagaaaaacattagaggaaaatatctaaaatggnttaaaatttatcaaccggagcattttcttaacatttccaaacacattatttagttgtttc

SEQ ID NO: 32045 - DNA, 121 bp, Artificial Sequence
  Synthesized
  misc_feature (61): n=t or c
gccgcactgaaatctggagctgcactgctgacatcatcaaggccatgttttcattccaagnatgctgatccctttggaataaatgcatatgagaagtactgtgacatccccggttcttgaa

SEQ ID NO: 32046 - DNA, 121 bp, Artificial Sequence
  Synthesized
  misc_feature (61): n=t or c
tgaaaggccaaggtacacaggctgttacttctgatgtaaataaatctgctagattaccaangacaaggaggaggtgtccaagcaaaagaagttggttgaacaaagtcaaggctatgctgag

SEQ ID NO: 32047 - DNA, 121 bp, Artificial Sequence
  Synthesized
  misc_feature (61): n=t or g
atgctgaagacgtgagctatttgtggtcttagtcccaaaataacgattagtccatggtcangagttacagctggtcatttcacttccttggtttcctattttggttgcaaagatccaggat

SEQ ID NO: 32048 - DNA, 121 bp, Artificial Sequence
  Synthesized
  misc_feature (61): n=a or g
tgatgtggcagaccttatctgcatgtgtccaaaactggtttgcacagaggagagcacaagnctgctaccagctcattactttgcatgcttttctgcctctttaagacaagatgagccatgg

SEQ ID NO: 32049 - DNA, 121 bp, Artificial Sequence
  Synthesized
  misc_feature (61): n=a or g
aaggactgccaacagatctaatgatagtactgtctttcattcagcactcttttggcatacnacttatttaaatgtgacacgagtatactcagatatgacaaaaaccacagcatagctaatg

SEQ ID NO: 32050 - DNA, 121 bp, Artificial Sequence
  Synthesized
  misc_feature (61): n=a or c
aatattcaggacttgtcttcaatgtactctggataatgttcttttgatagaagtttggacnagataatctccagaggtcctcttcaagctgaattttacagttgttctgggatactaaaac

SEQ ID NO: 32051 - DNA, 121 bp, Artificial Sequence
  Synthesized
  misc_feature (61): n=t or c
tctgacaagagctgtggatgtgcgtatgcatgtattaatgcatacatactggagaaattanagctcgcacatctcattttagagttatagaacactgtcaggtattaagtatctcatttgc

SEQ ID NO: 32052 - DNA, 121 bp, Artificial Sequence
  Synthesized
  misc_feature (61): n=t or c
agttttttgtacgctttcagtgtttcatttcaacttcagtctaagaagagaaaatgagacnagctcacttgtgagatgaagttttattgctggaatgcctgttgctgttggtctctcaagt

SEQ ID NO: 32053 - DNA, 121 bp, Artificial Sequence
  Synthesized
  misc_feature (61): n=t or c
ggacaccgggacactgggcagtggaaacactgagcccgtggtgctgctggtgctgactctnatggctgtaccccttaagtaggggcagaacagcttgaccctatgatagtctttctccttt

SEQ ID NO: 32054 - DNA, 121 bp, Artificial Sequence
  Synthesized
  misc_feature (61): n=t or c
ccttgaatgctgatgacttcctgaacatgattcagatgatacatacactcaacctttgtgnttcctgggagattggcctgactactaggaaatgtacaaaaagttcattcactcttttttt

SEQ ID NO: 32055 - DNA, 121 bp, Artificial Sequence
  Synthesized
  misc_feature (61): n=a or t
aacccttggttgtctcagctttcacggcttgagggtataacagtagttgagataagatatntcctgctatatccttgagagaagcttgttataaaaaccattttcagcatgctttccctct

SEQ ID NO: 32056 - DNA, 121 bp, Artificial Sequence
  Synthesized
  misc_feature (61): n=c or g
aaagattcaaaagggtttttatactacaaggagttcagattgactttaatgaaaatggtangatttcagctctcctttccttgactgcatctgaccctgcttcagtcttgcctttgtttat

SEQ ID NO: 32057 - DNA, 121 bp, Artificial Sequence
  Synthesized
  misc_feature (61): n=c or g
caaacataacccaagatgaggacttcttagtggctttggtgctagcagtgaaggagcgtgntttctgcattcttttcattagtgtttcagcttcactgaattcatccgaatccttccattc

SEQ ID NO: 32058 - DNA, 121 bp, Artificial Sequence
  Synthesized
  misc_feature (61): n=t or g
gaaggagccacacgtatgtgatgataacacgtgtcctggtgtgatattgggaggctaaaancccttctccaaatcatttgaaatggcaaccttaggaaagcagaaaatcaaaagataatct

SEQ ID NO: 32059 - DNA, 121 bp, Artificial Sequence
  Synthesized
  misc_feature (61): n=a or g
tctaccttaaattataaatattttctcagatgttgttgacttctagtataactggagtggntgaattccttatatgggaatgacagatttttagtggccaattgtgacagttaaaattgtc

SEQ ID NO: 32060 - DNA, 121 bp, Artificial Sequence
  Synthesized
  misc_feature (61): n=t or c
gataataattagtggtttttataaggatcatttactagaggacaatgttccaagtgccagncccataataaggggcataaacacggtgacaaatccagaaaccacgcatggccaaacttct

SEQ ID NO: 32061 - DNA, 121 bp, Artificial Sequence
  Synthesized
  misc_feature (61): n=t or c
cgctctacagctcccagcaagatgactacgcctttatcacccaacactgggagcagcccangcctgcaggacctgctgacaaagaccatctcgcttagcttctgctttttttaatgtaaga

SEQ ID NO: 32062 - DNA, 121 bp, Artificial Sequence
  Synthesized
  misc_feature (61): n=c or g
tcagaagtaagagtagcaaagtgctatgatgaataagctgcagaacttgcaggtcctcgcncacagaggtcctcacaatcaaatcaaacatcctttaagcatgacctcatatatttgttat

SEQ ID NO: 32063 - DNA, 121 bp, Artificial Sequence
  Synthesized
  misc_feature (61): n=t or c
tttttctagagactggctgagcgtggcatattcaatatagttacctcaaataccaaggaanggcagtacttccttattggccagcttaactaataacaggtcatattctctatcacagcca

SEQ ID NO: 32064 - DNA, 121 bp, Artificial Sequence
  Synthesized
  misc_feature (61): n=a or g
agacatttccatctccctaatagaacacagaaggagcaaaagacgctggaaatttagaagnataacgtgagcattttcagtgacctcctctaaagctttcagactagcattagacatgtac

SEQ ID NO: 32065 - DNA, 121 bp, Artificial Sequence
  Synthesized
  misc_feature (61): n=t or c
ttgagagatttttaaaaatccctagcaactacctgttattgtacaggtgtttgctgaatgnttttccatgtcagatttgaaatcctcaacaactgattaaaaaaataacaaactaaaaacc

SEQ ID NO: 32066 - DNA, 121 bp, Artificial Sequence
  Synthesized
  misc_feature (61): n=a or c
cttaagataaagcatccctcacacgttgccatccattcaaggataaccccagccacagtgntctgatcctacaaatggcactgatgaattctcctgctctcaaaaaaaaaaccaaaaaaaa

SEQ ID NO: 32067 - DNA, 121 bp, Artificial Sequence
  Synthesized
  misc_feature (61): n=t or c
ttcataagcctttcaggtgctgtttacaaacacactgagggtgatggtacatttctgctcntgttggaaagctgttcagaagcaaagtcctgtggcagtccttcattagattccatctgtg

SEQ ID NO: 32068 - DNA, 121 bp, Artificial Sequence
  Synthesized
  misc_feature (61): n=a or g
agacagggtggagagtatgtccataaagtgcaggagatccccatggtgtgggacgtccccntggtgcaggaggtccccatcggtgttgatgcagggactcagcactccgcaggtgacaaag

SEQ ID NO: 32069 - DNA, 121 bp, Artificial Sequence
  Synthesized
  misc_feature (61): n=t or c
agaaaagggtaacaaaaccagatgtggaaacatgggaaataacaaattattgcaagcctanataagcaagaaaacgttagctaggaacatcaccatcaggttgtaacaagccgtcttggca

SEQ ID NO: 32070 - DNA, 121 bp, Artificial Sequence
  Synthesized
  misc_feature (61): n=c or g
tacttattctattactgtctatctactggagtctgtgtcttaaagctatctaataaaccanttctgcttggaattagccaaatctgttcataacagattaccatcaatagcttttatagag

SEQ ID NO: 32071 - DNA, 121 bp, Artificial Sequence
  Synthesized
  misc_feature (61): n=t or g
gatctgagaccaggagcttatgaactggaaacatcttgtaggcacgagtgatccatgttantccaaaaccacatatagtctgctatggcccttttctctaagaaagtgggttgctctgtgt

SEQ ID NO: 32072 - DNA, 121 bp, Artificial Sequence
  Synthesized
  misc_feature (61): n=a or g
aaggagatgcatggtcattttgtaagcaagacttgttctctactctgtagggcttttaacntggaagaacccttgaggaatccacagtacatgaaccacggtttcccatttgagctgcatg

SEQ ID NO: 32073 - DNA, 121 bp, Artificial Sequence
  Synthesized
  misc_feature (61): n=t or c
tgattctatgatgagtcatggcagtaaaaattcaccatttgctgaggagtctcagaaatcngacaaagtcagcagaagttgtataagaaaccaaatgtgtgcgtatagggagctcaaaatc

SEQ ID NO: 32074 - DNA, 121 bp, Artificial Sequence
  Synthesized
  misc_feature (61): n=t or c
accctgggccagctgaggaggcagaagccatgtcactgtgtttgcggtgacgagaagtacncagctctggtaccttcaggcagcactgtggtgtgccatgtgggtaccagggcagcttccc

SEQ ID NO: 32075 - DNA, 121 bp, Artificial Sequence
  Synthesized
  misc_feature (61): n=c or g
gttgactgaaacttccaaaataaaaaagccaaaacctccacaaagaaccacaaaatttcanctgtgatgcatcacccataatctcagttaggaatgatgtgtagttctttatgcagttgta

SEQ ID NO: 32076 - DNA, 121 bp, Artificial Sequence
  Synthesized
  misc_feature (61): n=t or g
aattgtcaggatagtttcttacaggagaactccaagaaaggccaggactttaacagcaagntaaagagggcagcccacatggcagggtgagaggaggagctgaggagctgcagaggtgtag

SEQ ID NO: 32077 - DNA, 121 bp, Artificial Sequence
  Synthesized
  misc_feature (61): n=a or c
cttgctagtcctcttgtgggtcccccccccccccctcctataatataaactctgaatcacnagaaactgaaacagtaaaagggaaagctgctgcagaatagatgtgaggagcaaaagcagc

SEQ ID NO: 32078 - DNA, 121 bp, Artificial Sequence
  Synthesized
  misc_feature (61): n=t or c
gaagtgaaccctgggggaaaggagccacgagatggaaaactcaccagaccgtgggcagaangaaggactggactgccgttaaataccgctgcagtgcttggctggatggtgacggagcagc

SEQ ID NO: 32079 - DNA, 121 bp, Artificial Sequence
  Synthesized
  misc_feature (61): n=a or g
aagaaggcacaattttagctgtgaagaaacctacctgtgggacaatttattgaggagtgangtgcagtcaaagtcgtctgtaaatcaaggctcaagagttttgcaaagttataactcagat

SEQ ID NO: 32080 - DNA, 121 bp, Artificial Sequence
  Synthesized
  misc_feature (61): n=t or c
taaaaggcatattctggctcacatagcaagaatacacatgtgctcagtcttctgccaggcngcctcttcaaacttgtgcaaatgtgtcaatacttatatatatttgagacacatctctgcc

SEQ ID NO: 32081 - DNA, 121 bp, Artificial Sequence
  Synthesized
  misc_feature (61): n=t or c
ttgtcgcctctctgcaaggcgataagctcttcattgacgattaataaaagcagaagggcgngctgtctgcaagcagggatgccgtttggtgatgagagctgtcaagtcccacttgcacggc

SEQ ID NO: 32082 - DNA, 121 bp, Artificial Sequence
  Synthesized
  misc_feature (61): n=c or g
atgaagtataccagcaagaaagtgctacagaatatcttattggtggaaagtgtgcctaaanaagaggtttgcatgtctgttttttttccccttaaagcatcactagactattctgcataca

SEQ ID NO: 32083 - DNA, 121 bp, Artificial Sequence
  Synthesized
  misc_feature (61): n=a or g
cccttgaatcctggctcaaatggaatccatttttcttctgaattgaaggcaagaaattttnaaagcactttaaggggtgtttaaatccacagctgctctcaggtttctcacaccgtggtga

SEQ ID NO: 32084 - DNA, 121 bp, Artificial Sequence
  Synthesized
  misc_feature (61): n=c or g
ctctgaactagttcagtcttcccgcatccatggaaaagcagacatacacagtagttcaaanagacctctgaactaccctcattccaccctgcccaaaacagcaagttgaaattcaacataa

SEQ ID NO: 32085 - DNA, 121 bp, Artificial Sequence
  Synthesized
  misc_feature (61): n=t or c
taaatatgtaaagcctgaaattttatcagagtttatgcctgaacatgaaaaataacattcngttctcttaattgagtttatcttaatccacagggattttatttctataaatttgcttctg

SEQ ID NO: 32086 - DNA, 121 bp, Artificial Sequence
  Synthesized
  misc_feature (61): n=t or c
gatctacagagattcacttccagtccagtctttcaattcacaatatcagtctctcagatantcttttcagctccgaacatgatgtaagattttctctcacaaaacagaaagaataaacatc

SEQ ID NO: 32087 - DNA, 121 bp, Artificial Sequence
  Synthesized
  misc_feature (61): n=a or t
atcaatatctccagaaaacggtgagcagccacagccaaacttcacatttctgatctacagnctataccaaagaaatgcagacgtcattcagttttcagataaaagcattaaatacagtcta

SEQ ID NO: 32088 - DNA, 121 bp, Artificial Sequence
  Synthesized
  misc_feature (61): n=c or g
ggcagcacagccttgtctcccatgcatgttaccccgatctccagagcacggttgttgtctncacgatgtgctgttgtcctccactcaagcatgctttggtcgccccatctggtggtgtggg

SEQ ID NO: 32089 - DNA, 121 bp, Artificial Sequence
  Synthesized
  misc_feature (61): n=a or g
ttcagatctctctgcattttactttctttacttctccttttagaagaagatgagactaatntggtcagtctgtctgtcagttcctgcgcaaaagaggaggtgaaatttgaaggataattaa

SEQ ID NO: 32090 - DNA, 121 bp, Artificial Sequence
  Synthesized
  misc_feature (61): n=a or g
tttagatggcgtgcaatgaattccattctggcttcatctaaaactcccctttggaactgcngagtgcagaacaggggagtagtaaggagatccttccccctctcccacacacacatgtgca

SEQ ID NO: 32091 - DNA, 121 bp, Artificial Sequence
  Synthesized
  misc_feature (61): n=t or c
gatccattcctttattcttatagtgacataaatattctttagagcctccaatgttttcatnttacttgtaaagcagaagaacagaaatgttatttccttaacctggatcaatatacagaat

SEQ ID NO: 32092 - DNA, 121 bp, Artificial Sequence
  Synthesized
  misc_feature (61): n=a or g
caagacagattaccaatgttaattaacagctctcccaaagaacaatcctactggaaagcangaatctaacaccttttatttctcttagcctgggtttgacttcactgtagcttttctgtat

SEQ ID NO: 32093 - DNA, 121 bp, Artificial Sequence
  Synthesized
  misc_feature (61): n=a or t
ttattatgagttgttctcttttgtgaaaacgtcttgctcatcaacaaaataagacaagctnaatactgttaagctcccaggagatgagattttttacaggtttcttaattacccagacatt

SEQ ID NO: 32094 - DNA, 121 bp, Artificial Sequence
  Synthesized
  misc_feature (61): n=t or c
ctagcataaagtagagcagaactatgattgtgctattaactatggactaagcctacttcantgtagctcataattgtcttggtttgtgttggtctagttctgttgttcattgctgtaatta

SEQ ID NO: 32095 - DNA, 121 bp, Artificial Sequence
  Synthesized
  misc_feature (61): n=t or c
cactacctaagcaataaacacaacataacatcactaatattaatgcatggttcagctccangaggacatcagggagagacttctggggaacctgagggctgcagcagccccactgtgtcac

SEQ ID NO: 32096 - DNA, 121 bp, Artificial Sequence
  Synthesized
  misc_feature (61): n=t or c
ggaataggatgtaataggatgtagaggcacaacacgcctcttctgcacactgcaactcttnctttagggaaagcaaggaggtcatgttaacaaaaaggtattttcttccagttccaaactt

SEQ ID NO: 32097 - DNA, 121 bp, Artificial Sequence
  Synthesized
  misc_feature (61): n=c or g
agttttatttgcaacaaagtagagagataaaagcacagaagcaaatagaaaataattgtcncactaaaagagtaatgccatttgcatagtgacaaattataacatgtaactctcaaatgct

SEQ ID NO: 32098 - DNA, 121 bp, Artificial Sequence
  Synthesized
  misc_feature (61): n=t or c
ctcccaaagcatcactgagcctttcctaggagcactgcagtcacttcagacccacgacatncccatagtacaggcacacggacaccaggcagcgcaggcaaatcctgcaggatgcagcccc

SEQ ID NO: 32099 - DNA, 121 bp, Artificial Sequence
  Synthesized
  misc_feature (61): n=a or g
agctatgcctgtttccctaaaataacttaagactgaaagaacgaacaataattttggcttncagaatgactcacagagcaaagaatgattttgaggtgctgcagtagtagcaataaggcag

SEQ ID NO: 32100 - DNA, 121 bp, Artificial Sequence
  Synthesized
  misc_feature (61): n=a or t
gagtcactttctctatctcttctgatttatgtattgaggccagagctgctgttacatttanacttcagatttgcttcacccctgtagcgtttctttaatgcattatggctttatttatact

SEQ ID NO: 32101 - DNA, 121 bp, Artificial Sequence
  Synthesized
  misc_feature (61): n=t or c
gtgcactataagcatgacagatttcctctgcagcaattacagtctattgtgacaatagganttaatgaatataaacaacaaaccacataatctgttattacagaacacagccatacaccca

SEQ ID NO: 32102 - DNA, 121 bp, Artificial Sequence
  Synthesized
  misc_feature (61): n=a or g
tttgttcagtgacgtgctcagataccagaacttggaattataaatctagcagcagttgatncaggcagaaacaaatgaattgttctctatctttgatgaaggagaaaagctggcatgcact

SEQ ID NO: 32103 - DNA, 121 bp, Artificial Sequence
  Synthesized
  misc_feature (61): n=t or c
cagctcttgttagaataaaacataaccagcgctgcactttggtgtcacaggtctgaaaacncctctgggaatgagcacaaaggctgtgggctgtgtcctgggcagtgtccaggcacaactg

SEQ ID NO: 32104 - DNA, 121 bp, Artificial Sequence
  Synthesized
  misc_feature (61): n=t or c
gcagagcagggcacctgtcctggtttatctttcatttttagtggtatttgaccctctttangtggttggttttgcacctttgcaagccagcctagatatgccctgcagctgtgggttcctc

SEQ ID NO: 32105 - DNA, 121 bp, Artificial Sequence
  Synthesized
  misc_feature (61): n=t or c
gaattaaaagttccccaaggcagagaaagatctaaaaattccactgccacatcatggaaanactatcaagcacctggccaagtccaccccaggatccagcctaaaatttgaagccttgttt

SEQ ID NO: 32106 - DNA, 121 bp, Artificial Sequence
  Synthesized
  misc_feature (61): n=a or g
gaaggagactgtgtcccattcaaaactcggagtctaatgacatgcttagtgttctcccatnccttatctgctcaagcacatgttaaaactcccacctgaaacaaaagcatggctcttcact

SEQ ID NO: 32107 - DNA, 121 bp, Artificial Sequence
  Synthesized
  misc_feature (61): n=c or g
tctcacgggtggaggagtagctgaagatgtgctgtccttaggttttgaggtactgaaaatnaaaagtctcaagttagatgatgattataaaatgccttgtgcagatcagctgtacctttaa

SEQ ID NO: 32108 - DNA, 121 bp, Artificial Sequence
  Synthesized
  misc_feature (61): n=t or c
cttctccctaatcagatgcttatatcacctgtggcttcacgtccctgtgggtctcaaagantataagatttctgaggtcaggcactttgcatttcaccttctttgcaatccttgaaaatgg

SEQ ID NO: 32109 - DNA, 121 bp, Artificial Sequence
  Synthesized
  misc_feature (61): n=t or c
ctaatgttgtacctaaatcttccccctcttttagtttaaagcctttaccccttgtgctatngctgtcactgacaaagaacccctctcagatttcctacaggcccatttaggtacagaaagg

SEQ ID NO: 32110 - DNA, 121 bp, Artificial Sequence
  Synthesized
  misc_feature (61): n=a or g
aatcaatcatgcttgaagtactactaattgcttacaaggtgagggacacaggaagattganttctcttttcttcctgcctgcctgtatgtcacttatggcacaggctagacctgcatttgg

SEQ ID NO: 32111 - DNA, 121 bp, Artificial Sequence
  Synthesized
  misc_feature (61): n=t or g
ggttaaggatcaagtgaaaatgaattctcctagctcaaatactctctaagcacacaacagntcatattccctgccctgagtccacacagcccaacttcaaggaccaacagtggctcacatg

SEQ ID NO: 32112 - DNA, 121 bp, Artificial Sequence
  Synthesized
  misc_feature (61): n=a or t
tggaataaacttagtgaggtgaatcacaacaggcactggatgattttagcagtgataaatnttctgacaagaactgacaagaaagtttgcttattgtgactgaattgagtacttctaattc

SEQ ID NO: 32113 - DNA, 121 bp, Artificial Sequence
  Synthesized
  misc_feature (61): n=a or c
caatgcgttacacagactgatgcatactaaaactggaaataaaaggttagtcactgaagtnataacttttaagtagaaaatagacctcagtagttttgcattgtcaattgaaacacctaac

SEQ ID NO: 32114 - DNA, 121 bp, Artificial Sequence
  Synthesized
  misc_feature (61): n=t or c
tcagggcagctccccagatactttgccactgagtctccaaaacactgcaatcacatcccancagcagatgtctgctgcacatctgctttaagtgagcatcaggttgaagcttgctggggtt

SEQ ID NO: 32115 - DNA, 121 bp, Artificial Sequence
  Synthesized
  misc_feature (61): n=a or g
ttctaagtctttatttaaaacgtaatgttagcaaatagctattgccatctatctattctgngttctctaatgtgagctgagaggtggggaaggcagctctcagcctgtttttcagtacttt

SEQ ID NO: 32116 - DNA, 121 bp, Artificial Sequence
  Synthesized
  misc_feature (61): n=t or c
tgcaagacagatgccatttccgctgtgtgatcacagaacagcagcttccaatgcaacagtnggaacattcaaatatcagctctaaggcttcagcctccacatttacttaataaagacacac

SEQ ID NO: 32117 - DNA, 121 bp, Artificial Sequence
  Synthesized
  misc_feature (61): n=a or g
catagtcacctcagctgtttggggtcctttatagctggaaagatctctttcacacaatcangctaaaatagatattcacttatattctgaatgctacatcatcatgtctgtgtcttaacta

SEQ ID NO: 32118 - DNA, 121 bp, Artificial Sequence
  Synthesized
  misc_feature (61): n=a or g
aacagaagaaaaatgtcacactgatgtaattaggtggcaaactgagcagcttcgagcaccnggcactgctcactgttagtccatcatcagtgccagcgactgccagtgactttgttcaaat

SEQ ID NO: 32119 - DNA, 121 bp, Artificial Sequence
  Synthesized
  misc_feature (61): n=a or g
aggtgcatgagcttcagccttgttgctggaggaaattaggttaaaaatcaccggagggcanagaaaagggatctgtggagctctcactgggagataaagacctaaaccaggcactgttgct

SEQ ID NO: 32120 - DNA, 121 bp, Artificial Sequence
  Synthesized
  misc_feature (61): n=t or c
atttgcaactaatttggaaatgcattgagaacactatgttttcagttgaagtatagacagnatgtattagaaatgattgagctattcacataagtaaaagtaaataacagcaggaaatctg

SEQ ID NO: 32121 - DNA, 121 bp, Artificial Sequence
  Synthesized
  misc_feature (61): n=t or c
tcattatctcttgcatcagtcccatagcgtgtgcccctgtgtcacagcacagagcatatgntgtgcatcctcttctgtttgccgtacccaagccagtctactgggagcaggacggacatgg

SEQ ID NO: 32122 - DNA, 121 bp, Artificial Sequence
  Synthesized
  misc_feature (61): n=a or g
gtatgttagagttttcatgagatatattcacatcactgaaagtattttaagggaaggaagnataaatgactggcatagatataagaacaaggaaatcgctgagaaaatgttgaagctctta

SEQ ID NO: 32123 - DNA, 121 bp, Artificial Sequence
  Synthesized
  misc_feature (61): n=a or g
gctttgtggttcagggctactgttgctctagctgattgcttgtaagagatctgaagttccnggttccttttgaagctagagagccatggaaattccatctaaaatcataagtctttgttaa

SEQ ID NO: 32124 - DNA, 121 bp, Artificial Sequence
  Synthesized
  misc_feature (61): n=a or g
acactgcgatgtgcaccagatgtctgccacccctgacacaacacacacataaggtcaactncatgctacgtgttctcaagatatgagatgtttgtggagctgatgggtagcaaaatgaata

SEQ ID NO: 32125 - DNA, 121 bp, Artificial Sequence
  Synthesized
  misc_feature (61): n=t or g
gaattactcaacttccctctccatccagatcattctccctgggagaacagaaacacagagnaattcctttcactgggaaccttcaacggatgggtttaatcagctgttcccactcattcat

SEQ ID NO: 32126 - DNA, 121 bp, Artificial Sequence
  Synthesized
  misc_feature (61): n=a or g
ctccagtcttgggaacgtgggacagaaagcgaccagccacgtcatggattttacttcttcncctttcaaattgaagattacagtgatatggtaatcagaagggggaagacaaaaaaaaatt

SEQ ID NO: 32127 - DNA, 121 bp, Artificial Sequence
  Synthesized
  misc_feature (61): n=a or g
tccacctctgctttccacagacttggctgctaaaaccaagcttcctcgcccatctatcccncaaagatcagactgcttgccaggatgagcaaaacaagggaaaaggctctgtagagccaga

SEQ ID NO: 32128 - DNA, 121 bp, Artificial Sequence
  Synthesized
  misc_feature (61): n=a or g
caattaaacttacttttgtgtttgcatcttctcaggggattcactaaactgacttgtaatntgcttacttttatgtcatgaaaaatttagaataagaataaatatagagtatacgaaatta

SEQ ID NO: 32129 - DNA, 121 bp, Artificial Sequence
  Synthesized
  misc_feature (61): n=t or c
attctgaggtgctaacaagcccttacatattactttctaggaaatatataccacaagatanatctgcaacaaacctgcttacagtttctatggtttctgagtttgtagatttggcaaaaat

SEQ ID NO: 32130 - DNA, 121 bp, Artificial Sequence
  Synthesized
  misc_feature (61): n=a or g
tgaaaaagttaagacagttcactcttaactatttgcattccatacatgttcccatcttgcnttatagctctccttttctctatatgtatgtcttgccctttaaaagtgtctaattacattg

SEQ ID NO: 32131 - DNA, 121 bp, Artificial Sequence
  Synthesized
  misc_feature (61): n=a or g
attcacttgcagaataattacccatgtaaagtaactggtccacaacatgaaatggctaatnttaacccagtagtctatggaaagatctaaatttacacaggtttccaaatcacaactgttt

SEQ ID NO: 32132 - DNA, 121 bp, Artificial Sequence
  Synthesized
  misc_feature (61): n=a or g
caactggtggttctgaagtcatctctaaaaagaataacgtggaaactgggatggaaatgtngctgtagaggtggtagctgcagggatcggcaggagattcccttctttgcaagatgaaaaa

SEQ ID NO: 32133 - DNA, 121 bp, Artificial Sequence
  Synthesized
  misc_feature (61): n=a or t
aaaaaaaaaaagggaaaaagacaaaaagtactgcatttttgctaggccttcacaagcatgnctgactttggctttttgtattcacatggaaacattagatgcaatgagctagcaagaaagc

SEQ ID NO: 32134 - DNA, 121 bp, Artificial Sequence
  Synthesized
  misc_feature (61): n=a or t
cagtcacagcaacaatacatgtacttaaatcaacacgtgcacttttaaagttgcaaagtanctgcatgcttataccaaattgctgccctaaaaatgggtttcatgaattttcaagatttaa

SEQ ID NO: 32135 - DNA, 121 bp, Artificial Sequence
  Synthesized
  misc_feature (61): n=a or g
ctgctcagctggtttgcaggggtgtaatagcagaggtggagtggaggggaatcaaagaacngagtgggatgatgataattttgtgtcattttcagcgaaggccgccaccacctgttcctcc

SEQ ID NO: 32136 - DNA, 121 bp, Artificial Sequence
  Synthesized
  misc_feature (61): n=a or g
ccattaaagatgtaccaggtagcaaatagacctcctgtggcttttgaaatcaacccaaccncccctgcctttccagcacgtggtcctagaagctcacagcacatcttccaaactgctctgg

SEQ ID NO: 32137 - DNA, 121 bp, Artificial Sequence
  Synthesized
  misc_feature (61): n=t or c
tagtgcatttgttggtatgcccacagatctggctcaattgctttgcatccctttgaagtgnaatggaataactttccccctgccccttccaacctcctaatacccaccccccaaaaaagaa

SEQ ID NO: 32138 - DNA, 121 bp, Artificial Sequence
  Synthesized
  misc_feature (61): n=c or g
gccatttgatactttgtatttcttagctggctatttgtgtgcttgtcttattgcctggccntaagactgtctttggatttcaggcttaagctaaaggtgattctttaagcttggggaaaga

SEQ ID NO: 32139 - DNA, 121 bp, Artificial Sequence
  Synthesized
  misc_feature (61): n=a or c
ctttttttttttcttcaaacaactagtcatgtattgacttgactcactggattgtgagaanaattgctccaagacttggtcacatactgtctgtaatttgagtttctgcattgttctttag

SEQ ID NO: 32140 - DNA, 121 bp, Artificial Sequence
  Synthesized
  misc_feature (61): n=t or c
tgctttccctggcagaattgttggcagtgagcatggaagtgcgataacatttctactgtcntgggggacgcttttatgatacagtctgtctaggacaacccaacagtccttccagcaaatt

SEQ ID NO: 32141 - DNA, 121 bp, Artificial Sequence
  Synthesized
  misc_feature (61): n=a or g
catttcacgtagaaaatgctgaaatgacagctttcacttcactcatttttttccagggtgnaaagatttggctcaaattgtttgccaagtttgagtgcaaacagtttcagctgaactgagt

SEQ ID NO: 32142 - DNA, 121 bp, Artificial Sequence
  Synthesized
  misc_feature (61): n=t or c
taacaaatgagatcacacaaactaaagcacttagtaggccatgactaacactggcatactnacttttccattcaagttttacacatgatcttctaaacagggcatataaaagttagaaact

SEQ ID NO: 32143 - DNA, 121 bp, Artificial Sequence
  Synthesized
  misc_feature (61): n=a or c
tcattgaactggattcacatgctgtgagtagcttcccgttttcacatctctccctgttggngtgtccagcaggcagaagtagaagaaacacgggagtaaaagaatataggaaatcattgta

SEQ ID NO: 32144 - DNA, 121 bp, Artificial Sequence
  Synthesized
  misc_feature (61): n=t or c
catgttcatttgtgaggaacatccccaatccaaaagcactctagaagaaacactgccattnctatttactgccttttcctgtctcttgattatattttctctccccagctaatttgcagag

SEQ ID NO: 32145 - DNA, 121 bp, Artificial Sequence
  Synthesized
  misc_feature (61): n=t or c
ggtatgatgtctggtagacccctgaagcatctaacaaataaagatgactcccgcagaacantggttagtgtgtgctgaagctcagcagcttccaacttctgtatttggtttggatgctttt

SEQ ID NO: 32146 - DNA, 121 bp, Artificial Sequence
  Synthesized
  misc_feature (61): n=a or g
tcctacagtgccgctttctgtgattaataaagtcagttaaggagtgagtgagtagatagtnagcatttgggaggtgctgaaaacatagcactttatcttctggccaacctggatgcaccta

SEQ ID NO: 32147 - DNA, 121 bp, Artificial Sequence
  Synthesized
  misc_feature (61): n=c or g
catgcaatgccacatacagggaccagtaaccattttgtatgtcccactccctgccctcatntcctcctaaggacacaatacactctgactagccctggggaagaaacttgtctatcacaat

SEQ ID NO: 32148 - DNA, 121 bp, Artificial Sequence
  Synthesized
  misc_feature (61): n=t or g
gaaacctgcaccaaaaatgagtcaacaaataaacaaggatctgcagaagacatggtatctnccaagtccaactccttgtggcccaaggtccctgctgcagaaaccattaggatctgctgta

SEQ ID NO: 32149 - DNA, 121 bp, Artificial Sequence
  Synthesized
  misc_feature (61): n=t or c
taactcagcagaacagtgccagactaacagacctcataggaatgctttggagcacttcgcngacctgcataatagcaaagtcacactccctcacacccttgcaaactccagcacagaggta

SEQ ID NO: 32150 - DNA, 121 bp, Artificial Sequence
  Synthesized
  misc_feature (61): n=a or t
actttgtaattttacaccccaagcaaatccagaattttagttcaactgatgcaaactggtntatctggagagcagacccttatgttgaaaatttattgtagtgggcaaaatagaagctgaa

SEQ ID NO: 32151 - DNA, 121 bp, Artificial Sequence
  Synthesized
  misc_feature (61): n=t or c
gcacctggacggggaggcaatgggggcccacacccaaggcgagcctcagtttgtacaattngggcagaaaatcgattccaccccacagtggcaagagtgtgacactggaaaggatgcccaa

SEQ ID NO: 32152 - DNA, 121 bp, Artificial Sequence
  Synthesized
  misc_feature (61): n=a or g
tatactactctcaccacaggaaactgcagttacaattgagatgaccttcactgaaacactntaagatacaaaactcagctgtaaagaaagccttctttgtatcagtctttgctcacatctc

SEQ ID NO: 32153 - DNA, 121 bp, Artificial Sequence
  Synthesized
  misc_feature (61): n=t or c
cacagccccaacccggaggggtaccaccaagggaagaaaccaatctgcccaattctgtaanggcttcgctatttctttgcattggaagcacattttatccctccatctatgatgtgctgta

SEQ ID NO: 32154 - DNA, 121 bp, Artificial Sequence
  Synthesized
  misc_feature (61): n=a or c
cacaaaagtaagtggtgtggtatacttcactgccttatgatggaagcctcaatttggtttnattcatttagtttaactggaacaaattctggcttagttatttcttgaatcatctggacat

SEQ ID NO: 32155 - DNA, 121 bp, Artificial Sequence
  Synthesized
  misc_feature (61): n=t or c
tccaacagagggaaggtttgaaggctcctaaggcttggcccatcatttgtttatagcatgnatgtcaccataacacaaaactcagtgaagggatttattcatatctatgaaaggatatgga

SEQ ID NO: 32156 - DNA, 121 bp, Artificial Sequence
  Synthesized
  misc_feature (61): n=t or c
ccagcaaactaatagagtttccaggtgctatggtcctaatccatggtgtttaccaccagcntcgcatctgctccagattttaccccttctctttcctctcaacaaatctggtctctgctac

SEQ ID NO: 32157 - DNA, 121 bp, Artificial Sequence
  Synthesized
  misc_feature (61): n=a or g
ctaatgcaaaggcaattgttttgttactggagctaggttacgtttgtcttccagcactacnggataagtatcatgagacttccctgtcttacatggcatgtatttttcttctaatcaaagt

SEQ ID NO: 32158 - DNA, 121 bp, Artificial Sequence
  Synthesized
  misc_feature (61): n=a or g
ctattttactactctgagtagtgtaaaatctattagctgcaagactattttctagaacacnctacagaaattggcagcaaaatatatctcatattatgcaactataaatgtacaagacctt

SEQ ID NO: 32159 - DNA, 121 bp, Artificial Sequence
  Synthesized
  misc_feature (61): n=a or g
agtgaaaacaagatgaagagctgaggggcaggacggaaggcttgccagagacacagcccancatccaccaactgtgtgctagtactccttgacttgcttcccctgcaactccaaggtaata

SEQ ID NO: 32160 - DNA, 121 bp, Artificial Sequence
  Synthesized
  misc_feature (61): n=a or c
ccactgcgagaggagttaatgcagccagcagactgacatgacccggtcagattgcacaacnacctcctggatgttctagcaactgggcactgccagggcattcctaaatattagaaaaaaa

SEQ ID NO: 32161 - DNA, 121 bp, Artificial Sequence
  Synthesized
  misc_feature (61): n=t or c
tcataaagatcactctgttctaattgcaaaagacttcacgcggcttcacaacccgcagctncagattcactgcctgcaagatgtgaaaatctaaatttgattttattgagctaccgttgca

SEQ ID NO: 32162 - DNA, 121 bp, Artificial Sequence
  Synthesized
  misc_feature (61): n=c or g
ttggggttgtttatttttcttactttatttgtcttcctgctgaagtggttgattttcctgnatcttatcattaaaacatagaaattcttcaaaaatactgtttgctataaaattattaatt

SEQ ID NO: 32163 - DNA, 121 bp, Artificial Sequence
  Synthesized
  misc_feature (61): n=t or c
agagcttctaaatttagtcctgctttctgttagatgcatagattagggtttggagcatatnttttttctaaaaccttcccactcacctccattttctgtcagagttaatacagcagctgaa

SEQ ID NO: 32164 - DNA, 121 bp, Artificial Sequence
  Synthesized
  misc_feature (61): n=a or g
tgacaggcactgggactttcagtcctctctagaactaagagaactaattctttccttgggnagctggaacagacagaagtggtgggactagcccaagcagttctgtgcattgcatgaagct

SEQ ID NO: 32165 - DNA, 121 bp, Artificial Sequence
  Synthesized
  misc_feature (61): n=a or c
atctcttgctacagcagtttctctgaagtgttgctgtgttgtgtatgaaaaagaaggcatnggactagacagatggactgtcattactttttaagtatgtttgcataaaagggcactataa

SEQ ID NO: 32166 - DNA, 121 bp, Artificial Sequence
  Synthesized
  misc_feature (61): n=t or c
ttcagctgacccaagaaacaaatctgagagcctacatgaatagtaagatgaaatatgcaangcctcgatgagcaaactgcaatgtagactagttttctgtaacccaggtgcaatggaagtt

SEQ ID NO: 32167 - DNA, 121 bp, Artificial Sequence
  Synthesized
  misc_feature (61): n=a or c
tgaggtggcaggtatgggtaattagttttattttcataggaaaacaaggttgtaaacagcntaaactagtaataagcctcatgaataagtgtaggcttctggcttctggccctgtttacgg

SEQ ID NO: 32168 - DNA, 121 bp, Artificial Sequence
  Synthesized
  misc_feature (61): n=a or c
atgttatttctgtctctttattctctttccttttgcatttacagttatgtgcatatgctcntgtgtatacagacatacccctgcactcactgagtctttggagcttccaggtagcaagaga

SEQ ID NO: 32169 - DNA, 121 bp, Artificial Sequence
  Synthesized
  misc_feature (61): n=t or c
atacatcagcacaatcttgtaatttctaatgtgcttatactaagtagttatgtatctaaanaggatgcagtggcttctgaatacttcatgtgattgtttaaaatagatgtgattgtggttt

SEQ ID NO: 32170 - DNA, 121 bp, Artificial Sequence
  Synthesized
  misc_feature (61): n=a or g
taatttcatttccttttttttttttttttcctttctgctttgttgaacttgttctggtcanggccgagcacaacatggtggatgaccaagagtttgggggcaggaggaacaatcatttgcg

SEQ ID NO: 32171 - DNA, 121 bp, Artificial Sequence
  Synthesized
  misc_feature (61): n=t or c
tgcactcagccctgttgtattctgggagacctggtatttctcagtgaggtttttggagccngcagcacctcacatgctccagcactactgcatggcatcagcactgcctgctctcctccat

SEQ ID NO: 32172 - DNA, 121 bp, Artificial Sequence
  Synthesized
  misc_feature (61): n=a or g
ttctcaccttaccaacattctgtaactactgaaccctgactatacttctagaagatcttancaactcctcagcttctcttttcatttgtgtttttgggaaagatgttcaattttaaatgct

SEQ ID NO: 32173 - DNA, 121 bp, Artificial Sequence
  Synthesized
  misc_feature (61): n=c or g
tacattctgaatcaaaatggaaggcatagtcgtctacctacatataccagcaagaaattantatctgcttaccaggctaaactgtaagccatttatcaacatcatattaacttcctgcatg

SEQ ID NO: 32174 - DNA, 121 bp, Artificial Sequence
  Synthesized
  misc_feature (61): n=t or g
atatggatgcttttgggatggatgctttagagtagggatgcaacaaatggaagaaataatnaaactttcaacataaggaagaagacagtgtcttcatccagcattacacctggttccttcc

SEQ ID NO: 32175 - DNA, 121 bp, Artificial Sequence
  Synthesized
  misc_feature (61): n=c or g
ttctcccagccatggtcccagaaatgggacagaggggaccacagtgcccttttcccctttnccctcatggttttcgatgcacggacctgagctgtgggtagggagccacatccaccacccc

SEQ ID NO: 32176 - DNA, 121 bp, Artificial Sequence
  Synthesized
  misc_feature (61): n=a or c
catgctccaaacatttccttacaaatcaacaataataaagaaactcaaacttgatcttaangcttttattttgaaactccagtgaggaattgagttttaatctcatccaaattgaattaag

SEQ ID NO: 32177 - DNA, 121 bp, Artificial Sequence
  Synthesized
  misc_feature (61): n=a or g
atgcattgtgtatattgtgtatacacattgtgtacgttgtgtatagcatagtgctacagtntaatattatgacacagtatttttgtgctattagcatgcagatttcattaaaaaaataagg

SEQ ID NO: 32178 - DNA, 121 bp, Artificial Sequence
  Synthesized
  misc_feature (61): n=a or g
agactgtgccctgacctttgttacatgaatcttgtgccacagctttttaggatacttcagnaaaaagaacatgtgtttccgagatgcccctgttcaatttatgctggttacacctgggctt

SEQ ID NO: 32179 - DNA, 121 bp, Artificial Sequence
  Synthesized
  misc_feature (61): n=a or g
acacacatcagcaccaggggtggccagggtctgtctgagcaagcagggggagctggtagcngggtgctgtgcgttgtgccaatgatggcttgcagcaaggaaatctgagcaccagatttct

SEQ ID NO: 32180 - DNA, 121 bp, Artificial Sequence
  Synthesized
  misc_feature (61): n=a or g
cagaactgcacacatgcagctctcacaaagccagaagagaagaggcaccaaagaaaacagncaccttaaatttcatacatttttaaaccaaaaattgtagttatggatgtgtctttgtaac

SEQ ID NO: 32181 - DNA, 121 bp, Artificial Sequence
  Synthesized
  misc_feature (61): n=t or c
atttgtcttcattgcagagagggcagggaggaggctggaggtggagtgtagtcagctcagntgtaggaaaaagctggagaacaagtgttgcaacagccacccagtgccacctgcctgactg

SEQ ID NO: 32182 - DNA, 121 bp, Artificial Sequence
  Synthesized
  misc_feature (61): n=a or t
caaatgccacagacaaaactccgctttcttttacagatttgttttttgacaccaaacaggncatatctgggggataatttcagtccatatcttctcctggactcaactcagcttgttcttt

SEQ ID NO: 32183 - DNA, 121 bp, Artificial Sequence
  Synthesized
  misc_feature (61): n=a or g
attgaaataaggaagaattgaggatcagtctgtataaagtctgtggcattaacaatattcntattttattcagatacctttgacaaacggacaaatgtgccagccgcaaagacctcaggca

SEQ ID NO: 32184 - DNA, 121 bp, Artificial Sequence
  Synthesized
  misc_feature (61): n=a or g
gatgaggcccttaatttcagaagccatacctgtaagttctactgtgctacaaaactcttanctgaagctgtttgtgttttcaataagaatgatgaatactacttaatatggtttcttgcct

SEQ ID NO: 32185 - DNA, 121 bp, Artificial Sequence
  Synthesized
  misc_feature (61): n=a or g
cactgaataaattggtgctgtagttagagctcctcctcatacttcttaacaggttcagtgnggagagagagatgtccagggagaggactcagcaactgcctgttgggttcaaaacattact

SEQ ID NO: 32186 - DNA, 121 bp, Artificial Sequence
  Synthesized
  misc_feature (61): n=t or c
acaatgaaacacaagggaaaataaagaacatgccaaactttatcttccccaggtctcagantggtttatctgtcagctccgaacgagctatcactcccacatgtttaattagaagctgagg

SEQ ID NO: 32187 - DNA, 121 bp, Artificial Sequence
  Synthesized
  misc_feature (61): n=a or t
attttttttttcaggtgagatgtgatgtaatgtgtgcaatttctctgcagatttgacatcncgagattagaaattcccaaacccagtaatctggacagattctacagaataattactgaat

SEQ ID NO: 32188 - DNA, 121 bp, Artificial Sequence
  Synthesized
  misc_feature (61): n=a or g
gaccagatcgtaagcaaagcattagtcttcttcctaataaactatttgatttcagatccangaaatattaaaacagaaggctgaaagttttgctgcacttccttatctgaaaggtaacttt

SEQ ID NO: 32189 - DNA, 121 bp, Artificial Sequence
  Synthesized
  misc_feature (61): n=a or g
ctttgttagattttgctctttgattctgttttctgtaatagcatgcttcaggggtaacganctgacctatcttctggaagtacattactatgggggaattgcagattcccctttggaactg

SEQ ID NO: 32190 - DNA, 121 bp, Artificial Sequence
  Synthesized
  misc_feature (61): n=a or t
tagctttaaactatgcgttcacagccgtgtttaagaaatgctttacataccttgtcagcangattggtaaataaacccagtctgaggcttggcagaatgagcaaccacaagcctgcataag

SEQ ID NO: 32191 - DNA, 121 bp, Artificial Sequence
  Synthesized
  misc_feature (61): n=t or c
cagttgtagatggggctgttttcttctgcagttctgaagtctgggttgtttataatcacangtctgaggaggctcagggtaaaagcagtttaagtgcatcttgctccttcttgtcatccga

SEQ ID NO: 32192 - DNA, 121 bp, Artificial Sequence
  Synthesized
  misc_feature (61): n=a or g
caatggtgtgatcactactactggccaagagccatctgttggtgtcccagagggggatacnatgagcagccgagatgctgtgggtcttttcattaaggaccatggctatccttgggaagat

SEQ ID NO: 32193 - DNA, 121 bp, Artificial Sequence
  Synthesized
  misc_feature (61): n=t or c
gtgggacttgctggtacctactgggatgtcctgaaacccattgagaaccactggaactcantgggacttgctgggatctacttggaccactgagtgccctgggatattctgagacccactg

SEQ ID NO: 32194 - DNA, 121 bp, Artificial Sequence
  Synthesized
  misc_feature (61): n=a or t
ctgggattgccatgcagtgtgaagaggtacccattggccagatggggcctttgcttcaaangcggtggaaagctcaacgtcagcgtgcagccctgtgccctccggtgctggaaggggctgc

SEQ ID NO: 32195 - DNA, 121 bp, Artificial Sequence
  Synthesized
  misc_feature (61): n=a or g
tattgaattctgttagcaaagagcctgtacacgttgccacttagtgagtttatggtccacnttggttttgtgtgagctggttgagggatcactatgttactgctgtatgaattcccttgga

SEQ ID NO: 32196 - DNA, 121 bp, Artificial Sequence
  Synthesized
  misc_feature (61): n=a or g
gtgttcagataggagggtccttcatgacctgacttctcagccttccccagagtttgaagcnttaggaagcttaacaggaacaggtctgacttatcagtcacctctcctcaagctcccattt

SEQ ID NO: 32197 - DNA, 121 bp, Artificial Sequence
  Synthesized
  misc_feature (61): n=a or g
tctagaagaaattgtctgagaaggggactgtttccccaccggtatttttgtagtctgagantgaagacagcctcatttcaaaagatgctcagtgcttttatgtaagcatcaaattcagacc

SEQ ID NO: 32198 - DNA, 121 bp, Artificial Sequence
  Synthesized
  misc_feature (61): n=a or g
tctacagatacaacaaaggaaatgagctctttttacatactagcaacatctcatttcaccnattccttgcaacaagacagtttagagaaatttttgctgcaataacaccactggagaaagg

SEQ ID NO: 32199 - DNA, 121 bp, Artificial Sequence
  Synthesized
  misc_feature (61): n=a or g
aaatcttagttgagttacacataaacagtctgattctctagcttttgttatatttaaccantgcattgacatgatagagatcaagagaagaggaaaaaatattgcggagcaaggtagatta

SEQ ID NO: 32200 - DNA, 121 bp, Artificial Sequence
  Synthesized
  misc_feature (61): n=c or g
attacaacatctaaatgcatttttgtaaaaatattcctcataagagatataataacacatnttgtgtatgcttcacttgttaaaggtgaacttgctgtaccctgttgcaaggtatgttttg

SEQ ID NO: 32201 - DNA, 121 bp, Artificial Sequence
  Synthesized
  misc_feature (61): n=a or t
ccaattctctctagctcagctgttgtttcgggatcagccagaaacttgcttcaactgcttncttccctccttccccaatctgctagcagaagaaagtctcttccctcgtcctcagtgcctg

SEQ ID NO: 32202 - DNA, 121 bp, Artificial Sequence
  Synthesized
  misc_feature (61): n=a or g
ctatgccagtcctttaggcactctgcagtcaatgtagttgagtcatctcacagtggacatngtttagctagctgggatgagtcactgtccagagacatttgggcctctttatttgcgatgc

SEQ ID NO: 32203 - DNA, 121 bp, Artificial Sequence
  Synthesized
  misc_feature (61): n=c or g
gacagtgctggaaatacttattcccacaaatgactctgttcatacaagtagccttatacancactgcttgtggctggatggacataaattcaggaacagagtacgctgtgtgggatcagac

SEQ ID NO: 32204 - DNA, 121 bp, Artificial Sequence
  Synthesized
  misc_feature (61): n=a or g
tttaaacctcagccatacattaatcattagaacgaatacctaacctttccctttaataaanagcaaaagcaaaatcaatttgctttagcctcaaggcagcagcttgcaccaggtcactgcc

SEQ ID NO: 32205 - DNA, 121 bp, Artificial Sequence
  Synthesized
  misc_feature (61): n=a or g
aaaagaaaaatgaaatcctgagattaatttagaaatacattcgatgtatacctgggggggnaaaaatcctaccagaagatctgaaaaacactttttaccatctcaactcttagaatcattt

SEQ ID NO: 32206 - DNA, 121 bp, Artificial Sequence
  Synthesized
  misc_feature (61): n=a or g
agaccgatgctctgagagcaggcagcctcatatctctgactcctttgtcccagcttataangctagattagattgcccatctttgttcctctgtaggatgttagattgccttaatgtcctc

SEQ ID NO: 32207 - DNA, 121 bp, Artificial Sequence
  Synthesized
  misc_feature (61): n=t or c
catacttgggcctgctatatgaggctcaggaagagagaagtttgaatgtcagtgcagctgngaggatttgtgcagcgttgtttttcactgtgtgagcagaatgtaagaagtgggttaggct

SEQ ID NO: 32208 - DNA, 121 bp, Artificial Sequence
  Synthesized
  misc_feature (61): n=t or c
gacaacttctcagaagctggacaaaaatagcagttacagaaacagaaagctcttttttgcncccattgagagcaaagtaggtgatagcttttcagtgccagagttctgtttcagatattcc

SEQ ID NO: 32209 - DNA, 121 bp, Artificial Sequence
  Synthesized
  misc_feature (61): n=t or c
tttctgcttttcagaagcagatttcaaatatgtggcttgctcatagcactctgagaccacntctgtgcttggataatctgttacacagaaatgcgattcctgtgtggattttccagcatcc

SEQ ID NO: 32210 - DNA, 121 bp, Artificial Sequence
  Synthesized
  misc_feature (61): n=t or c
tcttcaagagcctccacttttgctaagaacaggcacagtcttgggttagatgagcagcagngagagtgggagtaaaaagcagagctccagctctcattgcaaactgaagcaccaatgccag

SEQ ID NO: 32211 - DNA, 121 bp, Artificial Sequence
  Synthesized
  misc_feature (61): n=a or g
gggatcgatagggcggtcatgttcctgcgcatcagcagccgctcgctatacatttaatacnttaaaacacattcccccaattttctatttatggcaaatgaatgtctaatcctcgagccgc

SEQ ID NO: 32212 - DNA, 121 bp, Artificial Sequence
  Synthesized
  misc_feature (61): n=t or g
atgcctcgtttgtaattgtgggttcataaaaccccttttcagaattcctcttatcagaacntagttccaggcttactcttactttactcttactttactcttaccttttaaatttagattt

SEQ ID NO: 32213 - DNA, 121 bp, Artificial Sequence
  Synthesized
  misc_feature (61): n=a or t
agcagttttcttcagatgcgcagtttgccaaatgcagtggaatctaagaaggaacactgtngtatacatgtgagcaaggtctgaggatccagctttttttaaatgccacataaaaagaaaa

SEQ ID NO: 32214 - DNA, 121 bp, Artificial Sequence
  Synthesized
  misc_feature (61): n=a or g
agagaatagttcccagtatgagaggtgtctaagagattagaaatgtacctatctcacttcnctggttgttttgaagttatttagataggtttaactaaaaacttaaccattttatagttta

SEQ ID NO: 32215 - DNA, 121 bp, Artificial Sequence
  Synthesized
  misc_feature (61): n=t or c
atgtcagtgtatcgccactgtccaaagaacaagttgacccatttgcctatctttccagtcncacagacaatttcttatcccacacaaccctatatatttctaccacaaattatgactcagt

SEQ ID NO: 32216 - DNA, 121 bp, Artificial Sequence
  Synthesized
  misc_feature (61): n=t or c
aagtgtggaaacttgaggcttttagtgtcagtgcataaggttttctcagtatccccggagngaagtctccatcaccagtatattctttgcagtcatattttggtgtctcctgctctttcct

SEQ ID NO: 32217 - DNA, 121 bp, Artificial Sequence
  Synthesized
  misc_feature (61): n=a or g
ttctttgtaggagaggtgtgccggacttctgggattcattaatattgcaaaatactttctnaagtagtttaccaccaggacgctgcaggattgctgccttgcccaaccaccctggccttat

SEQ ID NO: 32218 - DNA, 121 bp, Artificial Sequence
  Synthesized
  misc_feature (61): n=a or g
gccgttggatttacaagtcaagaacttacaccaagaggttcataagctacaggaaacttgnacatcttccatcttgcgctatgaacatgctgtagctttgctaatggaaagctctacgaaa

SEQ ID NO: 32219 - DNA, 121 bp, Artificial Sequence
  Synthesized
  misc_feature (61): n=a or g
aggctctcagacagtgaatggggaaggtctcaggtaactttgttctagcactgcagatgcnaaggagtcagaagcagtaactcagacctctcagaataatgagaatgccttaaaataagtg

SEQ ID NO: 32220 - DNA, 121 bp, Artificial Sequence
  Synthesized
  misc_feature (61): n=t or c
ggcaaatattcgcagcaaaatacagttttacattgtcaaataggtgtcacgttagcacaanctaaggaatgctttcagaatccaatactgtagtttcaggatgaaatgttaaagggagaga

SEQ ID NO: 32221 - DNA, 121 bp, Artificial Sequence
  Synthesized
  misc_feature (61): n=a or g
caaagggaagaagagggatgccaaggttaattcattccagccagagaaaatagagtcctcnctctgatttagaatctctgattccctgttacattactagtgcccaaactcataactaatt

SEQ ID NO: 32222 - DNA, 121 bp, Artificial Sequence
  Synthesized
  misc_feature (61): n=a or t
ttgaggctgtacagaacctgtgccccttttctttgttgactttcagtgcttcaaatgtccnggtgaaattccagctctgcaggtacaggagacaaaaacagttaatcctgaatagctgcat

SEQ ID NO: 32223 - DNA, 121 bp, Artificial Sequence
  Synthesized
  misc_feature (61): n=a or g
ggtagccaagtcgatgcagtaggtgctctgagagagcagtcaggagagcagggccacctcngttcacacaaggcctatacataaatattgtcatcacacagtgctgttcactgatgaactg

SEQ ID NO: 32224 - DNA, 121 bp, Artificial Sequence
  Synthesized
  misc_feature (61): n=c or g
gctgtggtttggacctgacaatccgggaacaactattttccctccaggaatccaggaaaantattagagtgacaaactctgctctcagatactcacccacagttcatgctcagagcaggga

SEQ ID NO: 32225 - DNA, 121 bp, Artificial Sequence
  Synthesized
  misc_feature (61): n=t or c
caccagaagattttgtctacctgtctcagatttagaagtgataaagtaacttgtatctttncctccactaacaattcactggtggtaactttctcgtttcctctggagatatttcttaaga

SEQ ID NO: 32226 - DNA, 121 bp, Artificial Sequence
  Synthesized
  misc_feature (61): n=a or g
ctgcctttgtctggagacagagataggtaagcagggtctgtatctaaagaaaacactgacnctcatttagccacatgcagataacaaaacacatttggctatcaaaacttcaagtttccaa

SEQ ID NO: 32227 - DNA, 121 bp, Artificial Sequence
  Synthesized
  misc_feature (61): n=a or g
catgtccttttgcaaggatgcttactggaacaggatttggacagcacacaagtgctcagcncaaatccctctgccttgtgccaaagccagcacgcaggccaggatttggcttgctggtgag

SEQ ID NO: 32228 - DNA, 121 bp, Artificial Sequence
  Synthesized
  misc_feature (61): n=a or g
tagaaattgctagtaataagtacaatctgagtttttaatgcatttccaggctgtgatgacnttgagaaaataatatgctaattgacaaaaccaaagaaaaaagttttgtgatttaaaaatg

SEQ ID NO: 32229 - DNA, 121 bp, Artificial Sequence
  Synthesized
  misc_feature (61): n=a or g
tacaaagatcttcttaaggtatgagaggcttttgtttgttttggcttagggaaaaacccantcttgtttggaaactctctaaatgttttgaatcaaatgtattatcagtagatttggaatt

SEQ ID NO: 32230 - DNA, 121 bp, Artificial Sequence
  Synthesized
  misc_feature (61): n=a or c
atcttgtttatggaagtctaactgcttatggacagttttagaagcttattactatgtgctncatctgtattagttgcggcgagagtggggttggtctcttctcactggtgacaggatgagg

SEQ ID NO: 32231 - DNA, 121 bp, Artificial Sequence
  Synthesized
  misc_feature (61): n=a or g
cacttcagaaccttctaaagagaagagtattgagttttcagctgtggttttataggtgacnattgaaatattgtattctggtgatctgccatctagatgagaaagtggttgtaatagtact

SEQ ID NO: 32232 - DNA, 121 bp, Artificial Sequence
  Synthesized
  misc_feature (61): n=a or g
ttttgattgttcttccaagataatatgatgtatgggtggtgtgttgtagaagatttattcnggcaacaattagacaagttgaaagaacaaaattaaaccgacgttttacttttggatctta

SEQ ID NO: 32233 - DNA, 121 bp, Artificial Sequence
  Synthesized
  misc_feature (61): n=t or c
acccattgagctctatgatcaaaaagaaattgagtcttccagcattatattatgaattcgngttctccacagtcaatgtgtagttaaacaatgaggcacaacaggcattaatccctttgaa

SEQ ID NO: 32234 - DNA, 121 bp, Artificial Sequence
  Synthesized
  misc_feature (61): n=a or g
tggtctgcaaaactctttatgttcactgggcatattcaaacaatttggagcaactccagtngatgtcaaagcacactaacatttacttggaaactgtataagccttgaaacaattcattgt

SEQ ID NO: 32235 - DNA, 121 bp, Artificial Sequence
  Synthesized
  misc_feature (61): n=a or g
aacaagactattctaacttgtctctattggttttacgctgtttggactcatcactaagagncagcctagagtggggactgaagaggatttagaggaaattcaaacagagatgcttgtgaaa

SEQ ID NO: 32236 - DNA, 121 bp, Artificial Sequence
  Synthesized
  misc_feature (61): n=a or t
cttgttaaataacaaatagactccatgtcattatgtgtggacttggatcaataccaagaanaaatgagaaaatatttatgaagctttttaaatggcaaccaaaagtcaataagatggtgtt

SEQ ID NO: 32237 - DNA, 121 bp, Artificial Sequence
  Synthesized
  misc_feature (61): n=c or g
gcctgggttggttcttgcatagatgtgtgttctagggcttggggagaaacctctactcttnaaatatctgcctcccttcttgtgcttcccctgaaataaggcagggcatccttcaaggatg

SEQ ID NO: 32238 - DNA, 121 bp, Artificial Sequence
  Synthesized
  misc_feature (61): n=t or c
gagcaagaataaatttagccaccaaatcagcagatgtgtttgtaagaagcaaggagcgacngtccgattggatgtctgatttctggagtgttcctgggtaggtgttctccttcctgtgtgc

SEQ ID NO: 32239 - DNA, 121 bp, Artificial Sequence
  Synthesized
  misc_feature (61): n=a or t
gctgttctggcaacagctgttcaaacaggcccacttttttctctccctcatatttttcagnaggtcatatagaaatctaaggcatccagaactgaaatgcaagagtagtacacataatgaa

SEQ ID NO: 32240 - DNA, 121 bp, Artificial Sequence
  Synthesized
  misc_feature (61): n=t or c
tttctacttgttcaggagaaccacagctcagaagtgctaaggcagcccacataacttgtgnccgttccatcactatttgaagtttcattcaaataacgctataaagcattaatgattgagc

SEQ ID NO: 32241 - DNA, 121 bp, Artificial Sequence
  Synthesized
  misc_feature (61): n=t or c
gtgtgctcatgtcaacttgcatggggttgtgcagcagccttctgaaaacacttgcgtttgnttttggattaaagcaacaaagtttaaagttcccacctgtattcataaggaacacttgaaa

SEQ ID NO: 32242 - DNA, 121 bp, Artificial Sequence
  Synthesized
  misc_feature (61): n=t or c
aagaggtatttacatgggttcaccaaccagacaacagaatctgttactgtaaaattcctangtgctgcgcagaacagaatgaactcgggctaaaaccatgcagtctgaccttgcaaagcct

SEQ ID NO: 32243 - DNA, 121 bp, Artificial Sequence
  Synthesized
  misc_feature (61): n=t or c
ttggctgatggaaccaagagccttccagtgacggaccaaaaagtctaggtgagcatttgtngtgtggaatttttcagaaagcctcttattttcttttcagaagaaaatcatacagtcactt

SEQ ID NO: 32244 - DNA, 121 bp, Artificial Sequence
  Synthesized
  misc_feature (61): n=t or c
cctttgttgttctggcctaggctggcctttcataaagctcataccacacattttaaggtcnccagccacctgctacccgggataaaaaaatccgggatacatggacaagttaggcactcag

SEQ ID NO: 32245 - DNA, 121 bp, Artificial Sequence
  Synthesized
  misc_feature (61): n=a or g
aaagaccaaatgacgatacggacagcctatgtgttcactataccctgggtttaggttttanaagatagctgagttaacacaacgtgaaatgctgctgggcaaagagatacctgtttgtttg

SEQ ID NO: 32246 - DNA, 121 bp, Artificial Sequence
  Synthesized
  misc_feature (61): n=a or t
ccttctaaaacaggattgagaaggatttggtcagctccagtcctactgcttctgggggttngtgcttgtttttggtaaaaggtgttgaatgtacttacagagatgtagctggaaagtagtt

SEQ ID NO: 32247 - DNA, 121 bp, Artificial Sequence
  Synthesized
  misc_feature (61): n=t or c
aagctcacactgctggcatctaaacccaaggaggaaaactcaagggaaccaacatccctcnccttgctatcaggttggggaaggagactccaaaggcctgaggctcaaccaagtggtcccc

SEQ ID NO: 32248 - DNA, 121 bp, Artificial Sequence
  Synthesized
  misc_feature (61): n=t or c
ctgactattttgcctgatctagatagtatgtagtaagacatctgaaaatacgtgcatcctnaggtatcttgcactgtaaggtactacagccttgtaggcaccctgagcatttctggtgttg

SEQ ID NO: 32249 - DNA, 121 bp, Artificial Sequence
  Synthesized
  misc_feature (61): n=a or g
caaacaaaatgttggaagttttccatttctgcttgttagaaaaaaaatgttatctatccanaagagttattttaggaaaaatcctgagtatttcagatccagtttccacattcaagcaaag

SEQ ID NO: 32250 - DNA, 121 bp, Artificial Sequence
  Synthesized
  misc_feature (61): n=t or g
ctgaaactctgctatagctgtaatctccaacagtaatatttagcctttatacagactcacncatgttcagaacactgcacatacactaagcctcgtgaggtagataaatacgtgttatgta

SEQ ID NO: 32251 - DNA, 121 bp, Artificial Sequence
  Synthesized
  misc_feature (61): n=t or c
accccaacagacatgaaagacacactgcatctgtcagtgctatcagaggtattagctgctngtgtcttcataaattacagccttaaattaccatttcacactcacacaagcagaaggatac

SEQ ID NO: 32252 - DNA, 121 bp, Artificial Sequence
  Synthesized
  misc_feature (61): n=t or g
aaagagttattgaatcattaccttaatctatctgaaacaattacttctgcatcaaattaanacctatttaccaactgtaaaaactgcacatttctaaattggaaaggtagatccttttggc

SEQ ID NO: 32253 - DNA, 121 bp, Artificial Sequence
  Synthesized
  misc_feature (61): n=t or c
tgcattgttccatgagcactccttagaggaacaaagcaccctgctgcattctctgtggcgngagctaaaaaacgacacttactattgagacccatggtactagcgatggattgtgatctga

SEQ ID NO: 32254 - DNA, 121 bp, Artificial Sequence
  Synthesized
  misc_feature (61): n=t or g
ggttcccccaccaagctttccccagacagatcccacccagccctggctaagagctgtcctntcaggctgctcatcaacagctgtttgcagcatacgacagcatcttctgttgctcctaaag

SEQ ID NO: 32255 - DNA, 121 bp, Artificial Sequence
  Synthesized
  misc_feature (61): n=a or g
tgggaagaagccagtccccttttgggggagaggtcccgggtagtggcatgctccatactgntgacctgatacgtttttctgtctcttgctgctccagagcccacagttgaagagaaacttc

SEQ ID NO: 32256 - DNA, 121 bp, Artificial Sequence
  Synthesized
  misc_feature (61): n=a or g
gcgtgcagagcctctcctgcagccacgtccccattttgggccaggtgggagaaaaacatgnggtaaatctgtgctcagctctggattaagtcaccgtggggatgcagggctcagcctttgc

SEQ ID NO: 32257 - DNA, 121 bp, Artificial Sequence
  Synthesized
  misc_feature (61): n=t or g
tttatccttacacatttcagagttttatgtcagcgacattttcctcgcaatctaaagacgnatgcttgaaaacaagaggtttccaggcaccaaaaagaagtgctatgactacttatattaa

SEQ ID NO: 32258 - DNA, 121 bp, Artificial Sequence
  Synthesized
  misc_feature (61): n=a or g
cctttatgccctgggacataacacatcccatcagggtatcagtgtcctcaaggtaatgacntgggtgaagtcaaacagcagctacctacctgaatgaattcatacaatcaatgaaaaacaa

SEQ ID NO: 32259 - DNA, 121 bp, Artificial Sequence
  Synthesized
  misc_feature (61): n=c or g
atttaaaggaaaattagaaccacaaaagtaacacccttagctacagcaaaaccaacaactnagccaagcgaacaaattatttgtacacagtagtaaagcattccctgctgcagaagctgta

SEQ ID NO: 32260 - DNA, 121 bp, Artificial Sequence
  Synthesized
  misc_feature (61): n=t or c
acctcctgcgccaccaaccaacggtggaacaagatttctcctacatcacaccaggggcaangcagctccaccttcctgctaacacaagaacaaaagctgccacctgaaatatgcgcacaca

SEQ ID NO: 32261 - DNA, 121 bp, Artificial Sequence
  Synthesized
  misc_feature (61): n=t or g
catgcatgcacatggacgtttacatgccgcaagagcagaagtttctatataggcaatgctnctggattgtggaagcagcccccttgctgtactggatggtagagtactgtagtgtttgagg

SEQ ID NO: 32262 - DNA, 121 bp, Artificial Sequence
  Synthesized
  misc_feature (61): n=t or c
cattaacgattatttcttctattttgggaaagaatattgctcaaattcttttaatgtattnctactggccacctcgaggctgctttgaaatgattaagtatgtggccaggaacctcaagtt

SEQ ID NO: 32263 - DNA, 121 bp, Artificial Sequence
  Synthesized
  misc_feature (61): n=t or c
ctcctcccaccacctgacagctctgcagagcctgctgaccacttgcgtttttcaatttgangctacagttgacttttgacaacttactgactgtgattaagaactgcactataataacgtt

SEQ ID NO: 32264 - DNA, 121 bp, Artificial Sequence
  Synthesized
  misc_feature (61): n=t or c
gtgaaaggatttttactgtatagaaacaagcacagcaaagtgcatctcaggacaacatctntagagaaagtgggaatgagtcttatttctgtttatatacattgtttttcttggcattcac

SEQ ID NO: 32265 - DNA, 121 bp, Artificial Sequence
  Synthesized
  misc_feature (61): n=a or t
tctcagtgttgccattactgcatagcagttgaaaaattctgctttatactttatgcaatangtccttggtgaggctttgttctgtcttaattaaagatagagtaaggtctgcctgaggagt

SEQ ID NO: 32266 - DNA, 121 bp, Artificial Sequence
  Synthesized
  misc_feature (61): n=t or c
tccatgtactttataggagcagtaagttatgtgtaagtggtggctgaatattcaaactttnggagtaaattatttgtatataagattgaatctcacaaaatgtagcgacttttccaagtgt

SEQ ID NO: 32267 - DNA, 121 bp, Artificial Sequence
  Synthesized
  misc_feature (61): n=a or g
gagaaatcgcagtaacccaatccaagcgagaatgagttacgggagagaagggaaatagggnaaatcattggaaatcatcctaaatatattcttgtgcgtgggtctgtacggctgtatggga

SEQ ID NO: 32268 - DNA, 121 bp, Artificial Sequence
  Synthesized
  misc_feature (61): n=a or g
aggtaagagcatatgctctgttaataaaagaaatccctacaattgaagtgttgaaaagctngattttaattcagcaaaacccttactctgaattccaaagaacggagaaaataatgaatat

SEQ ID NO: 32269 - DNA, 121 bp, Artificial Sequence
  Synthesized
  misc_feature (61): n=a or g
ttattctcagcactgaagaatccccactggtcaggagttttgggttgaaataaccaccccnagtcattttgcccatatgaacatggtgtggcctaaacttcagctttgatgagaatatcat

SEQ ID NO: 32270 - DNA, 121 bp, Artificial Sequence
  Synthesized
  misc_feature (61): n=t or c
ctggagtgggcagaggctggtgcgaaggaacattagtggggtccaagtagtttcatcctanggagaaaatgaaggaaacagagagaaacattgggcactggaggtactttgtaagtcacta

SEQ ID NO: 32271 - DNA, 121 bp, Artificial Sequence
  Synthesized
  misc_feature (61): n=a or c
cccgctaataaattgaagcgatctttcattttttaaccccctcctttcgcctttcccaccntccttccaggtttcggcgcgcctgaagaaataaagccataacgacgctgataatgacaat

SEQ ID NO: 32272 - DNA, 121 bp, Artificial Sequence
  Synthesized
  misc_feature (61): n=t or c
tttctaagctttacagttgcgttgtactgaagaatcgttacctcaagggcagattcatacngacactgatttctttagccttgtctctgggctttgctgtgctaggcaattggtgtgtgaa

SEQ ID NO: 32273 - DNA, 121 bp, Artificial Sequence
  Synthesized
  misc_feature (61): n=t or c
tctcagtccatgttattgattccagaaaataagcagacatcaatttccttccaaaggggcnactggagtgttatatttaaccatttcacactaatcctgactcttatacaactgtcctcct

SEQ ID NO: 32274 - DNA, 121 bp, Artificial Sequence
  Synthesized
  misc_feature (61): n=c or g
agaaaggtcagaatagaatcaatctgtaagtcaaagaatctcattgtgaccttcaattcanatattcagtttatatcagaggacgtgggactttgaaaatcagtgcatctaaataaattca

SEQ ID NO: 32275 - DNA, 121 bp, Artificial Sequence
  Synthesized
  misc_feature (61): n=t or c
agaaggaatgaagtatctactgcagtattattcacagaaacatgcctttcagagatgtaanacagactggatatgtttgcagaacaactcaagtaacagaaaatcacagctcttactctgg

SEQ ID NO: 32276 - DNA, 121 bp, Artificial Sequence
  Synthesized
  misc_feature (61): n=t or c
ggatggactgatccaaaacagatccaagatgtgattcccactgcccctgtgatcatgtcangataatgaaactaatttgattactctgaagtaatttcttcgaaagtctaagctgtctcct

SEQ ID NO: 32277 - DNA, 121 bp, Artificial Sequence
  Synthesized
  misc_feature (61): n=t or c
atcagtgcagcacaaactacagcttaggcagatgaaagaaactaagtctgctctctgttgngagctccctttcctagcttacacacctcgctgcagacagggcagtgtgtcagtgcatgct

SEQ ID NO: 32278 - DNA, 121 bp, Artificial Sequence
  Synthesized
  misc_feature (61): n=t or c
ctactgcatgtctatagacatcagtattggattaatattaatctacatacaagtgtacctntttaactaactttttaagctgaatcatagttctaaagcctttgtgtgaagtcttataaag

SEQ ID NO: 32279 - DNA, 121 bp, Artificial Sequence
  Synthesized
  misc_feature (61): n=a or g
agagcaagagctcctggatgactgtggtatttttaagtcatacagaagtgctgaaagaccnaagaaagcagcccagttggttttgctcatctgtcactataggcagtgaaataatttactc

SEQ ID NO: 32280 - DNA, 121 bp, Artificial Sequence
  Synthesized
  misc_feature (61): n=a or c
aacctctaaaaaataggaaatctgttgtccttaaccagtactgcactgttggcagctgtanataatgcttgcctatattgctgaatttgcaaaagaaggaccttatacaacatccagtttg

SEQ ID NO: 32281 - DNA, 121 bp, Artificial Sequence
  Synthesized
  misc_feature (61): n=a or t
agaaaatgtcctgatagatgtgaggtctcctatcagtgagagctactctgtcatggcaganctctgggaacaaaaggaatttgactgggtgtaacaaaccaaaggtgcacagaagctgagt

SEQ ID NO: 32282 - DNA, 121 bp, Artificial Sequence
  Synthesized
  misc_feature (61): n=t or c
tcttctgcatctctttcttctatgttagaacaagtaccaaatctgtgcctacttttcttgnaagtgtaaatctcccaactgaatcctctgttctgatgaggtgtcaactttcatttcttgc

SEQ ID NO: 32283 - DNA, 121 bp, Artificial Sequence
  Synthesized
  misc_feature (61): n=t or g
gttttagtcatctctttcttctttattgggcctccgcatagagttatttcctctttacatnacacatgttctacttattaacttcttcagctaaaaattcagacactaccagtaaataaaa

SEQ ID NO: 32284 - DNA, 121 bp, Artificial Sequence
  Synthesized
  misc_feature (61): n=a or g
ctcctgaaaatttcctgaaacatcctatggtaaagaaatatctgtagccagctctccaggnagggaaaccaaagtagagttgtgaactgacttgttcaagagtatgggttctgccggaaga

SEQ ID NO: 32285 - DNA, 121 bp, Artificial Sequence
  Synthesized
  misc_feature (61): n=t or c
gccctcactgaacacctttcctagaaacatggtgcaaaagagagaagagaaggttggaggncgcgagcactcatctaggtggagaagtatgtgactgtgcctgcagttagaacacaagagt

SEQ ID NO: 32286 - DNA, 121 bp, Artificial Sequence
  Synthesized
  misc_feature (61): n=a or g
ttgtccaacctggcgcttccccttcctattgtccatccaagggccaccatgatctatcccngtctttcccaaacccagtgcctatcccagctgctgtccccctgtcctgggcagtggcagc

SEQ ID NO: 32287 - DNA, 121 bp, Artificial Sequence
  Synthesized
  misc_feature (61): n=t or g
aagcaaaagagaaatacttcagataaaattaaattttgactttagaagaagtttgttaaantcaattctactttcattcttgtttcatttacctcctaggttaacagagaaaatacttcgc

SEQ ID NO: 32288 - DNA, 121 bp, Artificial Sequence
  Synthesized
  misc_feature (61): n=t or g
aagagtgggtacattgcagccaagtcttgtacttgcacactcttccgcaggtacaaatgcngttcattcaaaaatgattattgctaccctactgctgtaataacatccttacagaaatctg

SEQ ID NO: 32289 - DNA, 121 bp, Artificial Sequence
  Synthesized
  misc_feature (61): n=a or g
attgataggcaggtagagaaaaccaaggggaggcagtttgcaggaaagatgctttcattcngtgcactaggtgctcatttctggcatcctactgcaacacgacttcataatattctaaaaa

SEQ ID NO: 32290 - DNA, 121 bp, Artificial Sequence
  Synthesized
  misc_feature (61): n=c or g
catcagaataatcagccttaagagagctgtgatttaacatgtctgaatcattgggtttgcnaaatcagttgaatgagggggaggcaggggtagggagaaaaccaaaagcttgtgcagcagt

SEQ ID NO: 32291 - DNA, 121 bp, Artificial Sequence
  Synthesized
  misc_feature (61): n=c or g
tcctgccctgaagagttctgagtttaacttggaacttactgtaaatgtcactgaatacagnaaagcagatttcacagtagggatatatattaaaaaaagcatttcatattcagtctagcta

SEQ ID NO: 32292 - DNA, 121 bp, Artificial Sequence
  Synthesized
  misc_feature (61): n=t or c
ctaaattaagaacattgtccaataaggacaatttcatctgacaaccttagtaaagagaggnactttgctttatttgatgaattcattgagagcataaggaaaaaacaattaatacagtata

SEQ ID NO: 32293 - DNA, 121 bp, Artificial Sequence
  Synthesized
  misc_feature (61): n=c or g
gcaacacaatctcttgtgcttgctactattcactcagcatttatttccatagtgctatctnctgtgtaccctgtaatatctcctagttgtgcgttcacttttttttttagtgtttgtttgc

SEQ ID NO: 32294 - DNA, 121 bp, Artificial Sequence
  Synthesized
  misc_feature (61): n=a or c
ttgtatattgatcaattgattgtatgggaccaagtattatttctgaactgttcgtagcttnttctttagcaccatcctcgacatgtgattcagctaaccaatgttttcttgaccctgtgat

SEQ ID NO: 32295 - DNA, 121 bp, Artificial Sequence
  Synthesized
  misc_feature (61): n=a or g
tttaacagtctgcaaatgtgatctacagcaaaaataatcaaacaaatcaacttccagaagnaaagtttccttttggatcaggaaacagcagagggtcctgaaagaacatttgagtgggaga

SEQ ID NO: 32296 - DNA, 121 bp, Artificial Sequence
  Synthesized
  misc_feature (61): n=t or g
cgctattacagaggattaataaatgcaagctgaccgccagagtgcttttttataaggaagnttttcagaaggtgcaaccttttgaagaaaaagtgctaataatacagctttgccaagagca

SEQ ID NO: 32297 - DNA, 121 bp, Artificial Sequence
  Synthesized
  misc_feature (61): n=t or c
ctacaaaacacactgtcacttttcaatcccacattctggttctcctgcggtgcttttcccngggtactgaccattctttccacagagcagattcattaacgttctgatcatccattaaatg

SEQ ID NO: 32298 - DNA, 121 bp, Artificial Sequence
  Synthesized
  misc_feature (61): n=a or g
tgttgacagttgtatctttagtagaattacattttctaggaagatttgctgatactgattntttggcttacactgtacattcttgctgctttaaaggggcaaaagttgatttttactctga

SEQ ID NO: 32299 - DNA, 121 bp, Artificial Sequence
  Synthesized
  misc_feature (61): n=a or g
aattgtaaaaaaatgttttgaattaggtgactggggaagatgagactagctttcctaattngatttcctagggatgcttctattaaccaaagtcatttcacttctacagagacaaaaactg

SEQ ID NO: 32300 - DNA, 121 bp, Artificial Sequence
  Synthesized
  misc_feature (61): n=a or g
atttacagagcttgatctccagaatccagaattaacttgctggaaagaaagaatgaaagcnttagtaattgtaattgaaagcgtttgttgcatggaggagagtccttttggaactgcatta

SEQ ID NO: 32301 - DNA, 121 bp, Artificial Sequence
  Synthesized
  misc_feature (61): n=a or g
aagctaaacaaaaatacagttcttgcatcatattttgaatctctggccaccaattaggtcntattccaagagtttggacaaatagctgggtgaaaagtagtctctccagaccctgcttgca

SEQ ID NO: 32302 - DNA, 121 bp, Artificial Sequence
  Synthesized
  misc_feature (61): n=a or c
cctaagtgaattcacatctaacccttacacaaacatcagtgctgcaacaagctcaagtttngaactttatttataaaaaagggagtacctaagggacttgtggcattcctttgcctttctt

SEQ ID NO: 32303 - DNA, 121 bp, Artificial Sequence
  Synthesized
  misc_feature (61): n=t or c
cttctacttccgactcgaagtgctgcaggggagtgggaaatgggtgttgtggtcagcccanaatgtgttgtatctgctgctacttcatggtcacactctgcccctactccaacatgggatc

SEQ ID NO: 32304 - DNA, 121 bp, Artificial Sequence
  Synthesized
  misc_feature (61): n=a or g
ctggtcattccttcagtgctgccctgctccagaagattggaaaaaagtctttatcttttcnactgtttgaattaccaaagtcttattggatatcttctaaggataaagaacacatttttaa

SEQ ID NO: 32305 - DNA, 121 bp, Artificial Sequence
  Synthesized
  misc_feature (61): n=a or g
cgacttcctctgttctgtgtttacaggttaatagttactgtacattcatcccatacagganactattacaccttttccagagacatgaaccagtaaactcttaaaacaatattctatttaa

SEQ ID NO: 32306 - DNA, 121 bp, Artificial Sequence
  Synthesized
  misc_feature (61): n=t or c
tctcgctcgttttagatttctcatccttttcttcctgctcctattctttctctatttcacntaaaacaaagccccacccctcagccacctccctgcttgtacagagcctcccactttccgc

SEQ ID NO: 32307 - DNA, 121 bp, Artificial Sequence
  Synthesized
  misc_feature (61): n=t or g
aatatggattttttaatctggtgcttaagtccaccgaatgaccaaatagtggtcaacctgngaggttaccaagcgaggtgctgtgtgagcagacattgctctgcatctccccacgtcgcag

SEQ ID NO: 32308 - DNA, 121 bp, Artificial Sequence
  Synthesized
  misc_feature (61): n=t or g
gttctttttttttttttttttttttttttggccaaattttagctcttcagctagctatgtncctcctcctctgcatttcccacaaccttaggaagaaaaaattgcatggtgcagctgaagg

SEQ ID NO: 32309 - DNA, 121 bp, Artificial Sequence
  Synthesized
  misc_feature (61): n=t or c
cacaaggaataaaagatcatatgtgtcagctggcttcccaacttcccaggcattgaagagnctcacttgtccagacttagacaagatctgacattttgacacagggaaagcaaattctttc

SEQ ID NO: 32310 - DNA, 121 bp, Artificial Sequence
  Synthesized
  misc_feature (61): n=t or c
tgtcgtatgtgctacatattgacataggagcacgctggtaaaacacatcctttgagcatgngctgggttgatgggaagtagtttctcaagtcaagaggagtcagaatcacccctgaggaag

SEQ ID NO: 32311 - DNA, 121 bp, Artificial Sequence
  Synthesized
  misc_feature (61): n=t or c
gtcattcccagtaatcatgaaaggaataatcagactgcctggcactgaaatcttgccagtnttgcagccttgtctttaatttctgcttcttaaaagagactgcttagaagtgagtaaatgg

SEQ ID NO: 32312 - DNA, 121 bp, Artificial Sequence
  Synthesized
  misc_feature (61): n=c or g
cagtagatggagtgacagcaatcactccatcccagtgattgctgtcactccatcccagacnaaggagtgattgttgtcaattggccagatgtacttagaaaatgctgctatccatgctcgt

SEQ ID NO: 32313 - DNA, 121 bp, Artificial Sequence
  Synthesized
  misc_feature (61): n=a or c
acaaggtgcagcgtggtggctggttgtgcatttgctggaagaactgcaaggcagtccaagntcagagcacttacacccttggaaatgaatgggtaaccagcaaagaattagaaaacatgat

SEQ ID NO: 32314 - DNA, 121 bp, Artificial Sequence
  Synthesized
  misc_feature (61): n=c or g
gattatttccaaagagtttaggctcagtcagtcagcttttagagtctcagtgaaaccatgntcccagtcaccaaatgcatgtctgtctctccaaaccatcatgtcattcagcccagtactt

SEQ ID NO: 32315 - DNA, 121 bp, Artificial Sequence
  Synthesized
  misc_feature (61): n=a or g
tcaaggagaaagcaatctcagtactaagatgcagttagctttggactacatacaattgagnggggaaaagggagatttttcctacagatcagatatggaaaggcacttgtcactgacatga

SEQ ID NO: 32316 - DNA, 121 bp, Artificial Sequence
  Synthesized
  misc_feature (61): n=a or g
caacaaaggcacacgtgtcacccaaatactaatgtttatggcaatctgtttttctattacnttcttctatctttacattttatctgtttctcctgctccaattttctcttgcagcaaggca

SEQ ID NO: 32317 - DNA, 121 bp, Artificial Sequence
  Synthesized
  misc_feature (61): n=t or c
aataaaatgaaagtaaaccttctatgggggaaagtatatttatatggcaactaatgctaancttaagctgactcttgatacctctatcaaaaaataaaaattatataacaccagaacactc

SEQ ID NO: 32318 - DNA, 121 bp, Artificial Sequence
  Synthesized
  misc_feature (61): n=t or c
tcgggtacagtctgaccctaggaaatttttgagtgtgtttgctgagctggagctgataaanctcagtgccgagtcatttcaagggcaagaggagcacagtttcgggactaggtggtacttc

SEQ ID NO: 32319 - DNA, 121 bp, Artificial Sequence
  Synthesized
  misc_feature (61): n=a or g
gaaagtttacatgaattgttatcaccaatgacgaaaaaaaaattgatatgattggaaggcngctctgcaacaaatggtgcttgccctctccttaccccccagccaagctgcaggaagcttg

SEQ ID NO: 32320 - DNA, 121 bp, Artificial Sequence
  Synthesized
  misc_feature (61): n=a or c
tcacattggaggtagcaggatgaactagcctattccagactgttgtgtgctcagtggggcnagagagacgctttggtttttcatgaaacatcagggaacaaatcttcacgttttacaatta

SEQ ID NO: 32321 - DNA, 121 bp, Artificial Sequence
  Synthesized
  misc_feature (61): n=a or g
gatttctctatacttcatgcctgcatgtctgtgctaaggcatatctgtgtgtatgtcactnctaaagaatttgatattctgaacgctaaatgacagtttatgtctttcagatatttccttc

SEQ ID NO: 32322 - DNA, 121 bp, Artificial Sequence
  Synthesized
  misc_feature (61): n=t or c
ttggtaaatattttagacaagcaagtttaatggctcttgtaaagtaacaaatcctttcatntgttatgcatttgtgatctatatgtcatttgtccaatccagagctcattaatattactta

SEQ ID NO: 32323 - DNA, 121 bp, Artificial Sequence
  Synthesized
  misc_feature (61): n=a or g
actgatctgtccaaagctgtaagaagtagagaagccagagattaacacgagtgagaaaccntctccccaggacacaatggcagccccagttgggaccaaggcagcccaccgcccactgcac

SEQ ID NO: 32324 - DNA, 121 bp, Artificial Sequence
  Synthesized
  misc_feature (61): n=a or t
ataactatctaataaatagatttccatgtagacctatatgaatctgctgaggccctgttcntgattcctaaccacttccagtggtaagttccacatgttttctttagtcaatcctcatatt

SEQ ID NO: 32325 - DNA, 121 bp, Artificial Sequence
  Synthesized
  misc_feature (61): n=a or g
gctctctctgtggtgtagctgcagcagtggcactggaatagtttgaggagctctcagctgntgtgacatgcacggtcagttcttcctgctctgttctggcacactcatgggttaaagcagt

SEQ ID NO: 32326 - DNA, 121 bp, Artificial Sequence
  Synthesized
  misc_feature (61): n=a or g
tggaaaagaagaaatgtagatttaaaaacaaacgaggaataaaaacattggcagttctganagcaggagagaaacagagtggctaacagactgaggaaagccttcaaaaaggatgtgttgg

SEQ ID NO: 32327 - DNA, 121 bp, Artificial Sequence
  Synthesized
  misc_feature (61): n=t or c
atattattaatattagatattcctcattaagccagccgtttccatagcaggagccttgtanccagtgccattttccatgtgccttttcctgtccttgccagacgtggtttagacatctgct

SEQ ID NO: 32328 - DNA, 121 bp, Artificial Sequence
  Synthesized
  misc_feature (61): n=a or g
atgagtatcttatgtacttgagatttcaattctttttgttatgagagagagaagaagcaanagaaatatactagcttaacccctcagtgcacagcaatactgcttaaaatagtttatccta

SEQ ID NO: 32329 - DNA, 121 bp, Artificial Sequence
  Synthesized
  misc_feature (61): n=a or g
tttaaaatacacctctgtttgtaattcaggtcatggtatccctcattatcaactgttactntctatcctaaaagcagttattaactctttgttggttactctagaagaagcagacgattta

SEQ ID NO: 32330 - DNA, 121 bp, Artificial Sequence
  Synthesized
  misc_feature (61): n=a or g
actcattgtgcactgaaaaaagtcattgcagagcctttcacaacctgaacgcataactcanagatttctgagactcacacaacagctaaagttgtgcttctggcagcaatgggactttctg

SEQ ID NO: 32331 - DNA, 121 bp, Artificial Sequence
  Synthesized
  misc_feature (61): n=a or g
tctcatgcaaacccatgaacctgctgtaggtcatggaaaagaattagatgagacagagaanggaaatgacatgtagagtcaatgatacattaagtgactattttatcttaaggacatcaag

SEQ ID NO: 32332 - DNA, 121 bp, Artificial Sequence
  Synthesized
  misc_feature (61): n=a or t
ggtagccctcaaacagatcttccagtactataatctctgggtatcatgaaatggaaatacngttatcatctcgtttgcatcctttaagttttcagagatattagatatgaagctgttgcat

SEQ ID NO: 32333 - DNA, 121 bp, Artificial Sequence
  Synthesized
  misc_feature (61): n=a or c
agactttggttatttggcagagaaaattctttcatcttaaataaagttttgcctatgaatntaaactttggaatgaaatggtctgcatgccttacaggaatagagctctgttaaaaaaaat

SEQ ID NO: 32334 - DNA, 121 bp, Artificial Sequence
  Synthesized
  misc_feature (61): n=a or g
tatgttagagcagtaaaaaatggtggggaatcattgggtcttgcatgtttataaggctgcnggagaaagggaaatgttgcatgctccattcagcctgcatggctaatagacagaactactt

SEQ ID NO: 32335 - DNA, 121 bp, Artificial Sequence
  Synthesized
  misc_feature (61): n=a or c
gcagcatccgtcagaccaagaagactcaggaaggtgggtactgcacaagccaggcaggagnatgtgagacaaagaatccagctgtgactttctgtgaagtaaggaggagcaattttttccc

SEQ ID NO: 32336 - DNA, 121 bp, Artificial Sequence
  Synthesized
  misc_feature (61): n=t or c
agaaatacgttctttcccctggacagttttgcagattattctgcagcacacaggcaatgtncagccagctgatctatgtacatcggaagtttgagggagggagaaaaggcagcactgtgct

SEQ ID NO: 32337 - DNA, 121 bp, Artificial Sequence
  Synthesized
  misc_feature (61): n=a or c
ttggtaataattctatgttgaactgatgcatattctccattttttctccccactaaatccncaggaacttcggttgtgccaaaccccagtactttggtctcaattgtccttttgatgttca

SEQ ID NO: 32338 - DNA, 121 bp, Artificial Sequence
  Synthesized
  misc_feature (61): n=a or g
caatagaagttacagtaaagcaactgcatttccagttaaaaccacgaaaactggaaagccnatctcggaaaagaaataatattcacagaaacatggaagtgctggggtgaaggacctcctt

SEQ ID NO: 32339 - DNA, 121 bp, Artificial Sequence
  Synthesized
  misc_feature (61): n=c or g
ctgttgatgcatgggcaatcaatagccaaaacctgctggcccattcagtatcggagctctntgctcaacaactcagatcatagaatggttggggttggaagagaccttaaagttcatccag

SEQ ID NO: 32340 - DNA, 121 bp, Artificial Sequence
  Synthesized
  misc_feature (61): n=a or g
gtgaaggtctggcaggagcagtgcacaaggatgtcaccacctgcatccactggtgtcacantagtgtttggagatgtggagagtggttttgggaagctcagctgggtttgtgcctgaaaac

SEQ ID NO: 32341 - DNA, 121 bp, Artificial Sequence
  Synthesized
  misc_feature (61): n=a or c
agaacctgtgctccagtcccctgaccagtctggcagcactccacaggacagactccaacanattagtgccctccttgcactggagagctcaaatctggacgcagcattccaaatgcagcct

SEQ ID NO: 32342 - DNA, 121 bp, Artificial Sequence
  Synthesized
  misc_feature (61): n=t or g
aatttagtcatgctgacagttttctggctcaaaattaagtcctcaaattgatttcacaganagagaaaaacaaagtacagattctagctgcttcatcacagcttcatactaacttctctgt

SEQ ID NO: 32343 - DNA, 121 bp, Artificial Sequence
  Synthesized
  misc_feature (61): n=a or g
aaaatttccatcacaactaacggcctccacagttgttcaatgaacttatcctcaaattacngggtaataaaaggataacaacccttgactgaataaaagaaggggtgggttctcggtaaaa

SEQ ID NO: 32344 - DNA, 121 bp, Artificial Sequence
  Synthesized
  misc_feature (61): n=a or g
aacgaacagtgggccatttcaacttcagcattttgtagtgcaattccagggagggggaggngggagaaagaagtctatcaaatactataaatgctcattctctgtgcattgtatgtggcct

SEQ ID NO: 32345 - DNA, 121 bp, Artificial Sequence
  Synthesized
  misc_feature (61): n=a or g
tcctaggaatctcaaagttgctttggtttgtcaggaaagcatttgtcatgttatgtgtgtnattgaatctgctagttcgtacaaataaaaaaaccacatgagagttgccactggaaaactc

SEQ ID NO: 32346 - DNA, 121 bp, Artificial Sequence
  Synthesized
  misc_feature (61): n=a or g
gactgatcatttgacctaatatgtgaatatgctattttactgttgtagtagtagtaatctnaaaaccattacctgagcacatacatgaaggattctggtattttgaaaatcatatctgcta

SEQ ID NO: 32347 - DNA, 121 bp, Artificial Sequence
  Synthesized
  misc_feature (61): n=a or c
aaataaataaatacataaataaaacaaaacgaaatgtattacatcgttgtgcaaacacctntttgaggttcaagacaaccactctcatttaagttattagtgaggtgctgctttattcttc

SEQ ID NO: 32348 - DNA, 121 bp, Artificial Sequence
  Synthesized
  misc_feature (61): n=c or g
actgtagcttttacctggaaaagtacactgaaagattgcagaatatgttctcaactaaggntgttttttgaggagcctcattctctgttcctacctcatccctgcagctggtttcagggaa

SEQ ID NO: 32349 - DNA, 121 bp, Artificial Sequence
  Synthesized
  misc_feature (61): n=a or g
cacagtatctcctgggatgttttgctttatttaacctagggcttgcatttgaggacgtgcngtagactttatgttaccagtatgaagttttgaaaagcattagcaatgtggcactgaaaga

SEQ ID NO: 32350 - DNA, 121 bp, Artificial Sequence
  Synthesized
  misc_feature (61): n=t or c
ccagcttcctgaaatagccttgatcctaatgaactgaaaaaacttataaatcgcagattcnctgtgtgtttgcctacactcccccacacacataacactagtcaagagcacagagttatgc

SEQ ID NO: 32351 - DNA, 121 bp, Artificial Sequence
  Synthesized
  misc_feature (61): n=t or c
aaaagaaaaaaaaaacaaaacaaagaacacaaggatttccaacatttctattcgttggacngtaaccagggatcacaaccacatgcaacaaggctagttttgcactgcagatgaagacaca

SEQ ID NO: 32352 - DNA, 121 bp, Artificial Sequence
  Synthesized
  misc_feature (61): n=a or g
ctgcagaatgaagatttatactatacttctgtacaatacaaatctgtatttagcattcttntgttccttcttatcctattcatgctttttatcatcttcctcctcttgagaatattctcaa

SEQ ID NO: 32353 - DNA, 121 bp, Artificial Sequence
  Synthesized
  misc_feature (61): n=a or g
atttcaaaccattctatgaatgcaaagggcggtttctctaactcaagctttctatctgatncacgtttgcatccacacaaactaaggctcattaagcattacttaggaaacatgacagaag

SEQ ID NO: 32354 - DNA, 121 bp, Artificial Sequence
  Synthesized
  misc_feature (61): n=a or c
tttccagcaggaacattatttttgctgataacctctcagctgggcagaacctcagcgtggntctccctgggctgatggatgacttcctgaggctggtgttgcaaggcaggctgctgagctc

SEQ ID NO: 32355 - DNA, 121 bp, Artificial Sequence
  Synthesized
  misc_feature (61): n=a or g
ggttcattgaatttttagcagacatgtttgttatagccattccattcttcaatatgtgcantcgtaagtctggtagacagcactattcaccagaagactgcaaaataattttcctccaggc

SEQ ID NO: 32356 - DNA, 121 bp, Artificial Sequence
  Synthesized
  misc_feature (61): n=c or g
aaaggctcttggttgaacgatggaaaggacgctgaaagggacaaaatcagatgatattagnagcttggtaatagcatagtgccttgccacaaactcagcatcaaactgagcagccacagaa

SEQ ID NO: 32357 - DNA, 121 bp, Artificial Sequence
  Synthesized
  misc_feature (61): n=t or g
gttacagtacccttagatggaatatttttggttcattacgcaggaaaattgatttcatagngcttctcaagatctacctccttttttttccccccctctatcttaacatccccagtactat

SEQ ID NO: 32358 - DNA, 121 bp, Artificial Sequence
  Synthesized
  misc_feature (61): n=a or g
accaactccagaaaagcatttgtgaagcctttgaagcagtagttttgtaatttactgctgnatccagcaggagtatgtgacaacctcaaaataacttttgcagtgctgagattggcttgct

SEQ ID NO: 32359 - DNA, 121 bp, Artificial Sequence
  Synthesized
  misc_feature (61): n=a or g
aattctaaagggagcagactatatttaagcaaagatgacctctgttttgtgttaaaatctngttaaattgccatcgttcaacttgattgtgtttaaaggtacttaaatgcagttgtaaagg

SEQ ID NO: 32360 - DNA, 121 bp, Artificial Sequence
  Synthesized
  misc_feature (61): n=t or c
catttctaactgcctcagcctttgaaatgaagcacctctgcagcacgcgctcctataacanatctctgcatagggcacttattcagatatatagcattatatgttgcattctggctgtgct

SEQ ID NO: 32361 - DNA, 121 bp, Artificial Sequence
  Synthesized
  misc_feature (61): n=a or g
aagtagctctactgtttaatttggtttaccttgagtttaattagctgtgtacaatgtaggnctgtgggatgtggagctactttgggtagtttcattactgcatctgtacctagtaaggtac

SEQ ID NO: 32362 - DNA, 121 bp, Artificial Sequence
  Synthesized
  misc_feature (61): n=t or g
aggttaccattaagggagaaggagatctcagctcataaggatggacaatctcaacatagcntttgcctcccatttaacacattcaacaacgtggtgtgaagaaaattctgcattaaataag

SEQ ID NO: 32363 - DNA, 121 bp, Artificial Sequence
  Synthesized
  misc_feature (61): n=t or c
cagccttaagtacacctgtatttgaggcagccatcaaagcttcctaccttacaggtagggntaaaatgatgggtgtgggtttatttcccagggtgggactgctggcattccccctgtgcat

SEQ ID NO: 32364 - DNA, 121 bp, Artificial Sequence
  Synthesized
  misc_feature (61): n=a or g
gtaaacattgtttataataggtttctgtggagtactacaacatattcatgcctcatacacnaatgctggcattttatgatggagtctgcaaaatgatttggtttcgtgtaacattttacaa

SEQ ID NO: 32365 - DNA, 121 bp, Artificial Sequence
  Synthesized
  misc_feature (61): n=a or g
gtcatgagatctttttgggcagtagcagaatgggacgaataatatctgtatgcttaatatnaaattattattctattcctctgcagggttaactctccacaaagcagtgtgtacaagagga

SEQ ID NO: 32366 - DNA, 121 bp, Artificial Sequence
  Synthesized
  misc_feature (61): n=a or g
ccgtgctgcattcccaacaggcagcctacacagcgcagatttagctgtgatgaggaaacanatctccaaccagtgtgcccatcctgtcctctgagcttacggtgaggaaggacgtggggaa

SEQ ID NO: 32367 - DNA, 121 bp, Artificial Sequence
  Synthesized
  misc_feature (61): n=a or g
agccttggcatcactggagcccagggagaagagcccccacaactgaacacctggcagcacnggcttaacactgctctttggtgacactgagaaggtacagactcaagcattagggtataaa

SEQ ID NO: 32368 - DNA, 121 bp, Artificial Sequence
  Synthesized
  misc_feature (61): n=t or c
ctctgagataatcaggtaaacggtgataacttgaccacctgtttgagccagaaggcgtctnagtatgtctccatagggatgaattttaagattatgaattgaattgagtctccctactgca

SEQ ID NO: 32369 - DNA, 121 bp, Artificial Sequence
  Synthesized
  misc_feature (61): n=t or g
tctcctgaggttggagctgtcggttccaatagatgtctctctcactatgctgtgttggctncgagccccgcctctgggccatctctgacatctgtgcagcacacggaggcctcaactgtac

SEQ ID NO: 32370 - DNA, 121 bp, Artificial Sequence
  Synthesized
  misc_feature (61): n=t or c
cagagagtattgcaccacctcatgtctgacattgccagcctttctaaaagcagaagggaanggtgagtgccttcttgccagcagtgcacctcttcacgtggaaacaccacggctcctctgt

SEQ ID NO: 32371 - DNA, 121 bp, Artificial Sequence
  Synthesized
  misc_feature (61): n=a or c
cctcccagtgctgtttcccaagatgtgctagtaatgaatgtatttacttcccatctttccncttcactttcattgcttcaggaattgattaagatgccacagactgctatttttttccaaa

SEQ ID NO: 32372 - DNA, 121 bp, Artificial Sequence
  Synthesized
  misc_feature (61): n=t or c
aaacaccatagcagtgatgccctttgtcacgtataaggatattcaaattacagggattccnccaggaacacataatttccccaggggtgcatataagtaagggtgaaatattctgtacctc

SEQ ID NO: 32373 - DNA, 121 bp, Artificial Sequence
  Synthesized
  misc_feature (61): n=a or g
taatactgtcttgttcaccatcttacaagatgcaaagtgaaattctgtctgtaatttgttncatgactttttcatcagcaattacgagttttttatcaggttagaaattttcatatgacat

SEQ ID NO: 32374 - DNA, 121 bp, Artificial Sequence
  Synthesized
  misc_feature (61): n=c or g
cttcatttatatgtgaatcatgtaagaaaaccctgcatacaagtgccatttccatggtatntggatccctgcatccctgagcagcatttgtgatggtcatgataagtttcatgtttttctg

SEQ ID NO: 32375 - DNA, 121 bp, Artificial Sequence
  Synthesized
  misc_feature (61): n=a or g
gtctttacgtgactaaagataatcatgaatcaaataccaagttcttgaggaaaatactgcnagtgatagaatgtcaaaataggtgttgacttagttgaatgcctcctgacagccatttgaa

SEQ ID NO: 32376 - DNA, 121 bp, Artificial Sequence
  Synthesized
  misc_feature (61): n=t or c
cagaccatggatgcactacatatgcagacttgttgagggctgctgttcagccagctgtagngttatgcatcacctggagttttctaggcctgtggacttcatgctcagatacaacataggg

SEQ ID NO: 32377 - DNA, 121 bp, Artificial Sequence
  Synthesized
  misc_feature (61): n=t or g
acttcagaaatagtcagctgttcagagcaattccttggatcacacttgagagagggttcantcttgtcccctggataagtgtaaatgtgaaggtggcagaaaagggttgaacaaagaaatg

SEQ ID NO: 32378 - DNA, 121 bp, Artificial Sequence
  Synthesized
  misc_feature (61): n=a or g
atataatctgcaataaatcaccctttagagggtaaaagggacaatggcatttagttccccngagcgctcaatcccctgatctagcctgtaccgtaaggctgcttgtttgcttcctggggaa

SEQ ID NO: 32379 - DNA, 121 bp, Artificial Sequence
  Synthesized
  misc_feature (61): n=t or g
gacagtcattcatttccagtctgtaaaagcagacctggtctggaaccatttggtgctcagnaagcacagtagagaatgaagataaaactacacagcagatctcagcaatctgggaaaaata

SEQ ID NO: 32380 - DNA, 121 bp, Artificial Sequence
  Synthesized
  misc_feature (61): n=t or c
ccaaacagctttatatacctgatttaggtagtatggactgaactctagaaatgtttttctnttcaatgtaaatgaagcctaataggcacaggctagacacctaatactgatgcagcttaaa

SEQ ID NO: 32381 - DNA, 121 bp, Artificial Sequence
  Synthesized
  misc_feature (61): n=a or g
cagtgtttccatataaaacccgcattttcctcggtgttcatttatggtggaagtctgcacntaagatcctgcccgaggatacctttttctttcctattaaaattttataaacccgtcactt

SEQ ID NO: 32382 - DNA, 121 bp, Artificial Sequence
  Synthesized
  misc_feature (61): n=a or g
gtcaacaactccttgaagtcttacgtacgtatgcaaaaccaattgagagctgtttgcactnagtctatcatgccttcacacattacggctcctaaaacctctcagatggagagtgtagatc

SEQ ID NO: 32383 - DNA, 121 bp, Artificial Sequence
  Synthesized
  misc_feature (61): n=t or c
aaccaggtcttaaaatcaacagaataaaaacccacattaatttgtcagtagcacagtgttntcttttttggttgatagaaaaaaacatgatgttatccttcttcacctcatgaattagctg

SEQ ID NO: 32384 - DNA, 121 bp, Artificial Sequence
  Synthesized
  misc_feature (61): n=t or c
tatggagtatgattgatatatgtatgggttcggggtgtatcttgtaaggaggctgaactgncagacttctactgcaaataagacaccttcctgtcctcaagagtcactggaagctctggca

SEQ ID NO: 32385 - DNA, 121 bp, Artificial Sequence
  Synthesized
  misc_feature (61): n=c or g
atgtgctctcaacactgagcactgctgctaaaaggatcactcccaaaatagggagaagagntcttacacttcatttaccaggtgattctaggcaaatctaatgagtcttgggaagttttca

SEQ ID NO: 32386 - DNA, 121 bp, Artificial Sequence
  Synthesized
  misc_feature (61): n=c or g
ggtcccctccagcctaaaccattctgtgatgagcagtggtgcactgctgtaaacatttcanatggatgagcccagatgatgcccaaggctaggaacagagcccagaggtggggattttgga

SEQ ID NO: 32387 - DNA, 121 bp, Artificial Sequence
  Synthesized
  misc_feature (61): n=a or g
gcctttccaaaacacctatgagtgggaatgacacaatgatctttgggtgaggtgccttcanggctactttgtatgacaaagaggaaggctcaacgtgtacataacgcccactaatagcaaa

SEQ ID NO: 32388 - DNA, 121 bp, Artificial Sequence
  Synthesized
  misc_feature (61): n=t or c
ccccccccccccccccggccctgcacacacacaatttcataatgctacataagtacagcangttctttctcacacagattgcattttttaaaaaggacaagggggcctgatgcatgtgatt

SEQ ID NO: 32389 - DNA, 121 bp, Artificial Sequence
  Synthesized
  misc_feature (61): n=a or g
cttagacttggatctgcagaactccacagtaatcatgagaggcagctgaaatcctaacacnagcagaaatgagactgcaaatcctttcagagatgatctgttgagtaagaaggtgccatct

SEQ ID NO: 32390 - DNA, 121 bp, Artificial Sequence
  Synthesized
  misc_feature (61): n=t or c
ccttagtgtaagcaaagttacttggagccacaaaacaaccagcaaaacccagcgcctgttncctcttagagaactgagctttcacccaccctgagtacaaaaatggagcgagtgcctcgtt

SEQ ID NO: 32391 - DNA, 121 bp, Artificial Sequence
  Synthesized
  misc_feature (61): n=a or c
ccagtttgggcagctgaaagacaaacccagattaaccgcagtttaaaaagttaaatcttantgtacctggtctggcacaatgactcaattttctcacagctctacataattgcaatactcc

SEQ ID NO: 32392 - DNA, 121 bp, Artificial Sequence
  Synthesized
  misc_feature (61): n=a or g
agtgcatggctgtttcaggcggtagggaaggaagagcaatactttggctcacccaggactncctgccaacctgctggcaccaaaaagcagttgttcaggcacccgccaccaatctcacacc

SEQ ID NO: 32393 - DNA, 121 bp, Artificial Sequence
  Synthesized
  misc_feature (61): n=c or g
ggctttgaggtcccttccaacccaatccattgtgtcattctatatatcttctcagagttantactcactagtgttattggaagtaaactgatggcaggagaaaaaaagtgctttttaccat

SEQ ID NO: 32394 - DNA, 121 bp, Artificial Sequence
  Synthesized
  misc_feature (61): n=a or g
ataataatgcactcatacatcaaactgcaatgtatgtgtgagaaaaactctatctcaaatngccacatttgtgagtatgtacaaatatgcaagacagttatgaatacatcgcaaaggctta

SEQ ID NO: 32395 - DNA, 121 bp, Artificial Sequence
  Synthesized
  misc_feature (61): n=a or g
ttaaacctattactagccacagataatcaataaaggcagtaacacaggtcagaaggctggnaagccctttgcaggtcatcagatcgagttgcctgctagcatagtcaatcatatcatgtag

SEQ ID NO: 32396 - DNA, 121 bp, Artificial Sequence
  Synthesized
  misc_feature (61): n=a or g
ctagcaatgcaaaggcacaggtttcattaataatgcaacaggtcccttaacactgcttatntatccctgcaaggactgacaccaggagtggaaacaactcaatccaaaagaaataacacat

SEQ ID NO: 32397 - DNA, 121 bp, Artificial Sequence
  Synthesized
  misc_feature (61): n=t or c
agtgcagaagtaatgggttagactggggaaggaaatagcactttaagcactctcagtgtcnttagctggtgttaaaagcttttgccttttccctccaaacttaatgaaacttcttacacct

SEQ ID NO: 32398 - DNA, 121 bp, Artificial Sequence
  Synthesized
  misc_feature (61): n=a or g
tggtcctccaaagagtggtagggaggaatatctcctcccattctgtagattctaaatatanaggattgttttggtcttgctttgtcttcagaattactgacaggagtctgcgggagcagcc

SEQ ID NO: 32399 - DNA, 121 bp, Artificial Sequence
  Synthesized
  misc_feature (61): n=a or g
caaaaagataggtaagaaaaagaaagttcttcaacagttcaactattcaagagagcgctcntcagtcaatcttttaagccaacttgctctgactaatccatcccagcacaccaacatacag

SEQ ID NO: 32400 - DNA, 121 bp, Artificial Sequence
  Synthesized
  misc_feature (61): n=t or g
attgcagtattcaaagagaaaggccatattgctgctgccctggttttcttgcttacagcanactccaaatgctggaaagctacaaagaaataatttttactgaaatcctatttaaagcacc

SEQ ID NO: 32401 - DNA, 121 bp, Artificial Sequence
  Synthesized
  misc_feature (61): n=a or g
atatgttgaccgaggtttaaatatgctttgcgttcatatgtttggccacaaagcagttacntgtgatagccctgacagatcttactgacagatcttagaaggcaaagagtatttttgagtg

SEQ ID NO: 32402 - DNA, 121 bp, Artificial Sequence
  Synthesized
  misc_feature (61): n=a or g
agacttagatcagcagacatgcatttgcttaatgaacagcagcacacttcaacttcctatncactcctgaagtacatcagcagatttaggaaattccacataaaagaatcaactgattttc

SEQ ID NO: 32403 - DNA, 121 bp, Artificial Sequence
  Synthesized
  misc_feature (61): n=a or g
ctgaatatggtgtgaaccactcttatacaatgaaacacaagcacagctgaggactcagaancacagcacctgaaatagccatacatcacttggtaaaaggtttatcctgaaaaattaacac

SEQ ID NO: 32404 - DNA, 121 bp, Artificial Sequence
  Synthesized
  misc_feature (61): n=a or g
tgtacatactttacccctaatctttttccattgtgttgctgataacctcacccaaatatangatgtacctttccttatgaaaggcagtgtttcattaactctgctcgggtttttatattca

SEQ ID NO: 32405 - DNA, 121 bp, Artificial Sequence
  Synthesized
  misc_feature (61): n=t or c
cttatctttgtctctttggtgtccatactttttgtttccgaggttgaatgacagcagccantacaactaaaggcaacacggggattaatcctgagttatttcgtatctgggacaaggcagt

SEQ ID NO: 32406 - DNA, 121 bp, Artificial Sequence
  Synthesized
  misc_feature (61): n=t or c
ccttgatgaaaccatactggttgcctcatatcattgccctctcttttgcatgccttaacanagaaggatctacttcatgatcttccccagtacacagatgaggctgataggtcagtagttt

SEQ ID NO: 32407 - DNA, 121 bp, Artificial Sequence
  Synthesized
  misc_feature (61): n=a or g
gggctagttagaaacttccacaataagttttgtttttcctttcctggatttaatcccaacnaatactgtttttcaggaaaagacaatttcttggaactgcccagttcaaccttctctaagt

SEQ ID NO: 32408 - DNA, 121 bp, Artificial Sequence
  Synthesized
  misc_feature (61): n=t or g
tattaccgtgtcgcaagaatgagagaggcagcagcaagctcttggctccgtgccatcactntattacttattacttatttttatatagcctttggcatggcaagaagtccttctttaatta

SEQ ID NO: 32409 - DNA, 121 bp, Artificial Sequence
  Synthesized
  misc_feature (61): n=t or c
ctctttcagggtgttagacagggagcttttcattgcagctaggacatagtgcaacttccangacatttctctccagagttcccctctgctattagcaatgtgaatggtaaactggagaatt

SEQ ID NO: 32410 - DNA, 121 bp, Artificial Sequence
  Synthesized
  misc_feature (61): n=a or g
gctccttccccatatggagaggggatcccactctgcacagagcccatgtgctgcattaccnttggccctcagctccaaggtgagagccagcactgaaaggcggagagaggaagagaaagca

SEQ ID NO: 32411 - DNA, 121 bp, Artificial Sequence
  Synthesized
  misc_feature (61): n=t or c
cagtagcacccactgtcaaatctactccccgatcccaagcccctctacagattgcatctcntccttgatgacctgcagcatcatcggcccacgtgagccaattccatcctaaagccctcat

SEQ ID NO: 32412 - DNA, 121 bp, Artificial Sequence
  Synthesized
  misc_feature (61): n=c or g
atgccccattaacatcgcatggtttctgttctcagtttgagttatatgtacctctgtgctncttgatgtgaaggtgcaggaatggcagtgctcgcccggtgctgtgctgctcccctttcct

SEQ ID NO: 32413 - DNA, 121 bp, Artificial Sequence
  Synthesized
  misc_feature (61): n=t or c
agctttctttcatttggtagggaagtgcaactaaccaacttgttagtaattgagaacagancaaatcttccagaagccaaatacatggagggcctagaaacactttgaaaagtaagaaaaa

SEQ ID NO: 32414 - DNA, 121 bp, Artificial Sequence
  Synthesized
  misc_feature (61): n=t or c
caagcagacacttccagggagtaaagctaaaacaatatgaaggacctgaagtaaataaaanctttacaatagacttggaaaaaatgtgcagcagcatctgtcaaagtggagagctgctgct

SEQ ID NO: 32415 - DNA, 121 bp, Artificial Sequence
  Synthesized
  misc_feature (61): n=t or c
aaatgtgctttagtgcccacatgtgcagtatcttccagtctaagaacaggataggatctcnccacttggttatctcaaatctggggtgtcatcactctcacatgccccgcaatcctgaagg

SEQ ID NO: 32416 - DNA, 121 bp, Artificial Sequence
  Synthesized
  misc_feature (61): n=a or g
aacgtgtgcttttgttttgaaggatgtgaatgtaaattttttttggatgtacattatgggntgttggtttacgtggctgttgcgtatttccatttggcccgcaaatgtgtgttaaaagggc

SEQ ID NO: 32417 - DNA, 121 bp, Artificial Sequence
  Synthesized
  misc_feature (61): n=a or g
catcccagctgccggtacccgggcctcgactgtatttcagagatcctgaagaaaagagcangcatcagaaattgggtcagtacgctgcaagccaagaactggtttggtttctggattaata

SEQ ID NO: 32418 - DNA, 121 bp, Artificial Sequence
  Synthesized
  misc_feature (61): n=t or c
aaaagtgaagaaatacgacagtttaacactcctcccttgtttttgaacatgcagtgcatcngtctgagattttacctttgaaattctgaagaaggggatcacatcttatgaaatgttttct

SEQ ID NO: 32419 - DNA, 121 bp, Artificial Sequence
  Synthesized
  misc_feature (61): n=a or g
gtaatgatataccattttccaaatattttcatcacgtctaaataacactcactgtataacnttacacagttgctgctctgctatggttttacttggatctcctgaacagtcatgtaaaggg

SEQ ID NO: 32420 - DNA, 121 bp, Artificial Sequence
  Synthesized
  misc_feature (61): n=t or c
aactattattattatccaataataatgaccatatgaaacaagggaatgtatcatttcctanctcaggaacagtaaagtctcccctccttcactgaatgacatacagttccacaatgaatca

SEQ ID NO: 32421 - DNA, 121 bp, Artificial Sequence
  Synthesized
  misc_feature (61): n=a or g
aaactggtgctgtaatgtcatgatcagcgtgaacttacctgcctctctccctccaccaaangagacatgattcaatccatgtgttgctgttcatttctgcccctttgctaattccttcttc

SEQ ID NO: 32422 - DNA, 121 bp, Artificial Sequence
  Synthesized
  misc_feature (61): n=t or c
ttgaactcctgaagttcaaatgaagcaaaatctaaggtcgaccatacagaaactagaatangaatctaactccctagcctttagtacatatttactgaaagctggggaaagcaattcattt

SEQ ID NO: 32423 - DNA, 121 bp, Artificial Sequence
  Synthesized
  misc_feature (61): n=a or t
acaattctctgctgcactgagtaacaaagaacagaaatgaactatgcaaatgaactggaanggtttgcttgtgttaagtaggtttttttttaaatcatagaatcacaaggttggaaaggac

SEQ ID NO: 32424 - DNA, 121 bp, Artificial Sequence
  Synthesized
  misc_feature (61): n=a or g
ttcaagccttaatgattctatgattctgttctatttctgctcttggagaaatcagacctcntcaaaccaggagtcatcttcattgctgctgggcagggatcagagaggcatgggacacact

SEQ ID NO: 32425 - DNA, 121 bp, Artificial Sequence
  Synthesized
  misc_feature (61): n=t or c
tccgcttgtgagccgctcctgacagagccatgttgggttacaggcaaggtctgagcccacngttccttaccaccagcaccagtaacggtgctatgccccaagcacactggtcaggacacag

SEQ ID NO: 32426 - DNA, 121 bp, Artificial Sequence
  Synthesized
  misc_feature (61): n=a or t
ccacagagtatcactgctaacagggaaaagggccccattcatattgaacagatcaataaanggagggaccaggaacacgtatgtggtacagagatgaatggccacttaagagtaagatgtt

SEQ ID NO: 32427 - DNA, 121 bp, Artificial Sequence
  Synthesized
  misc_feature (61): n=a or c
ttttcccctacactgtaaacatgatcaagtttctgcattccaaagtgcaaaactcacgacntgaagactaggaaggattaaaatatttaaaggtgggcagtctcacttgaatgaaagttct

SEQ ID NO: 32428 - DNA, 121 bp, Artificial Sequence
  Synthesized
  misc_feature (61): n=t or c
gctgtttggtttgcttaagcaaatcatagcttgctttggttgggttttacaagctggcttnagcatgtgcaaatgcatccatgccagtggagccttgccattgacttcccaaatgaacgtt

SEQ ID NO: 32429 - DNA, 121 bp, Artificial Sequence
  Synthesized
  misc_feature (61): n=a or g
aacggtcgaaggatcccccaccactcatggccaaaaatccccatcacaacacaccagactntcaatatgctgatgcagatggggtcccaaggaccccagagtctctatccaaaccattgcg

SEQ ID NO: 32430 - DNA, 121 bp, Artificial Sequence
  Synthesized
  misc_feature (61): n=a or c
taacagtattaatattgctctttattttttcttacctcaactgtatctctgtctgtcattnttaaaccattaattccctgcctttcttctcttcaaggctagctttccaaagatctagcaa

SEQ ID NO: 32431 - DNA, 121 bp, Artificial Sequence
  Synthesized
  misc_feature (61): n=a or c
aagagccattatttcggtaatgtaaaaactatcatttactttcagcaaatagatcaaaagnagctcttttgtaaacaaaattctcatcccacagacacaatggtatgcacaaaaacatcac

SEQ ID NO: 32432 - DNA, 121 bp, Artificial Sequence
  Synthesized
  misc_feature (61): n=a or g
tgccgataaagaggctgctcctccccctgaagaatgccttcagcttcttagcagagccacncaagtgtttagagaggaatacatactgaaacaggatctggcaaaagaggaaattcagcaa

SEQ ID NO: 32433 - DNA, 121 bp, Artificial Sequence
  Synthesized
  misc_feature (61): n=c or g
aagacacgtaatttacacagcataaaaattgaaaagagaaacaggagatggaagatagaangaaacagtccaaaacataaacataataaacattgatttcccctatgatcccttttgatct

SEQ ID NO: 32434 - DNA, 121 bp, Artificial Sequence
  Synthesized
  misc_feature (61): n=c or g
tccctcccttacactaacctagcgttttgcttggttgcaaaaggatattcaggctgacacngtgctagggagtgtggcagcatgcagttatacaaagaagctggcaaacagacgtgtccca

SEQ ID NO: 32435 - DNA, 121 bp, Artificial Sequence
  Synthesized
  misc_feature (61): n=c or g
gcattgtcagtaacaattgtatatatttaatgggttcttttacacaaaatgctttgaagancctgtggaacttgtgttaagatctgatgtgagggcactcattagtaagattgcttcagta

SEQ ID NO: 32436 - DNA, 121 bp, Artificial Sequence
  Synthesized
  misc_feature (61): n=t or c
aagtcctcttagttgcataggtaatatcagtttttttaagagagcaaatgatcttctggangttttgatctgtttcctaaagataaagtttccacagttgcactgaaattgatagaaatag

SEQ ID NO: 32437 - DNA, 121 bp, Artificial Sequence
  Synthesized
  misc_feature (61): n=t or c
tggtcatcaaatgacctagattgggattacatgctgaggcatcagtctaatatgaaattantccgtgtttttattgtaatgaccaattaagaatcagcacctcagaaacctcaggtagcag

SEQ ID NO: 32438 - DNA, 121 bp, Artificial Sequence
  Synthesized
  misc_feature (61): n=a or g
cctgcttcccttcctgggtgtgttccaagtccttcccacacctacctactcctgttccacntgtcccatcaccatgggagtctgtggcacaaagtgttgcaccacactcagtgggcaggca

SEQ ID NO: 32439 - DNA, 121 bp, Artificial Sequence
  Synthesized
  misc_feature (61): n=t or c
ttatgagtctatgatttaagactatcatggtacaggtcccaacaaagacaccgtatggaanttcactattgattttcctgtgtaaaaaaatgaatgtgcacttaaatccagtggtggtcta

SEQ ID NO: 32440 - DNA, 121 bp, Artificial Sequence
  Synthesized
  misc_feature (61): n=a or t
ccatggcatgtgatgcacatcccagctgacaagtaccagcactatccaccttcacgattantctcatacagacaagccaagtttcaatgctctgactgtgtaatccttccattggccaagc

SEQ ID NO: 32441 - DNA, 121 bp, Artificial Sequence
  Synthesized
  misc_feature (61): n=t or c
agctgaaggctaacaatgaaggcattcggttagttcataacacattttctagatcacgaantgttgtcttcagagtcctctggaagtaaagtactcaacccctcagagaccctgcacctga

SEQ ID NO: 32442 - DNA, 121 bp, Artificial Sequence
  Synthesized
  misc_feature (61): n=a or g
gactgcctttctgtacatacatcttgcatgcattttaggcatctcttgtccagtgctgctncatcccctgacctgatcatgcttcagaaatgctaccacttaaccttccgtcaacttgtct

SEQ ID NO: 32443 - DNA, 121 bp, Artificial Sequence
  Synthesized
  misc_feature (61): n=t or c
tcataccatcaagtggtctcttggactgatgttcattaaaactgtattaaaactgaagaantggcttggaagtttgaaccttagtcttcctaccactagtgttgtgtcatcttttagcact

SEQ ID NO: 32444 - DNA, 121 bp, Artificial Sequence
  Synthesized
  misc_feature (61): n=a or c
attagcaccctagatatctgatgtataggtcagcccaagccacctcttcacttaatgagcnctcccctcgctatggggtacctggaacaaggcactcctgcacttcattagccttaaccga

SEQ ID NO: 32445 - DNA, 121 bp, Artificial Sequence
  Synthesized
  misc_feature (61): n=t or c
agtctatatctcattgccagatgtacaggcttaagctatcactctttcagggttagcagtncttactctgatctctggcaagtataattagcagcagcttcactgaagcccacagaacatt

SEQ ID NO: 32446 - DNA, 121 bp, Artificial Sequence
  Synthesized
  misc_feature (61): n=t or c
tgccttggaaatttacctgcacctaggagccagagagcagctttaagtcacacttttgctncttctaggtgcaaaaggaaggactacactgaaacactccaaaccctgcctgttccacaca

SEQ ID NO: 32447 - DNA, 121 bp, Artificial Sequence
  Synthesized
  misc_feature (61): n=t or c
ttccttcaaaaaatgtgcatattgaataatcatgagtataatttggcaagcaatttatttngttatagctgaccatgaaaggcaagaatatttgaagactaaacacaaaatatatttagag

SEQ ID NO: 32448 - DNA, 121 bp, Artificial Sequence
  Synthesized
  misc_feature (61): n=t or c
gattgttttccactcttcctcagcgctagctccagttttactatttagttacccttttttncctcacatttcctctcaatcctctttttttccttctccttggacatgtggtccaaataat

SEQ ID NO: 32449 - DNA, 121 bp, Artificial Sequence
  Synthesized
  misc_feature (61): n=t or c
gcataatcatgggtgtcaggaatttgaagggatatgtaattttagtattagtgacacttcncagttgctagaatgaaagactgaagatttaaaacatttaatggaaggtcttaaacaagat

SEQ ID NO: 32450 - DNA, 121 bp, Artificial Sequence
  Synthesized
  misc_feature (61): n=a or g
actttctcacgggctggcccagtgactgcttggggggagagccttgcagctctctgcaacntggctttggggactttggtattgtggcttccctgtgcacagcaattactgtccattttgc

SEQ ID NO: 32451 - DNA, 121 bp, Artificial Sequence
  Synthesized
  misc_feature (61): n=a or g
tcttgctctgcatctgctcctgggcactgctgaggaggtctggcttttgaacaatgcagangtatatctataacctgtggggcctcccctttactgagattctgaactatcaaattcctct

SEQ ID NO: 32452 - DNA, 121 bp, Artificial Sequence
  Synthesized
  misc_feature (61): n=a or g
tcatccctgccagacttgggcagtgaagggatttctcatgttccccccttctgtgctgaanagaatatcagacatcagaaagatacagccttgtcccttgatttggcaaaaaaaaagtctt

SEQ ID NO: 32453 - DNA, 121 bp, Artificial Sequence
  Synthesized
  misc_feature (61): n=a or t
ggcacctcatatgccactcttccgctctctgttcttttgaagtgataaagggagcctgttngttctttgtaggtcttgtaaatttaatgcaaaaaatgagcgtggttatcatcattgctgt

SEQ ID NO: 32454 - DNA, 121 bp, Artificial Sequence
  Synthesized
  misc_feature (61): n=t or c
aatggttatttttcagcaattgttactcattgttttgtggatgaactaagctgtcagaaangtggagatttttgatgtaaaaccacagccctttccgtaccaataatctttacactgatat

SEQ ID NO: 32455 - DNA, 121 bp, Artificial Sequence
  Synthesized
  misc_feature (61): n=a or g
gagagaaatgccatctcctgcccaaatagggactgatgttgaaggcagcccctgcgtgctntacagccaaggctgtacattcccctcccgggtggtggctgcagttcagcagcacagagca

SEQ ID NO: 32456 - DNA, 121 bp, Artificial Sequence
  Synthesized
  misc_feature (61): n=t or c
agcctggtctgtcccttcccgtttatctggaaaagtcttttttaaaccttctttttagccncttgctctgtgtgggaaggagctctgttgtgggtctggaggctgggtggggtcactgcat

SEQ ID NO: 32457 - DNA, 121 bp, Artificial Sequence
  Synthesized
  misc_feature (61): n=t or c
ctgttttctctctcctctttaaattcctggcagtgccacatctagtccagacagtgcagcnctcttcaggagaagaatcatagaagggcttggagtggaagggacctcaaagcccatggag

SEQ ID NO: 32458 - DNA, 121 bp, Artificial Sequence
  Synthesized
  misc_feature (61): n=t or c
cagtaccaatcatagcaggctgaaagaggaaacatgttcgggtttatcaagggatcgcaanagttactgtacctaaaaaaaatcagaccataaacgctgtgagcaaggtgggtgaagcagg

SEQ ID NO: 32459 - DNA, 121 bp, Artificial Sequence
  Synthesized
  misc_feature (61): n=a or g
tatcccatttccctttattccaagcacgttggacaatgttggcacattgctgctaacaaancattttgtgagaagtcatcacccagcagctaaaattcacccttacccttacatgtgctct

SEQ ID NO: 32460 - DNA, 121 bp, Artificial Sequence
  Synthesized
  misc_feature (61): n=a or g
ttcacatcctatttaattcaagtctgtagagctgaaattgctgtttgatcattgtcataanagaggaaggaaagagcaaactgtatccatataattagtacactgcagagcagaaatatca

SEQ ID NO: 32461 - DNA, 121 bp, Artificial Sequence
  Synthesized
  misc_feature (61): n=t or c
tccaggccaaagcaagactgatcccaactgtacattttcatgtgctctggccaagctaatnatgcatctgaagaagcaattctaccatctcccagtttgcagcctaatgcagttcagtatc

SEQ ID NO: 32462 - DNA, 121 bp, Artificial Sequence
  Synthesized
  misc_feature (61): n=t or c
tgaaggtgactttcaggacaatctcttgttaatagcttcaacaagtacaacattttcagtnagtgcaagttttatagcaagttcacaatggccagttctgttaaatcagctcaagattgaa

SEQ ID NO: 32463 - DNA, 121 bp, Artificial Sequence
  Synthesized
  misc_feature (61): n=t or c
aaaccaaagttgtttattcttgaattgagtatcttgctattaaaattaaactttgtaatgngaaaagaaagtcctgcagttaatcacttgtgttttgagctttacagaattgcttggtgtt

SEQ ID NO: 32464 - DNA, 121 bp, Artificial Sequence
  Synthesized
  misc_feature (61): n=t or c
catctggtgtgcacagggcacttgtgtgctgctgtaaattgataattacaaaatgccatancatatccacatttagcttaggaaaaagaaaggcagaagaggttcagaaagtgaagaaaac

SEQ ID NO: 32465 - DNA, 121 bp, Artificial Sequence
  Synthesized
  misc_feature (61): n=a or g
ctaagagaaaacagtgggttagctgtggcttttaaatatcaaataaatgaaatagtcctcntagtgctgttagtgaaatagagaatggcaattttatcatttgtactgcaatgctagttag

SEQ ID NO: 32466 - DNA, 121 bp, Artificial Sequence
  Synthesized
  misc_feature (61): n=c or g
cctgaggccattaacaatgccaagaggtgcagccagcccaaggtctgtgctcaggttacantaagtactgcatgatgctagccaaaaaaagcaagtcgttctggggcaagacacgcgggta

SEQ ID NO: 32467 - DNA, 121 bp, Artificial Sequence
  Synthesized
  misc_feature (61): n=t or c
agtttcaacatcttgcttagcagaaagaaaagggcccatgttttcccaaagaaaggaattnatcataagagagcaactgttccttagtaagaagctttttatcatagagatatgcatctgc

SEQ ID NO: 32468 - DNA, 121 bp, Artificial Sequence
  Synthesized
  misc_feature (61): n=t or c
ttgataattaactataatgctgttccccctaagtgtgtggtgtgcttgtccttctctttgncaagtataagtttcccatgctggtgacttgcccccaaccttgaggctagtagatcaactt

SEQ ID NO: 32469 - DNA, 121 bp, Artificial Sequence
  Synthesized
  misc_feature (61): n=a or g
gggaatttgggctataaactgtttggaaggaggttagcgtgatgatcatagagtgcaaacngccactttaaactctacctgcagttgtttgtttctcagtgaaagtggaacgccatggaag

SEQ ID NO: 32470 - DNA, 121 bp, Artificial Sequence
  Synthesized
  misc_feature (61): n=a or g
cgtctctcagatttttctagatcaatatcttgttcatagaataagcactggcgtttatctnttcaaagttttcatacattttagccaccctaacattgttcctccatactttgttatgtag

SEQ ID NO: 32471 - DNA, 121 bp, Artificial Sequence
  Synthesized
  misc_feature (61): n=t or c
gttccaccccttgctgtgcttcctatgtacagaataagtctggctttccagcacatattcnggaggtcttgcaggctcctgacagtgagagctccttctccccaccactggaaccccacag

SEQ ID NO: 32472 - DNA, 121 bp, Artificial Sequence
  Synthesized
  misc_feature (61): n=t or g
tataacaatatagtcgagttgtattttactaatgctctctaggtatgagggatttttcctngttaatgtgggtgtcaaatgattttgctgggtagatttgctctgcaagtagttagctctc

SEQ ID NO: 32473 - DNA, 121 bp, Artificial Sequence
  Synthesized
  misc_feature (61): n=a or g
cagtcttttctctctttttgcctactacaaaatattagtattttgtgtgtcaaggaatgcngaaacctttctccctttggcatgaaaacttttgcataaccaatgtgatctgtgccattac

SEQ ID NO: 32474 - DNA, 121 bp, Artificial Sequence
  Synthesized
  misc_feature (61): n=a or t
cttatctctcaaattgttactcagtaattgtctatacggatgcagacatggacaaaatacnctgaaattaaatgggaacaaaaatgaaaatagaaatatattcacaaagcttttttaaaca

SEQ ID NO: 32475 - DNA, 121 bp, Artificial Sequence
  Synthesized
  misc_feature (61): n=a or g
gcatagcttagagaagaaacataaatcccagctacctacagcccagatgaaaaataaaacnaatacctgtctatgaggaataaataatttcattattttctctgtgagctattctggttaa

SEQ ID NO: 32476 - DNA, 121 bp, Artificial Sequence
  Synthesized
  misc_feature (61): n=a or g
tgaaaatgattgaaaaaataatattggaaagcatgcaattaatgaagaagtcaggaatatncgaaagctgctctatcatcaatgtaaaacacgggagcccaggagtgcaatgtgcaaatgc

SEQ ID NO: 32477 - DNA, 121 bp, Artificial Sequence
  Synthesized
  misc_feature (61): n=t or c
cagtttttgggatggccccttgctggactgctttgtactgctttgggggtttgctgctttntggggtgtagctttgccgtgcttgcaggacgagctgctccatgcatggtaccggtgcgtg

SEQ ID NO: 32478 - DNA, 121 bp, Artificial Sequence
  Synthesized
  misc_feature (61): n=a or c
tgtcttatgcattttgttctcaatagcaaaacaggatgaagaggtccataagatccctgtnatgctctgagaccctggctcctcctcatcctccaggcacgggcaggcttctgcttacccc

SEQ ID NO: 32479 - DNA, 121 bp, Artificial Sequence
  Synthesized
  misc_feature (61): n=t or c
aacaacagaaactccaggggaaagggaagactgcaccagtagaaacatttgtgcagccccngtgtcagggtgctctgcaaagagctctctcaatgaactacgctgcctgctaagagaccta

SEQ ID NO: 32480 - DNA, 121 bp, Artificial Sequence
  Synthesized
  misc_feature (61): n=a or g
gctgaagaatatatgctatactgcttttaaatttgtgttatttgctagggaatctattgcncagatacttttccaggcttgtttgcaattgccaagaacaatttcttgaggaaagaaaaca

SEQ ID NO: 32481 - DNA, 121 bp, Artificial Sequence
  Synthesized
  misc_feature (61): n=a or g
ctcgggctgtatgggttgcttctgctggggagcagcgtggtgctctgctgtagtgcttttngaacccagcgccgttcctatgggccttcggtgtgtctttcagagcaggttttggagctgt

SEQ ID NO: 32482 - DNA, 121 bp, Artificial Sequence
  Synthesized
  misc_feature (61): n=c or g
ccaggagctggcgggggttcttcttgctcctctgaactggaatcagggtggccacttcatntaggttaacttgcactgatacgctgacagcaggcttctgaggcattgtctgcaccttagc

SEQ ID NO: 32483 - DNA, 121 bp, Artificial Sequence
  Synthesized
  misc_feature (61): n=t or c
ttcttgcagctcaggccttttgcagtgatgtgcatcagacagataaatgaagccagccatnttgctcttctctcatattggtttagctccaccattaggcattgattacaagcctgttctc

SEQ ID NO: 32484 - DNA, 121 bp, Artificial Sequence
  Synthesized
  misc_feature (61): n=a or c
agaatatgtttctgggtatttctgaacagaagttactgaatatttaccttgtttgttccanattcagcaaaacactattcagaatatgaaaaattagcctaactttgctccccctctttcc

SEQ ID NO: 32485 - DNA, 121 bp, Artificial Sequence
  Synthesized
  misc_feature (61): n=t or c
ctctctagttgttacatatttgaatcccctgacagttccaggggtgatcacaaacatcagnctggacacagctctttgatagtgatcagtactaatctgctgggggaggtctgtgtgcgga

SEQ ID NO: 32486 - DNA, 121 bp, Artificial Sequence
  Synthesized
  misc_feature (61): n=a or g
tgaaaattacgatgctggtcttagtgcaggaggaatggaagggtgtgaatgccgagactcnggtgaagtttgttaccaggaaagcactgtatgtggtgctgcagggtgtagcaaaaatgtg

SEQ ID NO: 32487 - DNA, 121 bp, Artificial Sequence
  Synthesized
  misc_feature (61): n=t or c
cccatcagcacagctcagatggcacaaggacagattttctgtgttcctgtacctctggagnattattgattgaactgttgcccaaataccagtggcagggctaaataacccccttagaaac

SEQ ID NO: 32488 - DNA, 121 bp, Artificial Sequence
  Synthesized
  misc_feature (61): n=t or g
gtcgtaactgcaatggttggatagcacaatatttttcagctttttaacactttgcagaacnttttttcagaacgtgttgctcaagagctcacattctcaatattaaatagcaaactaaagt

SEQ ID NO: 32489 - DNA, 121 bp, Artificial Sequence
  Synthesized
  misc_feature (61): n=c or g
agctatctatcacaactgctgtatggcaaggcagcaattttgggtgcacacacaaatgcanactccttcttgatggtgcagttgttctgctgactccaccaatatccgcagctctatacca

SEQ ID NO: 32490 - DNA, 121 bp, Artificial Sequence
  Synthesized
  misc_feature (61): n=c or g
agctggagtttgacgactttgccgttgaacttagcgcaggctgcatttacagttcagttgntgtttacactgatgaagaagatgaaaatcagctgggtgagtattaatactttcaaaaggg

SEQ ID NO: 32491 - DNA, 121 bp, Artificial Sequence
  Synthesized
  misc_feature (61): n=a or g
cactgctccaggcaaacccatttctgcctacagggcactcacaggaaaaagataaagccantctttaagaaccaaagctttaagcataaaggaagggtgggaggaggaactagaaggaggg

SEQ ID NO: 32492 - DNA, 121 bp, Artificial Sequence
  Synthesized
  misc_feature (61): n=t or c
gatacttgaactatacaatttcctggaaacagaaccactgtaaaatcacacaaatgctttngtgaaagacttacaaaaccttcaacactgtaacattttaccctcctctcctgaaatattt

SEQ ID NO: 32493 - DNA, 121 bp, Artificial Sequence
  Synthesized
  misc_feature (61): n=t or c
caatctgtttcagagggaaagacagttgtaggataaagctcctctgaataaactttcctcntgtcacacaagatttatagcctcacttaagtctggattcttgacagctccttcccaaacc

SEQ ID NO: 32494 - DNA, 121 bp, Artificial Sequence
  Synthesized
  misc_feature (61): n=a or c
cggaggtagccatgcgacagcacaaaaacatcaaatgtcttgagtacaagtaaagcagttnatgtagtaaaagcacaacaactgttttaatgaaaacaagcaaaaaaaaatctgtgtccct

SEQ ID NO: 32495 - DNA, 121 bp, Artificial Sequence
  Synthesized
  misc_feature (61): n=t or c
gatcataacccacagatgtttcagaggggaacaatagttaagatttatgtaaatatcattncaattttatggtacttatcttactgctgtaggggtgattagtcaagaagaccccaataca

SEQ ID NO: 32496 - DNA, 121 bp, Artificial Sequence
  Synthesized
  misc_feature (61): n=t or c
taacgcagggacgtgccggattctggctcccaaagaactcaggaccactcagcctcacctnggtaagaggtagagccttctttagagccatccagccactttaaaacagcgagatgttgag

SEQ ID NO: 32497 - DNA, 121 bp, Artificial Sequence
  Synthesized
  misc_feature (61): n=a or g
gcaaattctaggatgcatctatcccttatatttcctgctacctaagtcttaggaatctggnttttgctgattgagcacaccagttcttccatttttaagtgtctcttctctgcacatgctg

SEQ ID NO: 32498 - DNA, 121 bp, Artificial Sequence
  Synthesized
  misc_feature (61): n=a or c
aaacatgaagaactaaactggataatctcactatcctgccttctattcctctacttgaaantagcatcatgctgttttattttctcaactatccgttgcaggcagcaaatctctatagcac

SEQ ID NO: 32499 - DNA, 121 bp, Artificial Sequence
  Synthesized
  misc_feature (61): n=c or g
atttggtgaagaaggcttgttgtgtggaaaccttaggaaatggagaacaagggggaactgnctagctagagctctcaggtccagttctagaaggaagttatggaaagcagaccctgcccag

SEQ ID NO: 32500 - DNA, 121 bp, Artificial Sequence
  Synthesized
  misc_feature (61): n=a or g
ctaatatcttatggtacgtatcttcatattgacaaccacgtgctagtagaacagacttctncaacagctgttgtgcatattcatatcagtggtgttttcttgggaagtctgctcagccaag

SEQ ID NO: 32501 - DNA, 121 bp, Artificial Sequence
  Synthesized
  misc_feature (61): n=a or g
ctgtgaagaactgtttcagttttatgatgctcctaatagacaagctgaacagtcagtgcantctttctgttttggcttcactgggtgtgagagacacaagtttttatttgtttctctcttt

SEQ ID NO: 32502 - DNA, 121 bp, Artificial Sequence
  Synthesized
  misc_feature (61): n=a or g
agcctatcagcatggctgagaagattgttttctgaggctgaggttcctaaggtttaggtgntaattcaggttcccttgtgtcaccacctctgcactgagggtatgtttttgcttgattttt

SEQ ID NO: 32503 - DNA, 121 bp, Artificial Sequence
  Synthesized
  misc_feature (61): n=a or g
gagcaatctgctcacagcagtttcaaagcaagcaacagtagatttcctcacctgattcagntcagttgtcgaatttggtgcttctgcacgcagtcaataatacgggttcccatggggtcac

SEQ ID NO: 32504 - DNA, 121 bp, Artificial Sequence
  Synthesized
  misc_feature (61): n=a or g
aatcgtcagtgctctgtgtattaaagcaggtcctgtgggaagaaaccatcccatctaggcnactttggcagactaatttgatgtcagacagtgacctcacaacaccagcgctcgtgtcatc

SEQ ID NO: 32505 - DNA, 121 bp, Artificial Sequence
  Synthesized
  misc_feature (61): n=t or c
cattttaaaagactcatttaaaccaaacagagccaggaaaactccaaagccgggccaaaangtcatctttcagtaatccccttgtacctgggcgtcacagataatcacaccttctcttagc

SEQ ID NO: 32506 - DNA, 121 bp, Artificial Sequence
  Synthesized
  misc_feature (61): n=a or g
gctgagatggtctgtgtgcctttcatgaataaatgtacggctttgtgggaccctgacttantgttttcaatatggtcccagaactgaggatggtttagatcttatgttacattcccatgaa

SEQ ID NO: 32507 - DNA, 121 bp, Artificial Sequence
  Synthesized
  misc_feature (61): n=t or g
ccatgatgagcaaaccaatgccaccccagctgtgtaacttcactgtgcagctcaggagcanttatgacccagatccaatccctgcctcagtgctcagctgctgaactccttcccacactgc

SEQ ID NO: 32508 - DNA, 121 bp, Artificial Sequence
  Synthesized
  misc_feature (61): n=t or c
atccttgtgcacaaactttcaacatttctgttcttttacattcaaagtggattttcttccngttttccagcccccagaatgggactaagtttagcagacctcaactaagaagcttttccta

SEQ ID NO: 32509 - DNA, 121 bp, Artificial Sequence
  Synthesized
  misc_feature (61): n=a or c
gctgggtctttgttcattctgagaatggcaagcaagtaagctcctcagggaactctcaggntcatgcatcctattcagagagttctgataatttggtgttcagaatcatagaatcatagaa

SEQ ID NO: 32510 - DNA, 121 bp, Artificial Sequence
  Synthesized
  misc_feature (61): n=a or g
ccctcttatttctgttacctgataggcaggagtactaggtaaaaagaaaggctatgaaaanctagtattgcagaaacccgtgcgataactgatggaaaagctgcactaggtaggatcacat

SEQ ID NO: 32511 - DNA, 121 bp, Artificial Sequence
  Synthesized
  misc_feature (61): n=t or c
tggtggggaagccatcaaccatcattgatagaccacaggcaacaaaacctcaaaatggttntacctcacaccctgctctatggagattttggttctacaagattcagaggtaagtttcttc

SEQ ID NO: 32512 - DNA, 121 bp, Artificial Sequence
  Synthesized
  misc_feature (61): n=a or g
ctctgctttgaaatggccacactaagagctacacttttaagaaaaactaaaaagcaggttntaaaacaggtcagcacttactgctagggatcctggaagagtatgaaagagccagaatgac

SEQ ID NO: 32513 - DNA, 121 bp, Artificial Sequence
  Synthesized
  misc_feature (61): n=a or g
ctaatgaatctgaagggatgacctgagagaaggttaataatcaaccttggcaggagtgagnaacactaatgatcactccatcagatgtgaaagaaggtgtacccttgtttgaggcaacctc

SEQ ID NO: 32514 - DNA, 121 bp, Artificial Sequence
  Synthesized
  misc_feature (61): n=a or g
tttggagttcctcacactgcacaagtattagttgtggccatttttgagatcttgagtggcnctgacatggggctaagatgagttgacattttgacccagatttagctgattagggaaatat

SEQ ID NO: 32515 - DNA, 121 bp, Artificial Sequence
  Synthesized
  misc_feature (61): n=a or c
ttttttccccactttgatactgagcaaatattatttgctcagcaaatgcttattgctatanaagaagtgtgtaagatgacagtgtgttgggaaggagatagcacaaggtgactgcaattga

SEQ ID NO: 32516 - DNA, 121 bp, Artificial Sequence
  Synthesized
  misc_feature (61): n=t or c
agtgagcctgtttaacttggaaggtcctttattgggactcttttttatttagttgtcattngatataaagtcaggatcattaacatttgtttgagttttaatgaggctggtctcccttgct

SEQ ID NO: 32517 - DNA, 121 bp, Artificial Sequence
  Synthesized
  misc_feature (61): n=a or c
tactgaccatcacattatcccaacatcgtattttaacagcaatgagagtaccttacattgnggttctgcacagaaaaaggcaagcttgctcactgtagcaaataaaaagaatgtgctttct

SEQ ID NO: 32518 - DNA, 121 bp, Artificial Sequence
  Synthesized
  misc_feature (61): n=a or g
ccaacagataattaagctatggagttcactgaccaggatgttgtgggtattcatcctaagngataaatgaattcaaaaagcaattagataacttcctggatgaagatctctctaaaggcta

SEQ ID NO: 32519 - DNA, 121 bp, Artificial Sequence
  Synthesized
  misc_feature (61): n=a or c
gatgtcttttgcagggacaatacaataatacaatacagggcaccagaaattgaaaaggttnctggaatacgttaatgataacttcctcttctaagtggtacaggaacccacaagaaaaggt

SEQ ID NO: 32520 - DNA, 121 bp, Artificial Sequence
  Synthesized
  misc_feature (61): n=a or g
gtgaatgaaaagatcagtttcagagtagttcaaggaattggatgacacaactgatgaagantaaagttctactaagacatataaattaagtaactgttgaaaatttagaggtgatagagat

SEQ ID NO: 32521 - DNA, 121 bp, Artificial Sequence
  Synthesized
  misc_feature (61): n=a or g
gtgctgagcctgcagaggggaaaacgtggcttgattctgggtgtaaatctgacctactgcngctttcccccttctaatgtgaaaatccccttctaagtgcaaaggaaaagcagcaattgct

SEQ ID NO: 32522 - DNA, 121 bp, Artificial Sequence
  Synthesized
  misc_feature (61): n=a or g
attccagtatagcactcctaagctatcagtggcaatcattttgattgcagtataattgtgnatctgtctacatgaggatggtgcctgagtaggaattcacaagctttttctgggaacattt

SEQ ID NO: 32523 - DNA, 121 bp, Artificial Sequence
  Synthesized
  misc_feature (61): n=a or g
gtgtggtcattccgtgctaaaagtaaaataggagcagaactacaaagaaaggatacatgtnctgttttcctgtcagcattccattatcatcacagctgtaagttttaccattgaatgagta

SEQ ID NO: 32524 - DNA, 121 bp, Artificial Sequence
  Synthesized
  misc_feature (61): n=t or c
cattataactgcatttgagaaagcagctaaattgcttccagaccgaaatctattcataacnggctgacttggatgccttcacttcgtcctccctcagccttctctgttctggcctaagctt

SEQ ID NO: 32525 - DNA, 121 bp, Artificial Sequence
  Synthesized
  misc_feature (61): n=a or g
acagagagaaaagctttgtatctgaaagcttgtctaatttttctgatttgtaccactttgntgtaactgcaatctttgttccctttttagaagtgggcaccttctagccagtaattaagat

SEQ ID NO: 32526 - DNA, 121 bp, Artificial Sequence
  Synthesized
  misc_feature (61): n=t or c
gtaggactctgtaacacacgacaaaacttaacagaaactaaactaaatcccagattgttangttatgctagttgaatgcaacagctttcaaaaagcaatgcgttcagcagtgtttcctgat

SEQ ID NO: 32527 - DNA, 121 bp, Artificial Sequence
  Synthesized
  misc_feature (61): n=a or g
ctccgtactgccaaaattgctacctctttggaagtgtttggtcttggatatgtgagctgtnttgtacagattatagtgattgtgctctctctccctctatgaaatagaaattcgcagtctt

SEQ ID NO: 32528 - DNA, 121 bp, Artificial Sequence
  Synthesized
  misc_feature (61): n=a or g
aaatttctaatgtcctcaaatagattaaaccaaggctcacagaaagataatttctccccancatttatctgaaatatggcacatacagcactactctcaactcccccaatttgaagaaaga

SEQ ID NO: 32529 - DNA, 121 bp, Artificial Sequence
  Synthesized
  misc_feature (61): n=a or g
tgatgaaaatatagtgaatgaagacttaacttcactgaatatattgactcaaacacctctngaagaggtgagcccagttcatgggaagcacacgcactgataaaagcaccataaaattatc

SEQ ID NO: 32530 - DNA, 121 bp, Artificial Sequence
  Synthesized
  misc_feature (61): n=a or g
aagttatgttttgtgattatttactcataagtctttaaatgccagtgataaagaaacaagntctgtttgttccttcactgtcaagattcatcaggtacacagctgagttgtatcaaacttc

SEQ ID NO: 32531 - DNA, 121 bp, Artificial Sequence
  Synthesized
  misc_feature (61): n=t or c
taaagcactcttgctgacttctcaaagctgacctcgctttatgaactgcttcagtctgctncttgttcagtaagtagcaggtatgaaaaacgcttgctgttgtctattgaattcagaataa

SEQ ID NO: 32532 - DNA, 121 bp, Artificial Sequence
  Synthesized
  misc_feature (61): n=t or c
aaaacatcttgtcagtgggggactggtatcggaatccactgactgaatcatagtgcagttntattgttttaactgtagatgttcttttcaaaggcccttattcttgcattttaattatatc

SEQ ID NO: 32533 - DNA, 121 bp, Artificial Sequence
  Synthesized
  misc_feature (61): n=a or g
cacattgttctattttcagttttaaaaatcaagattctattactgttaatgagagctacanaataagcatagatggagcatatatccccatgcattttttaacaattcttcatgcagttcc

SEQ ID NO: 32534 - DNA, 121 bp, Artificial Sequence
  Synthesized
  misc_feature (61): n=t or c
atgcacagctctctccaccttaccagccccttggacccactgtgggtttgggttggctttncacaggaacaagtggcaatgcccctttctggtgctcatctggcttcacccgccccataag

SEQ ID NO: 32535 - DNA, 121 bp, Artificial Sequence
  Synthesized
  misc_feature (61): n=t or c
ttcagttgtaagattgctgttaaatcataaaaacataagtcactgtctaggtcccttctcngctggccctggctacactgataccacagacccagggatctgggcagacacagcggccctc

SEQ ID NO: 32536 - DNA, 121 bp, Artificial Sequence
  Synthesized
  misc_feature (61): n=t or c
aacgtgcagcttaccactctacatcagctagcagtgtttgcataataaaatggaatctctntcacaggcactttccactattaaacaccttttttcctacaattatcattaaatgacttaa

SEQ ID NO: 32537 - DNA, 121 bp, Artificial Sequence
  Synthesized
  misc_feature (61): n=t or c
gcactcaggcatgcacagcagcagtgtgggccatacggctgcacccagaacttgcaagctnaggaagaacaggcaaaaacaagttggtgtccaaagagttcacaatggaaatgaaatgtta

SEQ ID NO: 32538 - DNA, 121 bp, Artificial Sequence
  Synthesized
  misc_feature (61): n=t or g
cagactgtgcggtgctttctgagctccctgcctcagctttcaaccttttgccaccttctanataatcactcccatgactttttgctgacaagtcacacctcttgctctgggtagcagcacc

SEQ ID NO: 32539 - DNA, 121 bp, Artificial Sequence
  Synthesized
  misc_feature (61): n=a or c
caacttgggaaaatgttgtcagcaatgggtctgtgtctttgtgcactgacaaatataattnagaacagtatccctaaaaaattaattggatcatgctgcaagataatccccaaactgataa

SEQ ID NO: 32540 - DNA, 121 bp, Artificial Sequence
  Synthesized
  misc_feature (61): n=a or c
agtacagttctgtgtggctccagaggtacttagctgcacttacctgtacttacctgactgnaccagtgaagtacatttcaaagcgcaccaggatcagtgtcagaatgtgactgtgtattta

SEQ ID NO: 32541 - DNA, 121 bp, Artificial Sequence
  Synthesized
  misc_feature (61): n=c or g
tttcatctaaggagagcctaaagagtgttatcttcaacatttcttctttaaaatctattcnttctgtgcatgccaagatagcagcctaagagaaccatcaataggtctggattaaggttgt

SEQ ID NO: 32542 - DNA, 121 bp, Artificial Sequence
  Synthesized
  misc_feature (61): n=a or g
tctaggttttccagcaatcactttcacagatctgtccttaggacagcaggactactgccancattaacaaagatccacctgatgctcccaagatagaacacgtccctgcagtgacaattcc

SEQ ID NO: 32543 - DNA, 121 bp, Artificial Sequence
  Synthesized
  misc_feature (61): n=t or c
cacacagaccaacagttagccgagaatccctttccttgtctctttcttcagagatgtggtngtgggaaaatttagtgaaaagcatttgcacagttccctctatgagctgttatgcttcaga

SEQ ID NO: 32544 - DNA, 121 bp, Artificial Sequence
  Synthesized
  misc_feature (61): n=a or c
tatattcgccaaatggaatataataaaagctaggaactcgtcaggtccagaataacccttnattcatctccagaactctcatacactaccgttaccaaaaccaaagaactgaggcaattga

SEQ ID NO: 32545 - DNA, 121 bp, Artificial Sequence
  Synthesized
  misc_feature (61): n=a or g
tctgtgagagcacaggcacaggacagcggtacgcagagtgcctgttcatgcactgtacatnagagctgtacgtgcactgagggcaggcacaaggtacagccaaatgggattcacttcccca

SEQ ID NO: 32546 - DNA, 121 bp, Artificial Sequence
  Synthesized
  misc_feature (61): n=a or g
ggaaaacaatgtatgtactgtatctgatgatcagtgatgggacttgttttcttctactgtnggaaaccatgctaattaagagcttttgatctttttcttatgactgtgagttagttgcaaa

SEQ ID NO: 32547 - DNA, 121 bp, Artificial Sequence
  Synthesized
  misc_feature (61): n=c or g
cattatacaatcacagtccttaaacagaaatgacatactttattaaaaatccagaatatgnagtactctccaactcacactatggtaggactcccagcccacagtgtatctgtaggctcga

SEQ ID NO: 32548 - DNA, 121 bp, Artificial Sequence
  Synthesized
  misc_feature (61): n=t or c
attctatgagtctaagaacatgctgtaataaagtgctcttgtttctctcacaatggcctancttttgctttaaggcttggagactttcagagtcagaggttcaccatcttgtttgtgagca

SEQ ID NO: 32549 - DNA, 121 bp, Artificial Sequence
  Synthesized
  misc_feature (61): n=t or c
aaacaagattctgattagaagcacttgcctgtaaccatctgctggggttgtgtgaggccgnggagggctctggtgcgggtttggtgcaggtgtgccgtgcctcgccttgctctgatgagct

SEQ ID NO: 32550 - DNA, 121 bp, Artificial Sequence
  Synthesized
  misc_feature (61): n=t or c
taggtgtggttctctttacctccacacatttcatgttcattaggttcttcacggtttatgnagtctgagattgcggcacaaattgatcaaaaggcctagggagtacaatcaaaatggaaaa

SEQ ID NO: 32551 - DNA, 121 bp, Artificial Sequence
  Synthesized
  misc_feature (61): n=a or g
cagactatgatcacaccttgcatcaaagctggagaacttgctgcctcagtgacctcttacnacctgatccatcctacaagggaagaagcaacctgaaattaaacagactccaaggaagaat

SEQ ID NO: 32552 - DNA, 121 bp, Artificial Sequence
  Synthesized
  misc_feature (61): n=a or c
gagtacaaacctgttagagacggtggaataaaacaatgtctgtgaggcactaagtgctcantggtgttaggagtaagtcgtatcgtatgagatgctcagagcactttatcgaagcccagca

SEQ ID NO: 32553 - DNA, 121 bp, Artificial Sequence
  Synthesized
  misc_feature (61): n=a or g
tccctgaagccagagcacagcttctgccatgaccgagtccaacatgatgtgtgtcataaangctgttttgcaatgacacaaaggatttattttcccttccatttggcctccagtgctcaca

SEQ ID NO: 32554 - DNA, 121 bp, Artificial Sequence
  Synthesized
  misc_feature (61): n=a or g
atgctactttcttacaaaaaagaaaacaacaaactgccttcttagggaccaattctcttcnacgtgtagaagcacacacatgggatttgggcaacgtcctggaggaccagaagggaccata

SEQ ID NO: 32555 - DNA, 121 bp, Artificial Sequence
  Synthesized
  misc_feature (61): n=t or c
gattgaatgaaaatgcaaagacgtattaattcccaaggctgcttgaagtctattttaatantgcagcctgaactctattaacatgtctcttctttggagaactgtgtatttggatgccttg

SEQ ID NO: 32556 - DNA, 121 bp, Artificial Sequence
  Synthesized
  misc_feature (61): n=t or c
gtgcaaaaatcagatcaacccacatcttgtttatttacattgccatctttaatttgtcatnagttatatggagcagtaaagcttttagtgcaaaatattttaactgaatgggtagtatttt

SEQ ID NO: 32557 - DNA, 121 bp, Artificial Sequence
  Synthesized
  misc_feature (61): n=t or c
acctgcactttgttgcttttagctcccacttctgaaggagtcctggtgtactctggttctnagagcacagagctaccaacagctgcaggaaggcctgcaagcagtgcagcgtgttttcaac

SEQ ID NO: 32558 - DNA, 121 bp, Artificial Sequence
  Synthesized
  misc_feature (61): n=t or c
tgaaaagtttacagtgtgaaatatggctttatttacaattatgaaatatatcaaataccangggacttgtcagtgaactgaattatatttcaatattaaactagtaaaggataattctaac

SEQ ID NO: 32559 - DNA, 121 bp, Artificial Sequence
  Synthesized
  misc_feature (61): n=a or g
ggatacacagctatttcttaaactcgtggtactgcaaagtccttaatctcactgagaggcntagatggatgtcagaatgattttactccacagttgcaatatggaaaaataatttacgttt

SEQ ID NO: 32560 - DNA, 121 bp, Artificial Sequence
  Synthesized
  misc_feature (61): n=t or c
tcagtgccccgttctcatgacaaccaatgcacatcctcttcaatcccacacctcctggcantgacacctgcactaatgacactgtgaccgcatacgcctccgataaggagctctgccccac

SEQ ID NO: 32561 - DNA, 121 bp, Artificial Sequence
  Synthesized
  misc_feature (61): n=t or c
attaattcaaagcatgcaattatttagttttaaggaatagaccctgaagtaaacttgaaangtgtctatttggttataacctgtacctgtaccatgaaagtgaaaacaaaattatgctctt

SEQ ID NO: 32562 - DNA, 121 bp, Artificial Sequence
  Synthesized
  misc_feature (61): n=a or g
catttctttcacttgtcaggtgagcttggccgtgtgcggcgtggataggtttggatcagcngtcatattttcatggtgcgtgtgtaggtgcaacaggacaacacccaccctcgctgccacc

SEQ ID NO: 32563 - DNA, 121 bp, Artificial Sequence
  Synthesized
  misc_feature (61): n=t or g
ttcacttaggcataattgttctactattattatttttcaacttccagcagatcacaatgtnagttactcactgtgaaaataacacaatacgatgtccctttctggaattaaatcctaatgt

SEQ ID NO: 32564 - DNA, 121 bp, Artificial Sequence
  Synthesized
  misc_feature (61): n=t or g
atgcctgaatggaatcagtctcaataaggaagcataacaactctttttcctttgagatagntaaacaaacaaaataggaggggctaaataagatgtatgtgtattatcttaaaaaaagaaa

SEQ ID NO: 32565 - DNA, 121 bp, Artificial Sequence
  Synthesized
  misc_feature (61): n=a or t
tgagttcatcccctttagaaaaagaaagcatgccactgaagttcaagcttgcttgcaatgntgtgttttgaattcctctggatttacaccgcagtatctgagagcagacattttgtcattc

SEQ ID NO: 32566 - DNA, 121 bp, Artificial Sequence
  Synthesized
  misc_feature (61): n=t or c
gtattcatatttaattccagatgctatacttccagtgagaagaaaccagtttgcctgtttnagagaactgtctgcatggccttttgtattaccaagactcttccatacttctggtaaacca

SEQ ID NO: 32567 - DNA, 121 bp, Artificial Sequence
  Synthesized
  misc_feature (61): n=t or c
gggaacacgcacagaatttgtactcagagctgattcagaagacactgagaaggagaatttnagatgggaaatgacgtggagaactgctgctgtgacccagctgtgagccgtcagaaccgac

SEQ ID NO: 32568 - DNA, 121 bp, Artificial Sequence
  Synthesized
  misc_feature (61): n=a or g
gatagagtgttttagataaagaatcaatgggttagccatttttacttaagtgtatatggantgcgggctaaaaaaatgagatatgacttcaattaagtacagtacaggagcaggttgaata

SEQ ID NO: 32569 - DNA, 121 bp, Artificial Sequence
  Synthesized
  misc_feature (61): n=t or c
cctctttaaaggtgtatatatatgtattctccgaaagaagtgttagatgatgaaggaaaanttagagcagacccgcatacctgcccccctgagacatgtggtgaacaacacagtgctttgc

SEQ ID NO: 32570 - DNA, 121 bp, Artificial Sequence
  Synthesized
  misc_feature (61): n=t or c
gtgggtctgcttttgtcaagtgagggctgtataacaaagaggattacttataatgttcccngtgtatggatatgtgcagcatgtctgtgtatgtctataattccaagggaatgtaaccaat

SEQ ID NO: 32571 - DNA, 121 bp, Artificial Sequence
  Synthesized
  misc_feature (61): n=a or g
atttgcactatcaataaatctaattattacattcccacttctaattcccagatcattactnatgtattgtctgtacaacagtctctcaactataccagtaacttccgttcagctttctcaa

SEQ ID NO: 32572 - DNA, 121 bp, Artificial Sequence
  Synthesized
  misc_feature (61): n=a or g
ggtagctattgcagcaagcataacctctggggcaggaggagagttaaacccaagactgcgntggaggaaactccacagcatctatcagaagatcatgcagtaggcatttcttgcccatatc

SEQ ID NO: 32573 - DNA, 121 bp, Artificial Sequence
  Synthesized
  misc_feature (61): n=a or g
ggttgaaactctgtctcagtgtttttagttaagaccatgactcatgatgtgctgacagctngaaaattatcaccttgaagcttctagacagttgagtattattatattaaaagatgctctg

SEQ ID NO: 32574 - DNA, 121 bp, Artificial Sequence
  Synthesized
  misc_feature (61): n=t or g
tttgacaactgaagcatttggaagaatcagagattttgcagatacgccagaagaagaaaangtagaacacacaggagcttttctattcagagtagaatagagcatttttaacacttttcag

SEQ ID NO: 32575 - DNA, 121 bp, Artificial Sequence
  Synthesized
  misc_feature (61): n=t or c
gcttgaaatgtaatgcaaaaaggggaagcacactgttttggggagctggtgtctgactagnatgaggcttttagactcccaggcatccgtacttaaatatttcctgttacctgacacatcc

SEQ ID NO: 32576 - DNA, 121 bp, Artificial Sequence
  Synthesized
  misc_feature (61): n=t or c
acaattcagtttttctgaacttttagcagtgctcatcataacaatacccaagtggtgaaangccaaaacctaatgtggggaggcaaaaagcttacatattactgaaatactaactaaagtg

SEQ ID NO: 32577 - DNA, 121 bp, Artificial Sequence
  Synthesized
  misc_feature (61): n=a or g
tctctcactccctgggctctgtggctgatgcttgcaccttaggtctgactcagtggagcantttgtcccattctgctcagttctccctcctgttacagatgatttgcacctgctcttttgc

SEQ ID NO: 32578 - DNA, 121 bp, Artificial Sequence
  Synthesized
  misc_feature (61): n=a or g
gttcctactcacttcccacaggactttaatatggatatgattggaacaatcaaggctatantgaaggatgctcagctttcttagtccatgagattatgtatcaatattatcttatgcttca

SEQ ID NO: 32579 - DNA, 121 bp, Artificial Sequence
  Synthesized
  misc_feature (61): n=a or g
caaagcagaactgatggtcattctccatgcagaatttaaagttcgttaactgtagcagcanaataatatgtcattataattgctgccatgttggtaaaagtgctaatataaagtgaatatc

SEQ ID NO: 32580 - DNA, 121 bp, Artificial Sequence
  Synthesized
  misc_feature (61): n=c or g
gaacaatgtcctcattaaaagagatatgaattagagtaagcattctaccattacatagatnaacacgtgttttacgtcactggtaaatgaacaataactgatttatcatgaaggatatcta

SEQ ID NO: 32581 - DNA, 121 bp, Artificial Sequence
  Synthesized
  misc_feature (61): n=t or c
cacgactgattcctacacagcgctttaggacttcttcaaacactgataagcactctccccngtgcacccaggttctttactggcagatctgcagcttagcgctccctttcagactgatgca

SEQ ID NO: 32582 - DNA, 121 bp, Artificial Sequence
  Synthesized
  misc_feature (61): n=a or g
ccctgaagaagatgttattctgtttactctgctctacttctcccccactgtttacagcatngcttttgccaagaagactcagaaatgcttcttccaggcttcatgagtaattgtcttatca

SEQ ID NO: 32583 - DNA, 121 bp, Artificial Sequence
  Synthesized
  misc_feature (61): n=t or g
tgcatacagatgtagtgatatttgtggaagcattcacttctgtggatctgttttgcgcagncttgatactttctctgaataaaagtgctggagaataattagattccaagaataacatact

SEQ ID NO: 32584 - DNA, 121 bp, Artificial Sequence
  Synthesized
  misc_feature (61): n=a or g
agcaaaagcaggagtgattgccttgtaccagacaggacatgtgctcctcagggcatcggcnctgctgagctggccagcagaagtggaagaggctacaggctttgctggaaaagtaaccaca

SEQ ID NO: 32585 - DNA, 121 bp, Artificial Sequence
  Synthesized
  misc_feature (61): n=a or g
gtccattctaatatttcctactagatttgattgtcttttcagatatttcttcacttccaancctgattaaaatgtgattctcaatcttgttaattctaaagtcaaaagcacttaatacatt

SEQ ID NO: 32586 - DNA, 121 bp, Artificial Sequence
  Synthesized
  misc_feature (61): n=a or c
ttcttgtgtttttattcctaatgtgaatcttctgcaggggaaagaagcgaaaagaaattgnatgtgcataccctgaagctcacattagtgaagcccatatcctaaccaaccctatcctacc

SEQ ID NO: 32587 - DNA, 121 bp, Artificial Sequence
  Synthesized
  misc_feature (61): n=t or c
caagcaagctttcgttgtcacctactgacatttcgttcagcctaaaaatgaaaacacggtngcctgcactgtttcaaactctcagagccaccagggtctcacagataggaacaaagaaaga

SEQ ID NO: 32588 - DNA, 121 bp, Artificial Sequence
  Synthesized
  misc_feature (61): n=a or g
atttagtcacattatgtgtgaataggatttgatgcttggattgcacaaaacataaaccatnaggatttttaaccacatatttttcccagcttctactgaaaatatctacatggcatgattg

SEQ ID NO: 32589 - DNA, 121 bp, Artificial Sequence
  Synthesized
  misc_feature (61): n=t or c
acctcttaaattatttgattatcttttatgctatattaaagtgtttaggatgctttcaaantaatatactatacatgctcaggagtatgcacgtataccctttcaagtacgtggaaggaaa

SEQ ID NO: 32590 - DNA, 121 bp, Artificial Sequence
  Synthesized
  misc_feature (61): n=t or c
tgatttcttttgctgtaactcaagcctagtttttaaaacttaggtgccagaactgagacgnagctacgtattaaggagtagttttcggaagtgctgtctgccctcagcttctagaactgta

SEQ ID NO: 32591 - DNA, 121 bp, Artificial Sequence
  Synthesized
  misc_feature (61): n=a or g
ttcttgctccaagctgtttcagcatgcaccaaaggttgcaggggagcccatgcactatgcntgggtaggagctgcacatgggtaggagctgcacgatggcctggctcaggacagtctctgc

SEQ ID NO: 32592 - DNA, 121 bp, Artificial Sequence
  Synthesized
  misc_feature (61): n=t or c
tgtttattgcagtcctgaatgctctggggtgaggtcacggtaggtgttacataggctgtantaggcagttgagttgtcacacctggtggtcattacgagaagcatgaagcagggacaggag

SEQ ID NO: 32593 - DNA, 121 bp, Artificial Sequence
  Synthesized
  misc_feature (61): n=a or g
tagctgctgtctgaattctagactgagttgctgccttctatccttcatataacttacacancctttttcttctaaaactgttttgtccacataatagcagcagcattagccagcagtaaaa

SEQ ID NO: 32594 - DNA, 121 bp, Artificial Sequence
  Synthesized
  misc_feature (61): n=t or c
caggcttgtttttcttgctcttaccagtgcagtcagtcacactttgtgtttgtctctggcngggctgtgcctgaaaacacagctcatgtgagccagtggagcaatttcaaccactctgaag

SEQ ID NO: 32595 - DNA, 121 bp, Artificial Sequence
  Synthesized
  misc_feature (61): n=t or c
cctccaaaataagactgaatttttaggagaacgcttgctaagaagaatgtgaagtttttangccatttacagaaattgctggcctgtctacatggatttttaagcacaagaaatccaaatt

SEQ ID NO: 32596 - DNA, 121 bp, Artificial Sequence
  Synthesized
  misc_feature (61): n=a or c
tatttgagcaaagcaaagatacaggatattccaggcaggcaaaattcataccctctgaacnagattgtttcttctcatctcctccccgcaattctgaatcactcacgtcacaaaaaatgtc

SEQ ID NO: 32597 - DNA, 121 bp, Artificial Sequence
  Synthesized
  misc_feature (61): n=a or g
atatgtgtaagaaatacttcttaagactagcctttatcttatcatggagatcactccttcncctgtgaagaagtcatagagaactgagcaaaccagtgtatgaaaaacagaaaacttactc

SEQ ID NO: 32598 - DNA, 121 bp, Artificial Sequence
  Synthesized
  misc_feature (61): n=a or c
aatgctttctgaggttttgaaatcaggcaactgtagaagaactcagcaaaaggaagtatcnaaactagtcaaaattacattgcagaaaaatgaatgtaaactatgctaaaattacttcagt

SEQ ID NO: 32599 - DNA, 121 bp, Artificial Sequence
  Synthesized
  misc_feature (61): n=t or c
gtcctgcacaaatagtgtccccatgaaacctgatattccctaatgtttctccttcagtaangtgaaactgtcacccttcttagatatgaaaaaaaaaagaaaaaaaaagcaagttttataa

SEQ ID NO: 32600 - DNA, 121 bp, Artificial Sequence
  Synthesized
  misc_feature (61): n=t or c
gacgaaagccaaactatgcctatgcaatttattataaaaagtcctagcaataaaatatacngatagtgtctggaaggagaaaaaaattaagcccgagaacagccttaatgcattggttctg

SEQ ID NO: 32601 - DNA, 121 bp, Artificial Sequence
  Synthesized
  misc_feature (61): n=t or c
cacctatacagggtgggtttgctttgctgtccctcctcagcctgtgggatcactccttctnggaagcctctctcctgcttttcagtggcaattcgcaggtcatcgtcgcgtgattcattca

SEQ ID NO: 32602 - DNA, 121 bp, Artificial Sequence
  Synthesized
  misc_feature (61): n=a or c
ggcaaaatattgagtttatttctcatgaggaatataaccctttttaaactcagttctaaanctctaccaagcattactgggtgctttcatttattgtgacaaatagcagttttactctttt

SEQ ID NO: 32603 - DNA, 121 bp, Artificial Sequence
  Synthesized
  misc_feature (61): n=a or c
attgcactttgctaaccctactaagggttataactagcaacctgttatagtcttttctctncattttcttctccctcacactcttgaatcctcataaaagttgagaagaaaatattttctt

SEQ ID NO: 32604 - DNA, 121 bp, Artificial Sequence
  Synthesized
  misc_feature (61): n=a or g
gagataacctggtggctccttgctgctgacagccgcttgcagaagcaaagttctgatttcngcatcaacagcaggtaaatggtgagattttgggaggtaaaaatctcccaaaaatgaagag

SEQ ID NO: 32605 - DNA, 121 bp, Artificial Sequence
  Synthesized
  misc_feature (61): n=a or g
atattgcttccccaaacacggggatctgaaaatagcaccatccaccatgctattcaatgtnttacattaaatccaaaggaatattattggcaccacatctggcaattgctttgatgtggaa

SEQ ID NO: 32606 - DNA, 121 bp, Artificial Sequence
  Synthesized
  misc_feature (61): n=a or t
agctactaatgtagtcctgcacatgtaccatctaaagaaaaatggaaaattaatctgacanactaatatttacaatgactttttagggatttttactattcaggaggagtcaagaaaaata

SEQ ID NO: 32607 - DNA, 121 bp, Artificial Sequence
  Synthesized
  misc_feature (61): n=t or c
aggacctcagcccttccttggacgctgagccactgagcagtgggaccactttttccccagnccaccttgtggtgcacatacaaatacaagtgtccttcacagcccctggtgggtccagctg

SEQ ID NO: 32608 - DNA, 121 bp, Artificial Sequence
  Synthesized
  misc_feature (61): n=a or g
agcagggcttatggttgggagtaaaaactgaacccacaggctcaaaaggaatttgagaaanctctgtagcagacatagcctgtcctggtgcccattgccaagaggtatgaggttctgagga

SEQ ID NO: 32609 - DNA, 121 bp, Artificial Sequence
  Synthesized
  misc_feature (61): n=t or c
taagatctacctacacagaacaagagattgctgaaagatgacctttctcatcagatctctnggtatcagtttgaccacgcttattaggtgtaaatcttcacaaaagccacaaaagctgtcc

SEQ ID NO: 32610 - DNA, 121 bp, Artificial Sequence
  Synthesized
  misc_feature (61): n=a or g
tctcttcagggacagtaagaagaggaagaactgcacctaggactaatgaactgtgacctgngcacatcgtcattacacctcagtgcagcatttcagaagcaaggcaggaaagaacacatat

SEQ ID NO: 32611 - DNA, 121 bp, Artificial Sequence
  Synthesized
  misc_feature (61): n=a or c
agagtgaatcaaataaacaaaataccaacacttttaaaccagttaaaatagatgttaaaanaactgtgatggaacactgtgtattaaaagagacaactggatccagcgatccagaaagaca

SEQ ID NO: 32612 - DNA, 121 bp, Artificial Sequence
  Synthesized
  misc_feature (61): n=t or c
gttttgaacacaaagtcccagtgggttcaaatttatgtgctttctctctgtgtataaggangcatacagagtacctatgatagttgctgaaagctggttcggttcttctggtgtctgtatt

SEQ ID NO: 32613 - DNA, 121 bp, Artificial Sequence
  Synthesized
  misc_feature (61): n=a or g
atgggatgacattgcacaacctatgcaaggtgctctgagatgggtgggcaataagcaccanccaagattactctgtatttctgaccttagtgagtcatttctccaggctcccacactgcct

SEQ ID NO: 32614 - DNA, 121 bp, Artificial Sequence
  Synthesized
  misc_feature (61): n=t or c
tcaaaagtaaatgaagttatatgcatcttgggggattgggtggttttctataacatggtcnctaaggatgtttgcaaattgctttctttggactttttaacacttccgattgtgctgataa

SEQ ID NO: 32615 - DNA, 121 bp, Artificial Sequence
  Synthesized
  misc_feature (61): n=a or c
aaatatcttcctgacatacacaagctacttttcttgtggttttaggattggtttttcagcntcattgcaattgctaaaccaaattgtttacacagacagtgctcatgattttctgatgtaa

SEQ ID NO: 32616 - DNA, 121 bp, Artificial Sequence
  Synthesized
  misc_feature (61): n=t or c
aatgtaagacaaaggagaagaagaatagttatccctgttcagaaagtccttctgcagttcntccaatgtaaaggagtaaaggaatcttaaaggctctagaaatgttaactcagattcaaac

SEQ ID NO: 32617 - DNA, 121 bp, Artificial Sequence
  Synthesized
  misc_feature (61): n=t or c
gttggatcaacctatctggaattacagcagggtctgggagcaattgggagaagcagagtgnccctgcaacctcaactactacgtggatatctgaactgggcaccagcatatcggtgtactc

SEQ ID NO: 32618 - DNA, 121 bp, Artificial Sequence
  Synthesized
  misc_feature (61): n=t or c
aaaagtgctgtctgaagctgttggcagaggtgctgttttggttgcaatgtaagccttcctngtttacttgcctcctgtgaacataagttagtttaaaacattttttaaagctacataaatg

SEQ ID NO: 32619 - DNA, 121 bp, Artificial Sequence
  Synthesized
  misc_feature (61): n=t or g
ttctcacacaggaatgcacaggaagaagcttaaatgcaaggtctacaaagtttgatgaggntgggattgggattaatgagcacctggctctgagcacatcctcggacaaggcttctcagct

SEQ ID NO: 32620 - DNA, 121 bp, Artificial Sequence
  Synthesized
  misc_feature (61): n=a or g
tgaacagacatctacagctcgatcaggtgcttgagatccatccagactgaccctggatgtnagggtagtacctgacagcattatgaggtggtccacgtactgcagccaagaacactgcaaa

SEQ ID NO: 32621 - DNA, 121 bp, Artificial Sequence
  Synthesized
  misc_feature (61): n=c or g
ttagcaataagagcgattgtagtctgattgccatccatgacttttaggatgcttagaagtngttagtcagctaatgacagcattagaaagaattatttctgccctagttagtaataaattg

SEQ ID NO: 32622 - DNA, 121 bp, Artificial Sequence
  Synthesized
  misc_feature (61): n=a or g
gggagggaaacaaatctgtcagctcaaatgaggtgcagactgaccctactgggagggcagnggctcttcctacattaaaaaagggatattcctgagtctgcagatgtaaagtgagggaggg

SEQ ID NO: 32623 - DNA, 121 bp, Artificial Sequence
  Synthesized
  misc_feature (61): n=a or c
gagtaagttgcaactgaagttgcttactgtggggatttgtaaggcagttgcacagatcagncgccgagttcatacccatatgaagaaagtaacagaagaattacaatgctatgtgtagctt

SEQ ID NO: 32624 - DNA, 121 bp, Artificial Sequence
  Synthesized
  misc_feature (61): n=a or g
taggagacctgtagtcagttttcataaaagagaacaaatttgctactgaacatctgaagtntgatttttccaagatcaggtgcaggtcggtacattcagaatttgcaataataagcagagt

SEQ ID NO: 32625 - DNA, 121 bp, Artificial Sequence
  Synthesized
  misc_feature (61): n=a or g
gcctggaggaccctccatgtctttttgggcataaacataaggtgttttatcagatgggggntggggggaagttgattcccaagaagcaaagatttcagcctgcgtgagacacacaggcact

SEQ ID NO: 32626 - DNA, 121 bp, Artificial Sequence
  Synthesized
  misc_feature (61): n=t or c
aaagcactattgtgcactcttgccacatatttcttccccaagaagggggagatgatgcaanggaaatatgggaaaagatctgacgtgcagcaaccctggcagaggcagtggtccttgtaac

SEQ ID NO: 32627 - DNA, 121 bp, Artificial Sequence
  Synthesized
  misc_feature (61): n=a or g
tttaattttatccaaaacatatctaataagagcagggaaagctaaagaataagggaaatanaaggcaagaaaagatcagagagaagagtgaagcttgcagtctatttcatatttatgtttt

SEQ ID NO: 32628 - DNA, 121 bp, Artificial Sequence
  Synthesized
  misc_feature (61): n=a or c
tgagaagtggtgaaggttaaaggcaactttgcaggagctctgtgtatccaaactgtagatnccagtcctcccactgcttctgctagggattacttccagcacactccaccctagcagagtg

SEQ ID NO: 32629 - DNA, 121 bp, Artificial Sequence
  Synthesized
  misc_feature (61): n=c or g
gcaacgcacagctgtccaaacctctttcttgctgtatgccattggcctgcaaaaacaaagnaaaaccaagtggtcctctcctaaggatactgcagctgtgggttcaaacaccggctgctcc

SEQ ID NO: 32630 - DNA, 121 bp, Artificial Sequence
  Synthesized
  misc_feature (61): n=a or g
agcaatggttgcagaactttagctaggctaattagccaatacaactggaaatcagtgcttngacctcatatgtttggctgtctaggtataaaattagagtctttgaagatgtggcccacct

SEQ ID NO: 32631 - DNA, 121 bp, Artificial Sequence
  Synthesized
  misc_feature (61): n=a or g
tttcattttcttgttagttctttgaagaaagaagccagctttatctacctttcaggaagcntggaaacaattcgtttcccacctccctgcctccctcccccccccccttttttttttaatt

SEQ ID NO: 32632 - DNA, 121 bp, Artificial Sequence
  Synthesized
  misc_feature (61): n=a or g
gaaattcccattataaaaaaagatcttacttttttttttagccataattcacccacattanttaatcaatgtcatgaaagttcagtgggctttaagaaatagatgcttgaaaggtgctttt

SEQ ID NO: 32633 - DNA, 121 bp, Artificial Sequence
  Synthesized
  misc_feature (61): n=t or c
ttttcatttctatccagcaatcagatgacgtatgcaatgaatatggcacatatctcctgcncggagaatcccaagtatccgaagagcaatgctttgcctgggagaagccaccgagcacaac

SEQ ID NO: 32634 - DNA, 121 bp, Artificial Sequence
  Synthesized
  misc_feature (61): n=t or c
accactttgagggaaattgacttgatagagtactttttcctcaggaaattgggtcagttantgaacttgaatgccttttcacttgctgaatatgttatatatatatacacacacacatata

SEQ ID NO: 32635 - DNA, 121 bp, Artificial Sequence
  Synthesized
  misc_feature (61): n=t or c
aaaaggtaaactaaaatgaacgactatagaatgaggacctggttgctcagctgggggcttngatagtttccctgtgaagtgaccatctctagatggatgcctgtgagtaactatggacttt

SEQ ID NO: 32636 - DNA, 121 bp, Artificial Sequence
  Synthesized
  misc_feature (61): n=t or c
agcaagcccagcatgaaaataccacttccatcagcacgcctgggaaactgcacatagccancagttccctcctggaactgcatattgtagcaatggacttgggtggaaactgggagggaaa

SEQ ID NO: 32637 - DNA, 121 bp, Artificial Sequence
  Synthesized
  misc_feature (61): n=t or c
atctcaagaggctgttttgcagacctgcttcctgcttgcaataccaaaatcaccaacctcntctccttctggtttccactcaaaacaaattctcatgcatttatctgcacacgctgctcct

SEQ ID NO: 32638 - DNA, 121 bp, Artificial Sequence
  Synthesized
  misc_feature (61): n=t or c
tctcccttatgttaattcaccttccttgccaaagcagcacaaggttctgcagcgcaggganataaccaagcccctgcttcatacagaggtaattttctctctgctatgaactgcacagccc

SEQ ID NO: 32639 - DNA, 121 bp, Artificial Sequence
  Synthesized
  misc_feature (61): n=t or g
gattttgctcagatcactgtctcatgttagacccatcactttaattctagatggaaaagtnctgcagtctccaaagcccatccagatacctggttgcttctccccggtcctgacctcaaca

SEQ ID NO: 32640 - DNA, 121 bp, Artificial Sequence
  Synthesized
  misc_feature (61): n=t or c
atgtacagctagctctttgtagatggtaagctgattttttcttgagaaatgatatgccatngtgtcagatggacctgaattgaaacctgtctactccccacactcctggattcctattgca

SEQ ID NO: 32641 - DNA, 121 bp, Artificial Sequence
  Synthesized
  misc_feature (61): n=t or c
gctaatgagagggagaagtatcaaagacaatgatagatcctgcaagggttatagatgtcangagagcaaaatcttctagcaaaggaacgagttctaccatctgcaggaaactcttgccaga

SEQ ID NO: 32642 - DNA, 121 bp, Artificial Sequence
  Synthesized
  misc_feature (61): n=a or c
gaacatacagatcctcggcatccaagcagggtctgcctgatcactactaatggctctcccncacctatttttcactctgaaagtctgttaattatctctacaagaaataaggtgctttctt

SEQ ID NO: 32643 - DNA, 121 bp, Artificial Sequence
  Synthesized
  misc_feature (61): n=a or g
cacaattagtcaaaagaatttattcatctttctaaatactgatcctgactttactttgttngataagtcgctttttctgtggctccaaggtctggttttaatgaaacaagttggaggtatt

SEQ ID NO: 32644 - DNA, 121 bp, Artificial Sequence
  Synthesized
  misc_feature (61): n=t or g
agaccataaactttctggtctctggacccactctggaagagtgggaagatttggtatgtgntcagtattttctctcatgcttacccacaaagtcttgcttcatcttttgacatcttatatc

SEQ ID NO: 32645 - DNA, 121 bp, Artificial Sequence
  Synthesized
  misc_feature (61): n=a or t
taactttaggtatctatggagccaatatttagtctgcccctcactgccaataactaaaaantcacaccttccagactacaatttcattttgtcagcagtgaatcatgctgagacttgtaag

SEQ ID NO: 32646 - DNA, 121 bp, Artificial Sequence
  Synthesized
  misc_feature (61): n=a or g
cattttatacagcacccttatcagcaagagccagctttaggcctcataaggaaaatcaccnggttactttcacgtcgtttgtatgcattgctttaatttgaagagcactgacttgataaac

SEQ ID NO: 32647 - DNA, 121 bp, Artificial Sequence
  Synthesized
  misc_feature (61): n=a or g
ctgtgtatgaagcctcctacgtaaaaagtctattagcattagctaagatctaggagttaanctattattcccaaaataatctcaaatagaagtagtatttgaggaaacagaaatagtcatt

SEQ ID NO: 32648 - DNA, 121 bp, Artificial Sequence
  Synthesized
  misc_feature (61): n=a or g
agggatacctggtacatgccgctatcaggggaatgagaagacattcttctccaaagctgcntcacataacctgatttttctcatgcgtggcagaggcagcatcaagcctgtgttttatttg

SEQ ID NO: 32649 - DNA, 121 bp, Artificial Sequence
  Synthesized
  misc_feature (61): n=a or c
taccagattatcgtgatggccaagcaatgttattttttccaagtgtcattacaatcttggnacgtttgctagcatctcttttcacatcgtaagggctcatcattcttcagaattgcctctt

SEQ ID NO: 32650 - DNA, 121 bp, Artificial Sequence
  Synthesized
  misc_feature (61): n=a or g
caagggatcaggcatgctcacgcagctgctgcaaaaagctggttctgagacctgttggcanctgtaacactggtgacacagaagcattacccagccctttttccacaagcgaggcaaggat

SEQ ID NO: 32651 - DNA, 121 bp, Artificial Sequence
  Synthesized
  misc_feature (61): n=t or c
catatgttttgagttaaagccaaagtccatttttgctactgtttgattgttttatatgacngtaccacattctgtctcttacactactacaataatactttatatatctatagatgtgtat

SEQ ID NO: 32652 - DNA, 121 bp, Artificial Sequence
  Synthesized
  misc_feature (61): n=t or c
tgatggctcagtgtcaagtcaaagccttaggtgcatgatgcctgcaaagtttcacaactangtaactagttatactgaatgattgcttgtggaagcttaggaaataaatttgtcttccctc

SEQ ID NO: 32653 - DNA, 121 bp, Artificial Sequence
  Synthesized
  misc_feature (61): n=a or g
cagcttggggtccactggatttcaatctttggtagcagctctcatatcagaccaagactcnctcctgcagagcactatcccaatgtgtgctctggtttctgggaacctatactagatccag

SEQ ID NO: 32654 - DNA, 121 bp, Artificial Sequence
  Synthesized
  misc_feature (61): n=t or c
agaagatctaaaggcaaaggtaatgactgctgatttgtttatggtattccagatgctatgngtttaaaagagcagtagctggacacaggggaggcagactgccattttgtttcttccctcc

SEQ ID NO: 32655 - DNA, 121 bp, Artificial Sequence
  Synthesized
  misc_feature (61): n=t or c
ggtccttccaaggggaacagggtttccaaggtcccagagttacagaggggcagctctgcantcacatctccagaaggatgctgttgtagaggaaggcagcgaggtcccctggcagctggag

SEQ ID NO: 32656 - DNA, 121 bp, Artificial Sequence
  Synthesized
  misc_feature (61): n=a or g
actgcatggaggagcgtaacaagttgggcttaaagctgctccttctccaacaaagaaagcngggttgtgcgacagcggcatccctcgctagagctgtaggaggggtcaagagctgccatcg

SEQ ID NO: 32657 - DNA, 121 bp, Artificial Sequence
  Synthesized
  misc_feature (61): n=t or c
tgtattttttgtttctgttaatgttaatattgcgaagtagtatgtattgcatgagaattantcccaaaattgatggaactaaaggtatagattgcagaattgtctttaattttaggagaag

SEQ ID NO: 32658 - DNA, 121 bp, Artificial Sequence
  Synthesized
  misc_feature (61): n=a or c
acagacccagtggtattttctggatagatcaacttttggaaagaacaaattaccttttcanaacaatttgttttaactgaagcctgaaagcaaatgttttgactactttgcagatgaatga

SEQ ID NO: 32659 - DNA, 121 bp, Artificial Sequence
  Synthesized
  misc_feature (61): n=t or c
aaaaacaggccagtagttaaatgtttcctttttaagtccatgcatgcatagtccttaggantgtcctaacagcagtgcagttgcaagctggattttcaaaccagccagatgttatatgtat

SEQ ID NO: 32660 - DNA, 121 bp, Artificial Sequence
  Synthesized
  misc_feature (61): n=t or c
ctattcttccttacgtttacttacacttactgctgaaaacagacttctagactagatgaancttaggcctgatccattaaaactcatttacagtcttatttaagtaaggagttgttgtctg

SEQ ID NO: 32661 - DNA, 121 bp, Artificial Sequence
  Synthesized
  misc_feature (61): n=a or g
caaatatattttaaactcattagcttaactttaaggggtatgcaacaggatcgttcttccntctcttctacatcacctccaaataaatccatctaagtcacagaaatccctctcacatagg

SEQ ID NO: 32662 - DNA, 121 bp, Artificial Sequence
  Synthesized
  misc_feature (61): n=a or g
agaaacccctctcctattttccttgaaataaaacaaaagataacaaggaatattcccaccntggaaggtgggacaacttgataccagcatgaggcacttacaccttactctcaagctaagt

SEQ ID NO: 32663 - DNA, 121 bp, Artificial Sequence
  Synthesized
  misc_feature (61): n=t or c
aaatgccctggaaacacaatgagaatatgcatacagtgggaaataaatcagctctcaaagnggcagtgatgagagtgactcaaaccagcttgaaatttgtgcagattactgcattgctacc

SEQ ID NO: 32664 - DNA, 121 bp, Artificial Sequence
  Synthesized
  misc_feature (61): n=t or c
agtggctttgtgtaactcttggaaagagctggaatccccagtcttctgattatgaagatgnctccgtgcagggtatgtacttagtcattatgataataaattatttttaaaacaaacaaac

SEQ ID NO: 32665 - DNA, 121 bp, Artificial Sequence
  Synthesized
  misc_feature (61): n=a or g
tgcacaacgcacagcaccgagcagcccgggtttcccatttattcccctattacgttccaancaggtgtgaacaatgctttatcgggcctaaaacagaatcagccacacagctatctgccca

SEQ ID NO: 32666 - DNA, 121 bp, Artificial Sequence
  Synthesized
  misc_feature (61): n=t or c
gagcagcagccacaagtttcctgaaggttgtttttaaggcttataatcgttctctccttgnttgcagcagtgttttgtgtccttttatctagcaccagccgcaaacctgccctctgcttca

SEQ ID NO: 32667 - DNA, 121 bp, Artificial Sequence
  Synthesized
  misc_feature (61): n=a or g
gtaagtgactgtgcaatcagaataaaccaaaactcattcagaaagctacggtaaatcccancaccgagcaaggtatccctcacccgggaccagacagccatttaggagtccccagtttccc

SEQ ID NO: 32668 - DNA, 121 bp, Artificial Sequence
  Synthesized
  misc_feature (61): n=a or c
cttttctccagtattaaagcaccatggtgaaacacgttcactggagcactcgagtaaacangttgacagcaagaaaggaagtctaacagggaatctgtctcttcacctttgcattctttgc

SEQ ID NO: 32669 - DNA, 121 bp, Artificial Sequence
  Synthesized
  misc_feature (61): n=t or g
aggagaggtgcccaacagagtctcttctttgttgtggaccttcatgggagcaaaatgtggncatgtaacctatccccaaggagatgctgatggtaacatcactaagtgaggcatgagggat

SEQ ID NO: 32670 - DNA, 121 bp, Artificial Sequence
  Synthesized
  misc_feature (61): n=t or g
agtctaaagtacactcttcaccttcaaactgcagccttactctataatacctgaactgctnaaaacccctgctgccaaggtctccacttgctctgtaagacatcacgtaaacagacaccta

SEQ ID NO: 32671 - DNA, 121 bp, Artificial Sequence
  Synthesized
  misc_feature (61): n=t or c
acaactacatcaggctctttgttgagaacatcttggttgcaaacagcaacaaaaagtcaanagcattgagttgcaatttgtaagcttttgggaaagggttgcctaagctagaaatgtggaa

SEQ ID NO: 32672 - DNA, 121 bp, Artificial Sequence
  Synthesized
  misc_feature (61): n=a or t
aagaacaatcctgttcataatttggaaaactcttggaataagaccatatgtagtctacagnagaatatcagtcttcttaactacttttagatctttatcttaaaattaaaaagtatttcca

SEQ ID NO: 32673 - DNA, 121 bp, Artificial Sequence
  Synthesized
  misc_feature (61): n=t or g
acctcagggctcgctatgataacattattactgattacttcactaacaaagccaaaacctnctattgcagttgttaaatatgaaagctatggcaattaatcagcatattgaaggcaacagt

SEQ ID NO: 32674 - DNA, 121 bp, Artificial Sequence
  Synthesized
  misc_feature (61): n=t or c
aggaaaggagaactaaagcaacggttgaaagcttaagggaacttttaaagtggctattcgnttagcagcaagattgatatagctgcataccagcccactccttgctatctcagggttagcg

SEQ ID NO: 32675 - DNA, 121 bp, Artificial Sequence
  Synthesized
  misc_feature (61): n=t or c
catataatttatttttcttcgtagaatgctaatacatctttagtatctccccagggacgtnggtggctggaatggaactgaacagtttttccatggtagagtcagaagtgatatattctta

SEQ ID NO: 32676 - DNA, 121 bp, Artificial Sequence
  Synthesized
  misc_feature (61): n=a or g
ggactcacagtaaaaagagaggagacaaggcaaaaattgcttcagagagaattctagctgnataaacaataagttcttcacaatgagaaaaattaaacaccaatgacatggcaaaatccct

SEQ ID NO: 32677 - DNA, 121 bp, Artificial Sequence
  Synthesized
  misc_feature (61): n=a or t
tcagaagaataaacctctcccagcatataggccactggtgagcttggacgtttgttagtanccattagcattgccacacactttgctgtctgctctcagtaccttcctgttgttccttgtc

SEQ ID NO: 32678 - DNA, 121 bp, Artificial Sequence
  Synthesized
  misc_feature (61): n=t or g
cttttggtggaggaacgcttgtatcacccttatgcttagtgttgcctcattttacaactcnattacggtgtacgttcttaaacagaactgagaaaaggaggcagatagtcttggtgtagtg

SEQ ID NO: 32679 - DNA, 121 bp, Artificial Sequence
  Synthesized
  misc_feature (61): n=a or g
catagtattttcctactacagaaaaatggaagataagttgttgaatagtcttgggattggngagcacagaagtctgcacatcctgcagcatactaaatcctttgttttgatgaagatttag

SEQ ID NO: 32680 - DNA, 121 bp, Artificial Sequence
  Synthesized
  misc_feature (61): n=a or c
gtgtaactagagtaactcacatcagctaaaatggtacacatttttaactgagaattatttnaacgtagacaacattatttttcttacctacctccaacacagagtacaggaagtccttagc

SEQ ID NO: 32681 - DNA, 121 bp, Artificial Sequence
  Synthesized
  misc_feature (61): n=a or g
gctgataataaatgggtcaacagactttggatggatagttgtatcaatccacagttcagcntagtctgaggtctgttgttcctatttgaaatcaagcagaaaagagacttcagcctaaatc

SEQ ID NO: 32682 - DNA, 121 bp, Artificial Sequence
  Synthesized
  misc_feature (61): n=t or c
cagcttttaaggccacatgctattgttttagtctgctttgtgtgctggggccagacagtcnatcccatcaaaactagtcactctgcaaacacaatgtgtctcctgttcagactgaactagc

SEQ ID NO: 32683 - DNA, 121 bp, Artificial Sequence
  Synthesized
  misc_feature (61): n=t or c
tcagctatctttgccagagtacagccttcatcctaatggtgttatgcaacacttgtggcanactgagaaatgcgaaagtgaataaataacaggaggatctgtagcagcaggatacataatt

SEQ ID NO: 32684 - DNA, 121 bp, Artificial Sequence
  Synthesized
  misc_feature (61): n=a or c
atagcgttgtgaattgtagataatgatgaaaaggccaaatgttttgtaatcaatcagtgtntgtattagacgcagataaaagtagacttgaatcacatattgcatattcttctttgcgcat

SEQ ID NO: 32685 - DNA, 121 bp, Artificial Sequence
  Synthesized
  misc_feature (61): n=a or g
aatggttgtgtgccataggtttcttggagaacttgaagaccttgctgctgcatcatgatantactgtccgacagaagacaacagaaattctctacataatggcaatgcataatgttggcag

SEQ ID NO: 32686 - DNA, 121 bp, Artificial Sequence
  Synthesized
  misc_feature (61): n=a or c
ccgtaatatagaagtagtttaggaaaataaggacgtattgattgaaattaaccagttacancagtagattgataagatggcagaagggtgatgtgatagcctttctgaaacttcctatcct

SEQ ID NO: 32687 - DNA, 121 bp, Artificial Sequence
  Synthesized
  misc_feature (61): n=a or c
tgtattaataaactacattgatttcattatgttacctgaggactccatctggtgacttttnttttctttgccagatttagaaaagctacagccctgctgtgatctattgccaaaatataaa

SEQ ID NO: 32688 - DNA, 121 bp, Artificial Sequence
  Synthesized
  misc_feature (61): n=a or c
tactacatttatatactgaggactaaggctctgtttgcactactctagcaacacaaaattnaaaaaaaatgccttaaggcaggtaagtgtgccctctgaagggaaggcctctgtatgccag

SEQ ID NO: 32689 - DNA, 121 bp, Artificial Sequence
  Synthesized
  misc_feature (61): n=a or t
tatgcatgctgcttacaaagaatgcattgcaagagcttcttagctgtaaatattttgtttnacttattctttaacccaaattgcattttaatgagagtgaattattcctttctttacttga

SEQ ID NO: 32690 - DNA, 121 bp, Artificial Sequence
  Synthesized
  misc_feature (61): n=a or g
caggctgagccctgatgtccccattgtgtccccgaggtgtccctatgctgcagtggaagcncacagccctgcgttccccaaaggatgggaatttgcctgttatgtttttcctcctttgctg

SEQ ID NO: 32691 - DNA, 121 bp, Artificial Sequence
  Synthesized
  misc_feature (61): n=t or c
acaaagatgtctggattctacgatccaggagggctcatactctccaatatgaatttcaaancttggcaccaagaaattactcttgcttttagtcagccctcaagtaagcaaaaacatcaat

SEQ ID NO: 32692 - DNA, 121 bp, Artificial Sequence
  Synthesized
  misc_feature (61): n=t or c
tttcttccccctgagaagctaaaaacatcctatttattgctgttccaggtcacttccagcntctgaaaagctttgattttagtaggtcagcatccagtaacctgttctaattgacccagag

SEQ ID NO: 32693 - DNA, 121 bp, Artificial Sequence
  Synthesized
  misc_feature (61): n=t or c
gagaagctgataagattgactgactgtgtgagggatgtagatgaacaggatttaaaactcntgaatgtttacaagacagtgaattaaatatccttgataacaaagcacacatgcatttaat

SEQ ID NO: 32694 - DNA, 121 bp, Artificial Sequence
  Synthesized
  misc_feature (61): n=c or g
ctgccctaccaccgggcacgccaggggcttcttctaactccccatcagcaaaggaaagctnagaatgctgtgtgacatctcagcacccagaaagctgtctaacgtgcaaggggaaccagaa

SEQ ID NO: 32695 - DNA, 121 bp, Artificial Sequence
  Synthesized
  misc_feature (61): n=t or c
tggatctgtaccaaaaaggccctgagtaactagaaccttactataagattagatccctaantgattactgtggttggtgatcatttgctgtgccagttaagacaaaagaagtatcttgtct

SEQ ID NO: 32696 - DNA, 121 bp, Artificial Sequence
  Synthesized
  misc_feature (61): n=t or c
cctatctgaagcatgtacctcttgtgcttatgcctatgtgaggagagctagaagagtcatntcaaagaattaagatatacttcttcctttaattgagggtttagaagcaaatagacggcct

SEQ ID NO: 32697 - DNA, 121 bp, Artificial Sequence
  Synthesized
  misc_feature (61): n=a or g
atgaaacaaagcttttcaaaaacaaaaagagagaaaagagaggaacagagaatttcctganatatttgaggcttaatttaggtttctgattggaatctggcgtgttgctctgcacgctgag

SEQ ID NO: 32698 - DNA, 121 bp, Artificial Sequence
  Synthesized
  misc_feature (61): n=t or c
actggcatgagtcaccgtgtgggaaaaggataagctgggtaattacgcaggtttactttancagttcaagagtattttgtcttttgttgggctcagggtgatttctatgtgaggggtttgc

SEQ ID NO: 32699 - DNA, 121 bp, Artificial Sequence
  Synthesized
  misc_feature (61): n=t or c
gacatttgtacagtattgtacagtaggtgcagtattagttgcattgtttcacctgggatanagaacaaaattatgctctgaacttgtgacaaacctgccttccttaataacaagtccagaa

SEQ ID NO: 32700 - DNA, 121 bp, Artificial Sequence
  Synthesized
  misc_feature (61): n=a or g
attcaaccacttttcctgataaacaatttgtcagaaaaattcctcttggctcagggagccntgcaagttatttgtcagcagccaaagccctgttgggtgtttcccatatgacttttcctta

SEQ ID NO: 32701 - DNA, 121 bp, Artificial Sequence
  Synthesized
  misc_feature (61): n=t or g
acagtaataagcctcccattgattattaccgcatgtttcatttcaaataggaagtggcatnggagaagtgaaacaaaccaacaggaacacatctagtcgtttttcagcctgtcaaatccaa

SEQ ID NO: 32702 - DNA, 121 bp, Artificial Sequence
  Synthesized
  misc_feature (61): n=t or c
aagctcacagcatagtacagaagccaatactcttgttactatcacactgatcagtatactnaaagcacacaactgaagagagaacacagcattacttaaatcatttttattttgcctgata

SEQ ID NO: 32703 - DNA, 121 bp, Artificial Sequence
  Synthesized
  misc_feature (61): n=a or g
cataattttacatatttatgtagtttaaggcatccattagtggcatgactagaggagaatnggagagatgattaagtaataggtttgttcttcatccagattatgatacaaagttgagtat

SEQ ID NO: 32704 - DNA, 121 bp, Artificial Sequence
  Synthesized
  misc_feature (61): n=a or g
gaaaagaatagatgcatgccctgccctggcccattaccctcttattcatttcagtacactncttgatttgtaactatcactccttgctcagctatttattttatggtagctcattgcaatt

SEQ ID NO: 32705 - DNA, 121 bp, Artificial Sequence
  Synthesized
  misc_feature (61): n=t or c
tctgtcactggcttacctggagagctggggcaaactgcttactctatctgaatcaaaattncctcagctgtaaaaaatggaaagagaagatactaaaactgcacaagtctcttgaaacgta

SEQ ID NO: 32706 - DNA, 121 bp, Artificial Sequence
  Synthesized
  misc_feature (61): n=t or c
ctcagtgagaaaaaaagaaaagcaaacaaattctctctctcagccagcatctcagccttgngtgatggagggaatctcttggagtggccaaaaaccttgtctgtagagagccaggccctct

SEQ ID NO: 32707 - DNA, 121 bp, Artificial Sequence
  Synthesized
  misc_feature (61): n=t or c
gcatggattacgtctgatcacaatgatagttaatcatactggaaaatgatcagaagcagcnagaagagcaccaaactaagcttaaaaaaaaggcaaatgtagtcatgagtttaactcagca

SEQ ID NO: 32708 - DNA, 121 bp, Artificial Sequence
  Synthesized
  misc_feature (61): n=a or c
acccaggggatgctttaggctgaagtgttctcactgcagcatttggatgccgaccccttcngatggataaaccgtagctctttacacttcagcaggtgggggagaacagtttattaaacac

SEQ ID NO: 32709 - DNA, 121 bp, Artificial Sequence
  Synthesized
  misc_feature (61): n=a or g
gtaaaaatgtctgtacacgtgtagtccatcacctgccttaactgctcaacaactcaccacntaaaaaaatcagacttgtctaacagaagcaccacatcccaatgttgcagttcaagggaaa

SEQ ID NO: 32710 - DNA, 121 bp, Artificial Sequence
  Synthesized
  misc_feature (61): n=a or t
cacctcatccgaaattgcttgtatacttgtattgcaaggccacatcaaggcctcatcgagnatgagaatacatgatacacataacagaagactgtctatgtcttaagtaaaacaacaataa

SEQ ID NO: 32711 - DNA, 121 bp, Artificial Sequence
  Synthesized
  misc_feature (61): n=c or g
aatatcttatatcatttgtgagacagcagaccattagggagctgatattagcctcacctgnaggcttatatgagaagacgaattactgaacgtagtcaaggtatctcttctgcacaaaaac

SEQ ID NO: 32712 - DNA, 121 bp, Artificial Sequence
  Synthesized
  misc_feature (61): n=t or c
aggtgccccctctgctctcatcccttagctggtgtgccagagctcccctttccctctttantgcctccttcaaagcttgtttcagggaaccccccaggtcgccttctcctgcattcagcac

SEQ ID NO: 32713 - DNA, 121 bp, Artificial Sequence
  Synthesized
  misc_feature (61): n=c or g
tgctacaaccatccttatcaatactgggagatcatgtgctgctacatgaaagcattggtanataaattagctagcccagaggagatggggtttggatttttgtatctggtggaagtcttta

SEQ ID NO: 32714 - DNA, 121 bp, Artificial Sequence
  Synthesized
  misc_feature (61): n=a or c
actcatcacctgactccaaaccgtgcccaacagtttatgtatacatcctgtttggatcacnttcagaggaagcattggcagttggcctacaggttatatatagctctgcacagcaggatac

SEQ ID NO: 32715 - DNA, 121 bp, Artificial Sequence
  Synthesized
  misc_feature (61): n=t or c
ctcttgtaaattctgtatgcgtagtttactatctgaatcattagggcttaatattttttgnaaacatgtttaaaagactacttttcctctctgactttatggagatcatagcgaccttttt

SEQ ID NO: 32716 - DNA, 121 bp, Artificial Sequence
  Synthesized
  misc_feature (61): n=t or c
gcttacagccccgcctgggcactgacagacagagggacagacctgaagctgattaacaccnctggagctggacccctggttcattacctccagactgtggatggagaggccctggctcact

SEQ ID NO: 32717 - DNA, 121 bp, Artificial Sequence
  Synthesized
  misc_feature (61): n=a or g
caaacacttcaaacactgggcattttgatcagtaggatagatgaccttgctcctattttcntctttatcactgctttgagtattaatgtgcagaaatttgtactgcttagtggtcagcaaa

SEQ ID NO: 32718 - DNA, 121 bp, Artificial Sequence
  Synthesized
  misc_feature (61): n=c or g
tctagtgaaatgaagactctttcatctgttcctattagtgtctagataaaagaccaagacnaaagagaggcataccaagtccaaaagtaagtacataaatttaagaactggcttttggctc

SEQ ID NO: 32719 - DNA, 121 bp, Artificial Sequence
  Synthesized
  misc_feature (61): n=a or g
gcagttttaactgtgtgacccgcagtcggatcataaccaaagaacatgacaatatccaggntgatgcaatacttttaaataccatttgcagacaggcgtctttaatggatctctctggagt

SEQ ID NO: 32720 - DNA, 121 bp, Artificial Sequence
  Synthesized
  misc_feature (61): n=a or c
cactgtaaagaaaacatacagatatgcagagaaaataggagacatttcaggagccaacctnctgctgcttcacccactgatgcatcaaacctgactgtaatacctgaacactgcaccgcat

SEQ ID NO: 32721 - DNA, 121 bp, Artificial Sequence
  Synthesized
  misc_feature (61): n=t or c
tagtatcaaaaagcaactatgaagtgatgctggcctcttcaaacagcataacaatcacttnggccaatctttttcaaaacaaaaatccatattctcttgcaaatggcagtaccttgcattt

SEQ ID NO: 32722 - DNA, 121 bp, Artificial Sequence
  Synthesized
  misc_feature (61): n=a or g
aaccaaactcataccttaatgcagctgacaaatcacagataatatttcataatctcacacnctggcaaaatgtagagatcaatatggaaaaaaaaaaatccatgtcacctaataatcatta

SEQ ID NO: 32723 - DNA, 121 bp, Artificial Sequence
  Synthesized
  misc_feature (61): n=a or g
caagagctctagcactctgaggatgttatttttctttactcaaaagcttggtgtttgccangctacagtgaggtcagacgtctgcctgacaatgtgcaaaggaagcagcagttgccatctt

SEQ ID NO: 32724 - DNA, 121 bp, Artificial Sequence
  Synthesized
  misc_feature (61): n=a or g
gattccatttcctctgacctattacctgcccttcttgttcatttttcttccataagacttntagaattttttataatataatttaattaatgtccatgtaggtatttggttttctaatgtg

SEQ ID NO: 32725 - DNA, 121 bp, Artificial Sequence
  Synthesized
  misc_feature (61): n=a or g
caagaccttgcctgagttactgaagctgcagaggtccccagacatgttgcttggatatgtntgccattgctctttatgtaacactaagctggaggatctttctgaccttccagttatgtag

SEQ ID NO: 32726 - DNA, 121 bp, Artificial Sequence
  Synthesized
  misc_feature (61): n=t or c
caaatggaatacattagcattagttattctaataatcattaggaattttcagatgatagcngtctcctaatcacagctggtccccatctaagtactcctggtgccatcatgttaccttttt

SEQ ID NO: 32727 - DNA, 121 bp, Artificial Sequence
  Synthesized
  misc_feature (61): n=a or g
actgtgtactcccatcggtatgtctgtatgtggaacaattaagactgtatgttaagaaatncaagcacttctctgtagtttttttcttttctcattatatctttgagaagttcgccattga

SEQ ID NO: 32728 - DNA, 121 bp, Artificial Sequence
  Synthesized
  misc_feature (61): n=t or c
gctgccctaatatgaggggacctatacggaagaagttgaaaaggtaaatcaaagatcattngatcactaagttaataaaggtgatctcaaggctgagaattatatccttcagcaaaagcaa

SEQ ID NO: 32729 - DNA, 121 bp, Artificial Sequence
  Synthesized
  misc_feature (61): n=a or g
acttttcagcttgtctttcttcctgcccatctaggctgggcacttgtgtatctgtatgacnttcctcagtggttttacaagtgcattagcacatggtactggtattattcagcatataaag

SEQ ID NO: 32730 - DNA, 121 bp, Artificial Sequence
  Synthesized
  misc_feature (61): n=t or c
aactcagagaatttgattgtcttcactagcaataacctaggaagatgaagtttatacttcnctggaggaaaaagcctacatttaaaaatcctagctgattttgaagatactgcttcaatta

SEQ ID NO: 32731 - DNA, 121 bp, Artificial Sequence
  Synthesized
  misc_feature (61): n=a or t
ttttgtgctgcgagagagaactgctcatttttagacactggttatgtggaatgtacttatntttggcataaagtggtaaggaaattgtgaaagcgggggtgtgcagggattcacagttgaa

SEQ ID NO: 32732 - DNA, 121 bp, Artificial Sequence
  Synthesized
  misc_feature (61): n=t or c
caacgcataacgtgagggttgggcaggcacattgacagtacatgctcctatgtacccttgnatctactgaatcacagactcacagagtggtttgagttgaaaggaactttaaaggccatcc

SEQ ID NO: 32733 - DNA, 121 bp, Artificial Sequence
  Synthesized
  misc_feature (61): n=a or g
tgccttcgcattaatttaatttatgccatttgctaaataagtgtcaggccctggtgattcntgatagctaggattttccttgacctcccttcccccttgctttgccttcctgtgcctagac

SEQ ID NO: 32734 - DNA, 121 bp, Artificial Sequence
  Synthesized
  misc_feature (61): n=a or c
cccacggctttccatttgggaatcagcatcctcgggtgggtgtccggccgaattctgtgcnttgcttcaatcagtgaaggggagcctgcagctcagcaaggtgcacagcacagagcccagc

SEQ ID NO: 32735 - DNA, 121 bp, Artificial Sequence
  Synthesized
  misc_feature (61): n=t or c
aataaaggtagacagaaaaaaatcttccatgatatgtggattgaatcttgaatttcattgncattgtgttgcttttcaggagtccttcattttattttgctgtggcaaggactgggcattt

SEQ ID NO: 32736 - DNA, 121 bp, Artificial Sequence
  Synthesized
  misc_feature (61): n=t or g
aaacaaagtgaaaacggaaagatatccttaaaaatactaagaactacggctttattcaccngtttgcactgtcatttttgattgcaaagctgtgggtggatctgtgcctacagaaacgtta

SEQ ID NO: 32737 - DNA, 121 bp, Artificial Sequence
  Synthesized
  misc_feature (61): n=a or g
ttctgattttgaacaaggacgggggaaaaaaaaagaatgaaaaagctataaaattagatgngcatttttataaatttccaaattggaaggctgcagagctaagtagatcatataaatgcca

SEQ ID NO: 32738 - DNA, 121 bp, Artificial Sequence
  Synthesized
  misc_feature (61): n=t or c
aagacaaaccctgtaaaatcaaaccaagaaaactcattttcccatctgctttcaacctttncctctttgtcctggatatttgtagcaaaggagacaaaatcccatcaagcattcttttaag

SEQ ID NO: 32739 - DNA, 121 bp, Artificial Sequence
  Synthesized
  misc_feature (61): n=a or g
cgatgaaaaacagctaggagttgtttttgtaggtgggttcatggattaaagatcaactgtnaattgaaaggagtattaagttcacattatattttgttcctttttggaaaccattacctgg

SEQ ID NO: 32740 - DNA, 121 bp, Artificial Sequence
  Synthesized
  misc_feature (61): n=t or c
cctcagtcaggagcacaaatcaaaacagactttcaggcagaaagttgaagagatgatgttnaacatggttctgctttcctaaagcagctgtctttgccttactccagtctctatcctacag

SEQ ID NO: 32741 - DNA, 121 bp, Artificial Sequence
  Synthesized
  misc_feature (61): n=a or g
ggcatgcatcttttcttggcagaaaaagaacagttttgatttacaggcagaggtgatgcanttgtacgtatagtttatgtttattccactggcctatgtcccatcactgtatgacctcatt

SEQ ID NO: 32742 - DNA, 121 bp, Artificial Sequence
  Synthesized
  misc_feature (61): n=t or c
gccacaatctctagcccctctaactgtgatcttggagcaaaagaaagtgtcgttctgattngtggcagttgagtcagtaaaacagcatgacttggcatctagttatagaaaaggctgggga

SEQ ID NO: 32743 - DNA, 121 bp, Artificial Sequence
  Synthesized
  misc_feature (61): n=t or c
tttttcattatttgtttgctttgagtcagctgctctcttacagcattgccatgagtaaagncttcagccaggtttttcacaaataatgctgctttgtgtctggtgagactcaccactggaa

SEQ ID NO: 32744 - DNA, 121 bp, Artificial Sequence
  Synthesized
  misc_feature (61): n=a or g
gatgtggatgctgcagcgggatgggtgcacccaggacacacagcagtcggacacaacccangacttcagatcactcacagtcccttttcttttttggccctttttgccctcattctccctt

SEQ ID NO: 32745 - DNA, 121 bp, Artificial Sequence
  Synthesized
  misc_feature (61): n=t or c
actccgttcacatcatgttcagtatcatggcctgtcagacctgaaagttctgcttatgtgnccagatatcaaaaggaaaaagtagaacactgagcactgtagtacagtgctgcctcctgta

SEQ ID NO: 32746 - DNA, 121 bp, Artificial Sequence
  Synthesized
  misc_feature (61): n=a or g
ggatcagcattacaagcaagctaccactacccagcatttccatgctatccaagtgaattgngacttacctttgcacctcttggaccaggaggtccttctgggcctggaaacccaggcagac

SEQ ID NO: 32747 - DNA, 121 bp, Artificial Sequence
  Synthesized
  misc_feature (61): n=a or t
cagcatagttagataaacaaagaataaaatagtgttaggagaatacaatttacatagtagnaacctggttgattacaatgtcagctgctgttcttttatttatgaaattaaatagtcatga

SEQ ID NO: 32748 - DNA, 121 bp, Artificial Sequence
  Synthesized
  misc_feature (61): n=a or g
agtgaagactgcagggggtcctggggtaacttccatgatgtgcccagggtcagcagagccnagctcttgtcatgcagacgtgttcaggccaaagtttgggggtgtgctatgtcttgtgagt

SEQ ID NO: 32749 - DNA, 121 bp, Artificial Sequence
  Synthesized
  misc_feature (61): n=a or g
agtgtaacagaatgttttgtggtggaacatttacagaaagagcatgtggaaaaaattatcnctgcatgtattaagcacaaagaaagcatccctgtgctgccgtgtaggagcaactgacaaa

SEQ ID NO: 32750 - DNA, 121 bp, Artificial Sequence
  Synthesized
  misc_feature (61): n=t or c
gaagtgggctttgtcttctcttcgaacaggaccttaggaacacctgcatatgtatataaantaccatagctgaacatttctactcaattcatagatgtcaaactgggtgatttaatacgtt

SEQ ID NO: 32751 - DNA, 121 bp, Artificial Sequence
  Synthesized
  misc_feature (61): n=a or g
agtaattactgtagttcatgtcatacagatctttctgaggtattctggtgattcatttgcntactgagacaatcctgatctttaattggtaacttgttcttgtatgttctggaattaaatc

SEQ ID NO: 32752 - DNA, 121 bp, Artificial Sequence
  Synthesized
  misc_feature (61): n=a or g
gcatcgatccatccctgctcctcacctgagctgagcactgctgaattaccaacagcaaatnaaagccatcctattgcctttatgtttttctcgctaagaaggtgcttaaagaaaagtcatc

SEQ ID NO: 32753 - DNA, 121 bp, Artificial Sequence
  Synthesized
  misc_feature (61): n=a or g
ctgaatgacctattgtataagctgaactgttgttaattactctcaacaaaatgtggctgcntttaatggatgagggaattgggtcttattttgctgaagacatcctgtatgtttgttaggt

SEQ ID NO: 32754 - DNA, 121 bp, Artificial Sequence
  Synthesized
  misc_feature (61): n=a or g
cctactcgcaatctcttgacaccaagagatgctttcattatcctatcccacatgaacatgnggcatggtggaatagttgtggtccctgccccttacatcctcctcagcatccaagacccac

SEQ ID NO: 32755 - DNA, 121 bp, Artificial Sequence
  Synthesized
  misc_feature (61): n=a or g
gtattacaatcacaaattgcagagcagaattattcacagtatattttctatcagaaggganatagttgatttaaatattacaagcagagtgctcaataagttgtatgagtaaggatacaat

SEQ ID NO: 32756 - DNA, 121 bp, Artificial Sequence
  Synthesized
  misc_feature (61): n=a or g
agtcaagcctgagggaattctcagcttctcataacccaaactgtaaaaggagattattacnaagtttctattttgatttttgaattggccgtgagtgcagttgatacacagttaataccaa

SEQ ID NO: 32757 - DNA, 121 bp, Artificial Sequence
  Synthesized
  misc_feature (61): n=t or c
gagacaaatgttctaccttagggaagtcaaaacaattttttactcctagcttcaccattgntgcaagctcaccctcagatcttttctagactagggtcacatgccttgagctcatactcac

SEQ ID NO: 32758 - DNA, 121 bp, Artificial Sequence
  Synthesized
  misc_feature (61): n=a or t
ttaacagcacctaatcaggacatttgcctcagtggtgcaaaatgaaaatgttgatccttgngtttttcctgcctggagaaataactccttcagcagtgaatgagagctacttgtaatgtca

SEQ ID NO: 32759 - DNA, 121 bp, Artificial Sequence
  Synthesized
  misc_feature (61): n=t or c
atagaagcacactatgccaaacagatttgttcaagctcaccatggttctgatgggctacangcagcacgaggcaattcaaaaaaagcacacaactcaattcattggtataactacactggc

SEQ ID NO: 32760 - DNA, 121 bp, Artificial Sequence
  Synthesized
  misc_feature (61): n=t or c
tctaattattactattaatgtttccactttacaaacatgtgaatgagagtaatcagccttnctcctcagttctgctcaggatcagaaaagcaaagctttgccaagcagccagggtcagcac

SEQ ID NO: 32761 - DNA, 121 bp, Artificial Sequence
  Synthesized
  misc_feature (61): n=t or c
aaaatacaccgtcacttcttggagcacttaacatctccagtagacagaaggactgaagccngggtttttgaaggtacttaggtgcttgactcccactagaactgaattagacccaagtacc

SEQ ID NO: 32762 - DNA, 121 bp, Artificial Sequence
  Synthesized
  misc_feature (61): n=t or c
aaaggtcagcttctcgtctccacctggtgcaagcccaaattcgggatacaccatccatccnccctcctcctctggtaattgcaagttttagggaagctctctgcagagaggaaagctcagg

SEQ ID NO: 32763 - DNA, 121 bp, Artificial Sequence
  Synthesized
  misc_feature (61): n=t or c
ctgtgctgggaccactgctcagcaccagcctcacacttccaccctcattttctcttttggntctgacctaaactggtgacagctttgggacaaatgatgctctcatatgtccatcaaaact

SEQ ID NO: 32764 - DNA, 121 bp, Artificial Sequence
  Synthesized
  misc_feature (61): n=t or c
gaggagaatctggaattagaagtgaggctggagatgtaattttgcctacctttttacttgnatttattcttctgacttgttatgaaagctatggttgcctctactcaagaaatatctcatt

SEQ ID NO: 32765 - DNA, 121 bp, Artificial Sequence
  Synthesized
  misc_feature (61): n=t or c
tgtgagttttattgataaagtgggaatttcatctttgatcatgacgcagtttgatttcatngggctctgtgcagtaaatcactttacaggagccgacacagctttctgtatcattgatgaa

SEQ ID NO: 32766 - DNA, 121 bp, Artificial Sequence
  Synthesized
  misc_feature (61): n=t or g
cccagctccacaggaggtattttattcacaaaatatttaaaatgtgtgccccactgaacanttctacatctaatattgctcctctgctgcaacaggctcttagagacaggggaataaacta

SEQ ID NO: 32767 - DNA, 121 bp, Artificial Sequence
  Synthesized
  misc_feature (61): n=a or g
gtgattttaacactccactgttttaacagttaagctggaaggcagtcaaaggatagtgaangagtttgttgtgcatttaatgctgtgaagtatccatcagggaaatcttaaaagatttttt

SEQ ID NO: 32768 - DNA, 121 bp, Artificial Sequence
  Synthesized
  misc_feature (61): n=a or c
agtctggtaaaagtccaacaagtcatttaggcataaacttaatttcaaccttgtgcctagntctactgaactgactgaagttaaacaaatgcttaaagcattttactgactcagttgcaac

SEQ ID NO: 32769 - DNA, 121 bp, Artificial Sequence
  Synthesized
  misc_feature (61): n=t or c
ataggggcatctcgtaaggtagtgatgattctcactgtgaaccttatagaatcacttgcancaatattagcagatatggaagcaggctttaatggctactttggcctcaaaatttaagagt

SEQ ID NO: 32770 - DNA, 121 bp, Artificial Sequence
  Synthesized
  misc_feature (61): n=a or g
ataatgtaccatgccaggagtacatgtatagaatggtatacatttcctttccttatccagnagacagaagtccttagctagttttctcaggaaaacaacatttgtatatccctgatagagc

SEQ ID NO: 32771 - DNA, 121 bp, Artificial Sequence
  Synthesized
  misc_feature (61): n=t or c
tgaatgcaggtatttactgaggctgttattttgagatttagttagaataaaatggaagtangttccatctatctaatgcttgagcacatacatttctggcagatggacttctagtgcatca

SEQ ID NO: 32772 - DNA, 121 bp, Artificial Sequence
  Synthesized
  misc_feature (61): n=t or c
atctacgtaatgcaaagcatggtatttcaaccatataaggatagaaactagtatttcaaangcacatatcttaataaaagcattcaatctcaacagaatgactacatacaatgcatattct

SEQ ID NO: 32773 - DNA, 121 bp, Artificial Sequence
  Synthesized
  misc_feature (61): n=a or t
tctaatgtagaagactacatcaagggcaaaatcatttcccaccagcctggctgttgtctangttgatgagactaactctgtgaataggtgaaaagcagttataatattgaaaggcattcaa

SEQ ID NO: 32774 - DNA, 121 bp, Artificial Sequence
  Synthesized
  misc_feature (61): n=t or g
ttctggtggctgtgatcctcctctgtggtcacaaagagcaaatattcacctgcaaaattgnccttgtgtgcagtaggattctggtgggagtgggttttgtgcccatagctagcaggtaaac

SEQ ID NO: 32775 - DNA, 121 bp, Artificial Sequence
  Synthesized
  misc_feature (61): n=t or c
catatttttcctgccttggtagggctaaagatatcgaatttcaaagctgtgatattttcangtgaattggtattattttaggtcactttgggagctatctgaatattttaattgtggtgta

SEQ ID NO: 32776 - DNA, 121 bp, Artificial Sequence
  Synthesized
  misc_feature (61): n=t or c
tgcagttactgtgctttcaattaccatgctatatgtacagctcttttcatcttagctaagngttagctgtctgaatttctttgtgctggttttgtacgtgaagcaacattgttttgggtaa

SEQ ID NO: 32777 - DNA, 121 bp, Artificial Sequence
  Synthesized
  misc_feature (61): n=a or g
cggtgaagatgagctgatcagcttatggtagccgagggaggggggaagagaaagctaaagntactcattaaaatcttttcagctaaaacatcagaactccccaaactgctctcatgtggac

SEQ ID NO: 32778 - DNA, 121 bp, Artificial Sequence
  Synthesized
  misc_feature (61): n=t or c
atgccacacacacacagaagcatacatggatgagagtacatacatacacacctgttgctcngagcatcgggcaccgtttctcattcagacgtgtccttagtctggaaaaaaatacaaaaca

SEQ ID NO: 32779 - DNA, 121 bp, Artificial Sequence
  Synthesized
  misc_feature (61): n=c or g
caggtacctatggctgtgcttgtcagcatttataacttttacgagaagacatttcttcatntgttgcccttcacctgagatgtgagattgacaatttacctggttgttggaagtcgtttgc

SEQ ID NO: 32780 - DNA, 121 bp, Artificial Sequence
  Synthesized
  misc_feature (61): n=a or g
aagcaaatgtcatgacttggtaacatctgtattgtcaaacagaaggaagaatttctaacanataatctgggatgatctccataacgtatctggggatataatttttatttttttatttttt

SEQ ID NO: 32781 - DNA, 121 bp, Artificial Sequence
  Synthesized
  misc_feature (61): n=a or g
cctacttttaattgtggcttcatcagagtgtgaataagagcatcatggcaatgggtcaaangtcgacagccaaacggtcttttgagaaacttcctttttactccaatgcattgagaatgtc

SEQ ID NO: 32782 - DNA, 121 bp, Artificial Sequence
  Synthesized
  misc_feature (61): n=t or c
ggattgctttgcagagaggttctaaagcacatctttataaaacgctgaaatgcgtttgcantgagatgtggttttcacttgcccgtgttctggtctcccactcctgcagcccccatgctgg

SEQ ID NO: 32783 - DNA, 121 bp, Artificial Sequence
  Synthesized
  misc_feature (61): n=t or c
accagggtgccccagaacttgttttagctgtgtgttcaatgaatgtaattgactatagtcngtgccttctaactttgcatttccagaccttccaaattaaattagttttagtaagttggtg

SEQ ID NO: 32784 - DNA, 121 bp, Artificial Sequence
  Synthesized
  misc_feature (61): n=t or g
agtgaacctcagacatttatgtgcttttgcaaagtgtagtacaggctttcgggaatcctgngtcactctacaagaggagatacagtgactagtagaggtttcctaggacatcccaattgca

SEQ ID NO: 32785 - DNA, 121 bp, Artificial Sequence
  Synthesized
  misc_feature (61): n=t or c
atctcaacaccagttctctccattgacgccgagagctcccgcagccagtgctgctccaacngaaccttccctagaaccttttaatgccgacgttacccggtgtcctacactgagggaccag

SEQ ID NO: 32786 - DNA, 121 bp, Artificial Sequence
  Synthesized
  misc_feature (61): n=t or c
aagtgggcatggcttgttagtgcttgctaacttgaaaaaagggagttgtttccatagttangacttcttcaggtattgcccattgagttggacaaatcttaggttgtcactaatccctgtg

SEQ ID NO: 32787 - DNA, 121 bp, Artificial Sequence
  Synthesized
  misc_feature (61): n=t or c
agtgaatgggcaaagtgaattccaacagagctgagacatccatcttcagggtagctggcangggaaggcatgaggcatgtgtatctaaagacaaaaacaattgaagactcttaagcaattt

SEQ ID NO: 32788 - DNA, 121 bp, Artificial Sequence
  Synthesized
  misc_feature (61): n=a or t
agtacaaattactcgttggtagccacattcattcccgaggcttttcttcatgctgctctancaggaaggaatggcagaggaacaactcacttgtttctgggcagtgtcctgtattctccgt

SEQ ID NO: 32789 - DNA, 121 bp, Artificial Sequence
  Synthesized
  misc_feature (61): n=c or g
caacagtaaaaataagccatattttaaaatctcaaaagtagagttaattgttctttacatnttgggaaagagcagcagcacaagtagtagggaagtactgctttcattctttcttcaattt

SEQ ID NO: 32790 - DNA, 121 bp, Artificial Sequence
  Synthesized
  misc_feature (61): n=a or g
cagtgtatcattagccgtaatgcacaggatatttatgtccctgaagaactgtgtgctagantttgttaataattcaagactcgtatgctgagggatggaataatgtctaatgatcctttga

SEQ ID NO: 32791 - DNA, 121 bp, Artificial Sequence
  Synthesized
  misc_feature (61): n=t or c
catctgaataccgcccatccttatgacaggttagactgaaaactcacagcatgtctgaatnctgatcgcagttctgtggcttgaatccatctctaatctgaacaactaaatggatggttcc

SEQ ID NO: 32792 - DNA, 121 bp, Artificial Sequence
  Synthesized
  misc_feature (61): n=t or c
aaagtaggttttctttgaaacgcctttgaaaaacaagaaaaacatcctttcccactacttnccaatgtaaccacattcagcctataaaagagtaatcttagtacatagcagtcttttgagt

SEQ ID NO: 32793 - DNA, 121 bp, Artificial Sequence
  Synthesized
  misc_feature (61): n=a or g
ctctaaattccacaagttggtgtagtcttgaccacggggcaggccttattgtcatagttancatcttttattgtgtgattaaatgatcatttgatttgggttaatagagcaagaatataat

SEQ ID NO: 32794 - DNA, 121 bp, Artificial Sequence
  Synthesized
  misc_feature (61): n=c or g
cacaaagcgcaacatattcagtctgacaggaagcacagtcagccagtgctcctgacatcangataacttcagcagtaaggaccacttgcataacattgtaggtcagtcaattgcaacaaat

SEQ ID NO: 32795 - DNA, 121 bp, Artificial Sequence
  Synthesized
  misc_feature (61): n=a or g
tctttgcagcctaccagtttgtgtctctcatttcccagcccactttcttctaccttctctngttcttcttcctccatccttatggatgggcagagtgctttgttgtgacgtgctcatatat

SEQ ID NO: 32796 - DNA, 121 bp, Artificial Sequence
  Synthesized
  misc_feature (61): n=a or c
tttctttttttttttttttagtgcaaaatattagtactccttctggcttagtctttagccnagtactcaatttctacctggagtgtgtgtgtttgtccttttaggttatgtcctctagtaa

SEQ ID NO: 32797 - DNA, 121 bp, Artificial Sequence
  Synthesized
  misc_feature (61): n=t or c
cagcctggggttaaggtctgccaggaattgagaaaggaggagatttctgcactgatcttgntgaagaagaaaatgattctgaggtgtaaacctttcgagtagttaggtctaaactaaatgt

SEQ ID NO: 32798 - DNA, 121 bp, Artificial Sequence
  Synthesized
  misc_feature (61): n=t or c
gagcaatcctgtgatcctgtatttcttcttaattggtcctgaacaaaaatcttctgagctntgttaggcactgtaattacagtagaccagtttttccatattaccaagttcaaatccagac

SEQ ID NO: 32799 - DNA, 121 bp, Artificial Sequence
  Synthesized
  misc_feature (61): n=a or g
aatttttaagcattcaaaagcttttctctcagcatttgtctttacagtttcaaagaagctntatattttgctttcttctcatacctcaataaataaattagagaacatgctaaaatatcat

SEQ ID NO: 32800 - DNA, 121 bp, Artificial Sequence
  Synthesized
  misc_feature (61): n=t or c
ctctcccccatgatatttcaggatctgtgtttttcattgcaaggcaaattctagaaacctncacataggcagaactgataaagaagttgaagaaaagagctttcctctatttaatgcattc

SEQ ID NO: 32801 - DNA, 121 bp, Artificial Sequence
  Synthesized
  misc_feature (61): n=c or g
actctgtgaaagaataaatactatgtcaaaaaaatcttgaattattgtcttaatcgggtanagactgatgggtttcatagattttgtcttttgtgggaaatctccctaactgcaagttaat

SEQ ID NO: 32802 - DNA, 121 bp, Artificial Sequence
  Synthesized
  misc_feature (61): n=a or g
ttacatttaattgccttttttattcatttggtttggcacgattaaattaactgtgtaattntttaagaaatttaagatgtagcctctctaatatgaacttggcttcaacatccgaaattct

SEQ ID NO: 32803 - DNA, 121 bp, Artificial Sequence
  Synthesized
  misc_feature (61): n=a or g
cagggaggcttaaggtaagtttggctgaggttttgacatacaactagatgcttaaatgatnttcaaatgtgtaaaacttgaggtaaagaagggtattaaagcacatcagttgtaacactag

SEQ ID NO: 32804 - DNA, 121 bp, Artificial Sequence
  Synthesized
  misc_feature (61): n=a or g
tttatttctgaattctcttatactctgctgacttggtctcaatcccttgcagttccaatcnaaagcagcaaggcccaaaattctgatgacattttcctgtatcattgtgggccataatatt

SEQ ID NO: 32805 - DNA, 121 bp, Artificial Sequence
  Synthesized
  misc_feature (61): n=t or c
aaaagaaaaaaaagcctcgttttctttaagtgccaaagtggtttgctcagtaagtctgtcngtctgtcagatcacattggtccatgctgagcgttgtggtgccattggcaaagccattgca

SEQ ID NO: 32806 - DNA, 121 bp, Artificial Sequence
  Synthesized
  misc_feature (61): n=t or c
tacttctttcctaggaccttcaagcattcaaacagatcttgcttgtactgaatgtaagtcntcctgcttattctctttcctatgcttcccctttatatatatatatgtatatatatacata

SEQ ID NO: 32807 - DNA, 121 bp, Artificial Sequence
  Synthesized
  misc_feature (61): n=t or c
ttttttccagtacctgtgaagttgggtgagtgtcattggactgaatgatttcatggtcgangtgctttgcagtcttcaaggctttaccatttctcactttggttatggtcagcctaatgtt

SEQ ID NO: 32808 - DNA, 121 bp, Artificial Sequence
  Synthesized
  misc_feature (61): n=a or g
catttgtcatttatgtgtactttgctgagtttctcaggcaagctgaaacaaaaccctcaanccaaacttttctcacacctccctttctgtttactctcagtatgtaatcatacaccttact

SEQ ID NO: 32809 - DNA, 121 bp, Artificial Sequence
  Synthesized
  misc_feature (61): n=a or c
cttggcttccagcacagtcttgctgatgctttcattgctttttggcagatgggatggtgtnttccctggaaatgtctgtcttttccctaagtggctacaccttgatgaatagtttgttctt

SEQ ID NO: 32810 - DNA, 121 bp, Artificial Sequence
  Synthesized
  misc_feature (61): n=t or c
agttgagcaggaagttgttatccagctattctgattgtatttattagaccaaaaacgactngattctattggtccaaaccaatgtcttttacagtgagggtggtgaggcactggcacaggt

SEQ ID NO: 32811 - DNA, 121 bp, Artificial Sequence
  Synthesized
  misc_feature (61): n=a or g
atccaccgctgtagctctgccccgaactgttatttttgtctcggtgcattttttacagccncattctacagcaactttagtggggagcgtgtacccatcgcacaagatctctctcacttcc

SEQ ID NO: 32812 - DNA, 121 bp, Artificial Sequence
  Synthesized
  misc_feature (61): n=t or c
ttcctttaactaagccaattcaaaatgtgcaacaattataaagagatgggttcagatgagncaatttgtctcgagtgttttctagctgaacttaataatatcggagatgtgagagaaattg

SEQ ID NO: 32813 - DNA, 121 bp, Artificial Sequence
  Synthesized
  misc_feature (61): n=a or g
tacaagcatgccaaagctgcttcattaataatgctacctgaagattttccttctcccctcngggctaagctgtgtcacacactttgtttaaaaatataaaacagtattttcaagatgcttt

SEQ ID NO: 32814 - DNA, 121 bp, Artificial Sequence
  Synthesized
  misc_feature (61): n=a or t
tatgagtgcctctcattccaatggaagagagtgatcccttaaagcattaaaaggtatctgntcttttagggggatgtatgttgagacatccagaggggtctaatgcaaggaagcacgcacc

SEQ ID NO: 32815 - DNA, 121 bp, Artificial Sequence
  Synthesized
  misc_feature (61): n=a or g
gtcccctgggaacctaagagccatccaaagaacatcaggctcctgttctgcacagcacagngatgcaggtttcaacaccagggacagatgggcattgctgcatggcttcccgcgggcgatc

SEQ ID NO: 32816 - DNA, 121 bp, Artificial Sequence
  Synthesized
  misc_feature (61): n=t or c
tcttgtccaataatgctgcctaaaaccagaacattccattgctttatgagttgcagtctcntcctatgtatgtctgtgatatcacctactgaccaacccattggtgagatgttcagggtgt

SEQ ID NO: 32817 - DNA, 121 bp, Artificial Sequence
  Synthesized
  misc_feature (61): n=a or g
actactgcatcttggcttatacagcagtttgagacaaggagttgaggtacacacttcagcnggcttttccacttaatcacacagatcttactgcagactcctcagcccatctcttgtttgg

SEQ ID NO: 32818 - DNA, 121 bp, Artificial Sequence
  Synthesized
  misc_feature (61): n=t or c
cttttgcaaacagtaaacagaatagaacagacactatcagttcagacttagctacaaaganaatcatacaggtctctattcccctgtggctttgtaagaatctctctttcagactgaagga

SEQ ID NO: 32819 - DNA, 121 bp, Artificial Sequence
  Synthesized
  misc_feature (61): n=t or c
agggatgtttcctagttaatgggtctgtttattaactggttctgtctgttgtggcttacantgtgtttggtatttttgcactgaatctggctattttttttagcaacagactcaaaattaa

SEQ ID NO: 32820 - DNA, 121 bp, Artificial Sequence
  Synthesized
  misc_feature (61): n=t or g
agaaaccgcagaatgggagaagcttcttactctgctcgcaagctaatttgagtgaggcagngctacagtaggaagcttccacagaggatggttctcaaagcaacagcagcagagcagtggt

SEQ ID NO: 32821 - DNA, 121 bp, Artificial Sequence
  Synthesized
  misc_feature (61): n=t or c
ctactacttaggcaatttttttaatatcacagttaggcttctaaggacctagcctaaacancatgaagtcaataggaaaactgtttatgacttccagagccttaggatcagcactgcagtc

SEQ ID NO: 32822 - DNA, 121 bp, Artificial Sequence
  Synthesized
  misc_feature (61): n=t or c
aggtcccaagaaatttcagcagtatagaatcccgcctgccaagcgcagaggagcctggaangtcaatcccaccccactcctatcaacaccgaggttagatgggctcctggctctaagcctc

SEQ ID NO: 32823 - DNA, 121 bp, Artificial Sequence
  Synthesized
  misc_feature (61): n=c or g
atagagttacctgatcaagtctgaaaggaggccttgctttgtatctacaaatagtggctgnttactcattgaatctcacctcagttgggacatgttttgttttaagtgtggaagagtaaaa

SEQ ID NO: 32824 - DNA, 121 bp, Artificial Sequence
  Synthesized
  misc_feature (61): n=t or c
tatatttgctgcctaattttgaaaatttacgtcaaaatggagaccagagataatctaaggncataataaaatatccttacattagggaaaatacacataggttagggcctttgcgccctcc

SEQ ID NO: 32825 - DNA, 121 bp, Artificial Sequence
  Synthesized
  misc_feature (61): n=t or c
attggagaaaacttctgccatgtgacatacataccagaaccactgctgatacttctccaantctttcactttaaccaaatttgagaataggtgaatttgatatgatttcattgctcacact

SEQ ID NO: 32826 - DNA, 121 bp, Artificial Sequence
  Synthesized
  misc_feature (61): n=a or g
agattcagctgtgccagtagatctgctaaaaaccgcaggcgccagcaaaaagcttttaaanccatttcacctctctcacacatatcaaaatgccaaaacaagggacaaacactacatagat

SEQ ID NO: 32827 - DNA, 121 bp, Artificial Sequence
  Synthesized
  misc_feature (61): n=t or c
ggggtttccaagcctgcatcacgtcccttcacacctgctgcggtctgttcacatttaacantgagcagagcgtgtgagcagtaacaaatacttctctcagtgtattttgtgtctcctttgc

SEQ ID NO: 32828 - DNA, 121 bp, Artificial Sequence
  Synthesized
  misc_feature (61): n=a or g
gatatacagtgtgaaacgctgtttccacgctgtatttctctctgtttctacaacttcagcnctcagtgtgtgatacattcctgcatccatagcacctccccacgctgtgagaacacagtgc

SEQ ID NO: 32829 - DNA, 121 bp, Artificial Sequence
  Synthesized
  misc_feature (61): n=t or c
aagtctggaggaaggctttggaaaggagcgaccatggacatcccagatggctgagcttgcnatcgcagtccagtcctaccttccctatctgtgcaatatcattatcttcacagcaagagga

SEQ ID NO: 32830 - DNA, 121 bp, Artificial Sequence
  Synthesized
  misc_feature (61): n=t or c
taaaatgaaagctgatctcatgtttccttatcaaaatacaattcttactggacgttaacanaaagcctactcaaaataacattttaaagttaaaatacatattttagtctattcttaaaca

SEQ ID NO: 32831 - DNA, 121 bp, Artificial Sequence
  Synthesized
  misc_feature (61): n=t or c
tggacactactaagaataaaagttgatccctgttccttgattagaagaagagagcctgtcnagctcaaatagtttcctccagatgctccgttccttgtcctgaatgtgaacagaccttgtt

SEQ ID NO: 32832 - DNA, 121 bp, Artificial Sequence
  Synthesized
  misc_feature (61): n=a or g
ttaactgaactgtccagacatgtaattaatgtcaaaagtcagctgaagcctttcctggacntaacttacactgttagatttacatggtcaggctcaacagtggttaactggacagaatcaa

SEQ ID NO: 32833 - DNA, 121 bp, Artificial Sequence
  Synthesized
  misc_feature (61): n=a or g
actgcaggcagctcagagcgtggtgtgagaagggagaggggaaatgcagctgagacaaacngggattaaagcactcttaatttggtggtgggacatcagcagtggcgagaggttccccttt

SEQ ID NO: 32834 - DNA, 121 bp, Artificial Sequence
  Synthesized
  misc_feature (61): n=t or c
aaccttttgctaatccccaacctgacactgtcactaggcctgcttgtgctcaaggaccacntggactatgcatggtttggatctgaggttgccctgtgcagagtcaggagttggaccggat

SEQ ID NO: 32835 - DNA, 121 bp, Artificial Sequence
  Synthesized
  misc_feature (61): n=t or c
gcagctcagtgttcaagtactacagcgcccatctggatggggctgaacacaaactgggatnacaatgcacccgcagtgtctgaaagcaaagcttaacgctgccccttttcaccagggcatc

SEQ ID NO: 32836 - DNA, 121 bp, Artificial Sequence
  Synthesized
  misc_feature (61): n=a or g
aatgttcagccttctttcctggtttgtctgtctggggcagcctccaatatcatcacatccncgtaaccaacaagctgccatatttaaaaagaaaaaagcccaaaggtacaaaccaaccctt

SEQ ID NO: 32837 - DNA, 121 bp, Artificial Sequence
  Synthesized
  misc_feature (61): n=a or g
catgcactcaacagtaagacgctaaacaaagcagtaaaatgggatactgcctgtttcctcntacctctattggaaggtacacaacattctgaggctttttagccagcagacagggttttct

SEQ ID NO: 32838 - DNA, 121 bp, Artificial Sequence
  Synthesized
  misc_feature (61): n=c or g
ttaaatctccaagatactcttcaaaactggagccagaagtaatatggagttagatgcctgntaacttagttcagcagggagctattgctatggtctaaaacatacctcactcatattcact

SEQ ID NO: 32839 - DNA, 121 bp, Artificial Sequence
  Synthesized
  misc_feature (61): n=a or t
acatcgtatttgtcctggataataccgataggaaaagggaagaaatcatgtataaattgtngaatttccattcggttctgttcatttcactgttctataatattttttacttagcctaccc

SEQ ID NO: 32840 - DNA, 121 bp, Artificial Sequence
  Synthesized
  misc_feature (61): n=a or g
cagcagcacagaggttggaggcagagggcaccatgctcatggcagccacatctcccagggngagacaacaaccacagcaatatccagctggttgcagatccatgtcccgtcccccctcttc

SEQ ID NO: 32841 - DNA, 121 bp, Artificial Sequence
  Synthesized
  misc_feature (61): n=a or g
aagtccatttattgccaagtcttttgtagttttcaatctttctactacaagttgggaactngtatgttttccagtctacaaataaacttgcaagttgctactactgcatcttgcaagaacc

SEQ ID NO: 32842 - DNA, 121 bp, Artificial Sequence
  Synthesized
  misc_feature (61): n=t or c
agtggtccacactggggggatttttttacaaaggattataacatatggtgcatgtatatangaagtagatagagaaggtgcatctttggaatggggttagttatggggttaaatatttttt

SEQ ID NO: 32843 - DNA, 121 bp, Artificial Sequence
  Synthesized
  misc_feature (61): n=a or g
acccagtgagtgtgtatcatgtttacttttccaaaagattgctggttggcacttgaaacantaaaaccataaatacaccgtatgttgacatcttctaggtacttttatcatggaaatcaac

SEQ ID NO: 32844 - DNA, 121 bp, Artificial Sequence
  Synthesized
  misc_feature (61): n=a or g
cagaagttaagaagtattggactgcacaagcctgtccagtttgaatctggatgtgttgtgnatatccattaacatgtgatctctcaaatatttgtttaaatatcttcccctttatcgaaga

SEQ ID NO: 32845 - DNA, 121 bp, Artificial Sequence
  Synthesized
  misc_feature (61): n=t or c
ataaaaggtcttttgttgaacatgaccaaacatcttccagctataacactgtgagtaagcngatactacttgcagcagattctttggccctaggccaccacctctatcagttgtacctttg

SEQ ID NO: 32846 - DNA, 121 bp, Artificial Sequence
  Synthesized
  misc_feature (61): n=t or c
atacaattgaaaacaatacttgctttccttacaaaaaaacgagaaagaagtggcttatatnaaggtctctcctgtcctagatttcatttcatatgaatcccagagttgcaaggatgtttag

SEQ ID NO: 32847 - DNA, 121 bp, Artificial Sequence
  Synthesized
  misc_feature (61): n=t or c
aaagaaaaattctacatagagataacttggaaatacgtgcatagcaattgtctgggaatanggaataaaactccctcagttaccacaagaaatgttactattgattaaatttttgaataat

SEQ ID NO: 32848 - DNA, 121 bp, Artificial Sequence
  Synthesized
  misc_feature (61): n=t or c
gtgcttctccatggtgtggggaaatgccaggcaaagcacagggacaggcagagcccttgtngtattgcagagcccagaaataccagctaactgcacaccctgtgcaaataaaaacccgagc

SEQ ID NO: 32849 - DNA, 121 bp, Artificial Sequence
  Synthesized
  misc_feature (61): n=a or g
cagacagttatcatctgtgacccgttctcttgctctgggttacacacggggacctgggttntatacaaagaaatgacagcagcagctccgctctgtcacccgggcaccgcagttcatttca

SEQ ID NO: 32850 - DNA, 121 bp, Artificial Sequence
  Synthesized
  misc_feature (61): n=a or g
ttggtggtggtagattttttcagagggtttatctgtgctgttgagctctggttgtagcccngaaggtagcattgcaagggcccttcttcatctcacctgtgtcttccatcagctggagatg

SEQ ID NO: 32851 - DNA, 121 bp, Artificial Sequence
  Synthesized
  misc_feature (61): n=t or c
ttggatcatccctgtgttcgagtgaaatgtgctagctgatatttaggcccaagaaagcccngagaaggcagctaatcacagctatccagcagtggttttcacaggatgatattaaagtact

SEQ ID NO: 32852 - DNA, 121 bp, Artificial Sequence
  Synthesized
  misc_feature (61): n=t or g
taatgcatcttcctttgaatacagcttaatttgtagtattggtagatatttattatgctangtagtattgcaagcaagttcttgtcaatgttggttgaagcaatagtttgcaaagtagata

SEQ ID NO: 32853 - DNA, 121 bp, Artificial Sequence
  Synthesized
  misc_feature (61): n=t or c
gacatatgagccaaaaactctttgttttacatggcatgatctccatgtaaatgtggcaaanatccacagtggttttgcaaaattaatacctcaacttctaaaaaagaacagaacaaccaac

SEQ ID NO: 32854 - DNA, 121 bp, Artificial Sequence
  Synthesized
  misc_feature (61): n=t or c
caaatgatactataatctctgatacatgtacatcacaatctcgaagacattcgtaaaggangattgttctgtaatacaattagattaatatcatcgctctctccttctgtttattactttc

SEQ ID NO: 32855 - DNA, 121 bp, Artificial Sequence
  Synthesized
  misc_feature (61): n=a or g
gatgtcaccaccacacacaggggtgtccccaaggcatatgaggggcacccagggtggctcngggtgtcaccattctgtcattgggatgtcacagtgtgtagtggcaatgctaagtcaaggc

SEQ ID NO: 32856 - DNA, 121 bp, Artificial Sequence
  Synthesized
  misc_feature (61): n=t or c
tattttaattgaatgagcaactataaatttttcaatgagaacactgtgaatacatataacngtcttagccagagggtcagttgttgggtttgttatcagaacttactgtaacctttctttc

SEQ ID NO: 32857 - DNA, 121 bp, Artificial Sequence
  Synthesized
  misc_feature (61): n=t or c
aatacctaatgaatgtgcactcatttatctcctttaacaatattacaactcaggatttagnaatactaggactggttaaggaagtgagggtgttacctcacagtgggtttagttatggcag

SEQ ID NO: 32858 - DNA, 121 bp, Artificial Sequence
  Synthesized
  misc_feature (61): n=a or g
ctcagaaatagggcccattacctgcagctggagaagaaacctaatcttgcccggcacaccnatgaggagctgagcatgcacaggtgtggaggaaggggacaagtaagagtgggcaatgtgg

SEQ ID NO: 32859 - DNA, 121 bp, Artificial Sequence
  Synthesized
  misc_feature (61): n=a or g
tagagggaaaggtcccccagcttttgggaagtggagcaggtttgccagacgagcacaggangggctgactgatgcttcctatgtttttcctgccctagcagggtgacagcacagagggttg

SEQ ID NO: 32860 - DNA, 121 bp, Artificial Sequence
  Synthesized
  misc_feature (61): n=a or g
agcacatacaacaaagagactggagatagaaactagtttcagatgggctcctgggaagctncgctagctatgttctcaaatcaggcccaggatgtcttgaatgagtgacaactgttgggga

SEQ ID NO: 32861 - DNA, 121 bp, Artificial Sequence
  Synthesized
  misc_feature (61): n=t or c
gactgggcaataagcacagtcattgatacttgtttcagggtgttctagtcccgcagtcagntgtgggatccagctcagcgccatcctaggccacacacctgaggacgggtggttggctggg

SEQ ID NO: 32862 - DNA, 121 bp, Artificial Sequence
  Synthesized
  misc_feature (61): n=a or g
ctgaacgctgtaaaccagcctccacaggaagcttgagcttcccagcagtgctctccaggcnacagctgcaccatctccgagttggccctgagcccttctgcttctgccagatacttaaggt

SEQ ID NO: 32863 - DNA, 121 bp, Artificial Sequence
  Synthesized
  misc_feature (61): n=t or c
ggaaataaaatggtagcctcaccttcaaagaaacaaaatggggaaatcctgcttgttgtgnctttgaatgtttcttgggtttggtttcactcagtgcctaagaaaacaggcaaaggccata

SEQ ID NO: 32864 - DNA, 121 bp, Artificial Sequence
  Synthesized
  misc_feature (61): n=t or c
gctcattgcaatatccaaaagacaattcccaaagctttgattccctgtgtaaggcattctnattgctcctccagcacgcttcacctctgctgcttggagctaggcagcagctttagagcct

SEQ ID NO: 32865 - DNA, 121 bp, Artificial Sequence
  Synthesized
  misc_feature (61): n=a or g
atccttagccctttctgtgttgctgcagtaagatatgtttttaactctggtgggtggaagngcatgtgtagaaatagtttgtttttgaaagtggtatgaatataatcgttgtgcatgtgca

SEQ ID NO: 32866 - DNA, 121 bp, Artificial Sequence
  Synthesized
  misc_feature (61): n=a or c
atctcctgtcttacaccctgtcatgaacagttactctcagggcaattcctgttaaatatcnatccaaataagtaactgggaataatagcattccacatgaaatggtgggggaagatgagag

SEQ ID NO: 32867 - DNA, 121 bp, Artificial Sequence
  Synthesized
  misc_feature (61): n=a or g
tcagcaggtgtcttggttccaccatatctccatcttcctctttttcggagatgaaaagatntgacttaagcaaaacgtgtggtccccttgtggaaatgggggacgggcacaaggccagaac

SEQ ID NO: 32868 - DNA, 121 bp, Artificial Sequence
  Synthesized
  misc_feature (61): n=a or t
tgacagcattactttagctttgtccactgcttggagattgccattggcattggtgctgatnagcatgctggaatcaaaaccccattggccatgaggtttatgcacatggaaggcaagagca

SEQ ID NO: 32869 - DNA, 121 bp, Artificial Sequence
  Synthesized
  misc_feature (61): n=a or g
attggctccccgggtaatgcccaatattcctggttcaggtgagaggaaggcaggtcttgancatcactttcgatccaccataaaagcgtgaatgggttttgtgtgtagagctgcaggcctg

SEQ ID NO: 32870 - DNA, 121 bp, Artificial Sequence
  Synthesized
  misc_feature (61): n=t or c
ttagaattaaattcttcttgaatgtggcgaatgagcattaacatttcagttcagagatcanactctctaatttattttgtgattccagaaaatcacagagaatttggaaggctgctcttta

SEQ ID NO: 32871 - DNA, 121 bp, Artificial Sequence
  Synthesized
  misc_feature (61): n=a or g
agctacttagtgcagggagtcatttaggtgcgcacgggccctaaaaccatcggcctgattncaggtctggtgatggagagggctcccaaagagcatccaggcctggttctctgctgttaca

SEQ ID NO: 32872 - DNA, 121 bp, Artificial Sequence
  Synthesized
  misc_feature (61): n=t or c
gatttaaaaaagaagtggaaacagtgcacgtgcccagagccacagaagtgaaaatctgaanggagaaattcctagtttcctgtcttgaatccgtaccacaagtctgtcattgattaatata

SEQ ID NO: 32873 - DNA, 121 bp, Artificial Sequence
  Synthesized
  misc_feature (61): n=t or c
ctgagtgcaatgactctgactcaactcccaaacatgccactgggaaaaattaaaagtcaangatatgcaactgtttgatcttcagcaattgcttccaggtgatggtctagctctacccaag

SEQ ID NO: 32874 - DNA, 121 bp, Artificial Sequence
  Synthesized
  misc_feature (61): n=t or g
acaggaaatgctgctacctctggagctcacaaataaccacaacaggctcttgaatgagtcnctctctggctctgaatgcctctcagcatagcagtgggtccctgcgcctctctttgtgcta

SEQ ID NO: 32875 - DNA, 121 bp, Artificial Sequence
  Synthesized
  misc_feature (61): n=a or g
ctcttgtaggttacaggatccaaatacagttttagttttggctttattagtttggtttccntttgtctatgctgtgggttgcacacatccctctgatttgcttctatgtatctttcctatt

SEQ ID NO: 32876 - DNA, 121 bp, Artificial Sequence
  Synthesized
  misc_feature (61): n=t or c
gggggtctattttgaacttattctaactattttagttgttgtctcctttctttatctactntcctttagcttcacggctgtttaatactcgtgagccagaaagcaaatttctcctggagcc

SEQ ID NO: 32877 - DNA, 121 bp, Artificial Sequence
  Synthesized
  misc_feature (61): n=t or c
ccagacagcagcgcttacggcttcagggctacactggttttctaacatatttggattgtancttgcagacatacagcgcttttccaaaagcaataacagcagctgctctgtctgtgtgtgc

SEQ ID NO: 32878 - DNA, 121 bp, Artificial Sequence
  Synthesized
  misc_feature (61): n=a or g
attgaaataagaacagtaaataaaatgaataattgctcctttattttctgtatgtgagttntttgaactgggtaactgacagctgtagacaagggggaaggtatactttaaacttacattt

SEQ ID NO: 32879 - DNA, 121 bp, Artificial Sequence
  Synthesized
  misc_feature (61): n=a or g
tggttctttctggtggaaaaatgttttgtcagaaatattttgactatatttccaaattgtnaagcacttactcgctcctttctgtaattattatgcatttttcacgtgtcagggagaacac

SEQ ID NO: 32880 - DNA, 121 bp, Artificial Sequence
  Synthesized
  misc_feature (61): n=t or c
gttgcacaggggctcattaggtcacctacctccccagtgaagcggatgggtgtgctctgcncttcttccaaacccagcactggtgcataggagcagcaagcaggagctgcaagcgtgagcc

SEQ ID NO: 32881 - DNA, 121 bp, Artificial Sequence
  Synthesized
  misc_feature (61): n=a or t
ttctcagaaattttattaagtctataatttaagccagaacactaaccaagcatggaagaanattaatgtggatggtattttgtttttacagtaacaaatccaattatgttaatagtacatt

SEQ ID NO: 32882 - DNA, 121 bp, Artificial Sequence
  Synthesized
  misc_feature (61): n=a or g
aataccgcctgtgcacgcacatacacataacttctgtttttatcctgttgcataacttagnacataacaattaccgataagtacaactaaaccccctacaaatttagaaacatgaattgca

SEQ ID NO: 32883 - DNA, 121 bp, Artificial Sequence
  Synthesized
  misc_feature (61): n=t or c
cagagttgctaatgctcagcttacccataacccacacactaagcaaagagctgcttatagnaaggtactgcaggaagtatcccaagcagctgcatctcttctggttgccctgtctagaaat

SEQ ID NO: 32884 - DNA, 121 bp, Artificial Sequence
  Synthesized
  misc_feature (61): n=t or c
caaaatgagctaaaaattaattattcatctgtactaagtcatgtagtaatttatatactcnggtatcagcattcttcagctattcatttagttttatgaacattatcacttttttcttgat

SEQ ID NO: 32885 - DNA, 121 bp, Artificial Sequence
  Synthesized
  misc_feature (61): n=t or c
ctcctgcaatgcttcttgttatgcctttctttggcatccccacttctgtgtccttctctgncccaggatttgaaccttgcaagattctgatgagtgtggttggacagaagctgctctgtgc

SEQ ID NO: 32886 - DNA, 121 bp, Artificial Sequence
  Synthesized
  misc_feature (61): n=a or g
aaaacaacagctatagggtgatagcctgggggggggggtgagcgcatggatgcgtttgcantatatggaaaggatgtagaatgcaggcagagagaaggaaagacacaaaatgaaaccgtag

SEQ ID NO: 32887 - DNA, 121 bp, Artificial Sequence
  Synthesized
  misc_feature (61): n=t or c
aaccttcctgattgaggccagggcaggtagagcctgggaagttctctggcaatgagggtcnctaattagtgcctgagctcaatggaagtgcctgttcctttgctgggggttcttcagagtt

SEQ ID NO: 32888 - DNA, 121 bp, Artificial Sequence
  Synthesized
  misc_feature (61): n=c or g
gctggtgccagagaggtttgtcctgtagtgattgctggggaatattttgcttagtagctgnagtttacctaattctgcttccattaaaatcaatgctgtgattcctcctggctgcgaatta

SEQ ID NO: 32889 - DNA, 121 bp, Artificial Sequence
  Synthesized
  misc_feature (61): n=a or g
gtgggagtggagggactggaccccaaacccacctttgtttatgcaagtgggtgaagggagnagttggctctaccctcagatgtctcacactgctgtagggtatcccctacctgcagttgtg

SEQ ID NO: 32890 - DNA, 121 bp, Artificial Sequence
  Synthesized
  misc_feature (61): n=a or g
cccagttctgccatcaaactgctgacatgctgtattgctttgcttaggactttcactacantcatgcctgtcagttcatctacttttgagaagtctgacatgtctgttacaatgagatatt

SEQ ID NO: 32891 - DNA, 121 bp, Artificial Sequence
  Synthesized
  misc_feature (61): n=t or g
tgttaaaatctagcagaaggcgacttgggtggatgaggatatggtagcagattaagggatnttggaccgtccagaggaaacaaatcttgaaaaaactcttagacaaattgagaaataagtg

SEQ ID NO: 32892 - DNA, 121 bp, Artificial Sequence
  Synthesized
  misc_feature (61): n=t or c
tgtatctgaagttgctgtgtttggatggcagcagagtgcagagacatatggtagaagctcncctccataccttggtcctacttgctttacatatatatgtcagaaggcaatgagtcctgac

SEQ ID NO: 32893 - DNA, 121 bp, Artificial Sequence
  Synthesized
  misc_feature (61): n=a or c
tatcactgattccaagtcagataaaatacttcctcttagagattagcatgtcacagtggangctgtcctttttgtgcacaccatctgcttttctgaaatcccaaaagattaaaagagtgga

SEQ ID NO: 32894 - DNA, 121 bp, Artificial Sequence
  Synthesized
  misc_feature (61): n=t or g
ttcctggtacaaatagacggaatatttaaaaacttgacaattaaagtattaacaaatactnttatactggaagctctgaagtcatcaggttctggaaactgcatgctgtattttgaaacat

SEQ ID NO: 32895 - DNA, 121 bp, Artificial Sequence
  Synthesized
  misc_feature (61): n=t or c
ccagcaacaaaattgaagcaaaatggataaagccgctactgttttccatatgtccccacantgtctctgacaaatgctaacagccttttccatcacagtactaccacagtattatatattc

SEQ ID NO: 32896 - DNA, 121 bp, Artificial Sequence
  Synthesized
  misc_feature (61): n=c or g
tttagttgatttgccatcttgtctttgcctatcagtatgactgattagtgagaatgagtcntattatgaagtaccattcaatgtgaacaactcattttaaaaaaatgcctatagttttctt

SEQ ID NO: 32897 - DNA, 121 bp, Artificial Sequence
  Synthesized
  misc_feature (61): n=a or g
aatgtccgcaatccccttcggagaaatgcaggaagacttaagatcagcataattgtattcntctccaatacagctacaccttaaggtaatgctactgaccacctaaatccagtggtcataa

SEQ ID NO: 32898 - DNA, 121 bp, Artificial Sequence
  Synthesized
  misc_feature (61): n=a or c
tgttattatggagacacatccgtctatgaaaaaagcattttttaaaagagataatgaagantatacagtcaaataaatatgcttatccatgagcaaagtccttgggattaaaatgaggctc

SEQ ID NO: 32899 - DNA, 121 bp, Artificial Sequence
  Synthesized
  misc_feature (61): n=a or g
aaaaacaacgcatatggtcattttcatcagcaggactgagagagtatgagggctttctaanctagaactcctacttaatgtgttcatttttcaactgtgagtgaggctgagattatgattt

SEQ ID NO: 32900 - DNA, 121 bp, Artificial Sequence
  Synthesized
  misc_feature (61): n=a or g
tccttttagatgttctcccaccttgcacacagtgcaataatacatttctcacaggtggagnatcctgtcttttctttttgtggactgtttgaccgatcaatggtttaagttaatggtaaag

SEQ ID NO: 32901 - DNA, 121 bp, Artificial Sequence
  Synthesized
  misc_feature (61): n=a or g
gcataggttttattctattttctgttccttcttctcctcaggatggcagcttgccttgatnttggcatagttcatgcatgtatgttcaggaccctaataaagaaatagctgcctttgaaat

SEQ ID NO: 32902 - DNA, 121 bp, Artificial Sequence
  Synthesized
  misc_feature (61): n=t or c
tttccttaaagtagtacatccaggtgtgcagaagtattctcctgccttgagagtctcgctngtctttctggggtccttggaaaagaaggtgacaagtgacaggttcgctcgagatgcttac

SEQ ID NO: 32903 - DNA, 121 bp, Artificial Sequence
  Synthesized
  misc_feature (61): n=a or g
cagagtggctggagagctgtgcagaagaaaagaatatggggacactggttgaaattgctcngtcatgggaggaggaggctcaccttacctctctctgcaactgcctgaaaggaagctgcag

SEQ ID NO: 32904 - DNA, 121 bp, Artificial Sequence
  Synthesized
  misc_feature (61): n=c or g
tcaccaacaccaaaggggtcccagagacatctggctgcagacagaaggctttttgctccgnaaggaatctctacctaacagaggtggtccctgctgctctcatccctggcagcactgtcac

SEQ ID NO: 32905 - DNA, 121 bp, Artificial Sequence
  Synthesized
  misc_feature (61): n=t or c
ttgtcaacctggatccttaaaatgagatctacaaacccactgaagtttcgaagacttgaanttttcatagcacgtgtgtgtttttaggcacattttggtggtttgttaatgaggaaacatc

SEQ ID NO: 32906 - DNA, 121 bp, Artificial Sequence
  Synthesized
  misc_feature (61): n=t or c
actttggactcactgtctcaaagcctcatataagacttccggacttcagagcatgagttgnactggctgtgatggctgagcactgtgcattgctttctcacatgtctcagaccaggtcttc

SEQ ID NO: 32907 - DNA, 121 bp, Artificial Sequence
  Synthesized
  misc_feature (61): n=t or c
acagcctctgcagtaacacaggctcaacatttatttttgtagttctctctggagagttacntgtgcagacagcatatagacatatggctagagctctgggggcaaatagctgctgtgtcac

SEQ ID NO: 32908 - DNA, 121 bp, Artificial Sequence
  Synthesized
  misc_feature (61): n=a or g
gatagcttaaacttacagatcttcatacgtgcatttaatcctgggctaggttgtatttagncagaaagtgaagattttagcacattattgtatatcagctacaatgcttgaaaggactgcc

SEQ ID NO: 32909 - DNA, 121 bp, Artificial Sequence
  Synthesized
  misc_feature (61): n=c or g
ttcacaagagtaccaccaagacaaatgtaacacctcatttcctactgcaccaaactcagcncacttaattcaggaggagtagaagcaaacaggcatgcatctccatggcactacattgtca

SEQ ID NO: 32910 - DNA, 121 bp, Artificial Sequence
  Synthesized
  misc_feature (61): n=t or c
acaaactgagtaaacgggagcaggagattgacctgaacacctgcatgacttagctgtatcnttaattgggagaattagcaatgagtgtaacgtgtttcaagctaacccacatacccagctt

SEQ ID NO: 32911 - DNA, 121 bp, Artificial Sequence
  Synthesized
  misc_feature (61): n=a or g
tcatggatcttattcgtatggtgtaatgagagcccaagagctgaatctggaaggaagctanatccaactctgctttatatggcagctaatgacttcaaatatacaataaataaataaataa

SEQ ID NO: 32912 - DNA, 121 bp, Artificial Sequence
  Synthesized
  misc_feature (61): n=a or g
tacattatagtaactctagtataatctgcaataactccaaatataacagacgtacaaaaanaaagcaacaacggtaagtgcctcccagggtacttagagaaattatagtgctctggctgag

SEQ ID NO: 32913 - DNA, 121 bp, Artificial Sequence
  Synthesized
  misc_feature (61): n=t or c
tagctttgagagacttaaggatttcaagtgttattgaagacactttgtgccaactgtatgnagaggtaaatatctgccatttgtgtttgcagctaagaagtcttaacactcagattactga

SEQ ID NO: 32914 - DNA, 121 bp, Artificial Sequence
  Synthesized
  misc_feature (61): n=a or g
ccagctcaattgaaacagggcctgaaaacaggttattgaagtgagaatttccccacttgantatccagtaccttgcaaatgttgtaggaagatggttaaatgggatatggctcacccagta

SEQ ID NO: 32915 - DNA, 121 bp, Artificial Sequence
  Synthesized
  misc_feature (61): n=t or g
cccttctccctaccccatgggccaaataaagattccctttctctgaaggaaacaccaaacnttctctgtcatctcccaagtgcatgagtgtgaatttttgtattccctccctgcttttcta

SEQ ID NO: 32916 - DNA, 121 bp, Artificial Sequence
  Synthesized
  misc_feature (61): n=a or g
agctcaaaatttggccctcactagggttttgtaagtcacagaccaactgctgtgatttatntgatggtacggtgtgaatagatttcccctggatcattagagagtctctatgggtggtgat

SEQ ID NO: 32917 - DNA, 121 bp, Artificial Sequence
  Synthesized
  misc_feature (61): n=a or g
acaacaacttctcagagatgctaaagagattttgtacaaagctgagtgaaaagagagaagnaggaacggataaaataatgtcaattacccttatgtataaattacggatgaaatttagtat

SEQ ID NO: 32918 - DNA, 121 bp, Artificial Sequence
  Synthesized
  misc_feature (61): n=t or g
gaggaaggggctgcagttttgccaagatcaggaggttagaaatgtacatcaggaaccatcngtctgcagaaacatcactggatggatgaatggcaaggaaacccagcatagcaggctctga

SEQ ID NO: 32919 - DNA, 121 bp, Artificial Sequence
  Synthesized
  misc_feature (61): n=a or g
ccctaaagatcatcaagtccaactgcatcccagcctccaagcaatagcatacacaaccctngagcttctctcttcacactacagcgggtacctactaaagcctgaacaacacacccatgaa

SEQ ID NO: 32920 - DNA, 121 bp, Artificial Sequence
  Synthesized
  misc_feature (61): n=t or c
gaaagccaaatatcctttgcagtacagagtagaaaaagctgaaatgaagtaactttcccangaagaaggatctgagcaagagctaaagtacatctcctcacagcccagcacgatgcctgca

SEQ ID NO: 32921 - DNA, 121 bp, Artificial Sequence
  Synthesized
  misc_feature (61): n=t or c
tcatagctgcattgctcaatatgtctgtgctttggtggggctgccagatcagatcatacantgctggtgaaacacaggcctgtctgtcatcacttctctccctcctaatcttcctcactga

SEQ ID NO: 32922 - DNA, 121 bp, Artificial Sequence
  Synthesized
  misc_feature (61): n=a or g
ctccaaagggatgtctaccatgggagctgtttgttggttcctatgatacaaagttttttcngtttttgatcttctggcttattggtatttgttgaagattactaaaactttatgttttgga

SEQ ID NO: 32923 - DNA, 121 bp, Artificial Sequence
  Synthesized
  misc_feature (61): n=a or g
cttagtatatttcaactactttttaaataaagcctataaattctctacaatctaaatttgngggaaacgcaggcatacctatttcattacctgggctttgttgtgctgactgagccatgcc

SEQ ID NO: 32924 - DNA, 121 bp, Artificial Sequence
  Synthesized
  misc_feature (61): n=t or c
gtgaggggaaaatgtgaggactctaatagaacaggtcagtaactgccttcagaacaactgntggtgaaaatgttttggttctatgactgtgggaaccttctttcagaatgatgatatcttg

SEQ ID NO: 32925 - DNA, 121 bp, Artificial Sequence
  Synthesized
  misc_feature (61): n=t or c
ctgtaccccaagcagtatttaaattggaagttagaccgtcaaagcagagagatctgagtgngccttttccttatggaaagttcaatgcttgggagttcttaatcaagattgtcagacattt

SEQ ID NO: 32926 - DNA, 121 bp, Artificial Sequence
  Synthesized
  misc_feature (61): n=t or c
cctgtatagtatttcctgtatttccctgggcagatcctgcctgccaagtagaatagatacnatttataaataacagcacatacatcatttctgctccatcgtaggctctaattaaaggtta

SEQ ID NO: 32927 - DNA, 121 bp, Artificial Sequence
  Synthesized
  misc_feature (61): n=c or g
ggagaacatatgctccaactgtgcagccactgtggtgaactcgcagataggccaagtgctncacttttctgactctttcctccaagtatctgtaacagctaaaaccctcacttgtttctac

SEQ ID NO: 32928 - DNA, 121 bp, Artificial Sequence
  Synthesized
  misc_feature (61): n=t or c
gagatttctctgttatctgttcttaaagctagagatcagtaagttcatggattccctttcnaccttttctctcagaccttgtggaacatgcactgatgcaagtgaatctgttaccacatta

SEQ ID NO: 32929 - DNA, 121 bp, Artificial Sequence
  Synthesized
  misc_feature (61): n=t or c
accatgctaatttgttttgtctgtataaaatttcaattgtgtgaatttttaaatgatttanatatgccttgctcagtcccatgaaaccattactaagcatgtctaagaagtgaaataaaaa

SEQ ID NO: 32930 - DNA, 121 bp, Artificial Sequence
  Synthesized
  misc_feature (61): n=a or g
attactgggagaagtattgtgctctactgcacaagatataaatgtcattttcttaggaacncaatgactttcagcacttctttttcattaggactgcattctttttttctttcctttcctt

SEQ ID NO: 32931 - DNA, 121 bp, Artificial Sequence
  Synthesized
  misc_feature (61): n=t or c
gttctatgatattaagatattaatacaaggtttgtctacttaggatagtactgttaactangagagagcacagtttacattgcaaaaacaatagccttccgaccagtaaaaaaattaacca

SEQ ID NO: 32932 - DNA, 121 bp, Artificial Sequence
  Synthesized
  misc_feature (61): n=t or c
tccattgtgatggatttggcgttcacactgtggagtgtctctgccatccaaggactatttntcacatcgcagattcattctccgctctaccggttctgccctcttcctcacccaatggttt

SEQ ID NO: 32933 - DNA, 121 bp, Artificial Sequence
  Synthesized
  misc_feature (61): n=c or g
aatcatgatgaaagccatcaagccttccccatccagtttctgttgctcatcattcatcaanaccatgctgtcacatccaggtcagaaccggctcagggacaatgacccagaactgaatcag

SEQ ID NO: 32934 - DNA, 121 bp, Artificial Sequence
  Synthesized
  misc_feature (61): n=a or g
ataattgcaagttacgtaatgctcaaagggaatgattttttttgagactgaagaacagagngaaagagggctgcatgtttccattatattcgcagcatctaaatatcaacggggaacttct

SEQ ID NO: 32935 - DNA, 121 bp, Artificial Sequence
  Synthesized
  misc_feature (61): n=a or t
tcttaaaaccagatgcaattaacatgatctagtagcaagatctcacagttgtttatcgtgntcatgaaatgcttcggttttacttcttaatctgctgagcattaaagaataaaataaaata

SEQ ID NO: 32936 - DNA, 121 bp, Artificial Sequence
  Synthesized
  misc_feature (61): n=a or t
agttcacattcaaaggagagtgcaggggaaataaaaaattatcacatttttggagaaaagngtacccatccactcccagtagcactgcacttggcaaatataaacttcttgacaacaaata

SEQ ID NO: 32937 - DNA, 121 bp, Artificial Sequence
  Synthesized
  misc_feature (61): n=a or g
tcattactacattgttccaatttagagatttcataataagagatctctattttctttcaantgctgtagtgaaaagctggcttttactgtacgttgcaatagacttgtactctctcttttt

SEQ ID NO: 32938 - DNA, 121 bp, Artificial Sequence
  Synthesized
  misc_feature (61): n=a or g
gcagaaacggaagagattttaggtggaagaaagcagctgggagatgctcactctgagcganaccctcatgtgctgcttctgttttccagtcaggtccatgatttgggatgaggactgccag

SEQ ID NO: 32939 - DNA, 121 bp, Artificial Sequence
  Synthesized
  misc_feature (61): n=a or t
acatgcagtatttttcaaggttttcacattgttatcttaatcaaatgacaccgaaaaatangaggtattttttgtttatataagtgtagttactggagtgatatgcacacatagtatttgc

SEQ ID NO: 32940 - DNA, 121 bp, Artificial Sequence
  Synthesized
  misc_feature (61): n=a or g
taaatcaagccagcatggacagaaatacgattacatggatcaagagccagctattgaacgncaagaggaaggtaattaattagacatggtggcccatccaaagggggatgggagaagagga

SEQ ID NO: 32941 - DNA, 121 bp, Artificial Sequence
  Synthesized
  misc_feature (61): n=a or g
aaaagacagaaaattccaagatttttctccttcttatatcttaaaaaggtacttcttttgnttgagactgaactgtttttgttcacaagcattttaagtttaagagatctttttgtgacat

SEQ ID NO: 32942 - DNA, 121 bp, Artificial Sequence
  Synthesized
  misc_feature (61): n=a or g
agagtttccgagcaccataaattcttcttcaagttggtccctatcactaatataggaaggncttgccactttagatactggcattccctgttttgtttacctaggtcaatctgtaatctcc

SEQ ID NO: 32943 - DNA, 121 bp, Artificial Sequence
  Synthesized
  misc_feature (61): n=t or c
aaatgccttttaaagtctcaagtggctgattctgtacttggaatcaaaatacagctgattncaaatcaaaagggttttatgatccagcaagctgttctgatgatacaagtctttgagctga

SEQ ID NO: 32944 - DNA, 121 bp, Artificial Sequence
  Synthesized
  misc_feature (61): n=a or g
tcatgacccctggtcaagttctacagacccacttagcacttgcagacctctatttaatggncctaaaacccacccaaaagcaactcctggtatcacagaggccattccccatgtgtcccaa

SEQ ID NO: 32945 - DNA, 121 bp, Artificial Sequence
  Synthesized
  misc_feature (61): n=t or c
aaatcatcgaatgttttattaccacttctacagcccccaaaatcataagatgatacaaaangtcactgttatatgattaatatctacgtcttgcagagcaccttgttcccatggatcccaa

SEQ ID NO: 32946 - DNA, 121 bp, Artificial Sequence
  Synthesized
  misc_feature (61): n=a or c
agtgtaactgacatgctccaatcactttgaacaggaagggctggatcagttccagccatgntttcttgagggtagcatacctgataaggtgtaccaaggctactcctagctgccagcagta

SEQ ID NO: 32947 - DNA, 121 bp, Artificial Sequence
  Synthesized
  misc_feature (61): n=t or g
cagatcactggttacaaatgatggtgatctttttcatctctaaagaaatgtaattaacagnttcttcttcctcagtgtacatactttttgaaaatatctcttgctgtctattcacttaatg

SEQ ID NO: 32948 - DNA, 121 bp, Artificial Sequence
  Synthesized
  misc_feature (61): n=t or c
gcaaatcagagttttccaggaaatgcagtgagaatagggctgttcttacacaactgccatngctactgatgctactgaacgagaggaacacattgatgcctccacagtgaaaaggaatatc

SEQ ID NO: 32949 - DNA, 121 bp, Artificial Sequence
  Synthesized
  misc_feature (61): n=a or g
ttgggcagtgtctggcattcagctgagcacaggccatagaggctgtattcaggtgtggctnttcatttccaccactggaatgaggctgttgtggtccttttaaaagaggtggtagtggttt

SEQ ID NO: 32950 - DNA, 121 bp, Artificial Sequence
  Synthesized
  misc_feature (61): n=a or g
ctggggccaaaactgggacaccggaagttttcaatcaaaatctcattttctttgaatgaancaattggcttcaatggtgaggagaaaagaaaaaagaaaaaaggaaagaaagaaattttgt

SEQ ID NO: 32951 - DNA, 121 bp, Artificial Sequence
  Synthesized
  misc_feature (61): n=c or g
ttctgttgccaattaggagcccatgtaggtccttcaaactggcgattcctcttcatgctangctgtccatacagtagcaatttcttcctctctcatgattctccatccatgcatctgatgt

SEQ ID NO: 32952 - DNA, 121 bp, Artificial Sequence
  Synthesized
  misc_feature (61): n=a or g
taaaattccattgtctgtttctttggttttatttaacaggtaaaaagtaaaaggtcacagnactgatgtacccagaaaggacagaattatcaggttcattctagtgtatctttcttatcct

SEQ ID NO: 32953 - DNA, 121 bp, Artificial Sequence
  Synthesized
  misc_feature (61): n=c or g
cacacccagctgtgttggttgcaatgctttgtgttaatctggcagagccattcttcagacngcacatttgccatatcttgtcctccaatccctacgtcatatggcttatctgatctgcctg

SEQ ID NO: 32954 - DNA, 121 bp, Artificial Sequence
  Synthesized
  misc_feature (61): n=t or c
tagcagctgtatgaaattcactgcaacaaatacaactgattactactacctctttactcangctcatgctgtaacctattgattatcaagccaatgtcattcccaatttagaaagagacag

SEQ ID NO: 32955 - DNA, 121 bp, Artificial Sequence
  Synthesized
  misc_feature (61): n=a or g
tcatctacatttccctttttagaagtaattttaactctacttcctgtacacacattccccncactgttttctatcaggcatcttaattagatttttactccgcagtgatataatgacttaa

SEQ ID NO: 32956 - DNA, 121 bp, Artificial Sequence
  Synthesized
  misc_feature (61): n=a or g
gaggaacggaggcagcacaaagggatggaggtaagggctttcctcccaccctgtctcttcncctgtttggacgttgggcagcttttctgagcacaaaaatgccatggaaatatgctactga

SEQ ID NO: 32957 - DNA, 121 bp, Artificial Sequence
  Synthesized
  misc_feature (61): n=a or g
tggaggatttaaataagcaagagttcaatcctaaaccagaactttagtggaaatcaaggangacctggtatatagaaggctaacaaaaacaagttgctaccaggaaaaattaagagagacc

SEQ ID NO: 32958 - DNA, 121 bp, Artificial Sequence
  Synthesized
  misc_feature (61): n=t or g
cacataaataatccatgctttcttctttcttcgctataagtcagccagttcagtgtagaantgtagtgaaaaagactgcacgtacattgtatgcatctcagagttatctcagcaggtgtcg

SEQ ID NO: 32959 - DNA, 121 bp, Artificial Sequence
  Synthesized
  misc_feature (61): n=t or c
gcctagcaagcaagaagggaaaaatctctgagctaataatgaatggtcattcctcacaacnaatagagttactaaggataactgtatgccaaatgtaggctacaaccctgccatgcggact

SEQ ID NO: 32960 - DNA, 121 bp, Artificial Sequence
  Synthesized
  misc_feature (61): n=a or g
aatgggagcaagtctgaactctaaagctaagaattcctaaatacccaaactaaagcaattngttcataaatagcattgatggtaatgaggcatggctgtggtcccaaatagcatgagtgga

SEQ ID NO: 32961 - DNA, 121 bp, Artificial Sequence
  Synthesized
  misc_feature (61): n=a or g
cagctgtagttctgtaaaagaagaataaaacagcaacaaattaagccctaaatgacaaacntctcattaatagaaaaggagaaaatatgttttttttatgattgtaagcaattggcaacat

SEQ ID NO: 32962 - DNA, 121 bp, Artificial Sequence
  Synthesized
  misc_feature (61): n=t or c
tccagcagtgaggggtgcagcgttgtgcactcacacactcaggtctcagggatttgcattntcctcctcgctgatttctccctgctctgtcagagcagctgtttgtggctgcagcctgggc

SEQ ID NO: 32963 - DNA, 121 bp, Artificial Sequence
  Synthesized
  misc_feature (61): n=t or c
aatctgagagagagtagggaaagatttcttagtacatttggcacaagatcatctagggggnaaatagataatgccagactggaaatgtgagtcccccttataacagccaaagcaaccatgg

SEQ ID NO: 32964 - DNA, 121 bp, Artificial Sequence
  Synthesized
  misc_feature (61): n=t or c
aggtacaacagttggagaacatgcacagactgcagtctcagagggaatgatattgggttgnggtaatgcaggtgtagttttcagctgtcagtgcttacttacatcgtaaactgtactatgc

SEQ ID NO: 32965 - DNA, 121 bp, Artificial Sequence
  Synthesized
  misc_feature (61): n=a or g
cctgagtgaatattaattgtgttctagtgtagtgcaagtcacacacaagcagtacttttgnatagacttcaccccatgacaatgtcattaccctagaaaaaaccctaataagtcttgtagc

SEQ ID NO: 32966 - DNA, 121 bp, Artificial Sequence
  Synthesized
  misc_feature (61): n=a or t
taggactgattaggacattaaaatatctgtgttatgtaaagggtcatcacatctcaactcntcaggagggcaaatgctgacatctacactatagggacgaatgaagtactttttaaacatt

SEQ ID NO: 32967 - DNA, 121 bp, Artificial Sequence
  Synthesized
  misc_feature (61): n=a or g
ttaggataacataaaggcttaaactgctttacggatgtataagggctgacattaccagtanagtagtgttaaaagtgcttgatttttgaacttatctaacttcttagtgtctgcttggtga

SEQ ID NO: 32968 - DNA, 121 bp, Artificial Sequence
  Synthesized
  misc_feature (61): n=t or c
gcacttcagctctgtggcttcaggacttggaattcatgctgacctcactactctgacatanggggaaacgcagggcatcttttcaggcctgtagatttgaatacatctcaaaagatgcaga

SEQ ID NO: 32969 - DNA, 121 bp, Artificial Sequence
  Synthesized
  misc_feature (61): n=a or g
ttagccttgtgtgaatctaaatcctggtttgaatcttaatcctcgttttcaagtagcctcnaattatccatggtgtctggaagacttttgtactagaagagagccttagaggtaattcagt

SEQ ID NO: 32970 - DNA, 121 bp, Artificial Sequence
  Synthesized
  misc_feature (61): n=t or c
catggatattcctttaagcagttaatatcaaggaatgcatgactttgtaacaacatttgcnttaaggtgatgtattactgctaacaaagctgatcagacacaaagcagcttatggaaaaga

SEQ ID NO: 32971 - DNA, 121 bp, Artificial Sequence
  Synthesized
  misc_feature (61): n=a or g
tcggctgctccactctcatttgttgtctcactggtgcaagcttagcagtcacacggacaangcaagttaggaaactgcctttgcccaaaccccaccaaccagtctgttttagcacagtggg

SEQ ID NO: 32972 - DNA, 121 bp, Artificial Sequence
  Synthesized
  misc_feature (61): n=a or g
tttggatgagtgtgtcatccacagagaccatgaaaagattcaaagaaagtactatcaagantaagacagcaggagacatgagtgttaagatcagaaattttagaacgttatgaagtaatac

SEQ ID NO: 32973 - DNA, 121 bp, Artificial Sequence
  Synthesized
  misc_feature (61): n=a or g
agagtaaagaaaaaaaaaagaagtgttatttaagctatattgtggaccattcagcacaacngaagctacatgatcagaaaacatagcagcctgtcttttatgagaaagcaaccttgtaatt

SEQ ID NO: 32974 - DNA, 121 bp, Artificial Sequence
  Synthesized
  misc_feature (61): n=a or g
agtgaagatttttttctttttgctgtagagagacatcagcagagaagcagattttggcacngagctttctgtgtgttgtctagatttaatcttagctgaagttcaagtccgtctgtgtaag

SEQ ID NO: 32975 - DNA, 121 bp, Artificial Sequence
  Synthesized
  misc_feature (61): n=t or c
aaagcagtgttgcctttattgctaaagcaggtcttgaagattgaacaccatctatttgttnctggtggtagtttaaaagtttgaaaacctaattctactttttggactttaaacctcattt

SEQ ID NO: 32976 - DNA, 121 bp, Artificial Sequence
  Synthesized
  misc_feature (61): n=a or t
aaccacttgttttgatctttctttttttgctgttttcatctcctcagctgcgtgccaccancaagaataaagtagaattccccctcttaccacacctgggatgcaaaatagagacacacca

SEQ ID NO: 32977 - DNA, 121 bp, Artificial Sequence
  Synthesized
  misc_feature (61): n=a or t
agggtgtatcttttgagtggataaattttggcagtattgtttatgtgagtgcttcctgatngtttacaagggatattttgacaattgctggaagtattatggaaaagcttacatgctagct

SEQ ID NO: 32978 - DNA, 121 bp, Artificial Sequence
  Synthesized
  misc_feature (61): n=t or c
aatcatctcataatctggaatcacttgatttctgagaatgtgttcaccctattgtctcaanttccacttctcagcctggcacattttccgttgtacacacactattcacttcatgttattc

SEQ ID NO: 32979 - DNA, 121 bp, Artificial Sequence
  Synthesized
  misc_feature (61): n=t or c
tttggaacattttcttgacttgcgttgaaagtttcagtttgggtcccttccagaaggcaangtgtctgaatgttaggcagaaaagttagataagctttgagcagtgggaatgcaggaaaaa

SEQ ID NO: 32980 - DNA, 121 bp, Artificial Sequence
  Synthesized
  misc_feature (61): n=t or c
atgcagctttcagcccgctggggtcactgctgctctcctttcccgaggctgagactgagangtgacaaagagcaaaccaagaggcagccgtaggagctggcatggcgctcacacatcccaa

SEQ ID NO: 32981 - DNA, 121 bp, Artificial Sequence
  Synthesized
  misc_feature (61): n=c or g
ttctactcagaaaagctgtttttgtctatccaatcgccttttattcatcagatgtagcacnataccctgcctaattattgtttgattgtcatggttttgattttgatgatgtttttaaggc

SEQ ID NO: 32982 - DNA, 121 bp, Artificial Sequence
  Synthesized
  misc_feature (61): n=t or g
cggtgcagttgtgaacttctaacttggtgagtgtgagtgcatttggatttaaagtttgtcnagaatttgaatttcttggcactgtaatctcatgttacatttttaagtctccttgcctccc

SEQ ID NO: 32983 - DNA, 121 bp, Artificial Sequence
  Synthesized
  misc_feature (61): n=c or g
cctttcctccctctcccacagatgactgcagtgagtctgggtgctggagatcgagaagcangtttgttttgaagctaaaccaaatggaaacgagtcctctccccagattatgtgggggctg

SEQ ID NO: 32984 - DNA, 121 bp, Artificial Sequence
  Synthesized
  misc_feature (61): n=a or g
ctgtgagtgagcacagctgctccgtgctccctatcgctcagcatttccttgaccattaatncaaagtgatggcctttctggaggaaaatacctcctctttcccaaaggagaagcataaagc

SEQ ID NO: 32985 - DNA, 121 bp, Artificial Sequence
  Synthesized
  misc_feature (61): n=a or g
ccctccatggaaaggcccaagcatgaacactaaacatagatcatgaggtcagcacacaacntttaataacatcatctttttcaatcttcagaaacgtgacttgcagatcttctggtaattt

SEQ ID NO: 32986 - DNA, 121 bp, Artificial Sequence
  Synthesized
  misc_feature (61): n=t or g
cacatttcaagtagaagcaagtcactataacagctgatatatagtggaagcactgatcccntgactgcagtctcagcccctcataggtgcctaggaactggaacttccagccgcaggacag

SEQ ID NO: 32987 - DNA, 121 bp, Artificial Sequence
  Synthesized
  misc_feature (61): n=a or g
gaaggctggtaacccctttgctaatgaaagttatttcttctgtttgtctaataaccttggnaaatcttagccttgtgcaggcaactatgatggctgccaacaacaaacaggctcaattact

SEQ ID NO: 32988 - DNA, 121 bp, Artificial Sequence
  Synthesized
  misc_feature (61): n=t or g
agggagagatcacctgattgatttgcattgttttatgtgtagtggagggccatactacaanaaaagtgcagtacatttacactcttgtctaggaaaacaactagatttatttggatttgct

SEQ ID NO: 32989 - DNA, 121 bp, Artificial Sequence
  Synthesized
  misc_feature (61): n=c or g
agcctgaacatctgaagtcaaaaaaggcagccaagtcagaatagcccaaaattagcctctntgtgttaaattgtttctgtaatcttgtgagtttgtaaagcatgagtctttaagatttaaa

SEQ ID NO: 32990 - DNA, 121 bp, Artificial Sequence
  Synthesized
  misc_feature (61): n=t or c
tgaactttggatattctctctctacactcaaattttgctatatgaaaatgtgtacaacagnaacatcacaggaaacagagtttacaattgatttccatgaaggttaaaacatttttatcta

SEQ ID NO: 32991 - DNA, 121 bp, Artificial Sequence
  Synthesized
  misc_feature (61): n=a or g
tggatagcacacctctgttgatcacccagaccaatcatgaatactacagcaacaccatggncaatgtaatcccatcttctcctttctttctcacatacagaagtcagggccttgttcccaa

SEQ ID NO: 32992 - DNA, 121 bp, Artificial Sequence
  Synthesized
  misc_feature (61): n=a or g
cacctgtagtgcttgtactggtgtcaaaatacttgacaatgaaaagtagaaaactcagttnttttcaagggctgcaactcctgaacttacctaagcacccgttaaattaccacgggagtgc

SEQ ID NO: 32993 - DNA, 121 bp, Artificial Sequence
  Synthesized
  misc_feature (61): n=t or c
gtactggtgtattttctcatcttctgttctcttttctcagttgtgatcagaactttatacngtatataaaactacagtgcagtctctgcaaatattgtatgtgtttcacagtcagaaaaat

SEQ ID NO: 32994 - DNA, 121 bp, Artificial Sequence
  Synthesized
  misc_feature (61): n=a or c
gagagaatttagcttgacaaatgagaactacttccttttcccagccaactgaaattacttncatggtgctagagggctctcctttgagccccttgcatgtcgtgtctccttatttcagatt

SEQ ID NO: 32995 - DNA, 121 bp, Artificial Sequence
  Synthesized
  misc_feature (61): n=t or c
gatcatccctgcaaactttccttgttcagcatataacactgatcacagcgacaagaaacancccatgccacgaataccctggcggagtatgtaatgtggagctgaggcagtaggacttcat

SEQ ID NO: 32996 - DNA, 121 bp, Artificial Sequence
  Synthesized
  misc_feature (61): n=t or c
tgaagtggttgtgttcaagcaatacccagtgctgttctgactataaaatacacttctgaantaggtgatgtacataagctttctgcagatccagcttgactcagatgagctgtagatccat

SEQ ID NO: 32997 - DNA, 121 bp, Artificial Sequence
  Synthesized
  misc_feature (61): n=t or g
ttaattagaagttaaagatcaaggttctttgcagctataaatcaactgagaaattacaatncagagtagcatagaatttgcagcagatatttatggatgtccctttctgcagaagggcctc

SEQ ID NO: 32998 - DNA, 121 bp, Artificial Sequence
  Synthesized
  misc_feature (61): n=t or c
ctttgccaggggattttaatgagatgcacaccctcaatgcccaatgaactggatttaatangtttttaattgtctggggttgcgtttttctatgggggagaaggaaaatcagagccataag

SEQ ID NO: 32999 - DNA, 121 bp, Artificial Sequence
  Synthesized
  misc_feature (61): n=t or c
ctacgaggtcggggtagtcctgtctgcttcccagacagcttccaggaggatgtcccatttngctgtgtggtgtttgttaccaagagcaaagccccacagcaggctcttccctctggccttt

SEQ ID NO: 33000 - DNA, 121 bp, Artificial Sequence
  Synthesized
  misc_feature (61): n=t or c
gctccgtgctgcatgctagtatttccagtttgattgctgttagagatttccactgtgcttntgcatctttaatgtgacctaaagggcctaacatccactaggagagcagaatgagagctgc

SEQ ID NO: 33001 - DNA, 121 bp, Artificial Sequence
  Synthesized
  misc_feature (61): n=a or t
ttaaaggtagtccattggataacactttctgctatgacaaatatttcaggtggaacagatntatgctactgaacactcagttgactattggcagtgggtactctttgggagatagacttga

SEQ ID NO: 33002 - DNA, 121 bp, Artificial Sequence
  Synthesized
  misc_feature (61): n=a or c
acttcttaattagagagaaaatcctcttaattattaactctcaggataaaaattggaaacnacagtatatcacatggtcacagtactctcactcatgtacctaccttaagtcttatttatt

SEQ ID NO: 33003 - DNA, 121 bp, Artificial Sequence
  Synthesized
  misc_feature (61): n=t or c
catggagttacttcggaatatgtaaatatttgcaaattaattatccagatcacccttttgnttattttgtattacatcgtgcaaatagcattggtgatttcccagagaaaataaacataga

SEQ ID NO: 33004 - DNA, 121 bp, Artificial Sequence
  Synthesized
  misc_feature (61): n=t or c
ctgtgcactcaagcgatgcagctatgcttagaaccagctgagatcaaacagtctggcattncacatcaactgaaaaaaagaccaattttgtgctccaaaaaacacaaggaggaaaatttct

SEQ ID NO: 33005 - DNA, 121 bp, Artificial Sequence
  Synthesized
  misc_feature (61): n=c or g
actgcatacacaaccccagtgcctgatctcgtgtgctccctgtgctggaagtcactgttcncctgcactggctctcgagcaccttgcagggtcaggcctgttgcacttaattgtaatatct

SEQ ID NO: 33006 - DNA, 121 bp, Artificial Sequence
  Synthesized
  misc_feature (61): n=a or g
caaactatccaggatttggccaatgatttaaagatagcatcacagtgtccatgaaattgcngtggtttaaattcttaaagacagtatcctgggcttggctttttactgttcattttacaat

SEQ ID NO: 33007 - DNA, 121 bp, Artificial Sequence
  Synthesized
  misc_feature (61): n=t or c
tagagttttaatgggcactaagattgcttgagccatgacaagagtggatgctcttcacttngtcatcattctttactagtttatagttttgaagctctagccctcaacaaaatgcagtcct

SEQ ID NO: 33008 - DNA, 121 bp, Artificial Sequence
  Synthesized
  misc_feature (61): n=a or g
ctcttacttgaacaactgtttcccccccccccccttctatttgtttctgttttaatcaccntattacaaacacaatttaaatccccattgcagatgcaggatatggtaacaacaatcaaca

SEQ ID NO: 33009 - DNA, 121 bp, Artificial Sequence
  Synthesized
  misc_feature (61): n=t or c
tactgcaggaactgggtgggacagatgacgccaaatgattcaaagagacattctgtactanatgatgagctcagcaatgaagggtgaggaaaaggatggagggaggagcatttgaaattac

SEQ ID NO: 33010 - DNA, 121 bp, Artificial Sequence
  Synthesized
  misc_feature (61): n=a or g
ctgtgaacttgaacatacattgatgcattgaggagaggggtaaatctgtgctgatgattcntggttaagtgtttcctcattcaccatggctttcaattaggtgtatgccctctggcttcat

SEQ ID NO: 33011 - DNA, 121 bp, Artificial Sequence
  Synthesized
  misc_feature (61): n=a or g
tagcaatgcacacacattgtctatctacgcccttgacttactacaatgtgcttctgtcctnactttgtactgtataagagttccccctactggctgagctactggagctacatcaatttca

SEQ ID NO: 33012 - DNA, 121 bp, Artificial Sequence
  Synthesized
  misc_feature (61): n=t or c
gggttgcaaccccccagtggtagctgccactggtgatgcaaaagcatgttttctttttccncttaaaaacatgcgtacaacaccatgccctaaacctcactttttccctgcaaacgtggtc

SEQ ID NO: 33013 - DNA, 121 bp, Artificial Sequence
  Synthesized
  misc_feature (61): n=a or g
aaccagtacaatctgaaccagttaaaatggtggacagatttggtaagttgaacaagccaanaggttcaagtacgcttttaataatctctgaggacttgatttttgtctgaactttgtactt

SEQ ID NO: 33014 - DNA, 121 bp, Artificial Sequence
  Synthesized
  misc_feature (61): n=a or c
acagtctatctgaaaagactgaacacatctcttctggaggaaaatgattgcccagagctantattatagctgatataaaatgaattagaacatctcaagtaaattagacattcaaggaaag

SEQ ID NO: 33015 - DNA, 121 bp, Artificial Sequence
  Synthesized
  misc_feature (61): n=t or c
acactgctaactttaaagatctgaaagccacatttgtcgggggcactctaaaatgaattangctattgaagagaagaaggcagccagcaatctttcagcagactacagcaactgaaattat

SEQ ID NO: 33016 - DNA, 121 bp, Artificial Sequence
  Synthesized
  misc_feature (61): n=t or c
atcaaagatacattgtttcagtgcataagccctttttcctgaagactatttccttccaaangtgggattctgaagtacagccctaaaaatctctgaggttttaacttgcatccccaacaat

SEQ ID NO: 33017 - DNA, 121 bp, Artificial Sequence
  Synthesized
  misc_feature (61): n=a or g
tttcttggctaagactccttttccaatcacacccctttgaaaataactacagtaatatacntggttgtcttcatggctgtgttccaccaaatctaaagccattatgcatagaaacactgag

SEQ ID NO: 33018 - DNA, 121 bp, Artificial Sequence
  Synthesized
  misc_feature (61): n=t or c
ccacaaaatctcaaactgaaagaattcaggcaaagaggaaaaatgttggattgcctaagancatctgaacattggtaaatgacaacagaagtgctgaagtggacatgctcagagcttgccc

SEQ ID NO: 33019 - DNA, 121 bp, Artificial Sequence
  Synthesized
  misc_feature (61): n=c or g
tacaacacgcgtgtggggcagcagccagggcactctgcctctggcaatggctcaaggctgnaactattgacacaactcggtttttcccagctcctgttctgtgatcaaacaatcaggagag

SEQ ID NO: 33020 - DNA, 121 bp, Artificial Sequence
  Synthesized
  misc_feature (61): n=a or c
atgactttgataaccctacttctcctaagaagttagatactgttttcaggtgaaacagagnataccaatgactatggatcagcagtttcattttacagtagctaagatctggcatacaata

SEQ ID NO: 33021 - DNA, 121 bp, Artificial Sequence
  Synthesized
  misc_feature (61): n=a or g
gggagtttgaagtgccagaaaggaacattatagaaacatgggcatacaggaaagagtccangaaggggccatgcaggtgattaaggatttgaaacactgattgtatgtaagcaggaagtaa

SEQ ID NO: 33022 - DNA, 121 bp, Artificial Sequence
  Synthesized
  misc_feature (61): n=c or g
aattctacaagcttagagcagacaggatgtaaagctgcatagcaggaaagaattgttagcnaacagttatctgaatataaaacagcagtgtatccaggtggccatgaaagtcaacagcatt

SEQ ID NO: 33023 - DNA, 121 bp, Artificial Sequence
  Synthesized
  misc_feature (61): n=a or g
cgtgctaaattttcacttttctcagaagtaagaaaaacagaaggatcctcagtaatgatgnttcttctgactgacaagaatgtgcaccatgaggctgttatttggttttaaattatatcct

SEQ ID NO: 33024 - DNA, 121 bp, Artificial Sequence
  Synthesized
  misc_feature (61): n=a or t
aagaaacgtatctctgtactaatagtcacacaggaagctttcacaagctgaaagctgcagngcatgcaaagtacaatcttattattgatgcctgtgtttttaaaaccaacattcttcctat

SEQ ID NO: 33025 - DNA, 121 bp, Artificial Sequence
  Synthesized
  misc_feature (61): n=a or g
agtactgaaagaggggagttagagaaagcaattgtaggaaacgaacagaagttgtctgagnggaaaggggggaaattgaatgtaggaaagaggtgtgctgaggagagagcaagcttgcaag

SEQ ID NO: 33026 - DNA, 121 bp, Artificial Sequence
  Synthesized
  misc_feature (61): n=a or g
gtcaatgagcctcttggagatgccattgaccagggtgaggatgggagcttgggtttttttnatatagaaatagaaaagggctttggcatcctcaggaaatgagtatctttgctcttagtac

SEQ ID NO: 33027 - DNA, 121 bp, Artificial Sequence
  Synthesized
  misc_feature (61): n=t or c
agcagccaacagcgcccacccaatagcccacaccctgcctgcagggacacgtggggacatncaggatgggaagatctaacctgcttatcaaggaacacttcctaacaacaacaaacatctc

SEQ ID NO: 33028 - DNA, 121 bp, Artificial Sequence
  Synthesized
  misc_feature (61): n=a or g
agtgcaatctggttatctaccactttgtacattaagatctggagctaatgaagagtgttgncacttcagcactgagcaatggagagcacatatgtctcatcttctgttgcaacagagggag

SEQ ID NO: 33029 - DNA, 121 bp, Artificial Sequence
  Synthesized
  misc_feature (61): n=a or c
ttctcctgcaaataatgttataaatataactaaagaaggcaaccaaaacttgtgtttctgnagatgtgaatgcaagcaatgggagagagaataaatttcccaccagctcacactttctatg

SEQ ID NO: 33030 - DNA, 121 bp, Artificial Sequence
  Synthesized
  misc_feature (61): n=a or g
actacttcaagatacttatgaattgctttacctctctatgcactctatatcctataagaanaacccttgctctgccctttttattttaaataaaggaagcccattattctccaatctggca

SEQ ID NO: 33031 - DNA, 121 bp, Artificial Sequence
  Synthesized
  misc_feature (61): n=a or g
gagggtcctacaggaggcagccgagattccttgctttaaagggacactgtcaaaatgaatnatgtagacatactgttgaaagtagattcataagacatactgattactgttattatcaatt

SEQ ID NO: 33032 - DNA, 121 bp, Artificial Sequence
  Synthesized
  misc_feature (61): n=c or g
tgggagatgagagctatggcagtacacactgtactttggtccttgctcccaacagcactcnactttctgtcccttcccaatgaagacactgcaaaccgaagagctttatactgaactacca

SEQ ID NO: 33033 - DNA, 121 bp, Artificial Sequence
  Synthesized
  misc_feature (61): n=a or g
ttggagtcaatcatatataaatgacagaactctggatggactctcattcagatagatcccnacttggattttcatcagaaaatttgctcaaagctattggttttagttcaacactgaacat

SEQ ID NO: 33034 - DNA, 121 bp, Artificial Sequence
  Synthesized
  misc_feature (61): n=a or c
gtaacacatgaagaaaattcattacttagcatcataaagatttcactgctcatttccaatnaaatctacaatatgaagcccagaaatttgtaaagcattgcttttatgtacagtggtagac

SEQ ID NO: 33035 - DNA, 121 bp, Artificial Sequence
  Synthesized
  misc_feature (61): n=a or g
ctatgctgtcactaaacagattcagtagaaaagtatcttaactttttctcatctccttcantaacatgccagaagtttaattctttcaacaactaattcccacatttttccttcctttcat

SEQ ID NO: 33036 - DNA, 121 bp, Artificial Sequence
  Synthesized
  misc_feature (61): n=t or c
gttagaacaagtgttacagatacaacagctgaatccatcagagaaagcggtatcactacangatgaccatttggtgatagaccatccacccagacaggcagggagaatataagcaggccgg

SEQ ID NO: 33037 - DNA, 121 bp, Artificial Sequence
  Synthesized
  misc_feature (61): n=a or c
taaaaaagatgtgaaaatgtggagcttcgctatttacctaatactgcaacagcctacatanccaagcaaatgtgtaatttatgtaacacaattaaaaatgaaacaaaaatagctgatgtag

SEQ ID NO: 33038 - DNA, 121 bp, Artificial Sequence
  Synthesized
  misc_feature (61): n=c or g
ttttgtggtggtaacaggattctttgccatatttcttcacttatttgcattcactacttanatttggtacttcaaaattatgatagaaatattctttactgctgaaaggaataggtattgt

SEQ ID NO: 33039 - DNA, 121 bp, Artificial Sequence
  Synthesized
  misc_feature (61): n=a or c
tgattttggttctgaaagagcaacaaagggtaaaaacaatgcatttcttgattttgatttntgacagttaatcacaaactgctaactccatggagagtcccttaagtatttgcatagcatt

SEQ ID NO: 33040 - DNA, 121 bp, Artificial Sequence
  Synthesized
  misc_feature (61): n=a or c
ttgatcaggcaaagctcagattctttagtcatcaaggctgaagtaaaataagagtatgtanagaacagtcaaggaaagaatatttattcatcaagttacagcaacaaaagcacctgaaaga

SEQ ID NO: 33041 - DNA, 121 bp, Artificial Sequence
  Synthesized
  misc_feature (61): n=a or c
cagttttgctcagtgagatgtagctattcagggcacagaacaaactttttgatgtctgtcntggggaatgaaggcatcaggagttttgttgtatttactgttttccatctttctatcagga

SEQ ID NO: 33042 - DNA, 121 bp, Artificial Sequence
  Synthesized
  misc_feature (61): n=t or g
gaggggaatggaatgagagcaaaaggccgtaaaggagacagcagtgaagggagggattttnaaaggaatggaatagcacagggagaaaggccggtcggaagggataggtggattaggctcg

SEQ ID NO: 33043 - DNA, 121 bp, Artificial Sequence
  Synthesized
  misc_feature (61): n=t or c
catctcttgtggtatctttggatgtttcatctttggaacatcacctaagcacttcatgaangtgaaaaacagccaacctgtgtcaggttgaaaggcttactcaggccctgccacgctgcat

SEQ ID NO: 33044 - DNA, 121 bp, Artificial Sequence
  Synthesized
  misc_feature (61): n=t or c
tccaacagagacaaggagtcagaggttaattaagaaaaaaacatacctgaaatggataaanggaggactacattaaattagtttatattttctggttgcaaactgtggttactttgagttc

SEQ ID NO: 33045 - DNA, 121 bp, Artificial Sequence
  Synthesized
  misc_feature (61): n=t or c
tcagatttacaatgaaattgctctgaatacctcctcagaatgagagaatacaagattgagnattgatagaaagtaccatgggaagaactcacatcattaagtgtcaaacacatttttatat

SEQ ID NO: 33046 - DNA, 121 bp, Artificial Sequence
  Synthesized
  misc_feature (61): n=a or g
tgtcttagcaatccttttttaattgtccatagcgatgaccctgaaggataaattaaggccncagttacagttctgaagcctactgttttcagattatgctgtcctggtaaaggagactgat

SEQ ID NO: 33047 - DNA, 121 bp, Artificial Sequence
  Synthesized
  misc_feature (61): n=a or g
tttttcatgccagacaaagcaataagaaagattgcaaagattgactatggtttacaaagtnttctggttgttgtaagaatttgatcatagctctgaagtgctggatgatatgcctgtaaaa

SEQ ID NO: 33048 - DNA, 121 bp, Artificial Sequence
  Synthesized
  misc_feature (61): n=a or g
tgaaagttcccaacatgctgttcacttttggtaacacaattagctaggacttcttcaaaanccattgcacttttttgagcaattgctgcccacagcattcctgatctgactgcactggatc

SEQ ID NO: 33049 - DNA, 121 bp, Artificial Sequence
  Synthesized
  misc_feature (61): n=a or t
tactaaaaaagaagaaaacaaacactggataggcaggtatcacagaatgaagaaatactanaagcaagttagttatcaaatgttataattggaagcaaaaggatcattagactgtctgtag

SEQ ID NO: 33050 - DNA, 121 bp, Artificial Sequence
  Synthesized
  misc_feature (61): n=t or c
tagccgaagcacagtggagaaaagataggagacatgcagagagaggttatttgggaaaagnagacttgagtacaatagaaactagaacgagcagaaaaggatggggaaatgcagagtgata

SEQ ID NO: 33051 - DNA, 121 bp, Artificial Sequence
  Synthesized
  misc_feature (61): n=a or g
gagacctgcaccaatgcagtctctgctccaatgaatacttaaatagtctgtatcaaatgancagcttcaaaaggagacactaaactgccagtacctgcagaaccctggttacagaattcat

SEQ ID NO: 33052 - DNA, 121 bp, Artificial Sequence
  Synthesized
  misc_feature (61): n=a or g
ggatggtgggatttctctcagatgtaggacagtaggcaactggctggtgctgggcacaagnatctccctatacttccatgggaccattacaacagatccttgactatatgagcaccattca

SEQ ID NO: 33053 - DNA, 121 bp, Artificial Sequence
  Synthesized
  misc_feature (61): n=a or g
aagaacaaatgtttttcattaacaaatgttaactctgcagttctgtgagatattggagctnttgtaaaggaataatggacttgatattcccatgtagtaccataccaatttgaggttttta

SEQ ID NO: 33054 - DNA, 121 bp, Artificial Sequence
  Synthesized
  misc_feature (61): n=t or c
tcatgatgctaacatatcagccttggacaccaggcaattttaaagtatatcttaattcctngagtccccaaacttctttggggataggaaactttcctagataaaactctttccccattta

SEQ ID NO: 33055 - DNA, 121 bp, Artificial Sequence
  Synthesized
  misc_feature (61): n=a or g
ccctgctatttttgttaatcctcccagtttgcagtgctatacacactggagttgtgtaccntatcttggaatacctgaacagggactaataaggcagtacagtttagggtaggcctttcag

SEQ ID NO: 33056 - DNA, 121 bp, Artificial Sequence
  Synthesized
  misc_feature (61): n=t or c
tgtgtcaatgttgcatatgcttggagacaatattttctgtttttagctactaggaacttantactttgcttaatccattttgcttatcctattttaacacctagcaaaacaatttgattgt

SEQ ID NO: 33057 - DNA, 121 bp, Artificial Sequence
  Synthesized
  misc_feature (61): n=t or c
tgtggcccaatttggaggtggactatgactgttgtgagttcttgaagtccgtgcttggctnttccatgggagcgtgctgcccagaaaggctccaaaatcaccttctgctttctggcagcca

SEQ ID NO: 33058 - DNA, 121 bp, Artificial Sequence
  Synthesized
  misc_feature (61): n=a or g
ccaagctaagctgagttacacatatgaattcatccatgggatacagcagtatatattttcntatcgtgtgatgcctttattgcaaaataaaatttgaggcgttagaataaaaattgtcagg

SEQ ID NO: 33059 - DNA, 121 bp, Artificial Sequence
  Synthesized
  misc_feature (61): n=a or t
actaagttcttctcattttgccatttcaactttctcttctcaccaagtaaaaacaagaatnttttaacttctatgagagaacaactaacatctactgtgttagtttctccaagaagtgcca

SEQ ID NO: 33060 - DNA, 121 bp, Artificial Sequence
  Synthesized
  misc_feature (61): n=c or g
acgcaaagtaacttttgcctcacttcaggccggcttgcagcctattcaccacagcaaccancattccattagagaaaatctgtatttgcaacaagaggctgtgaacactgctggccttgca

SEQ ID NO: 33061 - DNA, 121 bp, Artificial Sequence
  Synthesized
  misc_feature (61): n=t or c
gctaactcgagaatcaaagcatgacagatacaaccacccaatgctgctcctatgctcatgngaagagtcacagactctcactgctcctagtacaataattgattcagttgtgtcactgcaa

SEQ ID NO: 33062 - DNA, 121 bp, Artificial Sequence
  Synthesized
  misc_feature (61): n=a or g
ggttgtagaagtatctacccaacttcatggtgcaggtgctacataaaaggcctctgctgtngtttgagcttcacatttgttggatgccaagcatggaaagctctttaaaagcctccacaca

SEQ ID NO: 33063 - DNA, 121 bp, Artificial Sequence
  Synthesized
  misc_feature (61): n=a or g
tctctcggctcactctgacattcactgtccattgccttcactggcatccaggctgtcccantggatgtcttcctcttggtattattagtgctagggagaaagtttgccagtatgtctgaga

SEQ ID NO: 33064 - DNA, 121 bp, Artificial Sequence
  Synthesized
  misc_feature (61): n=a or g
cgtgaatatctatgggaaagcagccaagaagccactttgcaaggactgccttttgcccacnacatccaagtccaagttctacctggcctttgagaactccatccaccaggactacatcacc

SEQ ID NO: 33065 - DNA, 121 bp, Artificial Sequence
  Synthesized
  misc_feature (61): n=a or g
cacccagagggggttctgtagctgaacaaactgcttcaccccaatgctccttcagaaaggnggtttacacactgctcccattccatgcccagaaagctgctgcacccagatgctaaccatg

SEQ ID NO: 33066 - DNA, 121 bp, Artificial Sequence
  Synthesized
  misc_feature (61): n=t or c
ggcatccagagtgcgttttgttaatgaagtctgtaaaattctaaacgaacttctggttttnctcatgaaggaagtttcatccctgccattatttgtgccttggaatgatattcctgtttaa

SEQ ID NO: 33067 - DNA, 121 bp, Artificial Sequence
  Synthesized
  misc_feature (61): n=t or c
ttgtaactccaccttatttggtttttgaaacagcttctagatctttacagcacatagctcnatacctaatttgcctaacaaattccacttcaatgacaacaaaatgaaacatgcattttgg

SEQ ID NO: 33068 - DNA, 121 bp, Artificial Sequence
  Synthesized
  misc_feature (61): n=t or g
acccttacacttcctagtggaaaatgtgaacactgctttatcacgcacacaaaaaaatcantgcagtcagttactgacacatcacatatttgtttcacattggagaagggcttttatcaat

SEQ ID NO: 33069 - DNA, 121 bp, Artificial Sequence
  Synthesized
  misc_feature (61): n=a or t
tatgctgctgaatattttgagaaagatttgaggttacacctaaaggagaaatttctcttangagttaggcctgaatgactttccttagaattaacaaataagaaatgaaagacaaacctct

SEQ ID NO: 33070 - DNA, 121 bp, Artificial Sequence
  Synthesized
  misc_feature (61): n=c or g
aaacactgacatcatgtttggaacagcttttttttctttcccccttttctgttctaattgngtggagattttaaagccaaggaataaagtctctccctctggagtgggagaatgttcccca

SEQ ID NO: 33071 - DNA, 121 bp, Artificial Sequence
  Synthesized
  misc_feature (61): n=t or c
aattaaggagaaccccaaaaaatacgtctgtcagatagttacttgaagtcctctctgattncctgttccataacatcttggctgtgaacaatgtcaatactcttttagagtatattcagga

SEQ ID NO: 33072 - DNA, 121 bp, Artificial Sequence
  Synthesized
  misc_feature (61): n=a or g
ggggtgcttgacttcctaggatcccagcggtgtccaagaatttagcctgtaattataactncttgttgctattacatctgtcatcctaacatgcaactccagctgtgtgagctctcagaat

SEQ ID NO: 33073 - DNA, 121 bp, Artificial Sequence
  Synthesized
  misc_feature (61): n=a or g
tgtgttttatggatctgttttgtcttcacttaaattagtagataggtgttacagagtactnttatctctagattttacaaataaaagtaagcattcacccagtgtgcatccatgctccaag

SEQ ID NO: 33074 - DNA, 121 bp, Artificial Sequence
  Synthesized
  misc_feature (61): n=a or t
ttcccactgtcaggacatttgtgctatgcttccagtaaaactcatttacctgcctaaaaanattcctccaaagactctctcctcaaaaatccatcttcccttactcgttgactccaaaact

SEQ ID NO: 33075 - DNA, 121 bp, Artificial Sequence
  Synthesized
  misc_feature (61): n=t or c
ccagctactgaatgacctgtttcttataaattagattaaattggttatatttcagggctangttttcttatgaatttggcatttaaggatcataccacactggcaggcctgaaaggtgata

SEQ ID NO: 33076 - DNA, 121 bp, Artificial Sequence
  Synthesized
  misc_feature (61): n=a or g
actttttcagtggaaaagcatcctgtgcatatggacagtgagcacgttgtaaatgcacagntgtgtcccaagtggggccgccttcagaccagaactcacaagttaaacagagcacaacttc

SEQ ID NO: 33077 - DNA, 121 bp, Artificial Sequence
  Synthesized
  misc_feature (61): n=t or g
ctggattccttatctacagcagctctgcccttcatctgctctggctcatatcccttctgtnttcacatgagatatctgtcttaatgagcttctgctggggttgctgcaagagaaggcacaa

SEQ ID NO: 33078 - DNA, 121 bp, Artificial Sequence
  Synthesized
  misc_feature (61): n=a or g
tttccattttcagaaggcatgtgcaaaatggggcagagtaggacgctggtctttatttctnttctcaagcattcctcatatccttgagttttgtcttcctgctttcacttaattttagtgc

SEQ ID NO: 33079 - DNA, 121 bp, Artificial Sequence
  Synthesized
  misc_feature (61): n=a or g
actttgattccaccttcctgataaaaccgtatttctttgataaaccttgaccacttttctntgcatttctctgcctggatgaccaaaggttccccaccagttttcatgatttgcagctcag

SEQ ID NO: 33080 - DNA, 121 bp, Artificial Sequence
  Synthesized
  misc_feature (61): n=a or g
tttgttaaataaataatcttttctgtgcttctcaagcttccctgactttactgctgtcatncttctgtctcggaactcattaaaaccacagcgagctaacgagtcattttcacacatcatc

SEQ ID NO: 33081 - DNA, 121 bp, Artificial Sequence
  Synthesized
  misc_feature (61): n=t or c
accttgacacggctgacttgggatctgcgatgcaaaacagagggctgcattttcaggtcangtcaaggcaaggggaagttactccctaaaacacttaccaggacttggaagagagaagcag

SEQ ID NO: 33082 - DNA, 121 bp, Artificial Sequence
  Synthesized
  misc_feature (61): n=a or g
acaaaaagcagaaaaacatgacataggaaggaaagtcagtgcttggaaaatactatctgcntgcagctcagatcactgatcttacttctatatgttcttaaattgtctttcccattttact

SEQ ID NO: 33083 - DNA, 121 bp, Artificial Sequence
  Synthesized
  misc_feature (61): n=a or g
aaaatgtatttaagcacagattttgtttctcttcacgttacttcatgttctatgacaggantactttgattaattaatttattctctattaagttccattaaacacacttaagagcagttt

SEQ ID NO: 33084 - DNA, 121 bp, Artificial Sequence
  Synthesized
  misc_feature (61): n=t or g
tcattaaagtgggaaatatctctcattcatttgcattggtttgacctgtgctcctggtttnctttcccagctagggacatggttgttgctcccagccaagtgccaggtgtatggcatgtga

SEQ ID NO: 33085 - DNA, 121 bp, Artificial Sequence
  Synthesized
  misc_feature (61): n=t or c
tctgctaaacaacataaaaaaaaaacaagagcgttccttttaactgcctaccatattatancaaattttaaacagagtcaacctaacaagctcctcggtattaacagagcacgataaggag

SEQ ID NO: 33086 - DNA, 121 bp, Artificial Sequence
  Synthesized
  misc_feature (61): n=t or c
ctttttataataatctgttctgatataggaatcatttagattgtgcagagaatagaccacngttgcagactactgcagtgttaactttcttaatattatttgctgtgattcagcactgagg

SEQ ID NO: 33087 - DNA, 121 bp, Artificial Sequence
  Synthesized
  misc_feature (61): n=a or t
gttgacaagaagataggtaagtgaatctgtcccccacgtattagtcttaaaggagcttgcntgagtgctaaaaattaaacgtaaaagaatgcaatgcaatcagttccattgcaacatactc

SEQ ID NO: 33088 - DNA, 121 bp, Artificial Sequence
  Synthesized
  misc_feature (61): n=a or g
tgccttccccgcttcccattgtcctcctctccctacacaatccactgctgtcaaggacctnggtgcttctttcttgcaactttcttcctctgaggcgatgcttgtccacgctcagcctcaa

SEQ ID NO: 33089 - DNA, 121 bp, Artificial Sequence
  Synthesized
  misc_feature (61): n=a or g
ggctgtggcgctactccagtttatatttgtaaatacctgaggaaaactggctttgacaggnaatttgaagtacttttggcagctttgttagtcttgggcatttaaaatgagaaggaaagta

SEQ ID NO: 33090 - DNA, 121 bp, Artificial Sequence
  Synthesized
  misc_feature (61): n=t or c
tggagtctcctaggagaagtttaaccaaaaagcagcagcataaatgatgcagacttgctgngggtttccttatcttgaagaaatgagcagttagatcaaaatgacaattttgttgatattt

SEQ ID NO: 33091 - DNA, 121 bp, Artificial Sequence
  Synthesized
  misc_feature (61): n=a or t
gaattacttgtttcagaatttaggtcaaaataaagggaatcaccactccaagaacagcccnaaatgaaggccaatgtatttttactttgtattacagtgccctgaaccccatccagcccct

SEQ ID NO: 33092 - DNA, 121 bp, Artificial Sequence
  Synthesized
  misc_feature (61): n=t or c
gtctaccattgagccagtttttaatccatgtaaagtatgccctgataattccataaaatgnaagtgctttaatcaaaatgctgtatggtgctgagtcaaagatattttgaaaatccaaata

SEQ ID NO: 33093 - DNA, 121 bp, Artificial Sequence
  Synthesized
  misc_feature (61): n=a or g
aaaaattttcacagttctccttgggatctgggctggcagggttaggaaggatgaaggaagngaaaacttggcatagcaaatcattcaatgaacttaccagcatgcaatgccagttaaaagc

SEQ ID NO: 33094 - DNA, 121 bp, Artificial Sequence
  Synthesized
  misc_feature (61): n=a or t
aagtctgtacttaatcagacaggcaataatagcagacagaaagtctgttttctcacagagntactatggtttgtatgtacattcagccctaatatgagcaagtctactattattttctaat

SEQ ID NO: 33095 - DNA, 121 bp, Artificial Sequence
  Synthesized
  misc_feature (61): n=t or c
aatatgctgtctgatttgctaacagagtggaggggtgttcacgttcggtgcaggttcctgngggcaactgggacatgattccatgaatgatgaagtgaacccccgaagagttcttgagctg

SEQ ID NO: 33096 - DNA, 121 bp, Artificial Sequence
  Synthesized
  misc_feature (61): n=t or c
cttcatttgtataattttacagagggtggcttaaaaatgaatgcacacaatagaattatanggtattctcaggggttcaaacaagttgctgtctgcctaagggaaggccgatcgagtgatt

SEQ ID NO: 33097 - DNA, 121 bp, Artificial Sequence
  Synthesized
  misc_feature (61): n=a or g
accaggggacttgaaagccaattctgcactgcaaggcaaggaacagggagtgatttgaacntactaggtcctttcatcatgtccccctttgtccccactgcctcctgacctgtaaagttca

SEQ ID NO: 33098 - DNA, 121 bp, Artificial Sequence
  Synthesized
  misc_feature (61): n=t or c
agtgaaggaagccacactgtggcaatccagtaaggatgaaagagaagcaaaacaagtcagngtattgatattcctttatctcctccaccaccgttgtaaagaccagcactgcagcgtggcc

SEQ ID NO: 33099 - DNA, 121 bp, Artificial Sequence
  Synthesized
  misc_feature (61): n=t or c
gtcacatccactgcctcatattcatttttgccttggttgctctcagtcattcagtatcagngtagttgctatctggtaaccacactgctcctagcactgtgcaaaattgctccccccctgc

SEQ ID NO: 33100 - DNA, 121 bp, Artificial Sequence
  Synthesized
  misc_feature (61): n=a or g
gtggtagtcaacagcaaaaattctgcttatgcaatggggtcagcacacatacatgatcacngagactgacatccttaaggtcagaccagaggagccacctggctttaaagccaagacactt

SEQ ID NO: 33101 - DNA, 121 bp, Artificial Sequence
  Synthesized
  misc_feature (61): n=a or g
gacatgcaagcataatgctgtgggagatacaagagaagagaacttgaggaaagggaaagcncaatgactccgttagtaaagctctgagtacacatcctagttcaaaaagttcagctgctta

SEQ ID NO: 33102 - DNA, 121 bp, Artificial Sequence
  Synthesized
  misc_feature (61): n=a or c
tcatgatgctataatatttcagaaggaccacattctctttaaagtcattggttttaagagntcaagcccttctgtttttctctcccacacctccaaatgaaaataaattcaagtgatactg

SEQ ID NO: 33103 - DNA, 121 bp, Artificial Sequence
  Synthesized
  misc_feature (61): n=a or g
ttacaagctgtttccaaactgaataccaccaacaaagcattctccagaatcagatattgcnagttatttgctttgctttgtgatagaaaccatgaaccaccaagtgtgtgcccatccttga

SEQ ID NO: 33104 - DNA, 121 bp, Artificial Sequence
  Synthesized
  misc_feature (61): n=a or g
ggaaagaccttgcttccgaagctgataccagctttagcacatatgtttgccccctgctttntcctaggcctttctgaagtgtaacttgcagccggtcaatacctatttgtgtgctacgtaa

SEQ ID NO: 33105 - DNA, 121 bp, Artificial Sequence
  Synthesized
  misc_feature (61): n=a or g
ggcagctgctgctgtctggaggttgtcaagtgtgtgttaagaggaaggaaaaaagtgggtnttgctactgatggacttctctcacaccttgtcactttttatgttgcacagaccaactggt

SEQ ID NO: 33106 - DNA, 121 bp, Artificial Sequence
  Synthesized
  misc_feature (61): n=a or g
ggataggagatctgtgtaaagaaatccttagaaaattggtggatggcttacccttccccancttgcaattattagtgaaaatatggaaagattttggaaagggttctccctcagagaggtg

SEQ ID NO: 33107 - DNA, 121 bp, Artificial Sequence
  Synthesized
  misc_feature (61): n=a or g
cccaaactgctgggagtgcaggttgttaatgcatggtacagatactgcgttatctttatcntctgactttgctggctgcctggtgtccacacatttttacagtcaactcttttccagatca

SEQ ID NO: 33108 - DNA, 121 bp, Artificial Sequence
  Synthesized
  misc_feature (61): n=a or g
gaatctggggagttgaacaacagctatcggtaaccacataaacttcatcttttatttggtncctcccatctcttaccttctcttgtctactgaggtcacaagccctttggggggatggatg

SEQ ID NO: 33109 - DNA, 121 bp, Artificial Sequence
  Synthesized
  misc_feature (61): n=t or c
cacattgggaaaagctgttaatgagctccagcaaagtgcctgggtaatggtcatatctggntctgagagatgaagaaacttgaaaccaggcttagtggtgctgcctgcagtgggaaggaac

SEQ ID NO: 33110 - DNA, 121 bp, Artificial Sequence
  Synthesized
  misc_feature (61): n=a or g
tgctctttggaaaggaggctacatacaaaaggtatttagctagggcagggaaaaggcacantaaatgcaaacattggccagcaactttagttaaaattccagcagttgctgctgtgattaa

SEQ ID NO: 33111 - DNA, 121 bp, Artificial Sequence
  Synthesized
  misc_feature (61): n=a or g
ccagtatgacaactcaacagctttcagtacagctttcatttctgtgccaataatttttacnttgcagagtgtcctggtggatttctactgctaagtaatgatgcctgtgtaacgctgtttg

SEQ ID NO: 33112 - DNA, 121 bp, Artificial Sequence
  Synthesized
  misc_feature (61): n=a or g
catgtagcgtagataaagcgtgatgtttacacagaggtgcatgcaattgaacattgatgtncttaatgccattaggcttctacagactgttttctgtaatctgcatgcattttttttcctg

SEQ ID NO: 33113 - DNA, 121 bp, Artificial Sequence
  Synthesized
  misc_feature (61): n=a or g
tcaaaacaagatggcttccagccaaaattcaagcaatttatttcccgctgtggaactttcngtgagaatttggtcccagttcctcatactcccattggcactgaagagccaaaggctaaga

SEQ ID NO: 33114 - DNA, 121 bp, Artificial Sequence
  Synthesized
  misc_feature (61): n=c or g
ttcaccctcctggggaacaggcagaagaacatcatgctggggacagtggaaggctgttcanaagagagcagaaggctctatccaggcatactgctatcatttgatcaggacatttgcacaa

SEQ ID NO: 33115 - DNA, 121 bp, Artificial Sequence
  Synthesized
  misc_feature (61): n=a or g
tatggaaactatgtcaaacataatcaaagcagacatgcaaagtatttacagttatgcctantaaatcctttaaggttttgacttttgtttgttagccgttaatatgcctttttcagatact

SEQ ID NO: 33116 - DNA, 121 bp, Artificial Sequence
  Synthesized
  misc_feature (61): n=t or c
ctggggcatgcatgctggggcagccactgcagtgagctgagcttggtcttggctttagatngtggaagaggaagcgaagaaggagctggaggagaataagcgctcgttggcagcacttgat

SEQ ID NO: 33117 - DNA, 121 bp, Artificial Sequence
  Synthesized
  misc_feature (61): n=t or c
gacgaatgcacaacctccttctggagctgctgttattcagtaagcgtcctgagtattaaangcatacctgtcactccttataattagactgtggcctcaaggttatgatcgtagaatcaca

SEQ ID NO: 33118 - DNA, 121 bp, Artificial Sequence
  Synthesized
  misc_feature (61): n=a or c
gaccacgctgggaaggcagctggctgctgttacactgcttcccccacctgagaaaggatgngagttctccctttggctctaccaaaagaagcagcagggacgctttgctctgaagctgtgc

SEQ ID NO: 33119 - DNA, 121 bp, Artificial Sequence
  Synthesized
  misc_feature (61): n=a or t
aggcagatataagcttccagcaatttacagtatttgtgaattcctttccacaaattatttntgctaagttttacctgagatgagccttgtggagtgttactctatttgtattgataaggtg

SEQ ID NO: 33120 - DNA, 121 bp, Artificial Sequence
  Synthesized
  misc_feature (61): n=a or g
acccagcttcacaagagccccctccagaacagggctgaggggcaaaaaggcagcagtactnacactacctatgctgtacctttccagagaggcctgcagtcaccatggatgtcaatacagc

SEQ ID NO: 33121 - DNA, 121 bp, Artificial Sequence
  Synthesized
  misc_feature (61): n=a or t
attctgtgatcaaaatgggtaaataatgaaaacattcattcagtaaggaacaattatgtanatttcagatgctgttgaataccatcccatcctctgtaaaaataagtgagtaaataaccta

SEQ ID NO: 33122 - DNA, 121 bp, Artificial Sequence
  Synthesized
  misc_feature (61): n=a or g
caggatagctgttgcaaaagaaggagagacgaataaggctgttagctttgaggtcagaccntgcagtctccattttaatgagaatcatgtgtggtttgttgcagtccagacaaaaatctaa

SEQ ID NO: 33123 - DNA, 121 bp, Artificial Sequence
  Synthesized
  misc_feature (61): n=t or c
ataggaattggtcccagtgagcgtgctccatatccacatttagtatcttctcataaacagngctggaaacacagcaggcccttgatgaagatacactagattatttctaatttaaagttat

SEQ ID NO: 33124 - DNA, 121 bp, Artificial Sequence
  Synthesized
  misc_feature (61): n=t or g
tgtagccaaatcctagaatgttgcttgcatacagtgtatatcctggaaaatagccctgaangtatagcatgcagggcatatctcagaaaccatatctattgtctctcattctgtgatttgc

SEQ ID NO: 33125 - DNA, 121 bp, Artificial Sequence
  Synthesized
  misc_feature (61): n=t or g
gggacctagcagatggaacacatctcagcaaccagcatgggtaagaatagaccatccatancgctgcagggaaaagacagagccataacctacatctcagaagaatcacaagacaacagtg

SEQ ID NO: 33126 - DNA, 121 bp, Artificial Sequence
  Synthesized
  misc_feature (61): n=a or g
gatattgcatgtggataacctgttagatgagcaaaaattagtagcagcggtgataacaacnaagatgaatatatgtatatctgaagggaaggagcctgggaagccaaaaacctcaacagtt

SEQ ID NO: 33127 - DNA, 121 bp, Artificial Sequence
  Synthesized
  misc_feature (61): n=a or g
atttaacacattcccaagtattctgtgcaacacgtcctgcagataattaaagggagacacngaggacaaagtaacgtctgtctttgtggaatattgcacttagaaaaaaataaaacaaccc

SEQ ID NO: 33128 - DNA, 121 bp, Artificial Sequence
  Synthesized
  misc_feature (61): n=a or c
taacttttcaactgcttctgaagtcgtgtgtttatttaacagggatttcattatgaatttntgttttacccctgttgttttatacatttatgtatttacataccattctcactgacgcatc

SEQ ID NO: 33129 - DNA, 121 bp, Artificial Sequence
  Synthesized
  misc_feature (61): n=a or g
agctaaattgccccgtggcaatgactgcactaacattatcacttgtacaaacagttctgcnttattcttttgcaaagttattatagcagtgtagatagcttttgtgtgggagaagtatcac

SEQ ID NO: 33130 - DNA, 121 bp, Artificial Sequence
  Synthesized
  misc_feature (61): n=t or g
caacaagatctccccttgagtagggatgcctcttgaggttacacctgagcacagatcctgnacatcttgccaatacagactatcagtaaacaactaatagtttgttttagactttgttaac

SEQ ID NO: 33131 - DNA, 121 bp, Artificial Sequence
  Synthesized
  misc_feature (61): n=c or g
agttctacaaaagtagcaggctgtgtttgcaggacctgcagcacctcatgtcagccagcanatgagctctcaggtaatgctgcacacatacttctcgctttaacaggcacataagcaacaa

SEQ ID NO: 33132 - DNA, 121 bp, Artificial Sequence
  Synthesized
  misc_feature (61): n=t or c
acaacacctttcttctgttacttaattacatatgccttctccactttccttacctaacccntccggtcaacccaggaaaaactcctaccagaactgtctgcaagacggttaaaggccactg

SEQ ID NO: 33133 - DNA, 121 bp, Artificial Sequence
  Synthesized
  misc_feature (61): n=t or c
cagagcaagaggtgtctcttaatagcagtcaagttcctttggcctagtcaattttgaatanatcacgcaaaaaaatatctgacatactcagatttggtacttctgtatatccttctgcatt

SEQ ID NO: 33134 - DNA, 121 bp, Artificial Sequence
  Synthesized
  misc_feature (61): n=a or c
ttttttatagaagcatcagtttccgaacttggtagcaaagagtaactcaatcagcaaagantgtgattgtcacttagcaaaaccgtgcaggcctttcatcctcaggtgccagggctgtgtg

SEQ ID NO: 33135 - DNA, 121 bp, Artificial Sequence
  Synthesized
  misc_feature (61): n=a or g
tactgaaatatactattatattagcctccttggaaaaatctatcacttctttctttcatcngaatagtagcatgtgaaatttcatttattttatcaagttatttattattaatcctgagct

SEQ ID NO: 33136 - DNA, 121 bp, Artificial Sequence
  Synthesized
  misc_feature (61): n=a or g
ccttaactggagatatctaaaggtttaaatgctggtatgagagcagggtttgagatgcacngcctgagacccagcttttcagaagggcccgaatgtttctggcttgaggtgtctgaaagga

SEQ ID NO: 33137 - DNA, 121 bp, Artificial Sequence
  Synthesized
  misc_feature (61): n=a or g
gggatacatagatttgcaccctggctttttcagatgaagagctcacctcagcacatctgcngtctccatccatccctatctatgaaggtgtcttcagagtgcataaagtcctgtttttttt

SEQ ID NO: 33138 - DNA, 121 bp, Artificial Sequence
  Synthesized
  misc_feature (61): n=a or c
tgcacaaggaacactgcagcagctactgcacatccagcacatgtaccatctccctgccaanggtttctgagctcaaagagggacactttctttccctgcaagcagcaactggatatgtaga

SEQ ID NO: 33139 - DNA, 121 bp, Artificial Sequence
  Synthesized
  misc_feature (61): n=a or t
ttctacttaatggaataaaacataattgaagacaggcttgaagatggacaggagagactgntggtctcttctttggtactaatcttgctcctcaatagaaaagaaagcactggaaatgctt

SEQ ID NO: 33140 - DNA, 121 bp, Artificial Sequence
  Synthesized
  misc_feature (61): n=a or g
ctgcccaagatctgcccaagtacaaaaccaccaatacctttcactgaaagattttcctctntttgctttttcagtgacagtgacagtgtagcactaaaaatatttacagaatcagagcaga

SEQ ID NO: 33141 - DNA, 121 bp, Artificial Sequence
  Synthesized
  misc_feature (61): n=t or c
ctgtggaatccatcctatacgcaaacacagaaattcctcttattcaaccagagaccatctngtgacagtagaaagcatcacaaattggacagacaactactttccttttcttttggacggg

SEQ ID NO: 33142 - DNA, 121 bp, Artificial Sequence
  Synthesized
  misc_feature (61): n=t or g
gctctgtacatcttcactgctttgtcaaatgtactaagcaaaccagcagccaggaaagtgntttttcaccgggtggtgtttgagatttctgtgtaatctggaggtgctggaaaatgcagat

SEQ ID NO: 33143 - DNA, 121 bp, Artificial Sequence
  Synthesized
  misc_feature (61): n=a or g
accttcaggatcaggcttgggaggatgcaaacaaaccaatacttgcaccagagcagcaatncacaaactttcaccgtgacacacaccacctgtaatgctgagcacgctaggacttgtgctt

SEQ ID NO: 33144 - DNA, 121 bp, Artificial Sequence
  Synthesized
  misc_feature (61): n=c or g
cgtgtgatatggttctagggctttatgaacacattatagctagctctttcctttaattctnttagattgagcaatatacttttatgtcattagtgtgctttgtgctgcaaaaatataaaga

SEQ ID NO: 33145 - DNA, 121 bp, Artificial Sequence
  Synthesized
  misc_feature (61): n=a or g
ctagtttcattccagttaaatttctgtttcatggtgttgcacattgcttttctgcatgcanctgaaattagagtcaagacagcaaactgaagtaactgaaagaggttagtaaaattataga

SEQ ID NO: 33146 - DNA, 121 bp, Artificial Sequence
  Synthesized
  misc_feature (61): n=t or c
ttcactgaagctgaccaagagaaaagcatacctgacactctcattctggcacagagttcgngtttttccaggcaggagatcatggccctgctctctgaaaagaggcccgagagcaacgtgt

SEQ ID NO: 33147 - DNA, 121 bp, Artificial Sequence
  Synthesized
  misc_feature (61): n=t or g
tcagttgttaaggaagttgatattcaccttgcacacgttccttttttttctccatgtactncttctgtgtgtttatggtcttcctttcagaatggagaagtgcatttgagactaaagaatc

SEQ ID NO: 33148 - DNA, 121 bp, Artificial Sequence
  Synthesized
  misc_feature (61): n=c or g
acgttttgcatttttcaaggcaatcttaacatgcagatgtctgtatgcattgtttagaganagaagtgagaaggaaaggcaaataaattgtgccattctgatgaggccttagctcttactg

SEQ ID NO: 33149 - DNA, 121 bp, Artificial Sequence
  Synthesized
  misc_feature (61): n=a or g
cagcttccccacgctctgacctctggcaaagatctcagcgcagcgcccagggaagaaagcngagcctgtgaagaaagcgagagaaaaatcaatatttctctgggccgaggaagtcaatagg

SEQ ID NO: 33150 - DNA, 121 bp, Artificial Sequence
  Synthesized
  misc_feature (61): n=t or c
ttagcaaacagctgaatgctgcttttttgttagtccttcaaggatacacacataccagttnctgctttagttttccccacactactgtatgtgaagaaatgcttgcagtttcaaattgagt

SEQ ID NO: 33151 - DNA, 121 bp, Artificial Sequence
  Synthesized
  misc_feature (61): n=t or g
tatttgcatgcttaattgcaattaatattgcttcttaacatatgacactgcaatcatctgnagtccatcttccttcacctgctggtcacgctcattttagttcacaccaagatgccatagg

SEQ ID NO: 33152 - DNA, 121 bp, Artificial Sequence
  Synthesized
  misc_feature (61): n=a or c
actctgttcaaaatattgaagattacttttagttttgctgtaacccctccatactttgtcncccttgcgttgcaatactgactgctttcggaatttgtgttcactcagaacggtttaaaga

SEQ ID NO: 33153 - DNA, 121 bp, Artificial Sequence
  Synthesized
  misc_feature (61): n=c or g
acagtattctttagtgcttagttgtgtgtaaaaccacctagacaggtgtgcataaggatcnctgttgtaagtaccttgttttttcagggtctattgtatggagagtcagctcttggtcagt

SEQ ID NO: 33154 - DNA, 121 bp, Artificial Sequence
  Synthesized
  misc_feature (61): n=t or c
gaagctggttgcaggctgggagtggttgaactacactgaaagggatatggaggtgttgttngtcctacaggagaagcactggaaatgtggcatgagcagcctgcggcagctcccaatgcac

SEQ ID NO: 33155 - DNA, 121 bp, Artificial Sequence
  Synthesized
  misc_feature (61): n=c or g
tgtttccctgggagcattgataatatatcggggtaaacaactttggagcatagctgcgganacagaaatagttttcttcccatgtctgctgatgatgttgcagtagttcttttccaagatc

SEQ ID NO: 33156 - DNA, 121 bp, Artificial Sequence
  Synthesized
  misc_feature (61): n=a or g
aaggtcaaagaagaaaagtggcagtatattattgtgatagtatctgaaattttattgcatntcttcttggtatattctcctttgttattcttaagcatttgctgtaaaactccacattcag

SEQ ID NO: 33157 - DNA, 121 bp, Artificial Sequence
  Synthesized
  misc_feature (61): n=t or g
ggtctcaaaaaataaaacaaaaagtaaataagctactcaatgaaagaggaagtaatgaaanttcctacatcccctcctaaacttctacagagtgtgaatgccatatgtatgtgggcaaaaa

SEQ ID NO: 33158 - DNA, 121 bp, Artificial Sequence
  Synthesized
  misc_feature (61): n=t or c
cttcctcccacagaggtcccaactgcagccctcctgctgccaaacctttccattggcatcnaacacagcctctaagggatgagtgtttgcggccctaaggtaagagcaagttaaaaattgt

SEQ ID NO: 33159 - DNA, 121 bp, Artificial Sequence
  Synthesized
  misc_feature (61): n=a or g
ccattctcatccagtgcagtattatgacattcctatgtaatacccaatttccctgtaggantcccatggattttttctgtttcagtttaaaagcctcattaacttactgtgtaattttaga

SEQ ID NO: 33160 - DNA, 121 bp, Artificial Sequence
  Synthesized
  misc_feature (61): n=t or c
tggtgtttgtagtgggagtgggatttgcttagattagtctgctggtgttccatggggtggncatgtgctccatgggggatcttctctaggtgtttcccttcacataaaatcaaattctttt

SEQ ID NO: 33161 - DNA, 121 bp, Artificial Sequence
  Synthesized
  misc_feature (61): n=a or g
tccaactcaaacgattctatgattctattattctagtgtggttctttaatccagctccttnccaacgtgccttattgctttattccatggtgatgtgttcctcggggttcagcccttaatg

SEQ ID NO: 33162 - DNA, 121 bp, Artificial Sequence
  Synthesized
  misc_feature (61): n=a or g
ggacatgggtcatttgcaagagctgcttatctgcagatcagtagaattattgcaactaatntagtggtttggtctacgtgtatggtccagttctccatccgcagctgagtttcactcacaa

SEQ ID NO: 33163 - DNA, 121 bp, Artificial Sequence
  Synthesized
  misc_feature (61): n=t or c
gaggaaagctggaagaggtttaacaaaagctggagtcagggtggggctgaatgagaagacngtgctgcagttggcaaacgtctacagtcaggagtggcccaaatagtgtggataggcactg

SEQ ID NO: 33164 - DNA, 121 bp, Artificial Sequence
  Synthesized
  misc_feature (61): n=a or g
atgagtacatgttttaatatgtactccaaagcagtctttcagcagtatcagaaacaggatnctgtttgaagaagatccagccatagaggatgctgtcaaagataaacagtgcacagtatgc

SEQ ID NO: 33165 - DNA, 121 bp, Artificial Sequence
  Synthesized
  misc_feature (61): n=t or c
ttattctgtcaccttccttgcctttgaggcagactgtgcatattgagttaaacacaactgnctcagactgtgagtttgaaagctccagtcaggagatgctgataatccaaccacaaggaca

SEQ ID NO: 33166 - DNA, 121 bp, Artificial Sequence
  Synthesized
  misc_feature (61): n=t or g
tacatacttccatgttaaaagtagcacgaatttttacagaataatacagcctcatctttantgcagtgcccttaatgcacagactgtatggcaactggtacttgctcagcaatgtgagaaa

SEQ ID NO: 33167 - DNA, 121 bp, Artificial Sequence
  Synthesized
  misc_feature (61): n=t or c
agcagcaggtatctcccatgtctgtccatccagtcagcttctgtgatggttttattcattngtttttctagagaatgcaaatgaaattcccctcccttctctggcatctatgggaggcctt

SEQ ID NO: 33168 - DNA, 121 bp, Artificial Sequence
  Synthesized
  misc_feature (61): n=t or c
aagaaaaacaagtgttctacttctagcttttaaaaagagctagggctccaagatgaattanttcagttctgaccaaaatacgacttcaacagcttgatgtgcaactgtaagagcactgcct

SEQ ID NO: 33169 - DNA, 121 bp, Artificial Sequence
  Synthesized
  misc_feature (61): n=t or c
ctcatttttaaaaaccttcacgttttgctgaggaacgaaaggttttgaagctttttgttgnttctttcagtagaaatcccccttgatagaaatcaccaaaaatgtaacaaaaaaaaaattg

SEQ ID NO: 33170 - DNA, 121 bp, Artificial Sequence
  Synthesized
  misc_feature (61): n=a or c
ctctgttttagcacatcacactccttctcagtgctattgtttccaccgagtttataccatncatagtcagtttgagaaacaaacaaaaggcaagtacacaaaagcatacctgtaaacatgg

SEQ ID NO: 33171 - DNA, 121 bp, Artificial Sequence
  Synthesized
  misc_feature (61): n=a or t
aatctggcaaagcagtaaatgtcactattttgtacatcacttgaacaatattcttccaacntggagatgatggaacggttcatttctgtttcaaaagtatacaaacatagatcctcacgga

SEQ ID NO: 33172 - DNA, 121 bp, Artificial Sequence
  Synthesized
  misc_feature (61): n=a or g
gtgtcacatctacttagaactttgatttgctttgttttgtctctggaccaaaggtagtacnttttcattgcagttgcagaatttgttgtggaatttggtttcacgctgtggtggctcctcg

SEQ ID NO: 33173 - DNA, 121 bp, Artificial Sequence
  Synthesized
  misc_feature (61): n=t or c
aagttacctacatgctcaacgccaccacggaagtaacagcaacagaagcaaaagaaggagntgtctgctttagaagccatgtatttttaaataaatattagaagatgatccttatcagctt

SEQ ID NO: 33174 - DNA, 121 bp, Artificial Sequence
  Synthesized
  misc_feature (61): n=a or g
aaaacaaacacaagtcaacagctgtggcatgttggcaacggggcagtatcaacaagcaccngggtttgtgctgtggtaataaaaaggtagggctgataacatctgtaataatagaaaaggc

SEQ ID NO: 33175 - DNA, 121 bp, Artificial Sequence
  Synthesized
  misc_feature (61): n=t or c
gaacacgagagaatttagggttctgttcactgcaacgggcagtgcagcgttctgtccttcnaccatcaacgaaggcgtgaagacatacaggcaggaatttaaaccgtctccagggttatct

SEQ ID NO: 33176 - DNA, 121 bp, Artificial Sequence
  Synthesized
  misc_feature (61): n=a or g
ccaaacagatcaaagtcatgctggagcctttccaacagtggcctctcttgcctacctagcnaaacttttagttctgtgaaactcataaaaacttcataactcagctctcaatccctctctc

SEQ ID NO: 33177 - DNA, 121 bp, Artificial Sequence
  Synthesized
  misc_feature (61): n=a or g
agaaggattagtaggctactcaagggataactctcacaggcagaaaatgtaagaccttccnctacagttgtaagctaactaaatatgagcaaacacagtgggtgacagggaggagctttta

SEQ ID NO: 33178 - DNA, 121 bp, Artificial Sequence
  Synthesized
  misc_feature (61): n=t or c
tggtcttgggaaagaaaccaaccttactccagctccagaatgaatcagaaaagatcaagantggagattcctaccaagggccaacaaacttatctcacgggttgtttgtgatttgagcatc

SEQ ID NO: 33179 - DNA, 121 bp, Artificial Sequence
  Synthesized
  misc_feature (61): n=a or g
aatagaaagacaagctcatcaatgaagtgaaatctttcccagtgctgcatgagcttgtttnaggtaaagacttcaccttttctttatcaaacagttgtctgctcctatatatcagaaggaa

SEQ ID NO: 33180 - DNA, 121 bp, Artificial Sequence
  Synthesized
  misc_feature (61): n=a or g
tttccatagtagatgctgattaaaaaagaaatggtagcaggatgaaaagtaactccagagnaagagaaggagacatattggcaaatagtgtcactgcagactgcttgtgaaaattatggtt

SEQ ID NO: 33181 - DNA, 121 bp, Artificial Sequence
  Synthesized
  misc_feature (61): n=t or c
gctggtaggatgaacagaacgtgacacacaagcatgaagtgatgtggcagtatgaaagggnagaaaataagactgtgggtcagggttggtaggaataaaatgatgagctataaataaggga

SEQ ID NO: 33182 - DNA, 121 bp, Artificial Sequence
  Synthesized
  misc_feature (61): n=t or c
tccatggggccacagagattactgggtctgttccaaagctgagatgcttcttcccagtgcnatgccttctggaatacccctaatctatctatctatctatctatctatctatctatctatc

SEQ ID NO: 33183 - DNA, 121 bp, Artificial Sequence
  Synthesized
  misc_feature (61): n=t or c
ttgtttaatactttttgcagtgcatttctgttcgggtgaatagtttctggagagctggagnaggcctaatactgagctgcatgcaccttttggaaggatttttttctattttttttaatcc

SEQ ID NO: 33184 - DNA, 121 bp, Artificial Sequence
  Synthesized
  misc_feature (61): n=a or c
aaaagtcctaatattatttgaagaacatcaaacaacaagaactcgcagaagaaagggcacntggaagactgatacctaaattgcattttttcacccatgtttaaggcagttttcaagaaaa

SEQ ID NO: 33185 - DNA, 121 bp, Artificial Sequence
  Synthesized
  misc_feature (61): n=a or t
aacaaaaaaataaaaaggaaaaaacttcccatcagaacagaaaagtgtgaaggggagaagncagagcagatggaccccgaacagcccacagccaccatctcctctggcacatcccaaatca

SEQ ID NO: 33186 - DNA, 121 bp, Artificial Sequence
  Synthesized
  misc_feature (61): n=a or g
caagctgaggcagatagagaagtgctaggcgatacatgaccatttcatcaggacagtgtcnatgatggcctatgaacatccaagggggaaaatcatcttttatcactattgtgtaccgtgc

SEQ ID NO: 33187 - DNA, 121 bp, Artificial Sequence
  Synthesized
  misc_feature (61): n=t or c
ataaagactgctgtgatgagtgctaattctcctgattctggaaggctccttaaatcaaagnactgaaactgagaagtgaggggcataactatgaggtttattgattattcttcactacatg

SEQ ID NO: 33188 - DNA, 121 bp, Artificial Sequence
  Synthesized
  misc_feature (61): n=t or c
ttattttgaacgctcaatgaaacagtggcattcagagcagtgcatttgtgtaaatctaaanagatatatgcactcctacgttctcagggaaggaaagtgaacaggagagtgccactgatac

SEQ ID NO: 33189 - DNA, 121 bp, Artificial Sequence
  Synthesized
  misc_feature (61): n=a or g
agctaagttgtaagtggcaaacgtaagactggatagagagaaggcttgcacaggagatccntccaggttggcactggaattctgaacagtcctaaatcgtgccttcctacactggcttact

SEQ ID NO: 33190 - DNA, 121 bp, Artificial Sequence
  Synthesized
  misc_feature (61): n=a or g
tctcttcacatccaagatttatttaggatatgtcacttgactacaaggactggagacaagnactgggagattaattacatctgtcctggtttaattatccacagattaagtatcttgataa

SEQ ID NO: 33191 - DNA, 121 bp, Artificial Sequence
  Synthesized
  misc_feature (61): n=t or c
ttgaatttcaagttcattggattacaggaaaacttacaggaaaaaatatcaagggtgtatnagctacaattaagtactagcaactcacagtagaaaaggtaagaaagataactggagtaca

SEQ ID NO: 33192 - DNA, 121 bp, Artificial Sequence
  Synthesized
  misc_feature (61): n=a or g
ctgccataatttaacttttacactactaacagagccaacttcatactgttttgggcatgcnagcttctgctcttaggttgccagttttgtcctgtcatacactgcatagcattgtcttgct

SEQ ID NO: 33193 - DNA, 121 bp, Artificial Sequence
  Synthesized
  misc_feature (61): n=a or g
aaggttcctgacccttctattgtattaccaatttcaaactaaacacaagtaataaatgaantgtgcaaaaggcggtgctcaaatcaagtcagaatagaggaagtctggtttcaaatttggc

SEQ ID NO: 33194 - DNA, 121 bp, Artificial Sequence
  Synthesized
  misc_feature (61): n=a or t
catgtcagagaaatgatttgaaaaagaagtgatagatctcacaggcttggaaatcaagacnttggacatcatgacttcaggaagcaggagggttagagcatgacagtagaagtccattccc

SEQ ID NO: 33195 - DNA, 121 bp, Artificial Sequence
  Synthesized
  misc_feature (61): n=a or g
gagcgtgagtttgatgtcttggttgcatcaagccagactgaagtacttgagcactcttctntcctccctgatggagatgaaatgagcctctccagaaaccagtgcagacagatagtcctca

SEQ ID NO: 33196 - DNA, 121 bp, Artificial Sequence
  Synthesized
  misc_feature (61): n=t or c
aagcctaggtgaaatcaaaagaggtgaaagctgcagctcagcaaatttgatccagtagtgnagcagctagctttatagtatcaccagctgtccagggagatcagattgtctatccctcaaa

SEQ ID NO: 33197 - DNA, 121 bp, Artificial Sequence
  Synthesized
  misc_feature (61): n=t or c
aggataagatgcaaaaccaaaaaataaataataataaaaaaaatcagcatgtcatcccacnagtatacaatttattttcatatgtgactgaactacaaagcatctccacccaggtcataag

SEQ ID NO: 33198 - DNA, 121 bp, Artificial Sequence
  Synthesized
  misc_feature (61): n=a or g
tttgtgaaccgtttttatcagttcatttggagttgtgttttgccagcaaaacctctgcacnctgtttatctctcttagaggaaggctattattattgcaaaatgaagcagcgtgcatgcgg

SEQ ID NO: 33199 - DNA, 121 bp, Artificial Sequence
  Synthesized
  misc_feature (61): n=c or g
gcagctcacctttttctcttccagactctgtagactcacatatacacctaaatgattaccntagatttacatttatgatgatttctttgtgagtagaacaccagctagaaattggtgtttg

SEQ ID NO: 33200 - DNA, 121 bp, Artificial Sequence
  Synthesized
  misc_feature (61): n=a or g
tgcagttccgagagcaagcaatgaacaccactaaatctattttatcatctttaaggcaacntgagattttcctttttatttgctaattcattctgaccattacactattcaactgtactta

SEQ ID NO: 33201 - DNA, 121 bp, Artificial Sequence
  Synthesized
  misc_feature (61): n=a or g
ctaacacttaaaggcgagggcaccctcaccaaacactgcagttggccatggctacactacngtttgtccatttcaggctgtgagatgaaagtcacctcgtgctgaggctgtaacagcacag

SEQ ID NO: 33202 - DNA, 121 bp, Artificial Sequence
  Synthesized
  misc_feature (61): n=t or g
agatccattttcaagatgctggagaataagccccagatgggtgtatttcctcctttctagnagtgtctgtaatacctgaccagccccttggggactcagcctttgttctgtggatggccag

SEQ ID NO: 33203 - DNA, 121 bp, Artificial Sequence
  Synthesized
  misc_feature (61): n=a or g
atgacctggagctctcctccagctctgtggcacagccagatgttgtgtgttctcacaggcngttgggaaacttccaggcggtttccagtccaaacatacccacatttgatttgtatccgtc

SEQ ID NO: 33204 - DNA, 121 bp, Artificial Sequence
  Synthesized
  misc_feature (61): n=a or t
ttggaagtcactgattttctcagtttcccatgcattcatttggataactttgtaccttttntgacatgctttaatgcaactagttagcaccacattactgctaggtggcaagggtcatttt

SEQ ID NO: 33205 - DNA, 121 bp, Artificial Sequence
  Synthesized
  misc_feature (61): n=a or t
aaaggtctttttcatcatatcctggaaaacaaataaaacgtttttctgagatgacgatacnctagttgaatgaaggatatttcagaaatagtaaaaaaatatttttgttttctacaaaaat

SEQ ID NO: 33206 - DNA, 121 bp, Artificial Sequence
  Synthesized
  misc_feature (61): n=t or c
tccaggaaaaacacagatgagttctagacaaggttatatttggtacctattccagacagangataaacaaggattttctaatacattttctagccagatcaaatggctgtgaacctgcctc

SEQ ID NO: 33207 - DNA, 121 bp, Artificial Sequence
  Synthesized
  misc_feature (61): n=a or g
ggtcttagatttattcctcaaccaaaaatatatgtctcttgtggcacataatgtccaggcncaatctggaagattgattcaaccgtcagccatgaactgaatcatcaggatcattataaac

SEQ ID NO: 33208 - DNA, 121 bp, Artificial Sequence
  Synthesized
  misc_feature (61): n=t or c
ttgaccctgactgtctttagactagctgaagttgtggttgataagttcaggaggtaaaatntgaaggtgagattattctgcaaatgcgtttagcgtaaaaaaaattaataattataataag

SEQ ID NO: 33209 - DNA, 121 bp, Artificial Sequence
  Synthesized
  misc_feature (61): n=t or g
ttaaattaattaatcatactgccatacaaaacccagcctgacttggtagtagagaagaatntcctaactacatctaaaaaacccagatccactgataaaacatttattctgttgtttgttt

SEQ ID NO: 33210 - DNA, 121 bp, Artificial Sequence
  Synthesized
  misc_feature (61): n=t or c
ttttcctgatctagagaccaaaacactagcgctagtgctagtgtaagaagtatactgaaangtaaactacttataccttaaacctgcattttgtgaaatgcaatctaatggtgtatattct

SEQ ID NO: 33211 - DNA, 121 bp, Artificial Sequence
  Synthesized
  misc_feature (61): n=a or t
aacttcctaactaatccatgtcttgtttattttcagcacagtgttcagtttctaagggaantcaaaccaaactccaatctctgtctgaaagcaaatgagcttattaaacttctcatgtaag

SEQ ID NO: 33212 - DNA, 121 bp, Artificial Sequence
  Synthesized
  misc_feature (61): n=t or c
gaaaaaaaaacattaattactgccttcagtttcgaccgtgcctttcagttttgggcaatgntgtccagctttgtacaaacagctgagtaagatctactctattttatcatgatgctaactg

SEQ ID NO: 33213 - DNA, 121 bp, Artificial Sequence
  Synthesized
  misc_feature (61): n=t or g
gcagcacttccagccagagctcacacacagctcccagaagaaaagaagtgacccggacctnttaaatcctgctgtgtcctgttttactgagctcagcgctcgcaggtcagaggaatgtgga

SEQ ID NO: 33214 - DNA, 121 bp, Artificial Sequence
  Synthesized
  misc_feature (61): n=t or c
tgtagctgccagaaaagttaattctacagaagtcttccatagatttgcctccctgagcagntcactgtcaggtcagatggacaatgatggatccaaaactccctactaattgttagacagt

SEQ ID NO: 33215 - DNA, 121 bp, Artificial Sequence
  Synthesized
  misc_feature (61): n=t or c
aggctccttttgtcttcagcccttcctttcttttaaggaaaattcactcctttttggcaangtgctgctcctacctcacacctgggagagctgagcacagcccagcccagtccagtccctt

SEQ ID NO: 33216 - DNA, 121 bp, Artificial Sequence
  Synthesized
  misc_feature (61): n=t or c
atgggagctttcaatacagctcaacagaatgtagaatggaacccaaaacaaagtcaacagnggcttatttgggctgtaattcttcactggtaccaaatctttgatagagtcttatgcagaa

SEQ ID NO: 33217 - DNA, 121 bp, Artificial Sequence
  Synthesized
  misc_feature (61): n=a or t
cctccctttgctggctcaagttcagaataagagtgaactgctggttaatgtgtaataaaangtttcttgtttttctggtagaagcatgagtgccctgttccatccctgccccttctcttct

SEQ ID NO: 33218 - DNA, 121 bp, Artificial Sequence
  Synthesized
  misc_feature (61): n=a or g
ttacattgcaatagctaagaatttcactcattagcagattctgtaaattcttccagctttnatgaatgtgcctcccaatatcttaataattggtgtattaatttctcatctaattgtttat

SEQ ID NO: 33219 - DNA, 121 bp, Artificial Sequence
  Synthesized
  misc_feature (61): n=c or g
cttggaagtttggcgtaagattgtaaggggatgtagctggactggtaagttgtctatctcncttgtttcccaaattcccatctgatgttaaatgaagagcccagggagctgcatctgagct

SEQ ID NO: 33220 - DNA, 121 bp, Artificial Sequence
  Synthesized
  misc_feature (61): n=a or c
acagcaagagccgactgtctgaagccaaacgtgaaactgcatctgaggtgaactccgcaangccataaagcagaagaacagaacctgcagtccttctgtgtgctgaacatatctcactttc

SEQ ID NO: 33221 - DNA, 121 bp, Artificial Sequence
  Synthesized
  misc_feature (61): n=a or g
ttatttttaagaacaggtgttttatttttctcattatccaagaaactggtccaaatctgcnccttactgtgaacaccaccacaaatctttaaatatacttcatgtcaggatctcacagggc

SEQ ID NO: 33222 - DNA, 121 bp, Artificial Sequence
  Synthesized
  misc_feature (61): n=t or c
tatggttaaaatcactgcaggcattctacttaacaaagtgttagttaggtggcagaagacnataaaacattggggttgtgcgagttgtcagtaccagagaagaaaagtgcgaatgccaagc

SEQ ID NO: 33223 - DNA, 121 bp, Artificial Sequence
  Synthesized
  misc_feature (61): n=a or g
ctgtgtgggcccactgctctcccagctattactgggaaaccactgtgtgaattcttgcacnttatttttcagctctgatcccgtctttttctttcaatttacaaaatgtggaaggtttaag

SEQ ID NO: 33224 - DNA, 121 bp, Artificial Sequence
  Synthesized
  misc_feature (61): n=a or g
tgactttgtttggagtaatgaggaggctttcacttttgtggctcatgagaagattgacagnatctctgtttccagggaggagtgctgcttctggtactggcactgtgttgcaaagttggtt

SEQ ID NO: 33225 - DNA, 121 bp, Artificial Sequence
  Synthesized
  misc_feature (61): n=t or c
caatggataaaaaacttattcagtaggaacatgtttcagaattaggccaaaattattttcngtctaacacagaacaacccatgtgtaaacagcttgtgcaaacacctccctcagttattaa

SEQ ID NO: 33226 - DNA, 121 bp, Artificial Sequence
  Synthesized
  misc_feature (61): n=t or c
acttgaggtggttcacaccacaaaacagcaagcttagtctctactaaatcaatttttacanttacacacacatacagtaaacatacacatatacatatggagtatactttatgcataagta

SEQ ID NO: 33227 - DNA, 121 bp, Artificial Sequence
  Synthesized
  misc_feature (61): n=t or g
tggtgcatctgctatgaatcagccatattttctatagggaaaaatgtaatccataaacaanctcatttcaaagtaactggatttattttctcatgcccctcattcactgttcttacatatc

SEQ ID NO: 33228 - DNA, 121 bp, Artificial Sequence
  Synthesized
  misc_feature (61): n=t or c
ggagtggccattgctctgagccacagggtggttggcgaggttatgagcaagcagtaaagancaatgcagctaatttcagtgaagtgtgacaagcagtgccgaggttgctggccctaaagta

SEQ ID NO: 33229 - DNA, 121 bp, Artificial Sequence
  Synthesized
  misc_feature (61): n=t or g
gcagcagtttccccaggctgaagcacagcacattgatatgtcaagtgcacattacagttantatactaatatgcctttttaccatggagtattttctgaggaaatactataggaggagatg

SEQ ID NO: 33230 - DNA, 121 bp, Artificial Sequence
  Synthesized
  misc_feature (61): n=t or g
ctgttctctgcaggtctttggaggtagccatgagtgctatggcacctttgagacaagtacncagccttgctcatcagagcagtgagaagcatagtgagagaataaatctgatcttgacgtt

SEQ ID NO: 33231 - DNA, 121 bp, Artificial Sequence
  Synthesized
  misc_feature (61): n=a or g
gttagaaaggaaaaagaaactgctctggaaagacaaggacaagagagagctcccagcaaangataggggagagcagttgtctgtattttagggtttttttttttcacttaagggacaagaa

SEQ ID NO: 33232 - DNA, 121 bp, Artificial Sequence
  Synthesized
  misc_feature (61): n=t or c
gctggcctggcccacgctctgcgccccttcccattgccagcccttcctttgcttacaagcngcagcacagtcctgcccaagaaatttcctgtgtcacgtggcactcggaacgccactggaa

SEQ ID NO: 33233 - DNA, 121 bp, Artificial Sequence
  Synthesized
  misc_feature (61): n=t or c
gatgcaaattttcattatactgatgaagatggtgactaaaatcattcatcaaaattttacnagccgtaaaggcttcactaagccattatatgagtttattaggtaaaattaaataaaaaga

SEQ ID NO: 33234 - DNA, 121 bp, Artificial Sequence
  Synthesized
  misc_feature (61): n=t or c
ttttttctttgaaatctccttggtaaactggctaaataaaagtcagccaactggattccanttcctaagctttggcaaactctccatcagtgccagaaatcagccccgttctttttacatc

SEQ ID NO: 33235 - DNA, 121 bp, Artificial Sequence
  Synthesized
  misc_feature (61): n=a or t
cccctaaacacaaagcagagcccaaactcacgaagctttcctagcagctggtttatatacncaaaacactgggtgtttgtgtttacaagacacagagctcgtttctgttcctttctatgag

SEQ ID NO: 33236 - DNA, 121 bp, Artificial Sequence
  Synthesized
  misc_feature (61): n=a or c
ttgaaggggacctctcctcagcaaaggagaaaaaatggtaaagcgtattaggaaaaaaaancaaactctgaaagtactcattatggctttcatacctcattgttcctgctgagggagttga

SEQ ID NO: 33237 - DNA, 121 bp, Artificial Sequence
  Synthesized
  misc_feature (61): n=t or g
ggaaaatagctaaaagcactctgagtaggaagaatatctgatacctgagcctccagccttnagggcttactgaaatgactgagcaactctttccaaagcctatacttttaaacaaaaaaca

SEQ ID NO: 33238 - DNA, 121 bp, Artificial Sequence
  Synthesized
  misc_feature (61): n=t or c
tcttgaacagggtgttcacatctttactccatggtctgctttacagaaagaagatactacngagaaaagctgaaagaatgcacatacatttttatacaatacgtataagtcaccctgaaag

SEQ ID NO: 33239 - DNA, 121 bp, Artificial Sequence
  Synthesized
  misc_feature (61): n=a or g
aactacttctcactggaacttcacagttactttgcagttcagatcgctagagtgtttctangagagcttaaattgcagtatagacagtgataggcttatattttgtctgcttgctggcaga

SEQ ID NO: 33240 - DNA, 121 bp, Artificial Sequence
  Synthesized
  misc_feature (61): n=t or c
cagtataggcaggacttatctccctctatctgcatgagcaatgcccactaacttgaagacngaacataggatgtacatacccaggccataacccactagcaaactgctgagcagctggtgc

SEQ ID NO: 33241 - DNA, 121 bp, Artificial Sequence
  Synthesized
  misc_feature (61): n=t or c
caactccactctaaaaatgcttatgtgttttggatagggcatacaaagactgtaccatganacccagaaatcaggaaaacagtggagtcctagaaaacaaatgtcagcagacaggagactg

SEQ ID NO: 33242 - DNA, 121 bp, Artificial Sequence
  Synthesized
  misc_feature (61): n=a or g
tgggactatgtctaagaataccaccatccagcccttaccttcccacacaccttcaggatgncagaggtcagaaccagcctgcacacagcaggtatatgggaaacacttttaggatgtagga

SEQ ID NO: 33243 - DNA, 121 bp, Artificial Sequence
  Synthesized
  misc_feature (61): n=a or g
tatttccccgtggagatcattgtgtaagtgcatctgttgcataatacagtgcaaatacagnctgctgtaattgcattcaataactgatatttttaaacatatagttattgttgtatctggc

SEQ ID NO: 33244 - DNA, 121 bp, Artificial Sequence
  Synthesized
  misc_feature (61): n=t or c
ggcataacactgtccagacctcctgcagcagagtccagccagccctgaggatgtttatganatcgagtccgtttcttgccacgtagcaaaaataagcaagatttattcaacgggccttttt

SEQ ID NO: 33245 - DNA, 121 bp, Artificial Sequence
  Synthesized
  misc_feature (61): n=a or g
tggctcataatcgagcatggaactatgaggggtatatggaactccttaaaataaaatgatntattgaaaaagactccctctatcctcccagtctggcctcattcacatagaaaaaccttca

SEQ ID NO: 33246 - DNA, 121 bp, Artificial Sequence
  Synthesized
  misc_feature (61): n=a or g
aaaatacatatcctattcgattctgtcttaaattttataaacatgtaccattaactatctntgcacttctctgtaggcaaattaagcaataagctctgcagttttcccaggtaactctctt

SEQ ID NO: 33247 - DNA, 121 bp, Artificial Sequence
  Synthesized
  misc_feature (61): n=t or c
agccatccataaggaataggattgatgttacactaatgctacaatgcaatttgctttctangtgagaagaaggaaaattggaaaagggtatttttttatattttatttcaaaaagcagatt

SEQ ID NO: 33248 - DNA, 121 bp, Artificial Sequence
  Synthesized
  misc_feature (61): n=t or c
acctagactccatgcacctgtgacttcaactcagcatgactctccagaagactataaaatnagcagatatttcagtggaaaaactacattaaaacagaagcatcaacagaattcttattct

SEQ ID NO: 33249 - DNA, 121 bp, Artificial Sequence
  Synthesized
  misc_feature (61): n=t or c
taatgaagctggcactgaattaggcaatgtgtctgtttctgtagcagtgctcattttctcntcccaaatactctaattgaccatactgactgatgaggtcagtcttttacgtgaggaaagg

SEQ ID NO: 33250 - DNA, 121 bp, Artificial Sequence
  Synthesized
  misc_feature (61): n=a or c
ctcaccaagctaaaaaaaaataaatgtcaaactaaggaaaagacttcacaccttcctcacngagaacctcagcttatgccaatccatacactgcgtgcatcaaatgcagagaagggcatta

SEQ ID NO: 33251 - DNA, 121 bp, Artificial Sequence
  Synthesized
  misc_feature (61): n=a or g
ttcatctgtgtgtacaactaatggtgctttagagctgaaacacatcttgaagcgctggccntcacatgtccagttccctccccagaactggagttgcgtggttgtttgtcttttaactgct

SEQ ID NO: 33252 - DNA, 121 bp, Artificial Sequence
  Synthesized
  misc_feature (61): n=a or g
aggacttttaaaagcaccattatgatagaaatttcagggtgtttgttctggctttagagcntgcttttcaagccttgattcagtgatgtcgttgatttccgaaggaatgagggaggggatg

SEQ ID NO: 33253 - DNA, 121 bp, Artificial Sequence
  Synthesized
  misc_feature (61): n=a or g
agtactgtggtgtgtcagtgattctagcctgctccatcatgtacaatatcctggaatttcnaatgaatcccctatgtccacagtgcatctgaccaattctgcatttctgcactagaggaga

SEQ ID NO: 33254 - DNA, 121 bp, Artificial Sequence
  Synthesized
  misc_feature (61): n=a or g
ttattcctgctgctgctgcaggtggaagctgtgatatcagtccgactcctaacactgtttngacaggagtgtcaaaagcaaaggaaggcatttttcatcaaagccgttaagatttcttggc

SEQ ID NO: 33255 - DNA, 121 bp, Artificial Sequence
  Synthesized
  misc_feature (61): n=a or c
ttagatttggatgaacatataaatcagagcagagacataggagacacagaattatcttcantacactttgtacttgaatgcctcgtcactaggtaactcacttgcagaacccatttcccct

SEQ ID NO: 33256 - DNA, 121 bp, Artificial Sequence
  Synthesized
  misc_feature (61): n=t or c
tatcagatgtgaaaacatttagtcatccatacagtttttaacttcatatgagttcaaactngcatttgtctatctatcttcacatcagaagcagaagtgaaacaagtctcataaaacatag

SEQ ID NO: 33257 - DNA, 121 bp, Artificial Sequence
  Synthesized
  misc_feature (61): n=a or g
atctcacaggctgtgtcaatctcctcctggccagttagaaacaccaaaatgtcgcctacanaggaagtaaaatgcatagaatcgagcatgtatgcttagtacagcttctgaattaccacat

SEQ ID NO: 33258 - DNA, 121 bp, Artificial Sequence
  Synthesized
  misc_feature (61): n=a or g
tttccaaacaatgctaaaaatactgagaaaagggtctcaagtgaatgagaaaaccttgatngaaggcctgtttcatggaaaatacgtaattgtgcttcactgattcagcagccccaaatgt

SEQ ID NO: 33259 - DNA, 121 bp, Artificial Sequence
  Synthesized
  misc_feature (61): n=a or g
taaatagggttactatgtatataacttcaaagtctttaggattaatcctctgtaaaatggntgacgaagcagtatgaatagcaatcaagtaaagagtatttttttttcctttaaattgata

SEQ ID NO: 33260 - DNA, 121 bp, Artificial Sequence
  Synthesized
  misc_feature (61): n=a or g
gattgacagtgagatgatctgtgaagaacaggaggattttcagtgttacttgtatccggtnctttaagaatctgtctcacattaacttcttgcagcataagaagttacagggtagcagcag

SEQ ID NO: 33261 - DNA, 121 bp, Artificial Sequence
  Synthesized
  misc_feature (61): n=a or g
ccagtgtttcacacttaatcacttacaaagtagtgtggtctagtgtggaaacttgagaatnaaagagttgggggaatggctaatattttaaggatgtttttatcctgcccggaaccttaaa

SEQ ID NO: 33262 - DNA, 121 bp, Artificial Sequence
  Synthesized
  misc_feature (61): n=t or c
ttctcaagctcattctagtgttctttcaaggtgaaaaatctatttttgattctgattctcnttcattggtctttaggactcactctgatcaagatctctttttcacatacactgtgtgaca

SEQ ID NO: 33263 - DNA, 121 bp, Artificial Sequence
  Synthesized
  misc_feature (61): n=a or g
acagtggcagtagagaaggagaggaagagatactccaggtgtagagcaacaggttcctgcnacccaggaaaggcccatggaagaacaggctgtccttctgcagcccacaggctgcatgatt

SEQ ID NO: 33264 - DNA, 121 bp, Artificial Sequence
  Synthesized
  misc_feature (61): n=c or g
tcaacatccaaatacacaagcaaggagcaatgccagctctgaaaagttgtccctcgatacngtaaccgactgccttccaccattttttccctttcacatggttgatttttgtcaggttttc

SEQ ID NO: 33265 - DNA, 121 bp, Artificial Sequence
  Synthesized
  misc_feature (61): n=t or c
cttctcttatgtttgtgtttgctttgccttatctgtgaatatcaagagtagggaaggaagntagattttagcaaaataacctggaaagaagattccttttgctactgataaaggcatttct

SEQ ID NO: 33266 - DNA, 121 bp, Artificial Sequence
  Synthesized
  misc_feature (61): n=a or g
acttcagcttgtcaagacctgacaaattcacttacagtttctgcttgctacactacatacntcaggttcagtagcaaaatacacatttatactcactcacacagaacagaactatggttgt

SEQ ID NO: 33267 - DNA, 121 bp, Artificial Sequence
  Synthesized
  misc_feature (61): n=t or c
acctctttaatgctgcgctggtaaggctttaatatttgtagctatgaaatttcaagcttangaggctttattgggtctgttttgttaaaatccttatgggcagtggctgaactaacgaaca

SEQ ID NO: 33268 - DNA, 121 bp, Artificial Sequence
  Synthesized
  misc_feature (61): n=t or c
tgcatcctgcaagggagatggaaataatagccttattgcttttactgctaaaaaacctcangctataccaatggtaaacatgggcagtaaagtgggaggacttttatgtgcaagaggtgat

SEQ ID NO: 33269 - DNA, 121 bp, Artificial Sequence
  Synthesized
  misc_feature (61): n=t or c
gttgtaattgtacaaagaattacatatttttctaaaaggaaatgcaggatttcttagaaanctcagataaacaaaacctcagaaactctcaccatgtttatgaaatcagtagcagtggacc

SEQ ID NO: 33270 - DNA, 121 bp, Artificial Sequence
  Synthesized
  misc_feature (61): n=t or c
tctgaattcatgcactgacttaaagcagaattgtgttcaactcttcattaggaatgagagntgtttctcttacagctactccttcagagttacttcatttaacaaacaaaatccctcccat

SEQ ID NO: 33271 - DNA, 121 bp, Artificial Sequence
  Synthesized
  misc_feature (61): n=t or c
tatccttttttgcaaacaaacaaacaaaaaaccaaccaactaagcccacaaaaactagctngagctggtttgtaatggttcgaatactgccaagtcaaagagctggagcactgtcctgcac

SEQ ID NO: 33272 - DNA, 121 bp, Artificial Sequence
  Synthesized
  misc_feature (61): n=a or g
taccgctgcttctactaataaaagctgttccacaaacatctgtgcaaacagaacccagcancaccaatattcagggaggaaaaaaatgggtcctgaagcagtccgggctaatgagccccat

SEQ ID NO: 33273 - DNA, 121 bp, Artificial Sequence
  Synthesized
  misc_feature (61): n=c or g
ccaacaagaaacaaactataaataaaaggcagcctcagactactttgtgtcatcagagtcnggagtgattcagtccttaccaatgcaataaaaaagaaagaccaatttctagcatggaaga

SEQ ID NO: 33274 - DNA, 121 bp, Artificial Sequence
  Synthesized
  misc_feature (61): n=a or g
ttagaagaatgtagttgttttgcaggtagagttgtatactgcaccataaacaattgttccngggttttctttaactagaacttctagatgagagtacttgcggtagtcggaactacaagta

SEQ ID NO: 33275 - DNA, 121 bp, Artificial Sequence
  Synthesized
  misc_feature (61): n=a or g
tgctgttgctactagagaaggtagggagggttagtgtcaggtctgtgtaataaatgtctgnagcaatatgagctacatgaagtacaggatatcatacagaggtagttgatttatgtaggtc

SEQ ID NO: 33276 - DNA, 121 bp, Artificial Sequence
  Synthesized
  misc_feature (61): n=a or g
tcatagctgtgctaagtgcaatgcattattaatacactaattagataaaaataacaactanaaaaggaattgtgtggattctgataaaaggcaactgggaacaagggaagaaccttgccca

SEQ ID NO: 33277 - DNA, 121 bp, Artificial Sequence
  Synthesized
  misc_feature (61): n=t or c
gcaggtatgcctgaaaggatttccttgaagcctttaacagaagccagggcaggactgtctnctcttaaataccggctttagctcgagctgtgagatgcaagcttgattcaaaaacaaccag

SEQ ID NO: 33278 - DNA, 121 bp, Artificial Sequence
  Synthesized
  misc_feature (61): n=t or c
tggctcctttaggtgtcttagtgaggcttgacttagaggaaggccttagatcagtgatatnctgcctttctacagtatctcctgaaaaggaggattagtgctgcactgctaaatgcagtgg

SEQ ID NO: 33279 - DNA, 121 bp, Artificial Sequence
  Synthesized
  misc_feature (61): n=a or g
tctatccttgaacattttggttcactgcttaatatgaggtcattttcagtaactggggaantgctcttgtgagctttggcatggagaagatggtaaagatgaggagtggaaatgaactgca

SEQ ID NO: 33280 - DNA, 121 bp, Artificial Sequence
  Synthesized
  misc_feature (61): n=a or g
gtgatgtcatttcaatcaatttagggcaagctgaacacagtttttgtaatttctaaagggntcataatctccttatatgggaggatacattctctttaaaatcattttcttgctgtttctt

SEQ ID NO: 33281 - DNA, 121 bp, Artificial Sequence
  Synthesized
  misc_feature (61): n=a or g
ataatttcagtatagtcatcctttaggccagctgctcagaagcacagctcagacctcctcntctccatgcacattttttttagggtcaaacatgctgccttccatcagcaacatacatggg

SEQ ID NO: 33282 - DNA, 121 bp, Artificial Sequence
  Synthesized
  misc_feature (61): n=a or g
tacaaaattgacaaatacgtgaatagggtgtgattatgtgtgcgtgtttcatccataaggnctatacaatataaaatgaagcctatactacattcagtgtacttcataggacactgttgct

SEQ ID NO: 33283 - DNA, 121 bp, Artificial Sequence
  Synthesized
  misc_feature (61): n=a or g
gcactactgggagtggctgccttgctaacacaagagtcctcatcctccccaccatcagaancccttctgtgacaccaagaaccctcccatgcatggtccttgggtcacgtggtggaagggc

SEQ ID NO: 33284 - DNA, 121 bp, Artificial Sequence
  Synthesized
  misc_feature (61): n=t or c
tatccactgcacctcaacagctgcagccagcaaatctagtcacagaaacacagaaccagtngttgcatgataattgatccatataataaatgtatcatcactcacttcccactacacagaa

SEQ ID NO: 33285 - DNA, 121 bp, Artificial Sequence
  Synthesized
  misc_feature (61): n=t or c
tgtaagattttttaagttcatgtatgatagagatgcaaagaatttctcaccctgattgtantggggcaatctatagcactcttcctggtagtagaacaaacacttctgtcactgtgaagtt

SEQ ID NO: 33286 - DNA, 121 bp, Artificial Sequence
  Synthesized
  misc_feature (61): n=t or g
caatcctcttttcttctctttataaaatctaaatgttgtttgctcctggatgatgcaaaanagccctactgcaattccccttccctatttcctcaatttttccctggtaaaatatagcaag

SEQ ID NO: 33287 - DNA, 121 bp, Artificial Sequence
  Synthesized
  misc_feature (61): n=t or g
caaggtaaggtgcgtctccttatcaaaactgataatatgccatttgttgtttctgaatatnacagtttcctcacacaggcaaaggactatacaatagttgcaaatatttggtataattctg

SEQ ID NO: 33288 - DNA, 121 bp, Artificial Sequence
  Synthesized
  misc_feature (61): n=a or g
tctagaattaatcatgtaaacataactgttcttggagaaatgatatacttgagtagtcaanatcagattctcatactagagcaggtttgaaacttgatgtcctttccagtcacttgtttga

SEQ ID NO: 33289 - DNA, 121 bp, Artificial Sequence
  Synthesized
  misc_feature (61): n=a or c
tttaaccaagacgtgagaatactccaaatagctcattaaggcaaacttgagttgtatctanattgctttcacattcttattctcttctacaacaatcagctgtgttagcatctagctggac

SEQ ID NO: 33290 - DNA, 121 bp, Artificial Sequence
  Synthesized
  misc_feature (61): n=t or c
ttcagttcttccttgaaaactgctggcagggctgggaatggaaagccaatagacaacatanataaactaagacctccgcacttgtgactggcatcatgaacaattaatttaagtacagcca

SEQ ID NO: 33291 - DNA, 121 bp, Artificial Sequence
  Synthesized
  misc_feature (61): n=t or c
ctggaaaaccatactgggctctgttgcctcctcatgtggggcacagggaatgtgggggtancctctgtgcagcctcgggtccagtggcatggctgtggggacgcggaagcagtgtgtcccc

SEQ ID NO: 33292 - DNA, 121 bp, Artificial Sequence
  Synthesized
  misc_feature (61): n=a or g
tctggcatacagggttccctccacagtgtaaggcagcatctccagttctcagccaaatganataaagcaccctgggaccagagctacccaggttttgactgagataagcggtaatttcagt

SEQ ID NO: 33293 - DNA, 121 bp, Artificial Sequence
  Synthesized
  misc_feature (61): n=a or g
tagacctgattttgtcatttttaactttgtaaaacgaactcttgatttgtgcttgcacccntctttgtattgccttctcttttggttagttccagtctgacagtgctgagacaggtgtagc

SEQ ID NO: 33294 - DNA, 121 bp, Artificial Sequence
  Synthesized
  misc_feature (61): n=a or c
ctgctggtagccttccttaggatattaattgacaaacgcatcccgacgttcatttaaaacnacagctgatggtctgttttgctgtgtgagctactcttgctgacataattaaatgtttgca

SEQ ID NO: 33295 - DNA, 121 bp, Artificial Sequence
  Synthesized
  misc_feature (61): n=t or c
caaattaaagtgactgttagttagaaattggtactaattttgtaaaaggtaaatatcaatntacattttttcttgggaagtgtagtatttttggtgtcttggtgtatttgtaattgaattg

SEQ ID NO: 33296 - DNA, 121 bp, Artificial Sequence
  Synthesized
  misc_feature (61): n=a or g
ttctgctctggctctggggctgccatcagattaactccctcattccaaatcagcttaagcngaggttaatgccaatcttgtgctcacacctgtgctgaatcagggctttgctgacttcctg

SEQ ID NO: 33297 - DNA, 121 bp, Artificial Sequence
  Synthesized
  misc_feature (61): n=a or t
gcctctctgagggctggcctaagcttctttatggttttccagtttgtttatagaacgtgcncatgttatacctagaatgaatttgatacttgtactcaacagcaccacatcgttcttgcac

SEQ ID NO: 33298 - DNA, 121 bp, Artificial Sequence
  Synthesized
  misc_feature (61): n=t or c
cttccctgtgtaggtactttcaattgaccatcaagacttttctggaaagaagaaaatatgntgaatttcattattctttttctgtattttggtttttctagactaaattattctactagct

SEQ ID NO: 33299 - DNA, 121 bp, Artificial Sequence
  Synthesized
  misc_feature (61): n=c or g
agctgggatgtcaaagcataggtgcagggagctacttcccagatactgcattatcactctnagacatcaagtattccaataacaaatgttgtgacattgcctttactcacatgttatccag

SEQ ID NO: 33300 - DNA, 121 bp, Artificial Sequence
  Synthesized
  misc_feature (61): n=a or g
gtccagtttgtcagcacagggagtctggccgttggccaatgataagacagcttacaaagantatgtgtgctctactacagctgaagagcaaatactttgctgaaatgcaaacattgtatta

SEQ ID NO: 33301 - DNA, 121 bp, Artificial Sequence
  Synthesized
  misc_feature (61): n=t or c
gaaattatacttcatcagtttcactacaaaacttatggagacaaaattcttgtcactctgnatgcccagaggtgatacagttgtaatcaagtcactggcacctatctcctgcctaaaggaa

SEQ ID NO: 33302 - DNA, 121 bp, Artificial Sequence
  Synthesized
  misc_feature (61): n=t or c
ttgtgcagtcagtcaggattcagcaagatattattgcatcgttaagtgtccttatttttcnatagtttttagtgttgaaatgccaaagtagtcccagacattcaaagcaagatagaataaa

SEQ ID NO: 33303 - DNA, 121 bp, Artificial Sequence
  Synthesized
  misc_feature (61): n=t or c
ataattccagggtatgctcagcacttgcagaaattgcaatttcttttcacacaagtgcacngctgttaactggaagaacagtactactattctttctggtcctaatgctgtgtagcatttt

SEQ ID NO: 33304 - DNA, 121 bp, Artificial Sequence
  Synthesized
  misc_feature (61): n=a or c
aaccacaaaatgataaatcaatgccaaaatggccaaaagtaaacatgtttcttcctccccngtcccacacactaccacacaccctgtgtctgtttctctctacatatattatatgtacacc

SEQ ID NO: 33305 - DNA, 121 bp, Artificial Sequence
  Synthesized
  misc_feature (61): n=a or g
ttaattaaaactgcctacaaagttattttcaaatgatactgtcacagcataatctgctaancaaatatatacatgaatttattaatttttaaccattactaatcataaatacacatgaata

SEQ ID NO: 33306 - DNA, 121 bp, Artificial Sequence
  Synthesized
  misc_feature (61): n=t or c
acagaggggatattccataccgtataatgttgtgatcagcaacagtacagaagagggtttnggggggttagagagattagccatcttttgcttgggaactggctgggcatcagtctactca

SEQ ID NO: 33307 - DNA, 121 bp, Artificial Sequence
  Synthesized
  misc_feature (61): n=t or c
gcaaatctttgttttgacattcctagtacaattcaaggtgtttttgtgacctttaaaacantgaatagaccacaagactgttactgcagctgagataagctggaagaaaagtcacgtctgt

SEQ ID NO: 33308 - DNA, 121 bp, Artificial Sequence
  Synthesized
  misc_feature (61): n=t or c
agcattatctggctcattatcacagagcttaatgccaaattaagggacaaggttaactctngtaaagcagaatgctctgtgcagtttctcgtgcttgaatacgagatgcctttatggggcc

SEQ ID NO: 33309 - DNA, 121 bp, Artificial Sequence
  Synthesized
  misc_feature (61): n=t or c
agatattccagtagctctgcaagaatcagcttgggtctaacagaggtaacagcaccagcanagcactcagtctaagctctgtattaggtcctgcaagatactgtgttgtctctcaccctgc

SEQ ID NO: 33310 - DNA, 121 bp, Artificial Sequence
  Synthesized
  misc_feature (61): n=a or g
atgcgtgcaaacgtgaaaaattggaaggatgattgagacgcttctaaaattgatcagtcantcaacagctagtctgttccaaatgtttacaggaacaaaatggctttctgaggtcagcatt

SEQ ID NO: 33311 - DNA, 121 bp, Artificial Sequence
  Synthesized
  misc_feature (61): n=c or g
aaaggctttgttttatgcactgtaatacttattccctttaagagaaacaaaatgcataacnaaattatttcttacttggaattgcaggatatacgtatgtcacactttaaatttcagtaaa

SEQ ID NO: 33312 - DNA, 121 bp, Artificial Sequence
  Synthesized
  misc_feature (61): n=a or g
ctgcagttcctccttcatggctttggagtacaccttcagcattattttcagcgttctaacntggtgcatttcagtctgcattagttctgggtaaagggaaataaaaattagtgctcattta

SEQ ID NO: 33313 - DNA, 121 bp, Artificial Sequence
  Synthesized
  misc_feature (61): n=t or g
gagaacacctatggggaacatgaagccctcggagcctggatgaatgcaaggagctgtctgngcattcaccctaacctgcaggatttcttcacacagccccagtaaaactctctcccaggaa

SEQ ID NO: 33314 - DNA, 121 bp, Artificial Sequence
  Synthesized
  misc_feature (61): n=t or c
tccccggtgctgagtgctgctcaagcagtgctgtcctcacagtgcaatggttaagctcccncagtacagggttaccattaaacagcagtttatacacccacgtgtttaagcagccttataa

SEQ ID NO: 33315 - DNA, 121 bp, Artificial Sequence
  Synthesized
  misc_feature (61): n=a or c
ctgaggtttccaatccctcatccgtacttggattcagaaagccaaaaagctgcttcggagntgcctgcatcggcatgtggcccctgcaaacccaccaaacctaatgagatcctcacccctc

SEQ ID NO: 33316 - DNA, 121 bp, Artificial Sequence
  Synthesized
  misc_feature (61): n=a or g
cctaatacagttgtaacctgagatcactgagtttctccacctacgctggccttgaactatnttctgtagcatgttactagatactttggaaataaatgctcgagatccaaactgacatctt

SEQ ID NO: 33317 - DNA, 121 bp, Artificial Sequence
  Synthesized
  misc_feature (61): n=t or c
gaaagcactccatatagcttttttgttctccaacttgtcttccattactgatgcaaagatngaagttttagcaacaattagtaagctcacgacagtaaggagagaagaaccttgctgaaat

SEQ ID NO: 33318 - DNA, 121 bp, Artificial Sequence
  Synthesized
  misc_feature (61): n=c or g
atacaagcagatgtcaatcagcaatacttgtggctgtcaggttttgtcctccttccaaggnctaagtgttttatctcatgtgctttagaacctttggcacacactggcaatctgttatggt

SEQ ID NO: 33319 - DNA, 121 bp, Artificial Sequence
  Synthesized
  misc_feature (61): n=a or g
ataaactgcttcagtgcagaaagatacaatccctaatcttgcctccttcacaggaaaaaanagcagcaaggctcatagctcagaattattttaacttcccctccaaagcctttttttctgg

SEQ ID NO: 33320 - DNA, 121 bp, Artificial Sequence
  Synthesized
  misc_feature (61): n=t or c
ctagctcccttgtacctaggggaggcctttgaaaagatggagctgagttctgtacaatagngcatgatgagagcaagagtgccaataggcataaaatgagaaaagagagaacctggctatg

SEQ ID NO: 33321 - DNA, 121 bp, Artificial Sequence
  Synthesized
  misc_feature (61): n=a or g
gctgacaggcaagctccatcaaacagaagcagccctgtgcatgaaaaagccttgctgtganagcagcagatttgtggaagcttgttttttaaactcagcgcactggggtctaagcacaagg

SEQ ID NO: 33322 - DNA, 121 bp, Artificial Sequence
  Synthesized
  misc_feature (61): n=t or c
ttcggcacacttttctgggagctcttatttcagaaaaattatgatcaaagttacctgttcnatcttgccatgcagtccatcacttcattcaagcacttgtttgtgagtagttttttgagcc

SEQ ID NO: 33323 - DNA, 121 bp, Artificial Sequence
  Synthesized
  misc_feature (61): n=a or c
agcgttctcagggtgttctgatgagctctgctatgaaggtgaacacacagctgtgctcttnttcaaaactggtgaagagagaaacagcttttaagtcaaggctggaattttttggagggga

SEQ ID NO: 33324 - DNA, 121 bp, Artificial Sequence
  Synthesized
  misc_feature (61): n=a or t
ctcttgaggttcagtcactgagaagagcatggacacaaccttcttcaggtacttacaaacnttgatcagattccccctaagccttcttttctccaagttgaacaggcccagcttcctgagc

SEQ ID NO: 33325 - DNA, 121 bp, Artificial Sequence
  Synthesized
  misc_feature (61): n=t or c
tgggtgttgggactgctgagctgagctggcttcatgctggaactttgggaagagctgctcngtgctgtgcccagctgtgtgcgtccggcgttggctgcgggtttcccactgtctgtccccc

SEQ ID NO: 33326 - DNA, 121 bp, Artificial Sequence
  Synthesized
  misc_feature (61): n=a or c
gtttcacaattggattacctttgtctacttatgcaaaagctcaaggtactttagttccatntgcctacttaaaaactgcaacaggattcataagtcagggatagattgataacatataaca

SEQ ID NO: 33327 - DNA, 121 bp, Artificial Sequence
  Synthesized
  misc_feature (61): n=a or g
atctcttggaaaatatcacaccacagctatattaaaataaaagtaacaacttccaccttancttttgagacctgcgacacctgtctgcatcaggataaagctgccagcactcccccaagag

SEQ ID NO: 33328 - DNA, 121 bp, Artificial Sequence
  Synthesized
  misc_feature (61): n=a or c
caacaccccctgctgctcagggctccacctgctttcctccctcatcagatattcatagatnttggtaagatacccctgagctctattctccaggctgggcagtcccacttcatgcagctac

SEQ ID NO: 33329 - DNA, 121 bp, Artificial Sequence
  Synthesized
  misc_feature (61): n=t or c
tacacttctgagtatgtcatcaggaatggtgtgacaccatccccaaatacaccagaagtgnatattctcaggagggtcatacataaacctgctgcaagaggcttagttttgaatcttaaat

SEQ ID NO: 33330 - DNA, 121 bp, Artificial Sequence
  Synthesized
  misc_feature (61): n=t or c
acttccctgcaatctatggggaacagaaaaagaaccacattaatttttgtagctgaaactntgttgataattcaatactaactagcaggtagttcacaataaatgtaataccttggtctca

SEQ ID NO: 33331 - DNA, 121 bp, Artificial Sequence
  Synthesized
  misc_feature (61): n=t or c
aaagcagacatcttttccatcaatcacagaaaaacttgtaactctgccccagcctagatcntgcttatgcttcaagcttactaccctaagagtgcagctggggcaacttaactgacttgct

SEQ ID NO: 33332 - DNA, 121 bp, Artificial Sequence
  Synthesized
  misc_feature (61): n=t or c
cattacgttgtgcctgtggtagggaaaagatggaaaatgagtgtgttagataacttccttngcagtgggaattaaagaaggaaacaagtaataacttactgccctgcttctttgagggcct

SEQ ID NO: 33333 - DNA, 121 bp, Artificial Sequence
  Synthesized
  misc_feature (61): n=t or c
aggttcataaaatgaccctccttcttcatcaggacagctgtaagaagtgggagacaaatangtttcatttacacgttagataatttaaaatcaattcaacatttagcctgaagcttttgcc

SEQ ID NO: 33334 - DNA, 121 bp, Artificial Sequence
  Synthesized
  misc_feature (61): n=a or g
ggacaatttggcagtgggaaatgaaacaggaaaagttttacatatattgatgtatcaaatntaccttctctaaagagataagaagaaattttcaaaggaaaaacaaacaaaatctctaaaa

SEQ ID NO: 33335 - DNA, 121 bp, Artificial Sequence
  Synthesized
  misc_feature (61): n=a or t
ccaggctatacttaaccctcagtcctccctgctgtggagcagccagctgtgactctggttngtgatcaaagacaggcatgtggaagtacacatttggaatggcaaactaccaagggcatgg

SEQ ID NO: 33336 - DNA, 121 bp, Artificial Sequence
  Synthesized
  misc_feature (61): n=a or g
agaaagacttgtttctcaaaagaaactttaatataaataaatttagtaagttttccttacnttgcttttgccagcctgatttaaacaaatgtttattactccaagtccctacataatttta

SEQ ID NO: 33337 - DNA, 121 bp, Artificial Sequence
  Synthesized
  misc_feature (61): n=a or t
ccttgctcctgtctcagcccttggtcccaaaagaatttagtggagtccaggtctggttcantcaccatggagagatgaagctgctctgacccttgttttggataagggttgagtgctactg

SEQ ID NO: 33338 - DNA, 121 bp, Artificial Sequence
  Synthesized
  misc_feature (61): n=c or g
tacttacactggagtaccaagtgaatacaaagtttgatattattccacaaccgtgcaagtntaaccttcagatataaaaggaatgagaaaagaacaattcagtggcaatctgaagtatcaa

SEQ ID NO: 33339 - DNA, 121 bp, Artificial Sequence
  Synthesized
  misc_feature (61): n=t or c
aactatctgcctagggttttgtgtttttatcttcactataaagcattcccattatgctccngctgccttctcagatggctcagcctatccctctcagccctgctacgtacccacaacagtg

SEQ ID NO: 33340 - DNA, 121 bp, Artificial Sequence
  Synthesized
  misc_feature (61): n=a or g
catgatactggagagaagaaagaacaggtaacacacaggagtgaatgtgctgtaaatccangcccactcttgcctagtagcatgttcgtatagctctgccatctgttctagcatgaggcac

SEQ ID NO: 33341 - DNA, 121 bp, Artificial Sequence
  Synthesized
  misc_feature (61): n=t or g
gtgattctgttgtatgctactacatgtttcttgatgctggttgcatgtaccagataagtantgtgaatcaacttccacctcctgcaaagaaaagtgcagcattaattgaaaggatcatcct

SEQ ID NO: 33342 - DNA, 121 bp, Artificial Sequence
  Synthesized
  misc_feature (61): n=a or g
gagaggtgatggtggcagcagcacctgtgactgactcctctagatccaggggatgctttanatcccatctgtgtttcaaatcatagtatcatagaatcatagaatggcttgggttggaagg

SEQ ID NO: 33343 - DNA, 121 bp, Artificial Sequence
  Synthesized
  misc_feature (61): n=a or g
cttagagttgagcattttcctaagcttatggggttaaccacgattatgggagagttcttgnagcatttttgaatgtaatgcttttatttaatgtttgtaagcaagttcaaaggtgtcagat

SEQ ID NO: 33344 - DNA, 121 bp, Artificial Sequence
  Synthesized
  misc_feature (61): n=a or t
tagcctttgttaacgaagcatgaaatgacacattagatgtctgggttttgcctgcagcagntatcccttgtgcaatccctatgaggtgctttgctccaccaggacccttgcaatcctatga

SEQ ID NO: 33345 - DNA, 121 bp, Artificial Sequence
  Synthesized
  misc_feature (61): n=a or c
tgaaatatctacataaactttcatgtagaactcattggaagaaacaacactaaatcaaaanagaagaccataaaggcagaaggaattaccaacgcagaggagaaacatgcactaactttag

SEQ ID NO: 33346 - DNA, 121 bp, Artificial Sequence
  Synthesized
  misc_feature (61): n=t or c
gtgctagatttcagctgcaagaaagaggagagaggcagctgtgcatttaatgcaggaggcntggatcctgatctctgcagtaccatgcactgcttttgtgaccttgggaaaggcacacagc

SEQ ID NO: 33347 - DNA, 121 bp, Artificial Sequence
  Synthesized
  misc_feature (61): n=a or c
tcctcctggttttctttctttttttaatatttttggagatgctcagtatatcccggcccanggacagtctttaaaagggtgaagagaatctttgaggtttcttccttagttgtgcaaagca

SEQ ID NO: 33348 - DNA, 121 bp, Artificial Sequence
  Synthesized
  misc_feature (61): n=a or g
aaattaacttactcttctttttctttttcctataaagtgctgggtttgcgtttagatagcncagttgctgaatggtggaagaggtattaaactttttttaattatcattttcatttcattt

SEQ ID NO: 33349 - DNA, 121 bp, Artificial Sequence
  Synthesized
  misc_feature (61): n=t or c
ttcaacttagtaaagtcttattcttaaaaaatcccacttcactccctcagcaggttgctcncactctccgttagtctttttcctgagtagtctgaaaacaagcgttagtctttagttagag

SEQ ID NO: 33350 - DNA, 121 bp, Artificial Sequence
  Synthesized
  misc_feature (61): n=a or g
ttgtattatcattccaaaatgcttgttgcatgggaactgacagctgtgacagaaatacggntaggacatctttgctgttctaatatggctgaaaaagtagttcactgtacatgcacatatg

SEQ ID NO: 33351 - DNA, 121 bp, Artificial Sequence
  Synthesized
  misc_feature (61): n=a or g
tgctggaatccatcagaagtagaaagctgctgcatggagtccaacatgatgagatgagaanggcactgaaggagaaggcaagttaaacctattggcagaggtaaaagacatccaactggcc

SEQ ID NO: 33352 - DNA, 121 bp, Artificial Sequence
  Synthesized
  misc_feature (61): n=t or c
gtatttagcaatacagtatataaagtaatgaggaaggaacttgatggagcaggagaggtgnctgtgtccctccaggctgataacactggtagaagaagcagcagccggatcagaccagcat

SEQ ID NO: 33353 - DNA, 121 bp, Artificial Sequence
  Synthesized
  misc_feature (61): n=a or g
cactgtgtaaggtcacctttagctttccccttttctttcggatttatggatgctgctgatntacttgggtaggatctgatttttttgtgggaaatgtcctggataaatgaaatcctattct

SEQ ID NO: 33354 - DNA, 121 bp, Artificial Sequence
  Synthesized
  misc_feature (61): n=t or g
ttctgactgaccctggcctacctgtaaaaagagtttctgtactggagtgctgcaaatgcantggaagacatgagtgtttattctatttcattttccttagttagttagaagcaaatagaac

SEQ ID NO: 33355 - DNA, 121 bp, Artificial Sequence
  Synthesized
  misc_feature (61): n=c or g
ctccaactactattgaaacaattgtgaagttggggttacgcacaaagtacttggtggtatnttttgtcttaatgacatgagtattaattgctgcattaactgcagttaggatcagtatgag

SEQ ID NO: 33356 - DNA, 121 bp, Artificial Sequence
  Synthesized
  misc_feature (61): n=a or t
gcacagctgcacagtgctgctgctcaaagtgaacactttacatgttgtgtaacaatatttngtcttttcaatgaaactggctttaagagcttagctcaaacataaaaaacaacatagggct

SEQ ID NO: 33357 - DNA, 121 bp, Artificial Sequence
  Synthesized
  misc_feature (61): n=a or t
cagcatttgtcacatatttgtgcatttacagatcttttctgggaattttagcttgtacagntgattgggtaaatggctgtggaaggatattatcagcacatgaattcctcaaagtaaataa

SEQ ID NO: 33358 - DNA, 121 bp, Artificial Sequence
  Synthesized
  misc_feature (61): n=t or g
agatgaagtgcatctctgcacacacagtgttaaagtgtaattcaactcttatttatttatntattatattgatttttaaagtgcctactgccctagcatctgtatcgatttaccagcatca

SEQ ID NO: 33359 - DNA, 121 bp, Artificial Sequence
  Synthesized
  misc_feature (61): n=c or g
tcatggatacttctccaaatgtcttcagtgttagttcaaaatatggctgtgttgctcctgnaggcagagaggatgccagctgcatgtggtgagtgcctgctctgctgcctgctgcagcagg

SEQ ID NO: 33360 - DNA, 121 bp, Artificial Sequence
  Synthesized
  misc_feature (61): n=a or c
tgcacgtgaatagctactacttccatatgggtatcaaagaccatacgcaggcatttgttcntgcagatggagaggaaaattaagcttctatctttgacaactgcccccttggtataacaaa

SEQ ID NO: 33361 - DNA, 121 bp, Artificial Sequence
  Synthesized
  misc_feature (61): n=t or c
gatattgataatcccatgtgactgacacgcagcaacagtgtgaggatagctttcttaaagnctattgccaatataaaggacacatattatcactaaacaatttcatggtgctactgtcagg

SEQ ID NO: 33362 - DNA, 121 bp, Artificial Sequence
  Synthesized
  misc_feature (61): n=a or t
ctaagctgaaatatttcaacgcagctctaaattagctcaagaagcaaactccagatatganttttcctagcatttgggataatttattttccactatatgaagcaatttataaagcgtgca

SEQ ID NO: 33363 - DNA, 121 bp, Artificial Sequence
  Synthesized
  misc_feature (61): n=c or g
tatgaaatatggaagtttagttctctaagcatgattttcagcttgtctgccactgtgaagncttttgctgacacagaactgtgtaggtgcaaacatcctgtgccccgatattaaggtcacc

SEQ ID NO: 33364 - DNA, 121 bp, Artificial Sequence
  Synthesized
  misc_feature (61): n=t or c
tgttcaaagcagcacaagtagcgatgttcgtgctcaaagtttcatggctcagatccagccncaggatctgagtagaggctcctgcttcagtgggaagtttgaagtcccaggtatgaggtga

SEQ ID NO: 33365 - DNA, 121 bp, Artificial Sequence
  Synthesized
  misc_feature (61): n=a or g
atgttcacaaaaattaggagagtgctgaattttggtaacacgtattttgggaggaatgaanaagactggacaatcattagggaatgattatggacaaatattgctgggcaaaatgataaga

SEQ ID NO: 33366 - DNA, 121 bp, Artificial Sequence
  Synthesized
  misc_feature (61): n=t or g
ctaatcactcccacttgatatttatcatgggcaggtttcacgagatgaatcctgtcaccangcagttgccaagtcccaggagcagctgcaaatcttcattaataaaatttggggggtttgc

SEQ ID NO: 33367 - DNA, 121 bp, Artificial Sequence
  Synthesized
  misc_feature (61): n=a or g
tttaaatagtatgtgttagacttaataaaaccaaatattttatcttaaagtaacctacctngagaccactttttttcatctgtatctattcatcccatataattaaagcagtatttttttt

SEQ ID NO: 33368 - DNA, 121 bp, Artificial Sequence
  Synthesized
  misc_feature (61): n=a or g
tcctgcacatgcaccttccagctgtgtgcagggtgcaggatcagcccctcatatttcactncattggttgtacccctgctgcaccccaggttcttgagcaatgtgtgccagagactccaac

SEQ ID NO: 33369 - DNA, 121 bp, Artificial Sequence
  Synthesized
  misc_feature (61): n=a or g
ggaagcaaaggaaatccaaacccaatagcccaattgtctgctgctgtaaataagctgaggntatagtatagagtttcttccatttaaacccagatttgtttccaaataaacaagaaggcag

SEQ ID NO: 33370 - DNA, 121 bp, Artificial Sequence
  Synthesized
  misc_feature (61): n=a or g
ttggaaaatggctgcaaacatattaagaactgaactaatactaactctagactgcatttcngtctaaaggattaaagactatcaaaataaactaacaaccctagaaaaaaaatagtgtgaa

SEQ ID NO: 33371 - DNA, 121 bp, Artificial Sequence
  Synthesized
  misc_feature (61): n=a or g
aagtcctttgaaattaacagattaacataatgaattacttctaaaaaacatgatctgaccntgctaacaataataaacctgacacctcatgcagtttataccgacgttatttgttctgtta

SEQ ID NO: 33372 - DNA, 121 bp, Artificial Sequence
  Synthesized
  misc_feature (61): n=a or g
tgggatgcagggcaggagcagcaaggctgtgcatgcttcaggcagttttagtgtgaagacngtctttctctatctaaatgagctgcacgcttgctgtggttttgcctttcccctcacatgc

SEQ ID NO: 33373 - DNA, 121 bp, Artificial Sequence
  Synthesized
  misc_feature (61): n=t or g
tgtctcaggagtgcattgatcgatccacaggattcgggcctggagctcagggtaccaaagncatctttgtgaggggatgtggatgtgcttcagttagatgtagggggaaatgtctggtgta

SEQ ID NO: 33374 - DNA, 121 bp, Artificial Sequence
  Synthesized
  misc_feature (61): n=t or c
ttactgcatggaaatagaaaagaatttcaagctggaactgagaaacagccctaaaagtagntcaaaaagcaatggaatgaatttcatgggaaggattcctcttataatcagatctgtacag

SEQ ID NO: 33375 - DNA, 121 bp, Artificial Sequence
  Synthesized
  misc_feature (61): n=t or c
tttctgcatgaatcaaatattcatcgcaggaactgtgatttcaaagtgataaatatacctncattacatttcctttctgcaaagcaacaggcgctatgtttcttatccaagagctcctttt

SEQ ID NO: 33376 - DNA, 121 bp, Artificial Sequence
  Synthesized
  misc_feature (61): n=a or g
aaagcagaacacctaccatcaaactacaacaagtcctacaaagaagaatgggggtgaactnggaacgtgtgaaaggcactgctgggacgctgtgacatacgttatacatccacagctcaaa

SEQ ID NO: 33377 - DNA, 121 bp, Artificial Sequence
  Synthesized
  misc_feature (61): n=a or g
gcggctgggtcccaagtcactgcacatgaactggtttaggtacagctgcctcacagcgcantgaagcctctattcttccttgctccagttaaaataaaattactccacagaccggcatctc

SEQ ID NO: 33378 - DNA, 121 bp, Artificial Sequence
  Synthesized
  misc_feature (61): n=a or g
tggaagtatcaggtctcagatttgactttaaagcaatttggtttttgtatcaattttcccnttcaaattacatacattctatgaaaatgcttacttctgtaaatactacatttttctctga

SEQ ID NO: 33379 - DNA, 121 bp, Artificial Sequence
  Synthesized
  misc_feature (61): n=t or c
acttctttgtggtcttctgctttaggtggattgtatgcaaatacttattaggttttgttcngtactggctttcttcaaggtgttgctggcctaacttgtgattcctgagaggggtctgttt

SEQ ID NO: 33380 - DNA, 121 bp, Artificial Sequence
  Synthesized
  misc_feature (61): n=a or g
cggtcgatcttgcagttgtcagtgccaggctggagttccccaggggcacatgggggtttgngggaacagccaaaggcagctgtgagcactcaggtctcctcacaagacctccccaccaaga

SEQ ID NO: 33381 - DNA, 121 bp, Artificial Sequence
  Synthesized
  misc_feature (61): n=t or c
tttgtccaaatgactcgggtgacagctgcagatgaaaagctggagacactcacagtgtttnaaagttgagaacaggtgctgtctatgagtttgctagaaatgtgacataagcactattcat

SEQ ID NO: 33382 - DNA, 121 bp, Artificial Sequence
  Synthesized
  misc_feature (61): n=a or g
ccagtaattcaaattaaagcaaagatatagccccaaatggatttcagacatttgcttacanctgtggaatgagttcggcacaaagcatttagtttgtataggtggtggagctgcgcagcta

SEQ ID NO: 33383 - DNA, 121 bp, Artificial Sequence
  Synthesized
  misc_feature (61): n=a or g
taatttttgatatgagaaactgttaggcagggaaaataataggatcctgactcacatatcngacaccacaagaaaagataataaatactagtgaaacgtagtgaactccttgatttgcacc

SEQ ID NO: 33384 - DNA, 121 bp, Artificial Sequence
  Synthesized
  misc_feature (61): n=a or t
cttgtcccttctatttctaatttctttctccaaatactctactacacatatctaaaaagcnagttttcaagattgttggcagaaggatagacttccatatatctcatttaaacatattggc

SEQ ID NO: 33385 - DNA, 121 bp, Artificial Sequence
  Synthesized
  misc_feature (61): n=a or c
cagagaataaaaaataaacaaacaaaaaaaaagctaactgaatattaaagaatatctgatnattcagtcttctgctgtttcaggcacccaagttcaggattaaaaattccagcctgcttct

SEQ ID NO: 33386 - DNA, 121 bp, Artificial Sequence
  Synthesized
  misc_feature (61): n=c or g
aaatcattacatagattacaagtacacaggaatgagagaagtaacggtgtagctaggctgntgcaatgctacaagaaagagtttctgcatgtcccaagaaaagaactttcatctgtgctag

SEQ ID NO: 33387 - DNA, 121 bp, Artificial Sequence
  Synthesized
  misc_feature (61): n=t or c
tcatcttcaaagcactctgccagtttcgttattctaagctgcacagaaatgcaggtagatnttggttatgcttgctttactctcctggggtgagctgatgtctctgcctaaggttttgttc

SEQ ID NO: 33388 - DNA, 121 bp, Artificial Sequence
  Synthesized
  misc_feature (61): n=a or g
atacagtgtggtgttgcagatatctttcatcaaacacaacacatattattcagaaggctgngccctagggatagcttcccaagctgccatttccttgtctgactgctgaaatgtacaggac

SEQ ID NO: 33389 - DNA, 121 bp, Artificial Sequence
  Synthesized
  misc_feature (61): n=a or g
cagccttctaccaacacctttaaagacaacattacagcagaagagagatcatctgctgttngcaggtcggcaaggtatcttcccaaaactccaccacgttttcaactacttcccccagtgt

SEQ ID NO: 33390 - DNA, 121 bp, Artificial Sequence
  Synthesized
  misc_feature (61): n=a or g
cttttgagcagtatgggtaaagataagcagtgtgctgggaactagaaaggatgtactggtntgcggaaacaaagggatgccagcaggaaaagtaggctgaagctcagtgccattggtgtat

SEQ ID NO: 33391 - DNA, 121 bp, Artificial Sequence
  Synthesized
  misc_feature (61): n=t or c
tattttatgaggatagaaattattttccctagtgaaaaacattgcagcaattatgaaacanaaaaacagtaagtgctcttaataattattaaacaaactggcaaaaacatagttcttattt

SEQ ID NO: 33392 - DNA, 121 bp, Artificial Sequence
  Synthesized
  misc_feature (61): n=a or g
aacatcttcgtgagttcttatggagctattttgttcttgtcactatagtgctgattcttcnaattgcattgaataggctctagaggcaactggaaactcacagtaaaatgctgtggttttg

SEQ ID NO: 33393 - DNA, 121 bp, Artificial Sequence
  Synthesized
  misc_feature (61): n=a or g
gttggcagatgcatttatattaataatattagtgttagcctggatcaggaatgtgctttcnaagagaaactccctatagtccatgcttaatgtttaagattatcaaacagccttggagcac

SEQ ID NO: 33394 - DNA, 121 bp, Artificial Sequence
  Synthesized
  misc_feature (61): n=a or g
taagtctgtctttttcttatgatttgatatgaaacagtagacagaatgataaaagatgcantctcccatgagataaggtttcaggagcctgaggaaactgtttaatatggaacaagtgaag

SEQ ID NO: 33395 - DNA, 121 bp, Artificial Sequence
  Synthesized
  misc_feature (61): n=a or g
ttaaaagtcagagttacacattaaaaattcatcatctgacgtataacataaagaagagtcnagaaaacatctttccattttttccattcaagtaaaatccaaaaaaagatttaacttattc

SEQ ID NO: 33396 - DNA, 121 bp, Artificial Sequence
  Synthesized
  misc_feature (61): n=t or c
attctacgtacaagattcaagagccaaaaattagacagcatctccctctggaggtctctgnaagcatctctgtctgtgcagggaacttggtacttattttagaaaggtggcattattaagc

SEQ ID NO: 33397 - DNA, 121 bp, Artificial Sequence
  Synthesized
  misc_feature (61): n=t or c
tccctgcatctcttgtatgttagattatgaaataattctagaactatagcgactttaacanttgtgtgtatacaaatgttatgttcatgtgtatggatgtacagacagctatattcatttt

SEQ ID NO: 33398 - DNA, 121 bp, Artificial Sequence
  Synthesized
  misc_feature (61): n=t or c
ttgactaagctgttttcttatgtactccttcatataaatagattatgttgatgaatagttnatgtggtttattgttctccaggaagcctggggtcatttagagttcctcaccggagttgcc

SEQ ID NO: 33399 - DNA, 121 bp, Artificial Sequence
  Synthesized
  misc_feature (61): n=a or g
cacctataaataactgtcctgtttggtaaacagctgcatatagacatttctgacacaggcnttgactacatcaggccagactgacttctaccatcaaatgtcagtactgctgctcatgagg

SEQ ID NO: 33400 - DNA, 121 bp, Artificial Sequence
  Synthesized
  misc_feature (61): n=a or g
gcattaaaggtggaagcttttagggaggtttcacagcaacagttaatcagggacttgcacnaagccagatttcttgccattggaaatgtgaaatatgatggccaatgtgtttttatgcagc

SEQ ID NO: 33401 - DNA, 121 bp, Artificial Sequence
  Synthesized
  misc_feature (61): n=c or g
aatttggcacttgctcttgtacagcttcacgtggttggtaattgcccagtttgtgtttcangtgattttggttctgttgcaaacatgtgccagctgaaggcaaacctgaactaagtataaa

SEQ ID NO: 33402 - DNA, 121 bp, Artificial Sequence
  Synthesized
  misc_feature (61): n=t or g
ccaccacccccgattgattcttcccgacgtcattttctctataacggtgaatacttctgcnggtcagatattggagttcaaactttaccctccgccccccacaacctgcaggcgaccctgc

SEQ ID NO: 33403 - DNA, 121 bp, Artificial Sequence
  Synthesized
  misc_feature (61): n=a or g
gattgatactacctgtagtttactctcttgtgtttttcttatattgaaaatgtaatatggnaagtggtttgagttggaacttgacgatgaacataccagtggcaaagcagtggtttctaca

SEQ ID NO: 33404 - DNA, 121 bp, Artificial Sequence
  Synthesized
  misc_feature (61): n=t or c
ggtgatggagcactgggaaatgcagactctggtgatgattgctgtgttgcatgtgacacanggctagcatttgctttccagatctgtgctttgcaagcttttgcaagccagacaaatgcat

SEQ ID NO: 33405 - DNA, 121 bp, Artificial Sequence
  Synthesized
  misc_feature (61): n=a or g
ctgtgtacccagcctgccctgtcagcaaatgagcacaagtgtggtgccaccaacaaaaagncccttgcaaacacagaatgagagggtgctctgtttctattctgatttccctgcttgcttg

SEQ ID NO: 33406 - DNA, 121 bp, Artificial Sequence
  Synthesized
  misc_feature (61): n=a or c
cctttccttgctttactatgagtaagccccagctcaccgcatagctgtatgaatgctgacncaagggatgaggtgccagaggataagaatgaacggccagggtttcaaggatgctgagagt

SEQ ID NO: 33407 - DNA, 121 bp, Artificial Sequence
  Synthesized
  misc_feature (61): n=t or c
gcaggctcagacagctaggagagaaatatgattaccagatggtttgtttttccataggacnagaggccagtgtgaggtaacaggaaaaattttaacccgccccaagccagcctgggtgtgg

SEQ ID NO: 33408 - DNA, 121 bp, Artificial Sequence
  Synthesized
  misc_feature (61): n=a or g
ctctatgaatatataaatatgcgtctgcatttggtatggaacagggtgtgtgtcagtggangaaggctttctcagggatgggctgtgaatatgcagcagctgaactttactcgtttgctga

SEQ ID NO: 33409 - DNA, 121 bp, Artificial Sequence
  Synthesized
  misc_feature (61): n=a or g
catactaggcttatcacacacaatcctccttattctgcttttttgccattttcatcttaanttacctggttttggctgtttgcactgcccaagagccacttctgttgctgctacctgttgc

SEQ ID NO: 33410 - DNA, 121 bp, Artificial Sequence
  Synthesized
  misc_feature (61): n=a or g
attaaaggaagtggttagtaaagtcaactggactgaagttcgcaaggatttgagtgtggangaggcttgaagtctcccttaatgaaaattacaaaaccaagtaggaatttgccaaacaagc

SEQ ID NO: 33411 - DNA, 121 bp, Artificial Sequence
  Synthesized
  misc_feature (61): n=t or g
cacatctctgatgaaaagcttgatgtgatctgcagtctagcacactccagcagaaacatgncaagtttgcccactgccctttgcattggctgccagctctccggggtgctggaccagccat

SEQ ID NO: 33412 - DNA, 121 bp, Artificial Sequence
  Synthesized
  misc_feature (61): n=c or g
acaaaacaaaagcttagcctaaacactgagtgttggaaaaatgatataaaactggaagcanagttctatagagatgtactgagcagtgtaggttaagagtgctgattgcgatagatatggt

SEQ ID NO: 33413 - DNA, 121 bp, Artificial Sequence
  Synthesized
  misc_feature (61): n=c or g
ccaaacagccacgtggataaatgcaagaaaacactgtgcaacctggcctttcttcctggantcatccaggaggcaacataaggcactgctgtgccaagaaagcattttacggcttttcttc

SEQ ID NO: 33414 - DNA, 121 bp, Artificial Sequence
  Synthesized
  misc_feature (61): n=c or g
tcttcagctagaataaagccctgtatttcacaaagcagttcttaaaatatgatcagatagnaaacaattctgttaaacctgtgctgagaaacagagatctgtttgtcttttctggctgact

SEQ ID NO: 33415 - DNA, 121 bp, Artificial Sequence
  Synthesized
  misc_feature (61): n=t or c
gctttgttctcttcttgcaccctccccagtcccttactgtgttgtgttttgtctgctttcntctctagatcacacaaggtcctggaaccaggtcttttctgcggctatgctctatttctat

SEQ ID NO: 33416 - DNA, 121 bp, Artificial Sequence
  Synthesized
  misc_feature (61): n=a or c
agcctatatgtcgggattcagaagggggattgactcacagggtttattctctgctttgctntgtgtgtgtttgagctctacaagaacagattttcctgaaagtcatttctatgtggattaa

SEQ ID NO: 33417 - DNA, 121 bp, Artificial Sequence
  Synthesized
  misc_feature (61): n=a or t
gcaaataatgtttggaatcattttttctgttccttagtattaacaggcctttttggcttcntcttgtacccatcaaagaataataataagaagaagcaatatcttaatatcaatttctgaa

SEQ ID NO: 33418 - DNA, 121 bp, Artificial Sequence
  Synthesized
  misc_feature (61): n=t or c
ccatgcaaccaggcaggcagaacctattgaagggatggatatcatgtgcatgcagaagtancatgttttattggaaaagccagtgagcaagagaacaggatgccaacttcttaccaaatgt

SEQ ID NO: 33419 - DNA, 121 bp, Artificial Sequence
  Synthesized
  misc_feature (61): n=c or g
agattcctagattgaaatctgtaaataaaggcagtagtgtttgaagtaattttgcagtttntagtaaatagaaatccatgtagattatcagagttcccaaactactgcatgatgttaattt

SEQ ID NO: 33420 - DNA, 121 bp, Artificial Sequence
  Synthesized
  misc_feature (61): n=t or c
agcataccaaagtgcacagaccagatgtggaatactgtatggagagctctgacatttcctnccacgttcatgcacatcatgcacccaaaactggaggctggacgaaacacacagctggatt

SEQ ID NO: 33421 - DNA, 121 bp, Artificial Sequence
  Synthesized
  misc_feature (61): n=t or c
ggcaacgtcagaatgaacgttgcccaggcaacttccattttccatccatttgcttgcatgngtgttgcactttttaattgcacaatcttgctgttctttttttcctcttaagtccgctgcc

SEQ ID NO: 33422 - DNA, 121 bp, Artificial Sequence
  Synthesized
  misc_feature (61): n=a or g
tacatgcacatcccattttaatctctttgctatttatggtagtgtaatttaagattacagntgtttccatttggaggacatcacagtgaagcttccaacagacattgctcacaacttcgca

SEQ ID NO: 33423 - DNA, 121 bp, Artificial Sequence
  Synthesized
  misc_feature (61): n=t or c
tcactggatcttttttataaatgcatgtaagcagtaggaagatgataaaagtcctcagggngtagaagagcacagcatctgctagagagcactggtagaggaattattccagttctctcta

SEQ ID NO: 33424 - DNA, 121 bp, Artificial Sequence
  Synthesized
  misc_feature (61): n=a or g
caggcagactcaacagttgttcctagttctgtttaagctctcgtctttactgtctagtctncctaaggggaaatccttgagctggcacactggggcctggatttttctagtactcatagca

SEQ ID NO: 33425 - DNA, 121 bp, Artificial Sequence
  Synthesized
  misc_feature (61): n=t or c
taaatctctttgttatacgtaagataaatttctgtgtaattttggattcacaaggagtttnactactgaagactgtgggctggatttcacatatgtgcttgctgtattgttatagatacac

SEQ ID NO: 33426 - DNA, 121 bp, Artificial Sequence
  Synthesized
  misc_feature (61): n=t or c
ggatcaagataagccatgttctgaggacaaacagcttgaagcagggaatgatgatctcagncctgagcacaacaagcacatccttagccttgaacactctgccacagagcagcatgatgat

SEQ ID NO: 33427 - DNA, 121 bp, Artificial Sequence
  Synthesized
  misc_feature (61): n=t or c
tcttgtttgtactggtaatggtgctagtttgactgtccaaattttagagtaatttctgttnagtacctttttcaatgctgaagatgcttaacattttacttgatgaaaacatcaacagtta

SEQ ID NO: 33428 - DNA, 121 bp, Artificial Sequence
  Synthesized
  misc_feature (61): n=a or t
atattccacaccactcccggtaaagaaatacctttacaagattctttctggtggaaaaaantgtttgtcggaagctttcttttaagcagtcctgaaacagatgctcctttggtcttacctg

SEQ ID NO: 33429 - DNA, 121 bp, Artificial Sequence
  Synthesized
  misc_feature (61): n=a or c
catccacccttcatcaaaatcatatagaccagctgcagctgctaccactgtcctctccagntggttgacacgtaaggattttaatcatgggcctcaggacagaaccacagtcagatgattt

SEQ ID NO: 33430 - DNA, 121 bp, Artificial Sequence
  Synthesized
  misc_feature (61): n=a or t
ccatcagcttcctaaaaactatctgctaacaacaatgttgctctacttgtactgtctcccntttttctggttctggtggcacgcaggccggagcagactggaccttcctggctgtacagtc

SEQ ID NO: 33431 - DNA, 121 bp, Artificial Sequence
  Synthesized
  misc_feature (61): n=t or c
aaggatcgccttaccacactctgctggtaactaaactaacagagatttgtgctaatctccnaacgagctatgcggtacaacgggactgagcagaaacaagggacttctggatgcgctgaag

SEQ ID NO: 33432 - DNA, 121 bp, Artificial Sequence
  Synthesized
  misc_feature (61): n=a or g
cagggagcataaagcctcagtcacagcaaataaagaaggaaagtaggcagaaccagaaacntcaataaaatgcagaagtggtgagtaaacaagcatgggttttatcagatttttataaatt

SEQ ID NO: 33433 - DNA, 121 bp, Artificial Sequence
  Synthesized
  misc_feature (61): n=a or g
gtgtttgcattagatgtattcatagttagatttgattgagtttctctcagtgactgaaccnaaccaaaatcctggctttaagaatgcccgagaagcggggaaactgaattttgaacccgtt

SEQ ID NO: 33434 - DNA, 121 bp, Artificial Sequence
  Synthesized
  misc_feature (61): n=a or g
ctatagttaatgtttagttaatagattatgaacatactcaagcgcttcagcatcttcacanaactgttcatatgtgcataaaaataacagcgaaaggagaagaaaaagtctgaaggtctct

SEQ ID NO: 33435 - DNA, 121 bp, Artificial Sequence
  Synthesized
  misc_feature (61): n=a or c
ttgctttcacctggttaaataatatgttgttatttacatttcaaagataggaatacagacncagattaagaaggattttcccaaggtcttttgtcactcattgataaaattagtattacaa

SEQ ID NO: 33436 - DNA, 121 bp, Artificial Sequence
  Synthesized
  misc_feature (61): n=a or t
aacatacacagtcttccttctttgtgttaagaacagtggtgatgaagtgtcatctttaacnttgaattgcccagcatctgttggtttgtaccacagcccaaccctaatgttatttaaatct

SEQ ID NO: 33437 - DNA, 121 bp, Artificial Sequence
  Synthesized
  misc_feature (61): n=a or g
tgggtttatccttcctgaaagacgtattcctctgattccttaccccaagagttctgcctcntgaaatagtatttctgaagttttatttatactctgttgtttccataataaataatgacag

SEQ ID NO: 33438 - DNA, 121 bp, Artificial Sequence
  Synthesized
  misc_feature (61): n=t or g
ttaaggttccttcaacccaaaccattctatgattcctataaatacgtggattataaagaanggccccagcatctgccttttcaccagtgtaaagaccaagagatccaaaaaaatgtatcag

SEQ ID NO: 33439 - DNA, 121 bp, Artificial Sequence
  Synthesized
  misc_feature (61): n=t or g
ctacgagcctttatgcacaaggttggaatctgcacgcagtttgaggtttttattagaatanagctctgcctgttaattatgctatgggtagtgcataattaaacagtatttcaaatactgg

SEQ ID NO: 33440 - DNA, 121 bp, Artificial Sequence
  Synthesized
  misc_feature (61): n=t or c
taaaatcagtagtcatatcataaactgaatagaaatccatcagcatattacataggatgtntttatcaaatgtacatgtcagtgacttacttggtgaatctcatgcaaactttgagcctgt

SEQ ID NO: 33441 - DNA, 121 bp, Artificial Sequence
  Synthesized
  misc_feature (61): n=a or g
gtggttcacaatacaaagacatactcaagatggctgctaaggaaaacaaacctgctagatncctgcacatagcatcctttcacagtggttcatttcaccccagccacagttatcctacagt

SEQ ID NO: 33442 - DNA, 121 bp, Artificial Sequence
  Synthesized
  misc_feature (61): n=t or g
aggactattgcagagatacctacaacaggaagcctttgacgtatgaaagtggtcaaatgtnctatcaaccaaataatcctctttctgtagtcttttcaaaagaagtgtcacaagtcttttc

SEQ ID NO: 33443 - DNA, 121 bp, Artificial Sequence
  Synthesized
  misc_feature (61): n=t or c
tcaccgcagtgccacaggttgctcatgtccatctgcagctcctgaagaacctcaaagcgangttgaaggaacctccaacccatcctgcagagcccatcccacccccaccccccgcctctcc

SEQ ID NO: 33444 - DNA, 121 bp, Artificial Sequence
  Synthesized
  misc_feature (61): n=c or g
aacctgagtctctgagtgtgattagtttcttaatctaaaagctgttctgagcttgctcttntgtatacagcattattaggaagaaagatcctgcaggtgacgtcaggactccagtgaaact

SEQ ID NO: 33445 - DNA, 121 bp, Artificial Sequence
  Synthesized
  misc_feature (61): n=t or g
ttaaatcaagtgctggaaatgcacagtttctagctgtaaagaattttgtgaagattaatgnttatataatattcaaagacacaaaacactgaataaatgatattttctattatggtgtttt

SEQ ID NO: 33446 - DNA, 121 bp, Artificial Sequence
  Synthesized
  misc_feature (61): n=a or c
cagacccattagccctccccatttccattaagttgttgtttggcagtaggagccacagcantgtagaaacctaaattttagtaaaacgagatctttaatgtttgtgggtatcaggaatagc

SEQ ID NO: 33447 - DNA, 121 bp, Artificial Sequence
  Synthesized
  misc_feature (61): n=a or g
taaaaaattcacctgagtaattcagttctggttgaagcagattcttttttctcatttccancatggaatatattgcttggctttgtcatctgtgcattaagatcagacttttcctgtaacc

SEQ ID NO: 33448 - DNA, 121 bp, Artificial Sequence
  Synthesized
  misc_feature (61): n=a or g
cactgcttattcgaagtccatacattcaggaggccttaaaatacagaagagacataatttnctacctctatatttgacatatctatatttgacatatctatatagaggtgacacctctata

SEQ ID NO: 33449 - DNA, 121 bp, Artificial Sequence
  Synthesized
  misc_feature (61): n=t or g
ggaagccattcaagatttaattctcttaatttgacattaatcctccattagccattagaangaactttctctgagcctgctccaggatcttgtttattttctgctatgttgccagtagcag

SEQ ID NO: 33450 - DNA, 121 bp, Artificial Sequence
  Synthesized
  misc_feature (61): n=a or g
ttgctattaattttaagtggtttggattatatcaatgcagtacttccctcctttctagccngatgcatgtgaaataacttaattacctacaaaaagcctattcaagttactgaggcagtct

SEQ ID NO: 33451 - DNA, 121 bp, Artificial Sequence
  Synthesized
  misc_feature (61): n=a or g
ggatcacaaacagcaatactgctcaaatggaaaacaggtgggagcttttccctagcaagangtaggtcttagtatgaacacagctttcacctggggacatcttttcagaactgacaagaga

SEQ ID NO: 33452 - DNA, 121 bp, Artificial Sequence
  Synthesized
  misc_feature (61): n=t or g
tcacttagctgtgatactggagcaattacaattagcagaacctgaaattctggaggacttnttttccccttctttacaactgcattactaacaagggaaagaaaggcacacggggcaccca

SEQ ID NO: 33453 - DNA, 121 bp, Artificial Sequence
  Synthesized
  misc_feature (61): n=t or c
ttaaatgcaaagttcttatgttattcaacgtaaggattcttcagagtatccctgctggctngagcatggacaaaaacagttgtgtgcctgtgtgcccagctctgttgtagatcttatgcag

SEQ ID NO: 33454 - DNA, 121 bp, Artificial Sequence
  Synthesized
  misc_feature (61): n=a or g
gatgtcccatcaattcagtatcagctgagtaagtttcatcatgcgtgtgcagcaaacaccntgaaactgcctcttatgtgcaagtgcagcacaagtgtttgatatgcatgctacctgggga

SEQ ID NO: 33455 - DNA, 121 bp, Artificial Sequence
  Synthesized
  misc_feature (61): n=t or c
aacctagatgtaactgccaggtctttgtggaggtatacataggtgtatagaaagttactgntgagggcaggaatagcaaactggtagtaacagcctggactctgaccaagaatgaccatca

SEQ ID NO: 33456 - DNA, 121 bp, Artificial Sequence
  Synthesized
  misc_feature (61): n=a or g
cttgccataataaattcaataggtgaattaatgtggcacagtcactacgcagcgctggtantttcaacagctttgttttcgttgtcggtgtttttgctgagaaatcagaatcgtttttcct

SEQ ID NO: 33457 - DNA, 121 bp, Artificial Sequence
  Synthesized
  misc_feature (61): n=a or g
gcaatctaaaggtcatagcatgaaattccataacatcccttccatgtgcaaagattcttcntaactcctatcaatgtttacctcaatactgaaaatattgacatttcatgtcattaacaca

SEQ ID NO: 33458 - DNA, 121 bp, Artificial Sequence
  Synthesized
  misc_feature (61): n=a or g
atcctcaccttcagagctttccgcaccatctttgtccaatgcctgctttctccggccagcntattccccgctttgttatgctgtgtgattcagccacctttctcagttctccattgctgtt

SEQ ID NO: 33459 - DNA, 121 bp, Artificial Sequence
  Synthesized
  misc_feature (61): n=t or c
ttcaaaatgtcttaggatgtaaaacttgagtttttaaatggaacttcatttgcatgctttngtggtcctgcacacatacttctatttattgaaatgaacactcccactcaaacttcatctc

SEQ ID NO: 33460 - DNA, 121 bp, Artificial Sequence
  Synthesized
  misc_feature (61): n=t or g
gctctacccaaaagaaactgatagaaagctgagactgtaatttgtctgttagaaggcattncctttgcagaagccctgtaggaatagctaaaattagtggtttcccttgagtgtttcatca

SEQ ID NO: 33461 - DNA, 121 bp, Artificial Sequence
  Synthesized
  misc_feature (61): n=a or g
tttccttagttgctacagcatttgacttcacttatcactgtgatcatgtaaacaacttcantatgttttttaggggctgatcctacagatccttcttcctttctcccaccaagataacttc

SEQ ID NO: 33462 - DNA, 121 bp, Artificial Sequence
  Synthesized
  misc_feature (61): n=t or c
gaaatcagtttagttgcatgaatttcaggagaatgtttttgtgattacacttcagttatgnctttaagaacttcttaggaagatgagctctacactgtgatttgatttagttcagatggag

SEQ ID NO: 33463 - DNA, 121 bp, Artificial Sequence
  Synthesized
  misc_feature (61): n=t or c
tggtaattgtgcagccaattaagctttgttgcaagaagctgtgacaaaatatactttgttntaataacaatcattatttgacaagccattaaaaaattaaaacagatgcagccgttacaga

SEQ ID NO: 33464 - DNA, 121 bp, Artificial Sequence
  Synthesized
  misc_feature (61): n=t or c
caaacacattatatctcattttgcgtgagctagattgccagagtacacagatcagtggttntccttaggcagcccaaattttcaatcagtaacaggtctggcctagagaatttgcccgttt

SEQ ID NO: 33465 - DNA, 121 bp, Artificial Sequence
  Synthesized
  misc_feature (61): n=a or g
ataggctgagcgtccagccagtcctgctaggcatcttccatttgtcagcagttgctctctngtaaaatttgggggtccatcttggtagggataacattcattccctgtaataatgacaatg

SEQ ID NO: 33466 - DNA, 121 bp, Artificial Sequence
  Synthesized
  misc_feature (61): n=t or c
gctggagagtgaaggcctgtgggagtgggctgtgtttgtggtgctgcatgagcccgatacncagtaagtaaacatctcacagttctcaaggcaaaaaaaaaccacccagtctctgctctgt

SEQ ID NO: 33467 - DNA, 121 bp, Artificial Sequence
  Synthesized
  misc_feature (61): n=c or g
ccatccttttacaggctgctgtgaaatgtactggactcctaacttactactgctagttttncatacggtttatattacctacacttacaggactgattgaggcaagaggaagctcaggaaa

SEQ ID NO: 33468 - DNA, 121 bp, Artificial Sequence
  Synthesized
  misc_feature (61): n=a or g
aaaatacatgatcctgttttaggcaaaaatgtaaagagtctgaagtataatatatgaaaanttacaagaaggatctacaagtcgtttcaaattattactcacagttcagtacttaagaaat

SEQ ID NO: 33469 - DNA, 121 bp, Artificial Sequence
  Synthesized
  misc_feature (61): n=a or t
ctaaaactgtatgttttcatgcataaattcttttaattatgtggacaacaaagcagaaggnatcttgtttcttgaagttctacgttattattgcttttccacacctccacccgcctcacct

SEQ ID NO: 33470 - DNA, 121 bp, Artificial Sequence
  Synthesized
  misc_feature (61): n=c or g
atttcgtggcagcctgaaaagacctctgtgaggatcccactaggcaccgcggcagagctantccacgctgacgtcttcgcgcttacctcggagctctcaaactcccgattcgctgcctcga

SEQ ID NO: 33471 - DNA, 121 bp, Artificial Sequence
  Synthesized
  misc_feature (61): n=a or c
tcacattaattttgattatttggagatgaaattgcccattatgctaggttaaccatctaantgaggctcttcggttgctttcagcaaattagctctaatgaggagccaagtcccatgtctg

SEQ ID NO: 33472 - DNA, 121 bp, Artificial Sequence
  Synthesized
  misc_feature (61): n=t or c
agatactccacaagaggagaggagatgtgagaacagtagaaaagcattccagggtgtagcntccactacctgtttcattgcattatttaactagtagtattttggaacacatgaactactc

SEQ ID NO: 33473 - DNA, 121 bp, Artificial Sequence
  Synthesized
  misc_feature (61): n=t or c
ttgttaattcacctgcaaatcacatctggggaagaacaggaaactacttggatgtagtttnaattctttatatcttgttttagagattgatggggaagtatgcatgaactctaaagacgtt

SEQ ID NO: 33474 - DNA, 121 bp, Artificial Sequence
  Synthesized
  misc_feature (61): n=t or c
tctactttagccaaacttctgaggaggagaatattgtatcgcacatcactaaagtcccttngggtagattattttggcccccacagtgttttcctgatgttttaaatagtataaaattaat

SEQ ID NO: 33475 - DNA, 121 bp, Artificial Sequence
  Synthesized
  misc_feature (61): n=t or c
gaaagatgctcttacatttgcacctgatcagatggtgcttctctccagtcaaggacaggantggcacatgcatgctaacagcctgcaggaacaaaggaggtatttctctacagacagcctt

SEQ ID NO: 33476 - DNA, 121 bp, Artificial Sequence
  Synthesized
  misc_feature (61): n=a or t
tttccggatccatctttagatttgcacaaatactaatcaaaatggtaaagcctactgcccnaattgctctgagatgtctgaaagacttcagaactgatttgttttgaggcaccacagaatt

SEQ ID NO: 33477 - DNA, 121 bp, Artificial Sequence
  Synthesized
  misc_feature (61): n=t or c
ttctttcaatttctataatgcaggagctgatagaatagtaatcaaaggctataagtagaanagagccccaaccttcgattgtccttattttaacatgaccatgatgaccatgagaactggc

SEQ ID NO: 33478 - DNA, 121 bp, Artificial Sequence
  Synthesized
  misc_feature (61): n=a or g
ggttattgatacagctacagccaagtgcctgcccaactgaggtctccagcatttggatganggacacctccaactatggtgctccatgcttaaaatgaaatgcgttgacaggggccaatgc

SEQ ID NO: 33479 - DNA, 121 bp, Artificial Sequence
  Synthesized
  misc_feature (61): n=a or t
ttttcttcttattaattattctgttcagtctatagagtctatcagttcttgctgacaacanacagcaagttcccctcagtacggttccaggaccccaatgcccagagccaacaaaagcagg

SEQ ID NO: 33480 - DNA, 121 bp, Artificial Sequence
  Synthesized
  misc_feature (61): n=t or c
aaattagcctttattacatccatcacaagtctgaccatctggtttgtactgcagcaagcanttgtggcccaactgatataaagtaggttttgctcacaggtttgggatctacagaagggat

SEQ ID NO: 33481 - DNA, 121 bp, Artificial Sequence
  Synthesized
  misc_feature (61): n=t or g
gtctgaattacatctgttaaaaacctcagataagactttggttaagtctcctctccatttntcaatcttggaaattagagactgagactataattaaataccagtgggtcacttagttctt

SEQ ID NO: 33482 - DNA, 121 bp, Artificial Sequence
  Synthesized
  misc_feature (61): n=t or c
tttgtttttcttgtgattttagtgaaacgttgtatgtagactgcctactctggacttaacnttaccatttcataggccattactgatgggagtagagaatcacctgggatgcagcctgaca

SEQ ID NO: 33483 - DNA, 121 bp, Artificial Sequence
  Synthesized
  misc_feature (61): n=t or c
tttccctggtgggacaggaggcaaggcaactcaacaacttgctcaagaagacgtcattacngttcagcgcatcacttatcaaatgtttaagtaaaagatgtcaggtccactgttgggtagt

SEQ ID NO: 33484 - DNA, 121 bp, Artificial Sequence
  Synthesized
  misc_feature (61): n=a or c
cagggctatatggtgtatttcctatcttatctccagcacttaagaattgaaaaatgtcccncgttcttctgactcaatcttctataaaatgacatcatgtagtagagggagagatatgaac

SEQ ID NO: 33485 - DNA, 121 bp, Artificial Sequence
  Synthesized
  misc_feature (61): n=t or c
tattaaaagttctgcttttatgggatgcaattttctgtttttgaaactgcaaaagcaaatntcaaaacatcattagaagagatgttaatgcaacatgaataggtttgtcagtgcctttttg

SEQ ID NO: 33486 - DNA, 121 bp, Artificial Sequence
  Synthesized
  misc_feature (61): n=t or c
cagatgaataaagtagcaaaattcagcagattcatgtgatgctgttgttagataactgganggtttcgtttaaggaggacagactgccatgtgcatgaatggagaacataattaaagagct

SEQ ID NO: 33487 - DNA, 121 bp, Artificial Sequence
  Synthesized
  misc_feature (61): n=t or g
tctttacaagatataacattgtgaccgaactaccatacagatgggcagcactgtgatgganttccagcatcaaaggccgatggtcgtaaagatgttgccatacaggacacagtggcgcaga

SEQ ID NO: 33488 - DNA, 121 bp, Artificial Sequence
  Synthesized
  misc_feature (61): n=t or c
taatgcacagtacggaattctatggaagtttctgtctccttcctgcaaagcttttctcctncttcttttcaaaattttgtcaccccttcctgcctgttagagatcagcataactcattcct

SEQ ID NO: 33489 - DNA, 121 bp, Artificial Sequence
  Synthesized
  misc_feature (61): n=a or g
ccatttctactgaagacaagaaatcacttgataatgtgtgttgggagtaacgaagaagagnaaggatctctcccttctccattccccgagatctgcatgctatttaaaaacacctattttc

SEQ ID NO: 33490 - DNA, 121 bp, Artificial Sequence
  Synthesized
  misc_feature (61): n=t or c
ctgtagtcatcttttgatctttttaggttaatgctacggttattatttttaataactgtangtggaaagtagcctggtgattttaggataattttttacgtaagaatgattttactttgat

SEQ ID NO: 33491 - DNA, 121 bp, Artificial Sequence
  Synthesized
  misc_feature (61): n=a or g
tgtgaatttgagcttattttgagtgttgttgaattctatacctcttcataccttgtgaccngagcgtatttctggtattctctatttaatagcagaatgcctgtgagaaagagcccatatt

SEQ ID NO: 33492 - DNA, 121 bp, Artificial Sequence
  Synthesized
  misc_feature (61): n=t or c
atcttggcattgagcagttaccatccaccagagtgtccctgtgccagctgctgctccctgncaccctttcttccccattcgttattctcatcctaagacctctcacctcttctttcctgat

SEQ ID NO: 33493 - DNA, 121 bp, Artificial Sequence
  Synthesized
  misc_feature (61): n=t or c
ttctaggactttctgacaggaggtgttctaagtggctttggacagacatgttagtcagtantgggggacaaagctgtattctgctagaataattagcagtacacattggaaaaacacctaa

SEQ ID NO: 33494 - DNA, 121 bp, Artificial Sequence
  Synthesized
  misc_feature (61): n=a or c
ggatccagctatgcctttcttctccattctgagtagtttcagtgactctagcaaaaaaaancactaggatttctgataatgctctgcattacacacctctgtacaaaatcttatactcagt

SEQ ID NO: 33495 - DNA, 121 bp, Artificial Sequence
  Synthesized
  misc_feature (61): n=t or c
tctgcttcctgaaagagctgcagagctcacccactaacactaactacaggataacagaacnccacaccaaaacctgactatggcactgacagccttgctttatgaggtccctgatataaaa

SEQ ID NO: 33496 - DNA, 121 bp, Artificial Sequence
  Synthesized
  misc_feature (61): n=t or c
aagtcctcataaccacgtgtcaccattcctcatgacgttcctgtgctgttacgtcttgttnacacatcagtgttggggttttgcatttatggggtgtgggatgtgaagaacccatggtcac

SEQ ID NO: 33497 - DNA, 121 bp, Artificial Sequence
  Synthesized
  misc_feature (61): n=a or g
gccttgtctctgattaaaatagaaaaagtggctgttacgtagcatcagtggcaacaactgntctgaagagatgttgtgagatgtgtagcaggctgtgaatttttctcattttgtttcttca

SEQ ID NO: 33498 - DNA, 121 bp, Artificial Sequence
  Synthesized
  misc_feature (61): n=t or g
tgacacacaaagataatttagtcctagtagttcacctctttttggatttgtttttatatgnttttttttcccttaaaaacccagctctgggagtcaagtgaacctttcactatcatagact

SEQ ID NO: 33499 - DNA, 121 bp, Artificial Sequence
  Synthesized
  misc_feature (61): n=a or g
acatagggtcattatatccaatgacaggtctccatcactatctacaggaatgactgattgngcaaaggcacatgtggccctggcaggttctggtccatagtgctctcacaaaaagtccctt

SEQ ID NO: 33500 - DNA, 121 bp, Artificial Sequence
  Synthesized
  misc_feature (61): n=a or g
ggaacctggtcctgctgatttgttccaagatgtcaaaaaaattggtgaggatgctatgacnccctctgggacagagttgtgcttcagcagtgaccatgtttcatcctccaagcaaagtaag

SEQ ID NO: 33501 - DNA, 121 bp, Artificial Sequence
  Synthesized
  misc_feature (61): n=t or c
ttagtgatacaaagaagaaggaataaatcattctccatgaggcaattttctatatttcagnttctgttaggaaaggatataaatcccacgaacttattccgcttttacaagatcttttatc

SEQ ID NO: 33502 - DNA, 121 bp, Artificial Sequence
  Synthesized
  misc_feature (61): n=t or g
tgatggacattaaaggatttaatgccatgaaatgttttgagctgatacagctggacacatnttgagtataatgtatgataagaaatagcataaagaaaactacaggcttgagcctttccat

SEQ ID NO: 33503 - DNA, 121 bp, Artificial Sequence
  Synthesized
  misc_feature (61): n=a or g
ttctttgcttttatgaaggaggaagggaatgtgcacagttacggcaaaagcaatgggtcanaatacctttcagtgtccttgcatacaatgcagacaacatcccattaacaaacagactgtg

SEQ ID NO: 33504 - DNA, 121 bp, Artificial Sequence
  Synthesized
  misc_feature (61): n=t or c
cctatctgcagctactaaattcatatactgtgtagatctagtcaatgaattgcttcaatangaaaggagatgctttaaaaagcttttctgattctgaagagctatctgtaagcttggaaat

SEQ ID NO: 33505 - DNA, 121 bp, Artificial Sequence
  Synthesized
  misc_feature (61): n=a or g
attcctgattccattacagattttctggaaattgattttgcctggtctctcaaggagaaanttcaataatcaagtccctcaggcaaataaaatattgtttgtcagcctctcagcttataag

SEQ ID NO: 33506 - DNA, 121 bp, Artificial Sequence
  Synthesized
  misc_feature (61): n=t or c
ttcaaaacaataaaaacaacaaatgtcacattaatgaccacactttaaccactctcatcangttaacacaagctaatatgtgaggcaatggagaaattacagcctcaggatattacctctc

SEQ ID NO: 33507 - DNA, 121 bp, Artificial Sequence
  Synthesized
  misc_feature (61): n=c or g
gaaatctctacaaaagactctctacagtagtgcaaaatgtacaatgatgagcctaagaggnagttgaaacatgacatttttcatttacagcctatgaaagtcctttaccagcagcagagtt

SEQ ID NO: 33508 - DNA, 121 bp, Artificial Sequence
  Synthesized
  misc_feature (61): n=a or g
ataaagtatactcagatattataaatgcacataaacattatgcattttatccctcagaaancaggaagaagaggctgaagctgatagcttggctgtacacctgcacagaaaccagcaatgc

SEQ ID NO: 33509 - DNA, 121 bp, Artificial Sequence
  Synthesized
  misc_feature (61): n=a or g
cgctagcctcttctagttgctttacatacaacataaaggaacaaccataaaaatgtgtgcntgattcggaaatatgtttttcttactttcaatcacaatggactggactgttggatgaaaa

SEQ ID NO: 33510 - DNA, 121 bp, Artificial Sequence
  Synthesized
  misc_feature (61): n=c or g
ccaaacactgaaatcaaataagattgcttttcggtatgaaaagacttctaggtttagcacntagtctctccaggactaccaaggaatactgaatgaatgagatagtgagggatttttactt

SEQ ID NO: 33511 - DNA, 121 bp, Artificial Sequence
  Synthesized
  misc_feature (61): n=t or c
aaagctcagctgaatttaaatttccccttcttgcttttttataaatgaggttgacatttgnccttcctcagttctcacatttctcctgtcctttgagttcagaacagcagctagcagcttt

SEQ ID NO: 33512 - DNA, 121 bp, Artificial Sequence
  Synthesized
  misc_feature (61): n=t or c
caataatacacaatatggctcacagagttttttgccacataatgggcactccagctcccanacaagatggcctctttcagcatgaataactcaagcagcatatatagctgctattcataat

SEQ ID NO: 33513 - DNA, 121 bp, Artificial Sequence
  Synthesized
  misc_feature (61): n=t or c
cattgtttccactgctgcaggacagttcctctctgtgttccagcccaagacttggcctctntcctaacccagtcgcttgggcaataaattagtgacagtgcatacttaacctcatttttta

SEQ ID NO: 33514 - DNA, 121 bp, Artificial Sequence
  Synthesized
  misc_feature (61): n=a or t
gtactcttaagactacctctacaccattctcagaagtggagagcacagagaaagtgctcanagcccagagagtgtagtggctgcttatctgacagtgctgagtgtatattttataggtacg

SEQ ID NO: 33515 - DNA, 121 bp, Artificial Sequence
  Synthesized
  misc_feature (61): n=a or g
tttataaaacagacacatagatttgtgtgactgaatctggagttgaaattaaatcaattcnttaatgtgtcaggttagagcgattccaaatatttgatggaagactgtataggagtagcag

SEQ ID NO: 33516 - DNA, 121 bp, Artificial Sequence
  Synthesized
  misc_feature (61): n=a or g
ctttagttgttcacactgcagtgcatcactttcatcccagtatgatgccaatcaatgtcangtcccatgctgttgtaaattgcaatgatgaatgttgaggcatatacaatcaattatggtt

SEQ ID NO: 33517 - DNA, 121 bp, Artificial Sequence
  Synthesized
  misc_feature (61): n=t or c
aggggcaggcccggagcagttcctgcagttcattgctgggacagctccatgggaaatacangggaaggggaagaattgcattgcctctacttgtctcacgagcttgtgtgctcagtttgag

SEQ ID NO: 33518 - DNA, 121 bp, Artificial Sequence
  Synthesized
  misc_feature (61): n=a or c
ccagtgactaaggaatctggatccacttggcacctgcttctgagcctgactgctatttgcntggtcagaacttctgtagtgtttaaagtttagtataaaatgcactggattgatgccagta

SEQ ID NO: 33519 - DNA, 121 bp, Artificial Sequence
  Synthesized
  misc_feature (61): n=t or c
agtaatacaaacaatttttaaacctttttagctttcagacaagtaaattgctccaagaaangtaaaatgagtacagcttttatattcctgaaagaccaattacaacaaagttcttactcag

SEQ ID NO: 33520 - DNA, 121 bp, Artificial Sequence
  Synthesized
  misc_feature (61): n=t or c
tagtgccaaacaaaaccatgctataagccacagcgatgcaccgaatcatcagtgcccgganagagaggcattcagtttttatcttctgctctttgtgcttctcagtgtctgaacaagcttt

SEQ ID NO: 33521 - DNA, 121 bp, Artificial Sequence
  Synthesized
  misc_feature (61): n=c or g
tggtaatacactctttggtcaaaaactcaggttgagagcacaccataaaaacatgttcacntggcaactaccagaactgagattcaaatttccactacaaatgtttgctcactgggtggta

SEQ ID NO: 33522 - DNA, 121 bp, Artificial Sequence
  Synthesized
  misc_feature (61): n=a or g
ccagccacatcaagctgcactgagagcccatcagaaattaaatctcttcagcctgaggganatgattcatgttttgttgcacaatctccatgcccactatgcccattattgaacgcgggtg

SEQ ID NO: 33523 - DNA, 121 bp, Artificial Sequence
  Synthesized
  misc_feature (61): n=a or g
tacgtctctggagctcatgagctctctgcagtgctcccattgtccccatcccccagggacnatccaagccctcatgcaaagagctgagcatcagagtgggaggagatggaggcgcagaggg

SEQ ID NO: 33524 - DNA, 121 bp, Artificial Sequence
  Synthesized
  misc_feature (61): n=a or g
ttctccgcaagcaaaaattagtgccattacttcattagttgtgttaaagcaatatgccacntcctgcagagcagataaaggtgttgagccaataccacagatgttagtttaaggctacaaa

SEQ ID NO: 33525 - DNA, 121 bp, Artificial Sequence
  Synthesized
  misc_feature (61): n=a or g
ttgtcattactatttagagaaactgcaccaaaaattcactcctggaagtcaatgtattccntctgtccgtctgcagaaacagttgagtgtttatgtgatctgtcacaagctgagtcagata

SEQ ID NO: 33526 - DNA, 121 bp, Artificial Sequence
  Synthesized
  misc_feature (61): n=a or t
ttccagcacaggtagcaatatggcattggcaccgcatggcaggaaaattgacagagagaangaggttagtgccctccacaaagatactgcatacattgcttctgaattatacatgctatct

SEQ ID NO: 33527 - DNA, 121 bp, Artificial Sequence
  Synthesized
  misc_feature (61): n=a or c
ttcctaacaaataagtctttatttctaaaaaacgttttatcagtcagtttcaataaaatgncctggaatcatatactgaagctgcattagcatctaatatagttgaaaactgcactccaac

SEQ ID NO: 33528 - DNA, 121 bp, Artificial Sequence
  Synthesized
  misc_feature (61): n=t or c
caaagtttaacaaagcacataaccagctgtccataaaaatcaacccaaagccataccttangaaaatgataacttcctgacagcctggcctccctctgttgcctaggaatgagtgagctgg

SEQ ID NO: 33529 - DNA, 121 bp, Artificial Sequence
  Synthesized
  misc_feature (61): n=c or g
ataaagtggattatacagtcttcttcagctcaatgagctgtcttaaaaaatattataccanttactttctaaaggtgaccagtaactttctaaagtgatttgagttcctcagggctgttca

SEQ ID NO: 33530 - DNA, 121 bp, Artificial Sequence
  Synthesized
  misc_feature (61): n=a or g
cctggagggaagcatgagggctggtgagcagggtacatctaaggggctgcaagtgctgaanccaggaggttcatcaagaaaagcaagacagctgggatgtggccaggtgaaactgccatgc

SEQ ID NO: 33531 - DNA, 121 bp, Artificial Sequence
  Synthesized
  misc_feature (61): n=t or g
gctgttgtccaagctcggagctcttgtgggcgtgacatgcagggctgaaaggggaggttanttggagcaggtgcatttgctatgagttcccctctggcctgtacagccagagccagcattt

SEQ ID NO: 33532 - DNA, 121 bp, Artificial Sequence
  Synthesized
  misc_feature (61): n=t or c
actggttacatagtttccatacaaaatgtttcatgttactgtcatatgtatttctgtttgntgtttactctccaagaaagaagtgctttaatacttagggacctactagatctttactgac

SEQ ID NO: 33533 - DNA, 121 bp, Artificial Sequence
  Synthesized
  misc_feature (61): n=a or g
atatgttaacatgctccaattttatactgataggtactaaaataacttcagataatagatnaaaccctcttcactgggcttattactcatttcacttttcatggggctatttgagatctta

SEQ ID NO: 33534 - DNA, 121 bp, Artificial Sequence
  Synthesized
  misc_feature (61): n=a or g
agcactttttccccattatgtaacactgcctgtgcacaaacagttctcttcctgacacatntatgtaagccaacagatcctccgcccagagcccttctcttaagctgaacagcccctaggc

SEQ ID NO: 33535 - DNA, 121 bp, Artificial Sequence
  Synthesized
  misc_feature (61): n=t or c
caagttaattgatccaatttgcctttctgttctctagctgtcccactcttcttcacctccngttatgagtatttttggagacctacgctgtacaaacttatctggagtgaaactgacctct

SEQ ID NO: 33536 - DNA, 121 bp, Artificial Sequence
  Synthesized
  misc_feature (61): n=t or c
tgaaaggtgttacattttattcctgaggagtgaatgtgtctggctttgcaatgctctattnccctatgctagtctgggaaaacgcatgttgaatttcagcctatgatatgaaaccaatggg

SEQ ID NO: 33537 - DNA, 121 bp, Artificial Sequence
  Synthesized
  misc_feature (61): n=a or c
tactggagcctctcctgagctcaataacaaaagcccattgtgtgagggtgttataccccangtgctcagcccaggacgtatttgtgtctcacgaaagtactggggatcttgcatgagaatt

SEQ ID NO: 33538 - DNA, 121 bp, Artificial Sequence
  Synthesized
  misc_feature (61): n=a or g
ttcacaatacaataagcataacatagagaagtgtggtttgacagcacaactattgtataancccacattcttaggtactttgtttttttaaggatttgcttagtcacacagaacacagcat

SEQ ID NO: 33539 - DNA, 121 bp, Artificial Sequence
  Synthesized
  misc_feature (61): n=t or c
ggtgctgcaggacacggtgatgcgctccatcatgttccctgcaacagagggtcaaactgcnggctttagctgggttagcacagggagatgcccacgacttggatagcacacagtatgagag

SEQ ID NO: 33540 - DNA, 121 bp, Artificial Sequence
  Synthesized
  misc_feature (61): n=t or c
cggtagtttctaatcggaacagagataggtgctgggaggacttccacccaagctgcagcgncgtagtgacaccagagctggttactcacgctcaagcaagaggcggaagaaactcaggaga

SEQ ID NO: 33541 - DNA, 121 bp, Artificial Sequence
  Synthesized
  misc_feature (61): n=a or g
aagcagaatttaagaatttaagtttctcaatgccatccactaactacttggttttaccagnaatttgaaagacgtgatgttacaggtgtttctctgtggtgcctttaactatgacaagtat

SEQ ID NO: 33542 - DNA, 121 bp, Artificial Sequence
  Synthesized
  misc_feature (61): n=a or t
agatctttcagttctaagcctcatgaaggtcatgatgtggagaaagctttcaaaagccaanataattgaaacatctacttctgtcctggaaagaacttagaatgaggctcaattgaagaaa

SEQ ID NO: 33543 - DNA, 121 bp, Artificial Sequence
  Synthesized
  misc_feature (61): n=a or g
actcattaataagtgatatgaaaatgatactgtgctttgaagtgacagcctttgctgatgntgtaccaggcaagatgttggtggcagagtggcttaatggggcagccactgtgaaaagaga

SEQ ID NO: 33544 - DNA, 121 bp, Artificial Sequence
  Synthesized
  misc_feature (61): n=t or c
tgcctgtgatggatttgactgctatctccagacaaatcattcccaaatgcacttcaccaanactacacaatctgataacttcagctgtcaagcagaaaatgtgcatttggtgatggcttaa

SEQ ID NO: 33545 - DNA, 121 bp, Artificial Sequence
  Synthesized
  misc_feature (61): n=a or g
tcagatatgtgctgaattttgcagtcaatactctccatccaaactggagggatatccaacnggacaaaaaggtgattgtccccttttactgtgcccctgtgaggctacatctggagtatgg

SEQ ID NO: 33546 - DNA, 121 bp, Artificial Sequence
  Synthesized
  misc_feature (61): n=a or g
taaaaaagcatgcaaattcactgtggccattagaacattctagttttcattattgagcaangagtagcacaaaaagataaattccatacgtatactcatcttaatataagtatagtatact

SEQ ID NO: 33547 - DNA, 121 bp, Artificial Sequence
  Synthesized
  misc_feature (61): n=a or g
gatggctcctgctttgtcgcttttaaagtgctgtttgaattatgggagcctgaagaagacnttaatgtctatgcttctaaaaataccttcctgcctacacctttttaaacggaggtaacga

SEQ ID NO: 33548 - DNA, 121 bp, Artificial Sequence
  Synthesized
  misc_feature (61): n=a or g
tgcgctttttgggatggtgtctctgtgactgctctacctcctgttttattgcgcagcacgncattactgagcttgcctgtgccctcagagaactacagaaccatagaatggttgggttaga

SEQ ID NO: 33549 - DNA, 121 bp, Artificial Sequence
  Synthesized
  misc_feature (61): n=c or g
tacagtttgtttttttttccaagcaatagttcttgaattcacagaatagtcctaaaacacntcatgctctcagtaccttagagccaagggaagtccatctcaccaaggatacatttgatgc

SEQ ID NO: 33550 - DNA, 121 bp, Artificial Sequence
  Synthesized
  misc_feature (61): n=t or c
aactacacgcatctgaaggaaggagaaacgtcctactggtgctggaaaatatttggcattnacacacctattgaagtatgaggaccagatgctcagctcatttatgcacacatccgctcgc

SEQ ID NO: 33551 - DNA, 121 bp, Artificial Sequence
  Synthesized
  misc_feature (61): n=t or c
attcttctctcactggttttatggctgtagaagtttgacttgtatgaaggtactttagatntatttgattgtatccaaaagcaagatgtgtcctgtgtagtgtagtgtttttcaactgggt

SEQ ID NO: 33552 - DNA, 121 bp, Artificial Sequence
  Synthesized
  misc_feature (61): n=c or g
gctggtaagggctgtgtttaggatggctaaaaaccagatggaaggatgtatgccagagcantgttcataaggcctaatcttttaaggcgccatcatttaattgctgtgttagctagttaat

SEQ ID NO: 33553 - DNA, 121 bp, Artificial Sequence
  Synthesized
  misc_feature (61): n=t or c
aggtttgtgggtaacggtctgacagaccagttttgatgcaaaggcacaaggcatccaatantgcatgttcctcttgccattgggtccagaggggcagggatggctgcaggaggcttcaggc

SEQ ID NO: 33554 - DNA, 121 bp, Artificial Sequence
  Synthesized
  misc_feature (61): n=a or g
gtatagctttcccatcttgtcagcgctgcccgtcaggagctgagccacaggctgtttgctncactctctctcacacaggtgtggagaggtttttgatctaactcagaaattccctgctccc

SEQ ID NO: 33555 - DNA, 121 bp, Artificial Sequence
  Synthesized
  misc_feature (61): n=t or c
cctttgaggaaaaaatacataaactttcccccctgtcttccttaaaaccaattaaagaaangactagcactaatgtaaaacaaaggaaaatgaggctcactatccttcactgtacttaatt

SEQ ID NO: 33556 - DNA, 121 bp, Artificial Sequence
  Synthesized
  misc_feature (61): n=a or g
attagttttttacataaactgctgtctataacttgcactgtttctctgaagaaatgcatcntaagtctaatgtgctgtggcaacgacaaataagttgtttcacatctgtatttctttgttg

SEQ ID NO: 33557 - DNA, 121 bp, Artificial Sequence
  Synthesized
  misc_feature (61): n=a or c
cacctgagagagaggctacaggcgctgcaagccctgtgactgcaaagtaacagctgaaagncatgctgtctacaatgttaacaacatagtttatgcgcaagttactttgttaaaagggaag

SEQ ID NO: 33558 - DNA, 121 bp, Artificial Sequence
  Synthesized
  misc_feature (61): n=t or c
cctctgtgtcccactgaggtaacagcaaaacctggttcaagtgagcatgaagacagttgcntgctactaccttgctgaaactaagcaagagggatatgttttcagggtgctgagttttctt

SEQ ID NO: 33559 - DNA, 121 bp, Artificial Sequence
  Synthesized
  misc_feature (61): n=t or c
gcccgcagcttggtggtttggtaaaacacaattttacttaataaagaagctcggacacttnccctttaatggacactctccctttaagaccctatctgccaagggaagaacaaacatattg

SEQ ID NO: 33560 - DNA, 121 bp, Artificial Sequence
  Synthesized
  misc_feature (61): n=a or g
tggtgctctttcaccttgggaaggacttccagattctaaacttgttttatcgagcaaagtnttatactggaaactagtgtatctttattgtttctttattgaaggtgtattaagtactcta

SEQ ID NO: 33561 - DNA, 121 bp, Artificial Sequence
  Synthesized
  misc_feature (61): n=a or g
gggtgttggagtagaaggaagctgctcttctgctgctggtttgaagctgggaagaccacancttggttctcacttccactagagatttgtgaataacttggtgtaagttgtttcacctaaa

SEQ ID NO: 33562 - DNA, 121 bp, Artificial Sequence
  Synthesized
  misc_feature (61): n=t or c
tctctccttgaggttttttttccttaccaggtctatgatgttcagaggttgtgatatccangtgggagttgaagacggcataactgcatactggtcatactgtataggattaaactttggg

SEQ ID NO: 33563 - DNA, 121 bp, Artificial Sequence
  Synthesized
  misc_feature (61): n=t or c
ctcaggagctttccccaaggaaaacacacagggagatcctctctgtccttttgatagggcncagctaacaaggttccctttctatgcaaccacccagccccttccattagggcagctttcc

SEQ ID NO: 33564 - DNA, 121 bp, Artificial Sequence
  Synthesized
  misc_feature (61): n=a or g
atcatgatctcctcagagatgcatctctaccagttccttggtagactcaaatactcttaanttcagaaaaaaaatgttagtacatctcttcaaaaattctttgttcaacacaaacctacat

SEQ ID NO: 33565 - DNA, 121 bp, Artificial Sequence
  Synthesized
  misc_feature (61): n=t or g
ttggtacacccggtggcaattcatcatatcatcattcacttgattcatacatttatcaggnaaaagaaaaagcctccagttcctgttcctgctctgttggcatgggatatgtggtgcctga

SEQ ID NO: 33566 - DNA, 121 bp, Artificial Sequence
  Synthesized
  misc_feature (61): n=a or g
aaagaaagtgtttcatatgagaccacacaatatttttatttacataatcatgacatctacnagcagacttggaattcaagaattagtgaatacttcagaaagtgcaggatagaaattcaca

SEQ ID NO: 33567 - DNA, 121 bp, Artificial Sequence
  Synthesized
  misc_feature (61): n=a or c
tcagactaatgcatctcaatatgtcctaggaagacctacctctttcctgtgtcttctcatnttaggacccataacacatgctgaggcctgtttgaagtcttgtttggcagcaatgatgagg

SEQ ID NO: 33568 - DNA, 121 bp, Artificial Sequence
  Synthesized
  misc_feature (61): n=a or g
cgtcagacagcattttgacatactgctactcttttgccatctctcacaatagagtggaagnaagagggagacagagtatgccagtgacagaaatcccagaggaatgagcagacattcagcc

SEQ ID NO: 33569 - DNA, 121 bp, Artificial Sequence
  Synthesized
  misc_feature (61): n=t or c
caaacccatttcggcatgttgaaaacactgcactatctcacaatgtaactatgacacaaangtacaaagctacaaatacaattacatctgtagtttttatctaaagtaatcacatgttatg

SEQ ID NO: 33570 - DNA, 121 bp, Artificial Sequence
  Synthesized
  misc_feature (61): n=t or c
aaagccctccgaagtttggaagttttcattatagggaaaaccccatcagctagaggatctnagttcaaaccaacatgcaatggaaccactcatcgtccagcagataggtggcctctgtcgc

SEQ ID NO: 33571 - DNA, 121 bp, Artificial Sequence
  Synthesized
  misc_feature (61): n=a or g
agggtgctagatgaaggtgggttttggtctacacacataggaaatgtctttgttttattcntagatcaaaagatgagtcgcaggaggcaccaggctccgggtggttgtggccttggctctg

SEQ ID NO: 33572 - DNA, 121 bp, Artificial Sequence
  Synthesized
  misc_feature (61): n=t or c
tctaccgggtttaggctggataaagaacagctactgaggctcgagatgaaggcagaggacngggtgacggcgaggcactggcgctgcagcccagagatgctgtggatgccccatccctatg

SEQ ID NO: 33573 - DNA, 121 bp, Artificial Sequence
  Synthesized
  misc_feature (61): n=t or c
gctgaaacatgggcttgactcagggagagctgcctccagccctgcacagccctcagctctncccaagcacgtggtgccatgccatgtcaggagctgagattagatggttgcagggatctga

SEQ ID NO: 33574 - DNA, 121 bp, Artificial Sequence
  Synthesized
  misc_feature (61): n=t or c
cattatattgcccttcactgaaacttgagaattgtggtgtctattacagctcattaactcnagacctattgtcctcctttacaggtaaggaaacaaacaaaaatggatcatttgacaacac

SEQ ID NO: 33575 - DNA, 121 bp, Artificial Sequence
  Synthesized
  misc_feature (61): n=a or g
aatgctggcagtaaactcatgacgtctctcagaaatgtattagattgagtgcttttttctngctggaggctagtgtttctgatttttgtcttctgtctcagttcagctcaaccatctgaac

SEQ ID NO: 33576 - DNA, 121 bp, Artificial Sequence
  Synthesized
  misc_feature (61): n=t or c
aggtacagagcggtgtcctttgggtgagcagcctggatgtgcagcacagcgtaatgcttcngatagtcacaggagaatccattcttcgttttatctatgcagttcagaagcagttggggcg

SEQ ID NO: 33577 - DNA, 121 bp, Artificial Sequence
  Synthesized
  misc_feature (61): n=a or g
ctcagttttgtaccaaagtcccagaactagggcttgtttaagagacatgtcctccacagtngggaaagccccactatgccacgtacaaagcctcacaaatggcaggctggtctgtttctcc

SEQ ID NO: 33578 - DNA, 121 bp, Artificial Sequence
  Synthesized
  misc_feature (61): n=a or t
aattcttaacacaaggaacaagtatttgactagtagaagagtagagaaaatgaagtacaanccgccattttgagccacttctaaaaaaaattttctacagaccattttgaaactatcacta

SEQ ID NO: 33579 - DNA, 121 bp, Artificial Sequence
  Synthesized
  misc_feature (61): n=t or c
cagaagaggtgtgcagataccaaacactgagcaatccttcagaattggaccagatgagcanggcatggctgctaatcagctgagaatacaaaaggaaagctgtcacacagaaaaaaagcac

SEQ ID NO: 33580 - DNA, 121 bp, Artificial Sequence
  Synthesized
  misc_feature (61): n=a or g
ctaattttatttctagcatgcatccaacgttcctacccatgtctggttctctatgctgtcntcacaaaaatgagcagtattttttaatagcacgggggaaatgcaattgctgtgattaact

SEQ ID NO: 33581 - DNA, 121 bp, Artificial Sequence
  Synthesized
  misc_feature (61): n=t or g
tggaatattgtttttaagcttcaaacatgttccatccacgtgttgttggatcagggggatnaaatttgtatgtacagaatgaatttctgtttcagtttattttgacaaatttgtgagtact

SEQ ID NO: 33582 - DNA, 121 bp, Artificial Sequence
  Synthesized
  misc_feature (61): n=t or c
gtgcagccctactttcccataggctgctcagaatgctccactgcccattaagctgtctgtntgaagcagaatatctaagcccaggttaagcagtgctactgcacgcagtgctggcatttca

SEQ ID NO: 33583 - DNA, 121 bp, Artificial Sequence
  Synthesized
  misc_feature (61): n=a or g
gatctgggcacttttgtttgatggatgccctggaacttgtgaaacaggtaactgatatctnggaaggatctatgcatgaattactttgctaagcaaattcattacaaatccatcatgttag

SEQ ID NO: 33584 - DNA, 121 bp, Artificial Sequence
  Synthesized
  misc_feature (61): n=t or c
tcctaactatttgctgttccttctcattaattttccaacttgagtatcttgatttcaacantactaaaagagtcatttcgagaaataatggaagagactggttccagtgccaattcatgct

SEQ ID NO: 33585 - DNA, 121 bp, Artificial Sequence
  Synthesized
  misc_feature (61): n=t or g
acaactcttaaatgacaaatgatgtatttatttattaagttcattttggtccaaatcagtnatcaggatcccatttcatttgtacagatagtttgaagatcttctctatactggaatctgc

SEQ ID NO: 33586 - DNA, 121 bp, Artificial Sequence
  Synthesized
  misc_feature (61): n=a or t
ccagtagcagagtaagtgacttaagtttgctgcagtaccgtgagaaaatggaagagcatcnctagaaatggctcaaattgatatgttttaaatattaagaatccataattaaccattttag

SEQ ID NO: 33587 - DNA, 121 bp, Artificial Sequence
  Synthesized
  misc_feature (61): n=a or g
ctcagcagtgacacaaaaccagcttgtactaacaaaagtggtaatactaaataggccaggnaagattgtaagaaatacgcgtgtttgtagagataaaaacacagatttcataggctaatga

SEQ ID NO: 33588 - DNA, 121 bp, Artificial Sequence
  Synthesized
  misc_feature (61): n=t or c
accaaaaaaataattggtggtattttaatccatttcctggaagtccaaatgcaaacacccngtgctaattaatgggctgtgggaagatgaatctgagtagcctcactccaatggaatgaat

SEQ ID NO: 33589 - DNA, 121 bp, Artificial Sequence
  Synthesized
  misc_feature (61): n=a or g
cagggctgtgctgaacctctgctctgcccatccagcactgacttcagagctctctcacacnccctataagacgctctatcagtcagctgagcgttcgccccctcttcgcaggcaggggagc

SEQ ID NO: 33590 - DNA, 121 bp, Artificial Sequence
  Synthesized
  misc_feature (61): n=a or c
gaacattagaaagagcacataataattaaattttgggaacgaagttacaaattccacttgntttccatgctgtctgtccatctgcaagaagatcttttccagagaacacactggcagccca

SEQ ID NO: 33591 - DNA, 121 bp, Artificial Sequence
  Synthesized
  misc_feature (61): n=a or g
aaaagcactacagaactgaatcaaggtgaatgccacgtgctgtgattttcccttgggtgcntttccttgagttgtcacatcaggtacagtgcaggctccagctctgcatataccaccaggc

SEQ ID NO: 33592 - DNA, 121 bp, Artificial Sequence
  Synthesized
  misc_feature (61): n=a or g
ccaatttttggcgagttaaactggtcaagataagggctgtgtaactaaaataccaccccantgcccagcagtatcagcccatcaccttgtacctccctgccttttgtggctacccagccct

SEQ ID NO: 33593 - DNA, 121 bp, Artificial Sequence
  Synthesized
  misc_feature (61): n=a or g
tctgagtgccacagggccggatggggctttccttgtgctgggggtggagttctgaaatcgntttctacgttctataaactccctgctgcagtatttccacatgtcctagggaggggcttcg

SEQ ID NO: 33594 - DNA, 121 bp, Artificial Sequence
  Synthesized
  misc_feature (61): n=a or g
gttcactctggtgaaggaacattgctgagctgctcctcgattttccttgctggcagcctgnagttattcagtcacattccttgccacgtgccagtgtgctgctttcctccaatagtacagg

SEQ ID NO: 33595 - DNA, 121 bp, Artificial Sequence
  Synthesized
  misc_feature (61): n=a or g
gtgttaacattcatcctgtaacacagtgaattccacttattggactgtggttgcagatttngcaacttgagagcagatgctgttacgtaatggaagttgatcatatcttagttatgtccat

SEQ ID NO: 33596 - DNA, 121 bp, Artificial Sequence
  Synthesized
  misc_feature (61): n=a or t
aacaaatactaattcttttatttaaataccttttaaaactagtttaatcttcacagggccnccccagacactggcacaacaaagagcgtgttgccatgggaagaagtgctataatgaggga

SEQ ID NO: 33597 - DNA, 121 bp, Artificial Sequence
  Synthesized
  misc_feature (61): n=a or g
cacagaaggtgcaaatcaatgccgtgaacgttctctaaccaacattccctgcgatgctccnggaaggcagaagagcatccccagacctgcagtacgtggtctgacaccagaagcctttact

SEQ ID NO: 33598 - DNA, 121 bp, Artificial Sequence
  Synthesized
  misc_feature (61): n=a or g
gagaacagaggtgctggtatcaaggcaggatgctgaattcagcaaacttagtcaaaagagnaatgaaaggagaaatggagaacaagatacagcatctacctactgcaagtttagggagaag

SEQ ID NO: 33599 - DNA, 121 bp, Artificial Sequence
  Synthesized
  misc_feature (61): n=a or g
atgctggtatcaaaaggcacttcagtttagcagagaaaagcacaacaggcactaatgactngggaggctaaaaccaaatacaaagagaatacgtttaatgaagaaaatgattgacattgga

SEQ ID NO: 33600 - DNA, 121 bp, Artificial Sequence
  Synthesized
  misc_feature (61): n=a or g
cttgttttccaattcatagccacatattatctgttctgtgaagaagtttccagagtggtanaaaagatggtgaaaaaaataggcgttctgccaattcctgcaaatctcagtttcaaccttc

SEQ ID NO: 33601 - DNA, 121 bp, Artificial Sequence
  Synthesized
  misc_feature (61): n=a or t
cttcagagtttagaatgatcttttggtagtaaaaagaaaggacagctaataatgatacttntaggtattatttacacatttcacacctagttaacactgatccgctggtctaagtatcaat

SEQ ID NO: 33602 - DNA, 121 bp, Artificial Sequence
  Synthesized
  misc_feature (61): n=t or c
attatatcacttaaaatgatttaaatcatgctgccacttgttgtggacatagcaatgtacngtagccaatgccaaattccactgcaactcttagaaatatcagaagggtgagtgtcaagag

SEQ ID NO: 33603 - DNA, 121 bp, Artificial Sequence
  Synthesized
  misc_feature (61): n=t or c
gaacagtcattccctcagtttacaggaacatctgggaaaagctgagagatggtttactttncccattcactctcacttatatagatgtcccccttcaaaaaagtcccaagagaaggtcagg

SEQ ID NO: 33604 - DNA, 121 bp, Artificial Sequence
  Synthesized
  misc_feature (61): n=a or g
agaggagcctgatgtagtcaagaaatggatcaggtggaacaccttttcagcagcagtttgnagaacaaatacaacagtgttgcagcaaagacgccaagagagtgagcaagaactcaggaga

SEQ ID NO: 33605 - DNA, 121 bp, Artificial Sequence
  Synthesized
  misc_feature (61): n=c or g
ctttgacttgatggtaagatgaggagtttttgtttggaagagagatcaaatatcttaactngtgaatgtgcaggggagatgtttatagcagtctctttgttctgtatggcagtaaagagtg

SEQ ID NO: 33606 - DNA, 121 bp, Artificial Sequence
  Synthesized
  misc_feature (61): n=a or c
tagctgaaaagtgaagagtacataattagtttgcttctcccaggaagaaagacaaacccancaatgtaaaaagccaagcagatttcaccattttttagctaaatcctggttgtatacattc

SEQ ID NO: 33607 - DNA, 121 bp, Artificial Sequence
  Synthesized
  misc_feature (61): n=a or g
ttactgggaccacactctaccccattgtttagatcattcatacaaatggtttattccatgnatgctgctacctcctaagcattaacattaatgaatcattcactgacagaaaaggtgggaa

SEQ ID NO: 33608 - DNA, 121 bp, Artificial Sequence
  Synthesized
  misc_feature (61): n=a or g
ctcactgtatgaaacctcttttctctatcactttctcaatttgatctcaaaaatcattgcnctatctttaccacagaaagtactatccatcagcacttggatgttcccgcaaaaaggcctg

SEQ ID NO: 33609 - DNA, 121 bp, Artificial Sequence
  Synthesized
  misc_feature (61): n=a or g
caggcagaacccttcctccccatgtgcctgcatgctcagtgctggcttctcgaaagggacncttgctgcctcgcagaagcaaactgcagaacacagaagatagtgcagtgtaccaaagagc

SEQ ID NO: 33610 - DNA, 121 bp, Artificial Sequence
  Synthesized
  misc_feature (61): n=c or g
caaattacactaacggagcagtggaagtgaatatattaatatcttgtcttcccatatatantgaaaggaaaaagtttaggatcttcactaagctactacactactacaaataatgtataac

SEQ ID NO: 33611 - DNA, 121 bp, Artificial Sequence
  Synthesized
  misc_feature (61): n=a or t
attgtgtacatgcaggtgcgtttgcaaaacagggtccagctctaaggatggcatgtacacncatcaaagagataaacctgtggaggttacagctaggaaattctgccacaaccacagatag

SEQ ID NO: 33612 - DNA, 121 bp, Artificial Sequence
  Synthesized
  misc_feature (61): n=t or g
ttataccaggggtacacagtctcccagtacaaagcctggagcactcacaaacacagcttgngcacagcccaggtgcaatgtagtgcacagcaggctggcagtgggaaatccggggaaggta

SEQ ID NO: 33613 - DNA, 121 bp, Artificial Sequence
  Synthesized
  misc_feature (61): n=a or c
atcacccacctgcactaaagtgagaggcatcattaattccctccaaggcagagaggctttncagagagatgatgacaaactgtagggttggataatcaccggccgcatggagttcaacaag

SEQ ID NO: 33614 - DNA, 121 bp, Artificial Sequence
  Synthesized
  misc_feature (61): n=t or c
caaagccattagtcagcagcctgtagaggaagttacaaaggtgggcctagattttcatctncatctcttatcactgctttaaatagaaggatatgtgtagcccccagccatagattcggtt

SEQ ID NO: 33615 - DNA, 121 bp, Artificial Sequence
  Synthesized
  misc_feature (61): n=a or c
atctctggtttcccattaatgaagcagcagaaatcatattacagagtagactgatggtatnaaaacaaacatgcatacaaaatttctagtcttgtttgttaaagagtttattctcaaagag

SEQ ID NO: 33616 - DNA, 121 bp, Artificial Sequence
  Synthesized
  misc_feature (61): n=c or g
cttaactgtgaaacaaggcttaaaaataatttggggatttctgaccttgcagtggaatatnccaagttctcacagctagacaacaatcagataccaaagcactaacccttaaataactact

SEQ ID NO: 33617 - DNA, 121 bp, Artificial Sequence
  Synthesized
  misc_feature (61): n=t or c
aacaggaaggtctgagccgggagggaaacacgttctgctatccctaccggtccacccatgncaccagacagcagggctggagccagccttctaccactttttactgcttctggacagagag

SEQ ID NO: 33618 - DNA, 121 bp, Artificial Sequence
  Synthesized
  misc_feature (61): n=a or g
tctcctgtagttacagggccaagaggggcctgctccctaacaacctctgaattaaagcaanaaaagccaacattttctccccactctacacttactccttttctgaagggatttaaatcac

SEQ ID NO: 33619 - DNA, 121 bp, Artificial Sequence
  Synthesized
  misc_feature (61): n=c or g
gagaaaataggtgagcgtgtccccgtagtgagcaggggacatggctagattgcaaaataangttgtgttttgccttggatgacttttcatcttttttcagctagatgagttgcttgcttag

SEQ ID NO: 33620 - DNA, 121 bp, Artificial Sequence
  Synthesized
  misc_feature (61): n=t or c
gattttttcccatcctttaatacttagattgctcatctgctgcattctcctgagcttcccncctagtgacatttagaagaacacaggtctgtgggttgctttcctgggatgctgtacttca

SEQ ID NO: 33621 - DNA, 121 bp, Artificial Sequence
  Synthesized
  misc_feature (61): n=t or c
gaagtaaagaaattaaattcatgctgaaaagtattttctccccccctttaaagatttctangagcattaagtatcagagtaaggtggtaaaataaccaaaacagtaaatgagcatgcacaa

SEQ ID NO: 33622 - DNA, 121 bp, Artificial Sequence
  Synthesized
  misc_feature (61): n=a or g
ggtgggccccaggcatgggacagggtgaatgggctgacccaaaggtatgaaaagggacctnagagcaggactgggagcacagctactggcacctccatcccatccctgggactgacaggag

SEQ ID NO: 33623 - DNA, 121 bp, Artificial Sequence
  Synthesized
  misc_feature (61): n=a or g
ggtctgctttttttaagatcaacactagtgagtgtaatgcagatggatgccttttgtgtanctactgaataatctgatttttatagaagaaatttgtgaaagagttttgctaacagaaatc

SEQ ID NO: 33624 - DNA, 121 bp, Artificial Sequence
  Synthesized
  misc_feature (61): n=a or g
cacgcaggtcagcactgctgacagcagcggtgttccaaccagaatccagctcaagctctgngagtacaaggtggaaacccagatgtccgaatgtatctgagggtccgatttcccacacagc

SEQ ID NO: 33625 - DNA, 121 bp, Artificial Sequence
  Synthesized
  misc_feature (61): n=a or g
acttattgaggaagaaattgaagaagatgaagaagagtttaaatatttacaacagaacacngtgttatttactatagatgggatttagcaatgattttggggaagactgctatgtcagata

SEQ ID NO: 33626 - DNA, 121 bp, Artificial Sequence
  Synthesized
  misc_feature (61): n=t or c
gcagctgttgctctttctttttcattctcttgtgtataaaagagatacttaagataaaagnccttgttaaaagactacctgatggtgttcgaaaatctcttttgaggtagggagtctacac

SEQ ID NO: 33627 - DNA, 121 bp, Artificial Sequence
  Synthesized
  misc_feature (61): n=t or c
gtggacaagagcaagcaattgtgtgatgtctgcaagctgcctgtagaatgcttcacttgtntcttcatcctgattgggtggtctgtaaagagatctctaccaggacatcagtctttttggc

SEQ ID NO: 33628 - DNA, 121 bp, Artificial Sequence
  Synthesized
  misc_feature (61): n=a or g
ttctgcttttaaagtctcctcctaactcagcagccttcactttggtgttgttggtacctcnttccataagctccaggtacatcacacaagattttcagctttctctccctacgttataatc

SEQ ID NO: 33629 - DNA, 121 bp, Artificial Sequence
  Synthesized
  misc_feature (61): n=t or c
aactgggaaatagaaacacaacaaaaatcgacgcgtttgcctgatgtaatggagattttanatgtcaaacccaatactattgattgtagtagcagagagcaatgtgttaacaaaggtaact

SEQ ID NO: 33630 - DNA, 121 bp, Artificial Sequence
  Synthesized
  misc_feature (61): n=a or g
aacaatatgatttttaaagctgcattttacttgtagaggcacagggagatgatttaaagcngctttcatgctgattactttagatgaaaatacagcctgttcaaagttagccaaacatgcc

SEQ ID NO: 33631 - DNA, 121 bp, Artificial Sequence
  Synthesized
  misc_feature (61): n=a or g
tttgctgagtgcagaagatccacatggctagaagctcaatgaaaactgtgaacagacaacntacagagacactgcagagaaagaaaacgacagcacaggtcagctgctgccagaacgctgc

SEQ ID NO: 33632 - DNA, 121 bp, Artificial Sequence
  Synthesized
  misc_feature (61): n=a or g
tttttctttaccatgccatctgctgttaagataaattgaatgtctgttgcttgtaattttnatttggagtggagttgatagtgaacttttctaccagcctaacttcatgtaatcctcatga

SEQ ID NO: 33633 - DNA, 121 bp, Artificial Sequence
  Synthesized
  misc_feature (61): n=a or c
ttaggaaaactacaaaggaatatgcaaattatgcacagtaagaattgtttacgttggtagncatgaggatagcccattggttagcagtgattagtacgtttgcctctctcttgtgccatgt

SEQ ID NO: 33634 - DNA, 121 bp, Artificial Sequence
  Synthesized
  misc_feature (61): n=c or g
accattatattcatcaccatattccttcctactgttgtcccagctatcaactaaaccctgnacaccataacctctctcattccataaaagtttgccatttatttctgagagtctaatcaat

SEQ ID NO: 33635 - DNA, 121 bp, Artificial Sequence
  Synthesized
  misc_feature (61): n=a or g
tgagtgcacctggaggactgtatagatctacattacacaagctaccgggacacgctttacnatgagataaacttgtaattcctaatgctgtaatgtctgcagtagggctactacatgttaa

SEQ ID NO: 33636 - DNA, 121 bp, Artificial Sequence
  Synthesized
  misc_feature (61): n=t or c
catgttgggactatgaactgaagcaaatcgctggaggagttttgaagatacgcagagcaantcagaagacagaaagaggaaagatctcctgccctactttccctttactttccctctcaga

SEQ ID NO: 33637 - DNA, 121 bp, Artificial Sequence
  Synthesized
  misc_feature (61): n=a or g
agatttggcaaggagtgccacgtggagtcagtgtaggaaatgtaaactgagggagaaagcnatctaacccaggtaatataaaggcaatgaaagtggtgttaacaaaagcataatgaccaca

SEQ ID NO: 33638 - DNA, 121 bp, Artificial Sequence
  Synthesized
  misc_feature (61): n=t or c
atcagcaacacaaaagttatatagcatacaccaggtagctacagcctaatcacagtcacangtttatccataattggcccaaagctccctaatgatagtccttattcttaatgcatagcaa

SEQ ID NO: 33639 - DNA, 121 bp, Artificial Sequence
  Synthesized
  misc_feature (61): n=a or g
ctctgtgctttcatttactgagtgccccatgaactaagtattttcagagaataacctgctnctcatcctagattatttccaagctcctttctttaactctgtcatgttaaatagtgttgag

SEQ ID NO: 33640 - DNA, 121 bp, Artificial Sequence
  Synthesized
  misc_feature (61): n=t or c
agaaaagcagaaaatggacatttgattaagttggtattgctaaaccagcaaatgagcgaancgatgaaatacggtcatgctggttttagtatttcagtgagaagcacagtctacaagctca

SEQ ID NO: 33641 - DNA, 121 bp, Artificial Sequence
  Synthesized
  misc_feature (61): n=a or t
tgtcttgaaccaaggactgccgtaatgttcctctcgctgtgccaagaactctccttcagancataaggactgtgagctgacgttttattactaagcatctatatgtgaggggtgcccaatt

SEQ ID NO: 33642 - DNA, 121 bp, Artificial Sequence
  Synthesized
  misc_feature (61): n=c or g
tctgtagaatgcaaggaactgttttacactcagagaataagaattctttttatgggtatancattacacattatgacctggtcctttgcagtcctaagtattttaatgttgtcagtgtatt

SEQ ID NO: 33643 - DNA, 121 bp, Artificial Sequence
  Synthesized
  misc_feature (61): n=t or c
acacactgtgagaaccatgaataaaacacaaccagtcacatcaagtacttcatgagctttntgctaacatttccctaaaaaagaaaagtgagtttggttctgtaattaaagtactcatgtc

SEQ ID NO: 33644 - DNA, 121 bp, Artificial Sequence
  Synthesized
  misc_feature (61): n=t or c
cagcctgctccaggattgctttcctaaatggctgtcacgcatccctgtccccagacgtccnctgcggagctccaggcacatcaagggcggtgtgggtgaggggcaaactggcatggcagca

SEQ ID NO: 33645 - DNA, 121 bp, Artificial Sequence
  Synthesized
  misc_feature (61): n=a or g
gcctgtcttgtatttgtcatagaaacaaaatttgctttccacaatgagtggagggtgctgnggaaattcaacagcaaacaacaaacagatttgatcagctgcaacaatgattggaatttta

SEQ ID NO: 33646 - DNA, 121 bp, Artificial Sequence
  Synthesized
  misc_feature (61): n=a or g
gcagaatcttgaacacaaaagtccccacatactgcaaaggaagccagtgcatttagcactncatatcctgtgtcatcactagaaactaagagtttttgagtaacactgaagaaaaactttt

SEQ ID NO: 33647 - DNA, 121 bp, Artificial Sequence
  Synthesized
  misc_feature (61): n=t or c
ggagttcctggcatatttacttaattataaatttcagttggtgtgtgcttacgtcagcaangaatctacatgattcaagtttcaaagagagctagcacctcctaagatacataaatcagcc

SEQ ID NO: 33648 - DNA, 121 bp, Artificial Sequence
  Synthesized
  misc_feature (61): n=c or g
agatcatgttacagcagatttttctattcagagggtttgttaatggttttgctattccttncatgggtcttgaaaaaaagcacacgctatgaatgtgatatctttggttttgatgccagag

SEQ ID NO: 33649 - DNA, 121 bp, Artificial Sequence
  Synthesized
  misc_feature (61): n=a or g
ggctgaaaaagacaaatccagatcctcgttaacattcctacatgagaaaatctgcagtccntaagcactttccagtgtattgaactaccccaagtcaagaaagctgcaataattcaagcag

SEQ ID NO: 33650 - DNA, 121 bp, Artificial Sequence
  Synthesized
  misc_feature (61): n=a or g
ttgacagaaatggggcagattctcacctgctcactcactctcaatagcactatgctatatngtctacatgattttgtaatttggcccacacattttttccctttaaacacaaatggaaaga

SEQ ID NO: 33651 - DNA, 121 bp, Artificial Sequence
  Synthesized
  misc_feature (61): n=a or g
tttcctgacttaatgttacagcaataactatctttccctgtcttccctcagggtttttccntaatggtcatcacataagtatgtttcacacagatggtttcacaaatattaatttcctttc

SEQ ID NO: 33652 - DNA, 121 bp, Artificial Sequence
  Synthesized
  misc_feature (61): n=t or c
ccagctgcagctcctcagccctcaagaagagtaatggtgtcggaggggtccttgtgctgcnctttaatatcaccttaaaatacagttgttagattgctaatctttaacagaatttatgcat

SEQ ID NO: 33653 - DNA, 121 bp, Artificial Sequence
  Synthesized
  misc_feature (61): n=a or g
ctctctgaaagtgcagccaccagcgctcgtcatttcccttcacctttatttacacagcccnaacttgtgcaacccgagctctgcacggcagtcctctcctatccctgcacccatccaggct

SEQ ID NO: 33654 - DNA, 121 bp, Artificial Sequence
  Synthesized
  misc_feature (61): n=t or g
ctgctccatcctcggtgccaactgagtgcagggactcaagggagggattatttctaagctngaagtgcctcttcctccacctcttgcattctgcttctattctggggatcagagcttccaa

SEQ ID NO: 33655 - DNA, 121 bp, Artificial Sequence
  Synthesized
  misc_feature (61): n=t or g
ttactggcttcctccgagttctggaagcataagatgcacacattcttattgctgtacattnttcagtttcaaagctatgaatttatttggtattacatgtaaaaaaatccttcagagaata

SEQ ID NO: 33656 - DNA, 121 bp, Artificial Sequence
  Synthesized
  misc_feature (61): n=t or c
atcaaagagatgtattggaaaaaaaacctccttggtggaagagctttatcagattagacantgcattcaagaatttccacacgatccccagaacctcattcagaacatcagcaaacataga

SEQ ID NO: 33657 - DNA, 121 bp, Artificial Sequence
  Synthesized
  misc_feature (61): n=a or t
agcatgtagcatgcacattatgtcagcttcaataataaatctaacctgctaatattttcancaccatacttggttctcacacacttttgaattactccaacactatttctaaacaaatcct

SEQ ID NO: 33658 - DNA, 121 bp, Artificial Sequence
  Synthesized
  misc_feature (61): n=t or c
ctgctttgtgtctgcagagataagctggtggcatgaaatctctcttctactgtaaaaatgnatcattttccattagcctaaatgagatgtgatggaaaatttcaagaggtttttaaggaga

SEQ ID NO: 33659 - DNA, 121 bp, Artificial Sequence
  Synthesized
  misc_feature (61): n=t or c
ctatagacagccagtgaccctgaaaggactgacatgtgatagcactgtgcaacagccgggntgggaggcactgcctacggctgtgtctttgctggggaaaggcagctcttcctgcagcctc

SEQ ID NO: 33660 - DNA, 121 bp, Artificial Sequence
  Synthesized
  misc_feature (61): n=a or g
gtatgcagggtatcctacagtcactgttaaacatttgcttccatattaactgaattgctanacttcttccctttccctctcgatttctgtaagtggatgctgttgggaacagaagtgtctg

SEQ ID NO: 33661 - DNA, 121 bp, Artificial Sequence
  Synthesized
  misc_feature (61): n=t or c
caccaccctcaagaagaatggaagcagaagtacaggtgtctgtctctcctcatcccatcantgggctatgggcactcttccatgaagcattttgggttctcctctgtttggcgtcccttct

SEQ ID NO: 33662 - DNA, 121 bp, Artificial Sequence
  Synthesized
  misc_feature (61): n=a or c
agccccaaggctgctctgctgagaacttcacgtttcttacagcagtggaggtttttaaagngctcagtctgttcacttcagggatcagatatcatgttgcagtgttatagcatttcccaca

SEQ ID NO: 33663 - DNA, 121 bp, Artificial Sequence
  Synthesized
  misc_feature (61): n=a or g
ataataggcctctgctgataaaatatcaaacacagagacccgactgagtcagatttttccntgttgatgtttaaatatttccatctgaactctgctttcattctgtgctgctcttccccac

SEQ ID NO: 33664 - DNA, 121 bp, Artificial Sequence
  Synthesized
  misc_feature (61): n=a or t
gaacaaagtttcataggtgaacatgtgaggaaaatttatccttgctcttaccctgaactcngttgtgtcagacagctatatttcaggacttactttaaaacaaacaaaacaccaaacaccc

SEQ ID NO: 33665 - DNA, 121 bp, Artificial Sequence
  Synthesized
  misc_feature (61): n=a or g
ggctcagctgatcacagagtttggcccccgagtggtactgctgggacaaatcagcacatcngggcttttagacacaggctgatttcttttagggctgctttgaagccccactggggagcta

SEQ ID NO: 33666 - DNA, 121 bp, Artificial Sequence
  Synthesized
  misc_feature (61): n=t or c
acataggtatcttccagcctcttactgttggtgacttttcccatcccaatgtttctctatnggtttgtctttgaatgctgagcagagccacaggttatagaatcacggagttgtgtgagtt

SEQ ID NO: 33667 - DNA, 121 bp, Artificial Sequence
  Synthesized
  misc_feature (61): n=a or g
ccaactacttgatattcaattttgagcatgtaacttatcaaagacgacagaagactctctncaagttgcctcacacaccatatgaataaatttccctggctttgcctagaaaatatcatac

SEQ ID NO: 33668 - DNA, 121 bp, Artificial Sequence
  Synthesized
  misc_feature (61): n=c or g
tgcagcattcctgctccaagtccagctagtagcaaatgctgatatgtcttagggatgtctnaggcctacaaatatctaggtgatacactgaagaagagtgttatatcatcatactgcagac

SEQ ID NO: 33669 - DNA, 121 bp, Artificial Sequence
  Synthesized
  misc_feature (61): n=a or g
ggtgattaatcctaacaaggttttggtggtgtagattatttgagtccagacacagaagatncctctgaagttcagggtcagtgttctctaccctgtctcctcagtccctgaggtggacagg

SEQ ID NO: 33670 - DNA, 121 bp, Artificial Sequence
  Synthesized
  misc_feature (61): n=a or g
acttcagcttgcataaattcactctactttcccttgttttcagcccaaagatgtacttcanacatacaataccaagcatttcctggaatttccaggacttgcaattaaaatcacagccttt

SEQ ID NO: 33671 - DNA, 121 bp, Artificial Sequence
  Synthesized
  misc_feature (61): n=a or g
cctgcttcaacgtccactatgtcactgaacccctcacctcaacatcttccctacgaagagngcatattaatactttgatgtattgctatcaaagcctctgatcacaaaacataaacattct

SEQ ID NO: 33672 - DNA, 121 bp, Artificial Sequence
  Synthesized
  misc_feature (61): n=a or g
ttggtaacaacaaatgtggcatgtagcactgcttccacttggctggctggtttcagtaggnctatcgctaatgtgggaggaggaggtggctcatggggtggcagaagaaggattaggggag

SEQ ID NO: 33673 - DNA, 121 bp, Artificial Sequence
  Synthesized
  misc_feature (61): n=a or g
tgcaactacttcccaaagctacatgtgtgtaaaatatacatatatgagacccaaaatttgntcatttatattagtaacatatttagatatgaaatatgtagaaatcttaaaattattggta

SEQ ID NO: 33674 - DNA, 121 bp, Artificial Sequence
  Synthesized
  misc_feature (61): n=t or c
gtgttgatgcagttatacactgcagttatacactgcagatatgaatctgatctgactttgnaagaacaatactactctgtgggaagcaaactttttatttctcttgtgactacaaacattg

SEQ ID NO: 33675 - DNA, 121 bp, Artificial Sequence
  Synthesized
  misc_feature (61): n=a or g
gagggcaagataaattagtagagtatgacagtatgtgtgtgcactagctacatcaactctnaagtcagtgaccttcccagtccagccagtgcacttcacagtgggagacagggacactgaa

SEQ ID NO: 33676 - DNA, 121 bp, Artificial Sequence
  Synthesized
  misc_feature (61): n=a or g
ggagatactgtctttctctggtgcatgttcttcagctgcttatagcaacagacatggtttntatcagttctcactgataaatatttggatgagctggagtgcaagaagagatgctgttgac

SEQ ID NO: 33677 - DNA, 121 bp, Artificial Sequence
  Synthesized
  misc_feature (61): n=a or g
tctgtctgtttatttagaggttcatttttactgtaacagtgtccatgctcggtggattatngcagtatctccagtcagcttctctgatggccagctctcccagagccctgagtgatgttga

SEQ ID NO: 33678 - DNA, 121 bp, Artificial Sequence
  Synthesized
  misc_feature (61): n=t or c
atatttcatgatacaatctgatctccttattgcttgtatatgcaataagctgaatttgtgnagtcattatttgtatgggggatcactgacacatatataaataccggagattactgtagga

SEQ ID NO: 33679 - DNA, 121 bp, Artificial Sequence
  Synthesized
  misc_feature (61): n=a or g
cgttatcccttaccctctgcttgcctgatgttcagtgattttcaggaagtctgataaaggncacaggaaagacaaaccttttttccactcttaaatttgttccgtcagaatcgacagatct

SEQ ID NO: 33680 - DNA, 121 bp, Artificial Sequence
  Synthesized
  misc_feature (61): n=t or c
aatcaggatgatttcttgaatcataagcaacctgcagccatagtagagaggccagcagaantgttaatccttttcccttgcctctataaggtcttccagtcctctcgcctactcattgtgt

SEQ ID NO: 33681 - DNA, 121 bp, Artificial Sequence
  Synthesized
  misc_feature (61): n=a or g
ggaatgtaatgtggaaactagacccaattgccagagtccgaggtcgtacatctccaggccntgaatcaatatcttggtcttctccagctgctgatgattacaaccatgatgtttataatcc

SEQ ID NO: 33682 - DNA, 121 bp, Artificial Sequence
  Synthesized
  misc_feature (61): n=a or g
aatggtattgtgattttgtaagacagtcttttgctaataatagagaagtgagtcaaaactnctttcagataggaatgcgaagtggaaagttttaatgctgtctgtaaaaaaccatggtatc

SEQ ID NO: 33683 - DNA, 121 bp, Artificial Sequence
  Synthesized
  misc_feature (61): n=t or c
ctacttcaggactcgaatccttgtaaaatgactcaagtgccaagcagctttatcaacctcngacttcataatctgagtgacactgaagctacacatcccatacactgtttatcacaaagtt

SEQ ID NO: 33684 - DNA, 121 bp, Artificial Sequence
  Synthesized
  misc_feature (61): n=a or g
atgctgcagacatcagccccacagccagccgtgtcaggacccaaatcccagtcacccacangaacaatcagacaccacagtgtcacattcatccaaaaggaatcactcccaagccccatct

SEQ ID NO: 33685 - DNA, 121 bp, Artificial Sequence
  Synthesized
  misc_feature (61): n=a or g
gcttgaggatctggggacaaattgtatgtatcaggtgtttgagtactgaagattgaatacnctgccttcttagcttgtgctagtatgaggtaaatgcttaatactaggtctctgaaaataa

SEQ ID NO: 33686 - DNA, 121 bp, Artificial Sequence
  Synthesized
  misc_feature (61): n=t or c
cttgtattcatagtcatcttcaagttcttgtttaatgtgagactgactttatactagttantgttccctcaggtccaaaggagcttgtcagttgtgtcatatgtaacaaggtatggagcag

SEQ ID NO: 33687 - DNA, 121 bp, Artificial Sequence
  Synthesized
  misc_feature (61): n=a or g
cttttggaccaaatccatcaagcaaaccacacagctgctgcatctttagcaccaaggtgcnttgcaaccatgggaaagaagaggcaggagcaaaacccacaggttttggcacaaaagaggg

SEQ ID NO: 33688 - DNA, 121 bp, Artificial Sequence
  Synthesized
  misc_feature (61): n=a or g
gaatccagtccaaattagaaagaacactgcccagtcagattagttccccctgaactcaagnaaagaaatatgaatttaaggcttcctaaactgcagaacacactaagttgatttacactca

SEQ ID NO: 33689 - DNA, 121 bp, Artificial Sequence
  Synthesized
  misc_feature (61): n=c or g
agaaacagggtaaaggagctggacctgatgagatgccaaacatacagctgccttctgaagnaggtctcagccattagagaactgcccttatatacaatctctatgataggttcccaatcta

SEQ ID NO: 33690 - DNA, 121 bp, Artificial Sequence
  Synthesized
  misc_feature (61): n=t or c
tggatgttgtcaggactggccatgttctgttattcatatcaggtattatcatagtttagcngtgctcaagtttgcaggattatggagccaggcagtggtgttcccatatttctagctgagt

SEQ ID NO: 33691 - DNA, 121 bp, Artificial Sequence
  Synthesized
  misc_feature (61): n=t or c
gagtcttgaaatattaatcttcctctccactgtaatgtaatcctgttttaccactgccctncacaattagagatgttacagcattcttgcttcctccctgcagcattccagcgtgttcccg

SEQ ID NO: 33692 - DNA, 121 bp, Artificial Sequence
  Synthesized
  misc_feature (61): n=a or t
tgtttgtacaacaaatcaatgcacagcactgcaaaatgtcctaacactactaaaatccaangaagctacatggcatctctccatttctgcatttatttgtatttcctgtcaagattaagag

SEQ ID NO: 33693 - DNA, 121 bp, Artificial Sequence
  Synthesized
  misc_feature (61): n=t or c
aatacaactgttcagagtggatagacacagtgcagttatgtatgacacgtacagagagctntggttatagtttttgagtagcacatagtgcacaacaagtagcacattgcttggtgtaaaa

SEQ ID NO: 33694 - DNA, 121 bp, Artificial Sequence
  Synthesized
  misc_feature (61): n=t or c
cttaatgagaacaacttactccaaacagaaagaaggtaaatctctggagtagaaaagctgntaaagaggacgttaacaaatttaagtaaatttgaggtttcaccttattttatatagagca

SEQ ID NO: 33695 - DNA, 121 bp, Artificial Sequence
  Synthesized
  misc_feature (61): n=t or c
atggaaggatgaggggtgtgattcagaaactgcaatgcaacaactgcattgttctccatcngataacttgtctcagtttttgtttttaacctgcatactagaactccagtctccacttgag

SEQ ID NO: 33696 - DNA, 121 bp, Artificial Sequence
  Synthesized
  misc_feature (61): n=t or c
cctttcatgaagactagcttgtttgtgaatactcagggaatatagcaaacatctccatccnacgcaatgttttaaacatctccgggtccctagagaaaatcactgctagaaacttttgcac

SEQ ID NO: 33697 - DNA, 121 bp, Artificial Sequence
  Synthesized
  misc_feature (61): n=a or g
agacatcattaaggcaaaaagcaaggtgcggatccctttggctcctttgatcaaacgcagnatacgtccaatacgagccaggcggatgactcggaagagagtgggggatacaaaatacttc

SEQ ID NO: 33698 - DNA, 121 bp, Artificial Sequence
  Synthesized
  misc_feature (61): n=a or g
aaaaatctgctttgaaaaagttatcacagcattagtgctggctctgcttctcctggatggnaagtacaagttattacacaacttcaaacagaaggtggagtatgtttttagttaaaacttc

SEQ ID NO: 33699 - DNA, 121 bp, Artificial Sequence
  Synthesized
  misc_feature (61): n=a or g
aaaaattaaatgctttttgatgatattctcagacctgtagaactgagaattatgcccactntgcaatacaagttaaaggcaagcatgaatgacaatgtgagatatatttaacaatgtcctc

SEQ ID NO: 33700 - DNA, 121 bp, Artificial Sequence
  Synthesized
  misc_feature (61): n=t or g
tatctgcagttccctggtgactttattatcaatagctaccgcatacgctaaattaactctncaggaaatgctgcttagcacagcaacagtgagttttgattaggtattaggttttttactg

SEQ ID NO: 33701 - DNA, 121 bp, Artificial Sequence
  Synthesized
  misc_feature (61): n=t or c
ctacaggggcctacctgaggtatttgccatgctcaatttgtatacctgtttttaaggaaangttgctaagcacctatataagaaaattgaaaaccaaaaccaagtgagattgtcctcctat

SEQ ID NO: 33702 - DNA, 121 bp, Artificial Sequence
  Synthesized
  misc_feature (61): n=t or c
ctgtacccaagcctgcctcatggctatgccttgctcctcaggcatgttctgaaagggaaanatgaaactgcctgtcatcacctcacaaaatcatgtcaaataaaatataggtacaaacacc

SEQ ID NO: 33703 - DNA, 121 bp, Artificial Sequence
  Synthesized
  misc_feature (61): n=t or c
gggaaaacacttgatgtttgtttttacatcctctctgttacattcaggccatcacagctangtgctacatagctatttagttcagaattccagctattaaatctcgttttatttttgaaag

SEQ ID NO: 33704 - DNA, 121 bp, Artificial Sequence
  Synthesized
  misc_feature (61): n=t or c
agcagcaaaccttcattcccccttcctcacctcaaaacctgaagttcagtgtcacgtcagngccttggaaaagcagggagggatttgtatccactcagatccgggctcagacagctgttgc

SEQ ID NO: 33705 - DNA, 121 bp, Artificial Sequence
  Synthesized
  misc_feature (61): n=t or c
tccaccagatccagctgagcgcttgctggtggcatgttggctggtgtgacacagaaaccanccaagggcaactggaggtgagagttctctgcaatctggaggacgctgttcttacggctga

SEQ ID NO: 33706 - DNA, 121 bp, Artificial Sequence
  Synthesized
  misc_feature (61): n=t or c
atgactcaagagaaagtggagatcttttctgaaggtcctacaagacatacactgtcatatntgaaatagtttaacagcactgaaatttaataatacaattaataattgtatgacaaaatgg

SEQ ID NO: 33707 - DNA, 121 bp, Artificial Sequence
  Synthesized
  misc_feature (61): n=t or c
agtcttttgtttcctggtaaaacatctgttcagtggaagttctgttactcaatgattacantgaatattcctgagcacgtgtttgctgtaaatctctgcaagcagcaaaaggaaaacaaag

SEQ ID NO: 33708 - DNA, 121 bp, Artificial Sequence
  Synthesized
  misc_feature (61): n=a or g
aacgcgagcggtgctccagaattgacagcgttccctggatttctttcaagttgaaatttgngttgttaaagcactgggagcttggatgcatgactagatttgggtatttaggaggaaacct

SEQ ID NO: 33709 - DNA, 121 bp, Artificial Sequence
  Synthesized
  misc_feature (61): n=a or g
taggcccttggcaaatgcactacaactgacaagagccacttctgccccaaaacatttctanaggcttgtggagattaggactggctccctgcctcacccaagaggactttcacccccttca

SEQ ID NO: 33710 - DNA, 121 bp, Artificial Sequence
  Synthesized
  misc_feature (61): n=t or c
cgatgaagacaccaggttaagctcttgcttctggctgagggccttagagcactctcaccangccctccactaaagcagcaagccttgtccgggcacaacaaactgtgcggggaaatagcag

SEQ ID NO: 33711 - DNA, 121 bp, Artificial Sequence
  Synthesized
  misc_feature (61): n=t or c
actcaaaatttgcaaatagttgtccttagctttaaaaatggtactcacccatgtacaaaanggaatcacaccacccattctcctggattatagacaaagttcacagattcatttcttcatt

SEQ ID NO: 33712 - DNA, 121 bp, Artificial Sequence
  Synthesized
  misc_feature (61): n=a or c
actctcagaacatgccatcatggaggaaaaaggagcaaacagcagcaatggttgtgctacntggactaatcccagaaaaccaaatactgctgtactggaaaagagggaaaaaaatccacaa

SEQ ID NO: 33713 - DNA, 121 bp, Artificial Sequence
  Synthesized
  misc_feature (61): n=t or c
ggcgtttggtcttctacccactccatattaaagagttaagaaacagaggggtgtcttattntgtagtacgtttgcaagcactgagacaccaatctggtttaacacaacagaaaatcagtct

SEQ ID NO: 33714 - DNA, 121 bp, Artificial Sequence
  Synthesized
  misc_feature (61): n=a or t
tttatgttctattgagtgtggaggacagtataagaaggaatctcactgccttcagctctanttttatcctgctgaacttgtcaaaaacaaaaaaggagagaagagacttgaatgtgcccct

SEQ ID NO: 33715 - DNA, 121 bp, Artificial Sequence
  Synthesized
  misc_feature (61): n=t or g
attacttcagcacttggttggctgaaaaacactgctcagcttgcacagtgttgaattaagngttaattggatgaatgaaaatgtgatgcatatgtacatttcacaatccaaatatactttg

SEQ ID NO: 33716 - DNA, 121 bp, Artificial Sequence
  Synthesized
  misc_feature (61): n=a or t
cttagtagaggagcagatcccattgttctggctttcctgcctcctttgcacaacttctgtngcctgcaggggaaacataaaataatcttggtgtggcagcttgtggaaagtaataggttag

SEQ ID NO: 33717 - DNA, 121 bp, Artificial Sequence
  Synthesized
  misc_feature (61): n=a or c
gcagaaccaacagtggctttcagaaatgaattcttcttacaaaatagtttcctcttatganaaaaagaaatgaaaatcaagggcagctcagcaggaaagctgaagtgaaaggcttggtgtc

SEQ ID NO: 33718 - DNA, 121 bp, Artificial Sequence
  Synthesized
  misc_feature (61): n=t or c
aaaaatgacaatttgtattagcaaagtagtaaggctgggcaataaagaatttgaaagttangagaaagatttcaagactcgcaatactacagtgtaggttaaaggaagaaacagcagatta

SEQ ID NO: 33719 - DNA, 121 bp, Artificial Sequence
  Synthesized
  misc_feature (61): n=a or g
cctgcacatacctgcctgcctaattttaaagtgccataactatttcctagacagatgttcngggtgtaatccctgtggcttcacaagagaatttcctaacagccaacatctcacaccccta

SEQ ID NO: 33720 - DNA, 121 bp, Artificial Sequence
  Synthesized
  misc_feature (61): n=t or c
agcaccttgtttataagaggaaaaggctgcagtgcaaacagcctctgaaacttcttcctantgagattttgcatcaattcctgttgcctgttcacatctgcagtatggaacaaaccccagg

SEQ ID NO: 33721 - DNA, 121 bp, Artificial Sequence
  Synthesized
  misc_feature (61): n=c or g
tgttattactagccaatggcttaggattaaaacattttgacattgaaactagccatgaagnaagagcattctgtcctagctattttcttgatagaacactttaaagatctaagcagcagtg

SEQ ID NO: 33722 - DNA, 121 bp, Artificial Sequence
  Synthesized
  misc_feature (61): n=c or g
aagtgataagtatcaataaaggtaagcttcttgtactgacatacagtgtaaataatgcttncatgggtaagttaagcttgaactttattttgaaagtgaacacttcaggaacatgacagag

SEQ ID NO: 33723 - DNA, 121 bp, Artificial Sequence
  Synthesized
  misc_feature (61): n=t or c
tgactctccattgaaagcagtgataaatcctggccatccagcataatccagtccaccgtancgggaaatctcatgggagctggcagcactgagagcagcaaggtcttttcatgctacagtt

SEQ ID NO: 33724 - DNA, 121 bp, Artificial Sequence
  Synthesized
  misc_feature (61): n=a or t
ccaccatttatcgttaaaaaagtgcatcaggggttcatattcaaagaggcaaatagagtanttcagtccaaaaagcagtttcaattggaaaatgctaacttcatcgacacagctggtttag

SEQ ID NO: 33725 - DNA, 121 bp, Artificial Sequence
  Synthesized
  misc_feature (61): n=c or g
gcttaactgctgtcatagtcagtgtttaagcagaagaatcttttctcctataaagaattangtactcctatggctagtaaaaaatagaggcatttgtacagcttcaaacaaataagcaatt

SEQ ID NO: 33726 - DNA, 121 bp, Artificial Sequence
  Synthesized
  misc_feature (61): n=a or g
gcagcatcagaagtcactccaactctggtctatgtgtgaagcacatacaaacagggagacngtggatactgatttctgtctcactgggccataaactttgttaatttcgtctgacgttgca

SEQ ID NO: 33727 - DNA, 121 bp, Artificial Sequence
  Synthesized
  misc_feature (61): n=t or c
tggcgttttaaaggccggtgaattgctttcctttgcaggagaaaggggtataactaattcnctgttagtgtttcccataatggagggatctgcttccctgcccataaaaacaacagcctca

SEQ ID NO: 33728 - DNA, 121 bp, Artificial Sequence
  Synthesized
  misc_feature (61): n=a or c
ctcatgcctgctttgtcttgtgagcagacaaaaaatgaacagcagaacacaagtcatgtcncttttctggtgccatctgaatagagattgttctagtggtgcatgcttcttgcttaggaat

SEQ ID NO: 33729 - DNA, 121 bp, Artificial Sequence
  Synthesized
  misc_feature (61): n=t or c
atctttcacatgaagctaatgtcatggtcctcactacttttgttcaggtttctaggtttanagtgtccgtaacagtggctaagacttttcagaaggatgtctctgttaattgtatgttatg

SEQ ID NO: 33730 - DNA, 121 bp, Artificial Sequence
  Synthesized
  misc_feature (61): n=a or g
ttctgtttagatgtacatacggagaggaaaataaacattttaggccttggttaaataggcntattggaggtagttatggttggtgtgcctcatccactgaacttagagataaatgtgtgta

SEQ ID NO: 33731 - DNA, 121 bp, Artificial Sequence
  Synthesized
  misc_feature (61): n=t or c
gtacttttacactaagaaaacccctagctagagattccatataaggactccattattacancttttctactctcttcctcatctgtagaataacaaataaacacagagaagagaaactgac

SEQ ID NO: 33732 - DNA, 121 bp, Artificial Sequence
  Synthesized
  misc_feature (61): n=a or g
atactagaaaatacctttggcccattttgtgttttggagtatgcctgggtaccatctggancagatccagtgggttcaagccataacagggatagggagtatgtcaagcgatacatattct

SEQ ID NO: 33733 - DNA, 121 bp, Artificial Sequence
  Synthesized
  misc_feature (61): n=t or g
gatggggttaattcagcaaaagaatcctctgactgtgatgtaaattccttggcttgttcanaagttgtagaaaaaattcaatggactgctccttgggctagaaggctgtgggctgggaggt

SEQ ID NO: 33734 - DNA, 121 bp, Artificial Sequence
  Synthesized
  misc_feature (61): n=t or c
ttgagagctgcgtgctgtggcagcgattcctcacagctccggattcagcttcttccattgngtccacatattctttctgctttcttgctgctcaacagccgctattcatccgagttcctat

SEQ ID NO: 33735 - DNA, 121 bp, Artificial Sequence
  Synthesized
  misc_feature (61): n=t or c
tattaaatacagtctcgatgataaaataggtccctttggagtgtagttacaaactttaacnccgaagatctgttgttagaggctagaatggtttaaattactgcttcctctcgttcaaggt

SEQ ID NO: 33736 - DNA, 121 bp, Artificial Sequence
  Synthesized
  misc_feature (61): n=a or g
attcatttttgacatcgactgtttaaaaattcagctgtacttttctagttcaaggcaaatncccaggcaagtagagtagcagaaacacaaaggaaaaatacagaagtcaaggatggcattt

SEQ ID NO: 33737 - DNA, 121 bp, Artificial Sequence
  Synthesized
  misc_feature (61): n=a or g
aactccctctttcccagaaagaaatgtagaaggcttcagaaatgtatgggagtacatatcnaagacattcatcacccacaaggctagatctgcctttgggcatgatattcataatctgttc

SEQ ID NO: 33738 - DNA, 121 bp, Artificial Sequence
  Synthesized
  misc_feature (61): n=a or g
cacgcacgcccttgtattcagagctaggttctatatcgaggtgctggcactcttgcacacntacattccattgctgcatgctataaatatatatatgacaagatgtcagcaggtcagatcc

SEQ ID NO: 33739 - DNA, 121 bp, Artificial Sequence
  Synthesized
  misc_feature (61): n=t or c
tgtatagtataattcatattttagggataagaccctgataacgcagatgtgatgtcacttntgttatacttgtagatatttttaatgcctttcattactcagtgttggatggtcgggatat

SEQ ID NO: 33740 - DNA, 121 bp, Artificial Sequence
  Synthesized
  misc_feature (61): n=c or g
taccggtattcaatgtaagctttaaagtagttagtatcataaatacacagtaacatcattngttatcgcaacttctaaagaagttcataactaactatgagttggtaatcagtcttagaaa

SEQ ID NO: 33741 - DNA, 121 bp, Artificial Sequence
  Synthesized
  misc_feature (61): n=t or c
ctttcctttgggagaaaaaagcacagggtagctttcctggcccttcagaagagctgtcttncaacccttagcttatgtgaatattccctaaagcagaaatgcagacaagtaggtaaacctc

SEQ ID NO: 33742 - DNA, 121 bp, Artificial Sequence
  Synthesized
  misc_feature (61): n=t or g
actgtagatctgcaagcggaacggttctgataaagccctccaaaagggatttgagctaaangagaaataattgttttaccacctatgatatatcacacagtttaagtctcccatcaaaaac

SEQ ID NO: 33743 - DNA, 121 bp, Artificial Sequence
  Synthesized
  misc_feature (61): n=a or g
tatctcctgagttctacaagctgggtgtgcccacaacagcagcacacactttgataagccntactatatacaaagagctaaaccctgtctaaacagccataagtcactctagaagaaatgg

SEQ ID NO: 33744 - DNA, 121 bp, Artificial Sequence
  Synthesized
  misc_feature (61): n=a or g
gggtgcttgtgggagaacaacaggaacatagggaaaattctggaagaaaaggtataatgtntatggaggaagggaaaagcatgtttcctttaatgtaagtgttagtgatgatgatgcttac

SEQ ID NO: 33745 - DNA, 121 bp, Artificial Sequence
  Synthesized
  misc_feature (61): n=c or g
tcaaagtgaaagtcatctagggtcatggattcataacaggcttagtctccagaagtcatantgtctcagttttaaactactgtaggcatatgacaaattaaaccacttttgtttgtagagt

SEQ ID NO: 33746 - DNA, 121 bp, Artificial Sequence
  Synthesized
  misc_feature (61): n=a or c
tttgttctggctgctgtacatcaagattgtctcagctcccagtggctcctgctgagctcantggggatgtctcaagttcctgtggagtgcaacagagcactgagctcatcaggggtgtttc

SEQ ID NO: 33747 - DNA, 121 bp, Artificial Sequence
  Synthesized
  misc_feature (61): n=a or g
aacaagtaaatatagctattacagactaataattgaagattttattcagagcacaactatnccacattaaacatgattctcatggactgaagtgcttagtaccaaactttttgtttcttcc

SEQ ID NO: 33748 - DNA, 121 bp, Artificial Sequence
  Synthesized
  misc_feature (61): n=t or c
gcctactctgaaactagaactttagcgctgtaaagactggcttacaggttctgtgtaattncttaaataggtatcctgacatatttgaaggatagggggtttcttttcatttaggttggag

SEQ ID NO: 33749 - DNA, 121 bp, Artificial Sequence
  Synthesized
  misc_feature (61): n=a or g
ccactttgaagagtaacacgagaggaaagggaaatgtgtttagtaccattttaaaatcttntgagaacttctccaaacaagtgtatacaagtaaaagaatccatctgagactgccctcata

SEQ ID NO: 33750 - DNA, 121 bp, Artificial Sequence
  Synthesized
  misc_feature (61): n=t or c
cagaagttttttagcatctattacagcttggtataatctcaaatgctgtccatcactagcnacaaagcaggcacttggagaattacagtatgcacctgaaaaatatgaatgcataaactgc

SEQ ID NO: 33751 - DNA, 121 bp, Artificial Sequence
  Synthesized
  misc_feature (61): n=c or g
aagagctgctattcctgaacagtacatccaggctcacggcccttccagcaattagagctanacaagaaaaaccctctaaactaaccagtcactgcagaacagctccagcagtctctccccg

SEQ ID NO: 33752 - DNA, 121 bp, Artificial Sequence
  Synthesized
  misc_feature (61): n=t or c
gctacatgctcaactcaaagttttgccctgttgtttcagaccttttgttcagaaataccanactgtgtatgtgcatattcttaatagtcacagaaaatctagtgctaggattgcatcttct

SEQ ID NO: 33753 - DNA, 121 bp, Artificial Sequence
  Synthesized
  misc_feature (61): n=t or g
ataggttgctctgaaagtagtatctcttaggatgacggataacagatagaggcaacagaanagcaaagcagctatggccataaaatcctttctttttttaacaaatctgtcatttacttgt

SEQ ID NO: 33754 - DNA, 121 bp, Artificial Sequence
  Synthesized
  misc_feature (61): n=a or t
agttgaaatccagacctggtggtggttgaagagctggccacttggaccacctttgtacttnctttttcaagcagaaatatctattactagagaaaagtcttctgtatttcactacaatcag

SEQ ID NO: 33755 - DNA, 121 bp, Artificial Sequence
  Synthesized
  misc_feature (61): n=t or c
ttttctttttccttttattcatacactcagatctcaagctttctggcgcagagaagcatgnacacattttatatgtggcttttactttgatatgctattgcttgatagctaattcaatgtt

SEQ ID NO: 33756 - DNA, 121 bp, Artificial Sequence
  Synthesized
  misc_feature (61): n=c or g
cacactgctgcaaagcagactcactgtagagttactggtcgtcacatggattgtctctcgntgtacacaaaatgtctgttttgtagctcaagtttcaaagaagatgaacattttttactgg

SEQ ID NO: 33757 - DNA, 121 bp, Artificial Sequence
  Synthesized
  misc_feature (61): n=a or t
tagtcatggtgcttcttagtgcatgctggccactggaattcatacaggtctgtgtacaagngtgtgttcattatcctaattgcctgtctgcatttagcttattttcagaagactttaaagg

SEQ ID NO: 33758 - DNA, 121 bp, Artificial Sequence
  Synthesized
  misc_feature (61): n=a or g
aggcactgagctggcctggagggtttccttgaaggaaattggcaaaacttcttgggagtantgtttcccaaggctgatcctctgttggttatcacaaagagttcaggacccatggagaaca

SEQ ID NO: 33759 - DNA, 121 bp, Artificial Sequence
  Synthesized
  misc_feature (61): n=a or g
ttgaaagcctcattttacaccaatcctgatgggagttttccaggtccaggtccaggtaggnacaactcctgtgctgctctatgaaatccagaactgttgggctcttaagttcttcagatgt

SEQ ID NO: 33760 - DNA, 121 bp, Artificial Sequence
  Synthesized
  misc_feature (61): n=t or c
agaaggctctagggaaacccgttagcagcctttcaagtgtctaaaggatgtctataagaanaaagaggaacagactttttagcagcagctgttgtgataggacaaggggaaatggtttcaa

SEQ ID NO: 33761 - DNA, 121 bp, Artificial Sequence
  Synthesized
  misc_feature (61): n=a or g
gtggcatcctatgaagacaagaggtggtggtgaaaagtgttggacttgttgaatatgtatnccctactcttttacagtcctgatcatgttggagtctaattgtgagggctcgtgttaatgt

SEQ ID NO: 33762 - DNA, 121 bp, Artificial Sequence
  Synthesized
  misc_feature (61): n=a or g
aggagctagatcttgaatgctaaaaacctttgctaggtatctccatagtctcagttttccnttgctcgaggtcacttgttcttgagtccaactattcatgggtttccctgaaagctgcaga

SEQ ID NO: 33763 - DNA, 121 bp, Artificial Sequence
  Synthesized
  misc_feature (61): n=t or c
ttcactggagcccttgtagccttcagtgggttgattggtcaccgagttctttgtctctcanttaccccagtctgccttcattctgagtatgaaggtgaagctgagatacgggtcgtccagc

SEQ ID NO: 33764 - DNA, 121 bp, Artificial Sequence
  Synthesized
  misc_feature (61): n=a or g
tctgcagggagctgagcagatccaccctctttgtctcatatctctatattcctcttcattntcctactgtgccatttactctgttggtttgtgcaataccagctcctcctttccacttctg

SEQ ID NO: 33765 - DNA, 121 bp, Artificial Sequence
  Synthesized
  misc_feature (61): n=a or g
acaagcagggaactatgtacagagctgaatatgtgtaggaaactatggtggcaaaattggnatatcacggagtctgcactaggcggatcctaccagtgttcaagcagtaccagaaagaaca

SEQ ID NO: 33766 - DNA, 121 bp, Artificial Sequence
  Synthesized
  misc_feature (61): n=a or g
cctcagctcagacctcagtgcacctgtttgttttttaaaccataggcagaattagattgangctgcccagaaacacagcacctctgccttcacatccactttcactgtttcttgcaattct

SEQ ID NO: 33767 - DNA, 121 bp, Artificial Sequence
  Synthesized
  misc_feature (61): n=a or g
aacagcgacggagctggtgttgacctcatcttgagacagaacaactagacaagatctcacnaggtttctatcagctgactttttttctactgatctgcacttgtaagtgaaatgtagtgtc

SEQ ID NO: 33768 - DNA, 121 bp, Artificial Sequence
  Synthesized
  misc_feature (61): n=t or c
ctatttttcccatggtcccaatttggccaatgctctgttttagtaagcaatacggaaacangatctgatgaagaaagtaataattgccaacagcctcagctgcagatttgatttgcaaatg

SEQ ID NO: 33769 - DNA, 121 bp, Artificial Sequence
  Synthesized
  misc_feature (61): n=t or c
ttccctgaaaacaccattttaacaagggaagagaggacaggcttatacgatgaaaacaggngctttatgtaacaaaccaatatctcagcaaaaatgcttctaaaaaccacatgcaaggaga

SEQ ID NO: 33770 - DNA, 121 bp, Artificial Sequence
  Synthesized
  misc_feature (61): n=t or c
ggggtataagcagggcatgattataataccataatgaactacttcctgcatgtgtatcccntaccttatactagagggaattagaatgacctcagctatatgtcataggcagctagcagtg

SEQ ID NO: 33771 - DNA, 121 bp, Artificial Sequence
  Synthesized
  misc_feature (61): n=a or g
ggctgtgctgacttacagcaagcagttcctggcttttcacaggtactcactgtgcagcgcntttcagctgcaatatgcctagatacaaaagtcccagctatgagaacacctgccataaggc

SEQ ID NO: 33772 - DNA, 121 bp, Artificial Sequence
  Synthesized
  misc_feature (61): n=t or g
agtgaacttataaatgggaaatgttgaacacagttaccttcttttggttgcaaacccattntcagagatccatcaaaaccttttcaagtgtgtttctgtatgttttaacgaggctttctaa

SEQ ID NO: 33773 - DNA, 121 bp, Artificial Sequence
  Synthesized
  misc_feature (61): n=a or g
ctatggaatacaaataaagagctaattagaggttaaaaagacagcacaaggaccgtaagcngcacacatgctctgcgagtatttttattacacctacactgaattcttattacaattccta

SEQ ID NO: 33774 - DNA, 121 bp, Artificial Sequence
  Synthesized
  misc_feature (61): n=a or g
ggtgggagcaggctgctggtccctggaatggtggtgagaaatggctgtctgtgccagcagnaaagcaagtgagcagatcagcataatttgcagcccaaaggctgtaggctggataggaagc

SEQ ID NO: 33775 - DNA, 121 bp, Artificial Sequence
  Synthesized
  misc_feature (61): n=a or g
atgacctcacatcatgtacaactggttacatccccatgcacccatggatggggcagatggnacttgtcctgtgtttacatccaagatagcttcaaagtattccccaggagaaaccacagga

SEQ ID NO: 33776 - DNA, 121 bp, Artificial Sequence
  Synthesized
  misc_feature (61): n=a or g
aagggcatacctgttttatttttcagctggattatcccatctgttcacaaagcagcaccanacagggctgggaacaaggtgcagaagcaggactggctcaaaatctagctgcttccatcct

SEQ ID NO: 33777 - DNA, 121 bp, Artificial Sequence
  Synthesized
  misc_feature (61): n=t or c
acaccccttcatacaaatgtagcagcagagggaccttgcagcctcctggccatgtaacagngatggagcccagggcattatggacagccctgtgcagccattgcatttccctgatgcagcc

SEQ ID NO: 33778 - DNA, 121 bp, Artificial Sequence
  Synthesized
  misc_feature (61): n=a or g
gaggtcccataacagtgccactcagcaacgggatggaactgtgtgagctgagatcactgcntcacactgagatgtaatttgatctcttggaaccttacgtatgaatatcttaatttctaat

SEQ ID NO: 33779 - DNA, 121 bp, Artificial Sequence
  Synthesized
  misc_feature (61): n=a or g
cagactcagagaaagcttcttcagaaatatttacagcatacacttcagtatctatagccanaggaagctctgttttgatttaaaagacaagggaatgtttgcaccctgattcaacctccgt

SEQ ID NO: 33780 - DNA, 121 bp, Artificial Sequence
  Synthesized
  misc_feature (61): n=t or c
tgctgtaggccaaaacagaaaacactttgtaaaattcagataagtgtgtatataaacactnctgttccagctatatttatactgtgcttgtggataacattggagaaaggtgtaggctggc

SEQ ID NO: 33781 - DNA, 121 bp, Artificial Sequence
  Synthesized
  misc_feature (61): n=a or t
gacagaggcttaaccaataagaaaaactgaagattcaggaaaaatgcacattttgagagantggctgaacatcacaggtcagacagctgagaagccacttgcaatatgatctcaaatatcc

SEQ ID NO: 33782 - DNA, 121 bp, Artificial Sequence
  Synthesized
  misc_feature (61): n=a or t
tcggaatgggctgaactctgcaggatctgaacaggagaggaaaaagccatattccttcccnaagcgatgaggccatttcaggtctctcctgagccccacagaaaggctggttggctcacac

SEQ ID NO: 33783 - DNA, 121 bp, Artificial Sequence
  Synthesized
  misc_feature (61): n=a or g
tgctaagtggattgaaacgtcaggcccacggttggggtaagcctggcagaatttgtgtttnactactttgcaagtacattagattagcaattatcctgttcctggttttaaattctatttt

SEQ ID NO: 33784 - DNA, 121 bp, Artificial Sequence
  Synthesized
  misc_feature (61): n=a or t
catggtgatggcttagctctgctcccagcttccaaatggcactgagcaagttgaacttacntctcgtattttaataatacgagtttaccgtcagatctgctgaagtgccacagagacgttg

SEQ ID NO: 33785 - DNA, 121 bp, Artificial Sequence
  Synthesized
  misc_feature (61): n=t or c
acgaggggagtactgttgatgtgaatgtgaatgccaaatgttatgcagcttgctttcagtntcttctgcacgccaggtaactgaccgcctgcaaagtaaatacgcaagagaatcccaaatc

SEQ ID NO: 33786 - DNA, 121 bp, Artificial Sequence
  Synthesized
  misc_feature (61): n=a or g
tgatttgctgccaaacacctgcaaatacatgcatgaaaatccctgccctcatacaggcctntggcataagaaacagttaagcaatttctaaagtctgaactgactttcaggagaggataca

SEQ ID NO: 33787 - DNA, 121 bp, Artificial Sequence
  Synthesized
  misc_feature (61): n=a or g
gttgttttgcaccgtcctgtggcattgcaaagcatgagacaaactggcaccctagcaggantggagagcacagcttttccagactgactccgttcattcccagaaggttcttccagctacg

SEQ ID NO: 33788 - DNA, 121 bp, Artificial Sequence
  Synthesized
  misc_feature (61): n=t or c
gaactaagtaccagatggctgggaggaaaggtacttcccagagacactcctctggtgtcanggatcagatgtgttctgaactcagaatgttttcttctaaaagttttttctagaggtagac

SEQ ID NO: 33789 - DNA, 121 bp, Artificial Sequence
  Synthesized
  misc_feature (61): n=a or g
tttgtttaataacgctgacagctcttacggagcagaattggagagacctaaatattaatanagtcattcaagtggagcaaaagttacaaatcattagctgaagaaagttggcttccagccc

SEQ ID NO: 33790 - DNA, 121 bp, Artificial Sequence
  Synthesized
  misc_feature (61): n=t or g
actgcctcatcatggtattgtaacagaataagcttcagcatagctgccagaggatgagctncattgtgccacaaaaagtcacagaaatgatgcacttaccataatcctactgcatgctaag

SEQ ID NO: 33791 - DNA, 121 bp, Artificial Sequence
  Synthesized
  misc_feature (61): n=a or c
ctcactgtaactctgtttccggactcaacattcctgctttgattctctgtgtcctctcagntgtataaatggaaaagatctccatccttatcctaccaacacaggcgtcatgccctccctt

SEQ ID NO: 33792 - DNA, 121 bp, Artificial Sequence
  Synthesized
  misc_feature (61): n=a or c
ctctaatccaaattcgccaatctcattttgtctgttgctttcttaaagattttcacagttnctgtaaatatggacctttgcaatacttaaaacctggaggaaaaaaaaaaggggacaatag

SEQ ID NO: 33793 - DNA, 121 bp, Artificial Sequence
  Synthesized
  misc_feature (61): n=a or g
ctctgggatatttacctgtatagatcttcaacaggatgttttatcagggaattacggtacnttttaatattttcaaaactagcacgttaagttaaaagcaataaaattatgtactattcct

SEQ ID NO: 33794 - DNA, 121 bp, Artificial Sequence
  Synthesized
  misc_feature (61): n=t or c
gcctcagtctctcataatcttcatttcataaacatgcctcatttttgaccaattccataanaaacattacatgtttcagcctctgagctcacaagtatacctgtcacttcccacgtacata

SEQ ID NO: 33795 - DNA, 121 bp, Artificial Sequence
  Synthesized
  misc_feature (61): n=t or c
gtggaatgagggctgcctcggggtctttttcacacagcatctactgaaagctgagtcatangcatttgtttgcttacatttaaactaaccatagtggatttaaaagccacatgtaaggaca

SEQ ID NO: 33796 - DNA, 121 bp, Artificial Sequence
  Synthesized
  misc_feature (61): n=t or c
gatttgtgatgcagctagcccctctacagaacatgaagtatgttttagataattaatgaangttttagtattagatattggttttactaggaacagcctgctgatgttggtaactatgttt

SEQ ID NO: 33797 - DNA, 121 bp, Artificial Sequence
  Synthesized
  misc_feature (61): n=t or c
aaactgagcatgtgctgtgttacagtagccagtacatgatagagaatgatttctggagttnaagaagtgattttgtttccctttgattttccaagtgattgtagctaggtatgtctcatgc

SEQ ID NO: 33798 - DNA, 121 bp, Artificial Sequence
  Synthesized
  misc_feature (61): n=c or g
agggggtgaaaaggctgcaaatctttaatctaaaagcattcccctgctttcatttgagcanctatgtaagtgtgaaagtgtatgatgtctttaatgttttcagataagcagataaatacaa

SEQ ID NO: 33799 - DNA, 121 bp, Artificial Sequence
  Synthesized
  misc_feature (61): n=a or g
cgaaatctcaccatttaacatattgtcccacttcatattgctggtgtaagctgctgcctcnccattttttgcatacccctgtactaatactaggaatagctgaaatcctgcaactagtcta

SEQ ID NO: 33800 - DNA, 121 bp, Artificial Sequence
  Synthesized
  misc_feature (61): n=t or c
acggagtttttttgtagtaagcaaaaaattcttattgcagctgcaatttctttgccaaggngcacattacattcaaggggcatgtgctgatagttttgattataggtcttccttttgatga

SEQ ID NO: 33801 - DNA, 121 bp, Artificial Sequence
  Synthesized
  misc_feature (61): n=t or g
actaggaaaggaagggagaacttttaatactccttcacatttttgcagaaccaggtttctncctttctgcttgcagctctgtgagaccaaggcctctacagtgttggcagaccctgctcaa

SEQ ID NO: 33802 - DNA, 121 bp, Artificial Sequence
  Synthesized
  misc_feature (61): n=a or g
gaatgtattttgcttcattctatgcttgtaactaaatgaagtgaaactaaaaaaaggaacnaaaataaaaaatacgaccatgtaacagaatgagtggagtggaggagttagaggtgctctt

SEQ ID NO: 33803 - DNA, 121 bp, Artificial Sequence
  Synthesized
  misc_feature (61): n=t or c
atggacttgactttcagacataggaaacatccttctgggtcacagctgggaccacaaagtntgtcactccgtctctctgctcagagctagagattatagaagtgctttcagtttgtgtatg

SEQ ID NO: 33804 - DNA, 121 bp, Artificial Sequence
  Synthesized
  misc_feature (61): n=a or g
tgggttgtcccttggctctctgcgatagctgcaatctgctgctcactccctgttccacacntgggtgtgaagagctgcttaaggacagcttcctgggagcaggaatgtgcggcacatgatc

SEQ ID NO: 33805 - DNA, 121 bp, Artificial Sequence
  Synthesized
  misc_feature (61): n=a or t
acatttcgtgaggtgccacatgcccatggggtcatgaatcactctgctctggtgcaggacnggtccaaaagctttggatgttcatctccaaggagatgcctggatttttgcaaaagtttgg

SEQ ID NO: 33806 - DNA, 121 bp, Artificial Sequence
  Synthesized
  misc_feature (61): n=a or g
tattctctcctggctattctatatactcagagcaccaagtcaggaaggtgccacaattacntcaagatgtttcatcatgacaattccaaattacattaatgctaaaaagcagctataactg

SEQ ID NO: 33807 - DNA, 121 bp, Artificial Sequence
  Synthesized
  misc_feature (61): n=a or g
acatttcagactacttttattactcgtattctccacttaaatgcaaaactttacccttgangttaatattctcctttatcagaaagaaccaacgacaaggaatatcttttaaaaatactct

SEQ ID NO: 33808 - DNA, 121 bp, Artificial Sequence
  Synthesized
  misc_feature (61): n=t or c
aaatgctcttccttaaaacctttgtctgtggagagaaggaatgctgaagctgaagaacttnccggcttgtgtggcagctactgtgcaaaagagggcaaaaacatctgggtggtttgtcaag

SEQ ID NO: 33809 - DNA, 121 bp, Artificial Sequence
  Synthesized
  misc_feature (61): n=t or c
aacatgcttcttctgtcattacttcatttatagcttttataaaaaactgcaatcacgttgntcattttggacttttgaaatacttaatactgacagtcctcaatcaccgcatgttggttca

SEQ ID NO: 33810 - DNA, 121 bp, Artificial Sequence
  Synthesized
  misc_feature (61): n=t or c
ccagcttgatgctacacttgtttctaggctgcctttctctcattcaacagtttgaagtcanagcacagacttctctgatagttaacagaaagcttcccatgtagacacaccaggcaaaagc

SEQ ID NO: 33811 - DNA, 121 bp, Artificial Sequence
  Synthesized
  misc_feature (61): n=c or g
tagctggtatagaaaaggcctttctaaacaagattgatgaagtcaaacagccagtaacaantaagacactgcccacaggtagaaaatactgaatgtgaagacacaataaatatacttaacc

SEQ ID NO: 33812 - DNA, 121 bp, Artificial Sequence
  Synthesized
  misc_feature (61): n=a or g
tctcagaaaactttcagaaagatttcatagcagttcagcagaactttgctgaacattagcncttgcacaagcagaggtgaagcgagtggctaagagacacacagctggcaggtgtttgatc

SEQ ID NO: 33813 - DNA, 121 bp, Artificial Sequence
  Synthesized
  misc_feature (61): n=a or t
atttttttttttttttttctgttagaaattaaaatatcttaaaaagccttcccaagctgtnccaagtcctttatctcacaaaaatgaatgatgtgggaagagaatattgccctccagaaaa

SEQ ID NO: 33814 - DNA, 121 bp, Artificial Sequence
  Synthesized
  misc_feature (61): n=a or g
tgttttccagctttctgcttctctataatgttgtgtattcacagaactttgcctgaagtcntaaaccagggcacggttgtgaaaatgtatgcaggtagaaacactgctttgctagagataa

SEQ ID NO: 33815 - DNA, 121 bp, Artificial Sequence
  Synthesized
  misc_feature (61): n=c or g
tcagtgattttaccatggcaacagtacaagtctgtggtagagccagaaactgaccctaatnacccccaagctcaaaagacgtctttttccctcaagccttccatctctcctcaggaactgg

SEQ ID NO: 33816 - DNA, 121 bp, Artificial Sequence
  Synthesized
  misc_feature (61): n=t or c
gttctggagctgctgagcagcactgggaggaaggtcttcagtcacatctcaggcaacaccntgagtttctctctcaacatggggatgctgctgcccagcaaggccaagatctctaacccag

SEQ ID NO: 33817 - DNA, 121 bp, Artificial Sequence
  Synthesized
  misc_feature (61): n=t or c
ttttttgtttaacatgaacaaattctgagaaatgaccgagtaggaaatgccgtctttgccnatgtgaacaaccagatacacacctgattctcatctccaggactgcaatagggagccatgg

SEQ ID NO: 33818 - DNA, 121 bp, Artificial Sequence
  Synthesized
  misc_feature (61): n=t or c
taggtggaggggggaagggtttcaaaatgggattggttacaaccattgccacttgttgcgntagcccctggcacgtgagtgtgtgtaagtatcaaaaatctctgtagaattcctttgctga

SEQ ID NO: 33819 - DNA, 121 bp, Artificial Sequence
  Synthesized
  misc_feature (61): n=t or c
acagagcttccaaattctctgcctgtgaatgattacctaagatgctctttttaataatttntgtttgtccttttgaaaactaactattcctggctagagaacttactgcatgcacaattat

SEQ ID NO: 33820 - DNA, 121 bp, Artificial Sequence
  Synthesized
  misc_feature (61): n=a or g
tttgtaggtaggatacctaactaacatgagcattcagagcccagtggcaatgagctccacnctgaaaaacaccttaagaataaatagaccaggtggataaatggataatcaacgttacagt

SEQ ID NO: 33821 - DNA, 121 bp, Artificial Sequence
  Synthesized
  misc_feature (61): n=a or g
ccaaattcagctaatctttgcaaaggaatgaaaacaataaccagctggcattgggatgagncaaaagtgcctttaccagttttctaacaagtaaagagatccaacgtgagcttacacaata

SEQ ID NO: 33822 - DNA, 121 bp, Artificial Sequence
  Synthesized
  misc_feature (61): n=a or g
cgtagcatggatgtaggctgatagggccacagggatgtagttctgaaggggtggaggatgngtgcacgtttatgggggtgcgtgattatgggtttcaggataggtgcagggctagagtgat

SEQ ID NO: 33823 - DNA, 121 bp, Artificial Sequence
  Synthesized
  misc_feature (61): n=a or g
ggaggagctaagatttttctaggcaccccagcatctatggaggaataaatcaaatcacacnttcaaagccatctgacttaatttgtcatcagctgttttaatactgacattaaaacaacga

SEQ ID NO: 33824 - DNA, 121 bp, Artificial Sequence
  Synthesized
  misc_feature (61): n=t or g
tagtaaagtcaatagaattatgcttgctgttttcttgcctagcagagcatcaacaaccatntgtatgttaacacgaatttcttctcttgcaggttgttggtcttcttctgcccaaccagac

SEQ ID NO: 33825 - DNA, 121 bp, Artificial Sequence
  Synthesized
  misc_feature (61): n=a or g
gacagcctgaacagctctgtgagcctccccacagggtcacatctcttaccttcaaaggtcnaagactgtgagaagaggaaaagctccctcaggcaaacatagcagatactagctgaaagtc

SEQ ID NO: 33826 - DNA, 121 bp, Artificial Sequence
  Synthesized
  misc_feature (61): n=a or g
ttgtgacatggcctattggatttctcccctgaccagttgtgcatgagccaatgagtcaggnctagcaagagtccatgaagttaacacaacttttttctccaccagggcgaccagaatgtga

SEQ ID NO: 33827 - DNA, 121 bp, Artificial Sequence
  Synthesized
  misc_feature (61): n=c or g
gagcatttctgatgtagacagacaagagcagaggggccagtacagcaaatattgggttcancaggttccttgttgcaattatgtgctatggattcctcaactggaagaaaatatcattctt

SEQ ID NO: 33828 - DNA, 121 bp, Artificial Sequence
  Synthesized
  misc_feature (61): n=c or g
aaccaaaccctaattttacagttcatttgcagctgcaaggctagaggagtttggacagatntcacggtaggaaaggagcaaagtatttgaattatggggcatcagaacttgagatgctggt

SEQ ID NO: 33829 - DNA, 121 bp, Artificial Sequence
  Synthesized
  misc_feature (61): n=t or c
atcctacgtaccaaaacaaggctggatttagttagtccaggataacctgtactaagctaangttgtagatcatggaaatgaacaccttaaaaatagggacctctgtaaatcctgcaatacc

SEQ ID NO: 33830 - DNA, 121 bp, Artificial Sequence
  Synthesized
  misc_feature (61): n=c or g
ctaacactggtatgcaacctgtctccatggggtcctttgggaccactgctgttggaaaatnacaacgtacaaggtctcctgtgactacatgcacaccacagattgaccaaggggcacttta

SEQ ID NO: 33831 - DNA, 121 bp, Artificial Sequence
  Synthesized
  misc_feature (61): n=a or c
agagacataaacttgtgttaccctttggtaaaagccttaaaaactaagtaatatgtaatantgatgcaatatgtctttttccagctacagcacttctatttgttgtaatgttcttcagtgt

SEQ ID NO: 33832 - DNA, 121 bp, Artificial Sequence
  Synthesized
  misc_feature (61): n=t or g
ctgatactgatcactgtggcatgcttgctttaggacaagtagcaacaaaacgctttcaaantctgtcagaattgcatattctgacaaaaagtaaaccaaaaacaggcctcacatactatag

SEQ ID NO: 33833 - DNA, 121 bp, Artificial Sequence
  Synthesized
  misc_feature (61): n=a or g
taaaaattgaagcatgtgaatattacgtgagttactaaagcaaaaagcttaccttctatanaatgaacttgtttatatcattccagctgcctgattttcctctgggattctcaaaacagaa

SEQ ID NO: 33834 - DNA, 121 bp, Artificial Sequence
  Synthesized
  misc_feature (61): n=a or g
ccagaagatgctgctgatgcagagagcactatttaccaaatgactcactgtgcctctaatnctgtgataagaagagatgctgcttttttctttcctaggagaaacgatctgatagttttta

SEQ ID NO: 33835 - DNA, 121 bp, Artificial Sequence
  Synthesized
  misc_feature (61): n=t or c
tgagaccttcttcagaatgttctctgatgggagaggaaggcagccaagaaataagaagtgngctctgagagaagaccagctccacttgacctcctcactgagtgcctgagaatgacatgaa

SEQ ID NO: 33836 - DNA, 121 bp, Artificial Sequence
  Synthesized
  misc_feature (61): n=a or g
gtttcatttgtttttctttcacctgggaaggaattagaacacaatcccaaagttgtataangtctaacatggtcacagtgttactttttaaacctatttggacactccaacaatgctttat

SEQ ID NO: 33837 - DNA, 121 bp, Artificial Sequence
  Synthesized
  misc_feature (61): n=a or c
atcagtttctctttcggcctgtcacgactgcatccccttctctagacaataagatttcganggtgggactgtttttttttagattcaaattagtcatgaaatctttcaaaggcattcaggc

SEQ ID NO: 33838 - DNA, 121 bp, Artificial Sequence
  Synthesized
  misc_feature (61): n=a or g
cttctgtctgaatccctttttcatcctggataagcatgtaacactttctgtggtaaatgtnctatatggtgccatgagtcattaatcagtttgtgactgcagcagagctgcctttcagaat

SEQ ID NO: 33839 - DNA, 121 bp, Artificial Sequence
  Synthesized
  misc_feature (61): n=c or g
gtcgttctgaccgaacctgagttaaaaccaaagaaaaccccatcctccgttttacatgaangaaaatacgcgttctgacggcagctcgacgtaacccgccacctggtgcccccagcagctc

SEQ ID NO: 33840 - DNA, 121 bp, Artificial Sequence
  Synthesized
  misc_feature (61): n=t or g
tgcaacttatttaatttttggttgccatctgtggagtagacaggagtaaagatactgtttngggcatatcattttaggtatgatttgatggtaagggccactagccattatttgtatgcca

SEQ ID NO: 33841 - DNA, 121 bp, Artificial Sequence
  Synthesized
  misc_feature (61): n=t or c
gcaaatgcacatttagcaagaatcacagcattaatcacttaaactagaacaggaacttctnggtagtcagaaagaggatagtgtgccagtggtcaaaaccaactaatcaaggaacatgtgc

SEQ ID NO: 33842 - DNA, 121 bp, Artificial Sequence
  Synthesized
  misc_feature (61): n=t or g
tcctcagaacttaagaggtacttgtaaacactggagaaaataaaatatatagctctctagnggaagatacttaagtctttttaacagacatttgaaacatttcacctctagaagtatcttt

SEQ ID NO: 33843 - DNA, 121 bp, Artificial Sequence
  Synthesized
  misc_feature (61): n=t or c
aacaaggagctgcaagaggagctggaataagaagcacatcatttgcagggcccttctattntgtggtctgtgctctcgtgctgcttcaatagctgaggctgctgacaaggtctctgtcctt

SEQ ID NO: 33844 - DNA, 121 bp, Artificial Sequence
  Synthesized
  misc_feature (61): n=a or t
gtgcagcacattccccctttccatctgaagttacttatgcagcgctggttactgcacaaancagagcagaacgttccctctgccaacacacaacctttgcaagagcaataggaatgaatag

SEQ ID NO: 33845 - DNA, 121 bp, Artificial Sequence
  Synthesized
  misc_feature (61): n=t or g
gtctctggtaatgttcacactgtaattctgcttacaggtctaccatccatagcttcatatnaggactttctaaagtctcagcaaggcttttgattacatttttgttgtcttttcactcttt

SEQ ID NO: 33846 - DNA, 121 bp, Artificial Sequence
  Synthesized
  misc_feature (61): n=a or g
ggagaaactttttgtaccaaaagtattctgtaactgtcaatagcatctacagcaaagagcntgactttcagccatcgagtgactccaagctagaaagagagctcaggctcactctgtttgt

SEQ ID NO: 33847 - DNA, 121 bp, Artificial Sequence
  Synthesized
  misc_feature (61): n=a or g
tatgctctcatatgtaatgtattcttcactagcaaaggtttccaggctgatatctcttctntaagttgcaaagatttaaaactgttctagaatggttattttgtcatttgaatagctatat

SEQ ID NO: 33848 - DNA, 121 bp, Artificial Sequence
  Synthesized
  misc_feature (61): n=a or g
gtgattaacataaatatagcataaatattaatagaaacaaacaccaaggcataatattctntgctatatagcctgaggaaatgaaatgtttaactggcttagtttctgcaatttaaatatt

SEQ ID NO: 33849 - DNA, 121 bp, Artificial Sequence
  Synthesized
  misc_feature (61): n=a or c
ataacacagcaacaaaatattcccatttctttttcagggtgtcactgtttatacacatagnaacttaaattaacaggcaatgttttataaggatgcctttctaaaaacactccaagagctt

SEQ ID NO: 33850 - DNA, 121 bp, Artificial Sequence
  Synthesized
  misc_feature (61): n=a or g
tttattgttgttgctgttgtttttataaaggtacacagcacttaggcactacagttacacnaacagtaacagtgcctaactgtttttccttgcaagggaagggcctctaattacagttttg

SEQ ID NO: 33851 - DNA, 121 bp, Artificial Sequence
  Synthesized
  misc_feature (61): n=t or c
atctaataactgtctgtaagacatgttagaagaacaacgtaatgagtaagcacaaagctcnaagtgctgaagttagaaaaaccaatgagaaaaaagcaaaactaagactgatatgtttatg

SEQ ID NO: 33852 - DNA, 121 bp, Artificial Sequence
  Synthesized
  misc_feature (61): n=a or t
agacatttgagtggcttttataaagtcacactggaaaagcagaatcctctttataacatgnagtgtgaaggtatcagatgtaaaatgaaaatgcaatctagcaggtgggtcaaaatattcc

SEQ ID NO: 33853 - DNA, 121 bp, Artificial Sequence
  Synthesized
  misc_feature (61): n=a or c
aatttacaatgcctggtggtgggcttttgtagtttcactgcttccatatatctgtctcagngtaaggaattgtatgtatgctgtattttataaaaattgaacatattcaacaactataaat

SEQ ID NO: 33854 - DNA, 121 bp, Artificial Sequence
  Synthesized
  misc_feature (61): n=t or c
tttttcaaaattctgcagtcattcagggatgatgttccaaatcattaggggtgcccactgntttaagtacctgcccataccatcccatgttccccagcattcaactatccagcctcaggac

SEQ ID NO: 33855 - DNA, 121 bp, Artificial Sequence
  Synthesized
  misc_feature (61): n=a or g
gttttgatgctaaaagagccctcactccatctccaacaacaggtcacacttagggtggtangtgaccttgccggctgataaagctggatttgtttaggtgtattctgctcaactcaaaagg

SEQ ID NO: 33856 - DNA, 121 bp, Artificial Sequence
  Synthesized
  misc_feature (61): n=t or c
aatgtatataaatgcattccacttaggtttaatagcatagtgaggaatggtcattagggcngatgtgtttgtctacaagatactctaggtttaatgttcttctttattcacatatttgtgg

SEQ ID NO: 33857 - DNA, 121 bp, Artificial Sequence
  Synthesized
  misc_feature (61): n=a or g
agctcacataaagtctaaagtaagtttaattcaaattttaaccttcatagaatggatcacngcagctgtagacaacctttgtcttggtatctctaggaagggagaaggaaagcacttaact

SEQ ID NO: 33858 - DNA, 121 bp, Artificial Sequence
  Synthesized
  misc_feature (61): n=t or c
cttcataggtgaggtgcttcaggatgatgtggtttatttataaatagattatagcacaganagagaattatggaatgactagcaaaatagaaaagtagaaagacgaggaaatggacagaaa

SEQ ID NO: 33859 - DNA, 121 bp, Artificial Sequence
  Synthesized
  misc_feature (61): n=t or c
ggtcataacttctgaactgctgaccgggagctgctaagtgatggcatgtggccacttcttngctgtaagctccctaatttgagacgttccagccggccaggtggcagggagctgggactgc

SEQ ID NO: 33860 - DNA, 121 bp, Artificial Sequence
  Synthesized
  misc_feature (61): n=t or c
gtcgtgtgaaatgacgcctattgggttgatgggaagaagccacctgagctgctttgctgtngcagcacggatcccattggcatcgggagatggcatatgtgtgtctgcagtgctctgtgtg

SEQ ID NO: 33861 - DNA, 121 bp, Artificial Sequence
  Synthesized
  misc_feature (61): n=a or g
caaaggatgggttgtggttggaaagtgctctgcagccattcttatattggctgagtaaccnacagggcttcaccagacagaatcccatccctagttcaatgctgacatgaactcagggtcc

SEQ ID NO: 33862 - DNA, 121 bp, Artificial Sequence
  Synthesized
  misc_feature (61): n=c or g
ggacacaagctttttccttgaaaaaaaatcagaaagctcaagaaaatcccctgatacttgntaggggaaattagtaataatcatcatcatcatcataatcatcattatcatagtgaaactt

SEQ ID NO: 33863 - DNA, 121 bp, Artificial Sequence
  Synthesized
  misc_feature (61): n=a or g
ttcattaatattaagctagccatggaatttctggaatgctatgtggctttcctccctctcntgtacaatacactctgtggataggcaacatggctatgaacttcacctcttctttgttttt

SEQ ID NO: 33864 - DNA, 121 bp, Artificial Sequence
  Synthesized
  misc_feature (61): n=a or g
agcaagtttagttgggtttgaacatgtgtatggatggagactcttaaaataatcttttccngtatttaatagtgcttgtaggtacgtagatatgtattgaatgtttaaatggaattgccat

SEQ ID NO: 33865 - DNA, 121 bp, Artificial Sequence
  Synthesized
  misc_feature (61): n=t or c
ttccaatgatacaacttgcatggacacatacataaaatctaatgcacataaatcatcccanagccaaaacctgattcttcactcagtttgttcagttcctcttcaggcaaagttttctttt

SEQ ID NO: 33866 - DNA, 121 bp, Artificial Sequence
  Synthesized
  misc_feature (61): n=a or g
tccattaacatcactgtgatgaatggcagactctccaaatgcagcagaccaaagtgcttcngcagacatcccagtccttgccccacagcaaacccctccaactagcggctcccagccccat

SEQ ID NO: 33867 - DNA, 121 bp, Artificial Sequence
  Synthesized
  misc_feature (61): n=t or c
cagctgggagatgtgcatgccctatgtacagctacatccaaatgagatgcagatggatgcnacagcatgggtgagtgtctatagcctgctttaagaaaagtgtaggatgtagattcaagcc

SEQ ID NO: 33868 - DNA, 121 bp, Artificial Sequence
  Synthesized
  misc_feature (61): n=t or c
caaaataaagcagaaagtactaacaagacagctaaatatcctaatctttgataggacagcngacagctatccaagcttatcagatgtgtgtccatgtttggaaagaaaaataaagcattaa

SEQ ID NO: 33869 - DNA, 121 bp, Artificial Sequence
  Synthesized
  misc_feature (61): n=t or c
cagaattatgtgtgacctgtaggatttttaaatcacgtgtatccattttatctaagtgttncatagatgaatttgttttcagaatgtctttaaaagatgagctggtgttatttttatgtta

SEQ ID NO: 33870 - DNA, 121 bp, Artificial Sequence
  Synthesized
  misc_feature (61): n=a or g
aggcaaggtagttttatggaagaggttattaccttgtgctacaattcttgatcaagggagnaagagatagtaaagtatttttgatatacaagttgatgatacaaaaagatactaagtaatg

SEQ ID NO: 33871 - DNA, 121 bp, Artificial Sequence
  Synthesized
  misc_feature (61): n=t or c
ctctgcacagggcagccctgtgagacttccagagtgttagcgatagtatgctgtggcatgnggccctgaattaagttagccctttgcagctctggctcttcctgcttgtctgctctgtttc

SEQ ID NO: 33872 - DNA, 121 bp, Artificial Sequence
  Synthesized
  misc_feature (61): n=t or c
ttctactgtgatcaaaggctgagggaggccatgaatggacagtatgcctcacagacagcangccacatacactggaatctttttaatgcaggttgcaagataaacaaggtttgcacccaga

SEQ ID NO: 33873 - DNA, 121 bp, Artificial Sequence
  Synthesized
  misc_feature (61): n=t or c
aataactttttcactccatttattagtttattctccaaggtaaactctgaaaatgtaaaantgtgcagacgtcataagcactgacatacagctaagtttagatttcaattatttttgccca

SEQ ID NO: 33874 - DNA, 121 bp, Artificial Sequence
  Synthesized
  misc_feature (61): n=t or c
ttttttgtgctggcatggggcaggaagaagatgtgaactcaacagcttctgatacagtggntcccaagacatgaagtactctgccctgggggccaacaagaaagcatggtaaattttcaag

SEQ ID NO: 33875 - DNA, 121 bp, Artificial Sequence
  Synthesized
  misc_feature (61): n=t or c
tggctgggtccactgacaaggcccagcaagtaagcttaaaaatcaggtggtggtaaaatanaaccattacgtagacacaaactgttaatgaggtgttctgtgactggtgaaaggctggaga

SEQ ID NO: 33876 - DNA, 121 bp, Artificial Sequence
  Synthesized
  misc_feature (61): n=a or g
agaaactggtctgaattggtttttccaggcaattctttgccctggattaacctgatcccancccaagctgcagcagagaccctcacagagtttgataacatttatcattaagtcctgaatc

SEQ ID NO: 33877 - DNA, 121 bp, Artificial Sequence
  Synthesized
  misc_feature (61): n=t or c
aacttgagtgcccaacacacccaacttgtgtgcttgtggcatctcaaacttcttatctccntcacatccaggataattgaagtagcaaaatccagtagcagataccttccataagatcata

SEQ ID NO: 33878 - DNA, 121 bp, Artificial Sequence
  Synthesized
  misc_feature (61): n=a or t
ggtaggctttttttaaaagaaagaaaccttagagctgtcccagataccttttctgaagagnggtagaggccatgttgtaagttcctcttggaccagtcttctctaagtgaagcaggagttg

SEQ ID NO: 33879 - DNA, 121 bp, Artificial Sequence
  Synthesized
  misc_feature (61): n=a or t
tgagtagagtgcagaaatagcttaggccaaggtggcagaaccttttcactcatccctgctngtctgtttcagctctgtcccatataaattaaatgggaggatttgggccctgtgtgtgcct

SEQ ID NO: 33880 - DNA, 121 bp, Artificial Sequence
  Synthesized
  misc_feature (61): n=a or g
tgtactgtcatttataccaggctgttcaggtttggtgcccactttgcactggtacctatcncccaactttctatgctgtaaagaattaaatcaaaagccctgtctggatgccaacagcact

SEQ ID NO: 33881 - DNA, 121 bp, Artificial Sequence
  Synthesized
  misc_feature (61): n=a or g
tcttcagagaagtagaaagaggatgaaagagaactgtattaattcagcttttacagctgcntcagttttgtggaagcattgattgttatctatcaggatcaatttatttagctttgtaggt

SEQ ID NO: 33882 - DNA, 121 bp, Artificial Sequence
  Synthesized
  misc_feature (61): n=c or g
tactgcttgtagctgtcaacatgggaagctgccagtcaccttctcccttcctaggatggangtgatacctcccctcagaagggatttggtctccatggggctatggctgatagtatgggat

SEQ ID NO: 33883 - DNA, 121 bp, Artificial Sequence
  Synthesized
  misc_feature (61): n=t or c
gtggctgcaaaaatgtgtgcgaacttttctgaaattcccagggagaagaacaatttgggtngagaagtgatgagtgcagagctctagatgctggtgccatcagcctacgtgaactagcttg

SEQ ID NO: 33884 - DNA, 121 bp, Artificial Sequence
  Synthesized
  misc_feature (61): n=a or g
tctgactcatcttttttactccccatattttatatgctggtgtacaggcacttaagagggncacccaaacattttgagtccctggaaagtgtttttgataatttctccataatgttgcctt

SEQ ID NO: 33885 - DNA, 121 bp, Artificial Sequence
  Synthesized
  misc_feature (61): n=t or g
tgatatgcattaaaatgccttagtgtttcctggattttcagttcatcaaatatatcagaancttaatgtgtcacatatatccttcagtttctgcagcaaaaaagtggttttgatattgctg

SEQ ID NO: 33886 - DNA, 121 bp, Artificial Sequence
  Synthesized
  misc_feature (61): n=t or c
cttccaatatccagtctaaaaagagaagctttctgaagctaagggcaagaatacaggactnagacaaaaggaacttgaaagataacctaactaggtttgaagagctgatgaccacaaaggt

SEQ ID NO: 33887 - DNA, 121 bp, Artificial Sequence
  Synthesized
  misc_feature (61): n=t or c
caacacgttcaccacaacagcacaaagcacacaccaacaaagggaagaagcaatcctgctnccacatctcagcctctcccttttgtcagagcaccagcatttagacagtcaagcacaaggc

SEQ ID NO: 33888 - DNA, 121 bp, Artificial Sequence
  Synthesized
  misc_feature (61): n=t or c
gttccacttacagacacatgaggctcttatgccaagcctgggcaagagccttataccttgnttcatacagttcacattgagccactgacctgcagcatcaggcagttaatccaccccaaac

SEQ ID NO: 33889 - DNA, 121 bp, Artificial Sequence
  Synthesized
  misc_feature (61): n=t or c
aaccaaattatgcagtactaggagtgaaaacacttgataggttgagatcttctgagaatanatgcagaagatcagatatctagattttgtttgattccaagatactgaggaagtgcagaag

SEQ ID NO: 33890 - DNA, 121 bp, Artificial Sequence
  Synthesized
  misc_feature (61): n=a or g
ctttcaaattaagttcatctcaagcttctggtctcactcccgtgtaattatacacagagangtttcagtttagggactgaaggaatgagttaagggtgtaaacatttatgcaaacaacttc

SEQ ID NO: 33891 - DNA, 121 bp, Artificial Sequence
  Synthesized
  misc_feature (61): n=t or c
atttgatgaggaaaaatgttatactgtagaaaattcacagtataatgtgaatgctactganatgcaactgccatgtatggtgtacttctgtactcctggacctgcaaggcttccttcagtg

SEQ ID NO: 33892 - DNA, 121 bp, Artificial Sequence
  Synthesized
  misc_feature (61): n=a or c
aactcctgggagtgcagacagcactaaaacaagcctctccagactgatgagacatctaganaaatgtccgcaaaagggcacattagcagaagacttcttctaaagggaagcaaacatctca

SEQ ID NO: 33893 - DNA, 121 bp, Artificial Sequence
  Synthesized
  misc_feature (61): n=t or g
gaactgtaatggttctttattgaatatagatgttaatagcagtgctagaagggcctaattntaactgcaagaaatatcagctcatctgaatctttgattaggtggatggcaaaaaacgggc

SEQ ID NO: 33894 - DNA, 121 bp, Artificial Sequence
  Synthesized
  misc_feature (61): n=a or g
agtcaccaagagtttaacaagccttctctgctcttctcagtgaaaggaaataagtgaaganataaaatttttattgctcgtattattcatccttttctctagcatagtgattaccacgtgc

SEQ ID NO: 33895 - DNA, 121 bp, Artificial Sequence
  Synthesized
  misc_feature (61): n=a or g
tgttgttcacagatggcagtgttgtatcataactccttcaagcctctcttttaagccttcnttttggagtgatgatgaaacatacaaacacttgaaatcatcttaactagtttttgaatac

SEQ ID NO: 33896 - DNA, 121 bp, Artificial Sequence
  Synthesized
  misc_feature (61): n=a or g
tggtgaccgaagatgcagttggtgttgagcttggtccagcgtcacaaggaatttcatgccnttcacaacagtttaccctgatttcataattatagcaaagatgccagatacttgcatcttg

SEQ ID NO: 33897 - DNA, 121 bp, Artificial Sequence
  Synthesized
  misc_feature (61): n=t or c
atttttgatggtttctgaacttcataggatcatagcattgccacagttggacttttccagntcctctagtggaggacttttccacatggaaatagtaggaggaaaaaaaaaaaaaggggaa

SEQ ID NO: 33898 - DNA, 121 bp, Artificial Sequence
  Synthesized
  misc_feature (61): n=t or c
ttcaaacttgacaaaagttggttgatgtcagtgaatatgcaaatactcaactacaatcttnctactgaattctgtgtattctgcctcacttccttggggtgaaacactgcccctgtgagta

SEQ ID NO: 33899 - DNA, 121 bp, Artificial Sequence
  Synthesized
  misc_feature (61): n=t or c
ttatcaagacaaactgccttgcctcctgcagatgcctaagtgaaataatatgatcaactcntcccttcgcagacatccatctcctttagtaatttctttcacagaaacagtccaccctacc

SEQ ID NO: 33900 - DNA, 121 bp, Artificial Sequence
  Synthesized
  misc_feature (61): n=t or c
aggggcttcatcctgttgttttctcaaaaactaagagcctcttcactcccactcatgaaancactagaaattcattgttcacgttgtactgctaaaagttatttgtcatataaactctcac

SEQ ID NO: 33901 - DNA, 121 bp, Artificial Sequence
  Synthesized
  misc_feature (61): n=a or g
tcaaaatgagagaaagtgttactaaagtttcaggagcttcttgtgccagaaaatatatgcntgcctcattttatgaagtgatagtaattcaggccctgatttaggttcattaatatctttg

SEQ ID NO: 33902 - DNA, 121 bp, Artificial Sequence
  Synthesized
  misc_feature (61): n=t or c
atacacatggtttagatttgcaggatgaacagtatgattttaacattgtcccttttttatngtgtcagaagcataaatttcacgaattcagtgagttgtgcctcagaagctacaagccttt

SEQ ID NO: 33903 - DNA, 121 bp, Artificial Sequence
  Synthesized
  misc_feature (61): n=t or c
ggaacaaacaggaatgcttccactgtgaagaaattctttatgaaagagacactgaagcagnggtgtcaggtggggaagccatatctagtgtttgtcatagcttctgtagaaaggctggctg

SEQ ID NO: 33904 - DNA, 121 bp, Artificial Sequence
  Synthesized
  misc_feature (61): n=a or g
tacctatctgcagtcaaaagattcagaggtataggtgccatttggctcaaaccctgagacncatcctacatagttgtaccacatgataagaggatactaccagaatgaaggtgttatagca

SEQ ID NO: 33905 - DNA, 121 bp, Artificial Sequence
  Synthesized
  misc_feature (61): n=t or c
tgtctcatgctaatctgggaggataggtattcccttattttcctatagcgaacaagttgcngagaggtctgttcgtcaaaattatgattagtattgattgttttctcttgaagtcaaaaat

SEQ ID NO: 33906 - DNA, 121 bp, Artificial Sequence
  Synthesized
  misc_feature (61): n=a or g
atccatatgaaactaattaaggacatgattcgatgttttagacaatttttatgccagaccnggcccttcctttgaaagtaagtcaaagtgtttactcacattgaaaaaataacagagcttt

SEQ ID NO: 33907 - DNA, 121 bp, Artificial Sequence
  Synthesized
  misc_feature (61): n=a or t
aaatacaaacagaaaacgagttttgtgatggttaaaattcagaactagattttgaattcanttttttgaagcaccagttttgattttgtgttttgtttcagtccagaagggatcctaagca

SEQ ID NO: 33908 - DNA, 121 bp, Artificial Sequence
  Synthesized
  misc_feature (61): n=a or g
ctgggagcagggggcagtgggtggcactgctgagtggctgttgatggagtactgcactganatgggggtccctgatgtctccctcttcatcagggagagtgagacatttgctggggactat

SEQ ID NO: 33909 - DNA, 121 bp, Artificial Sequence
  Synthesized
  misc_feature (61): n=c or g
cgccagaaaacacagaaatgctaccaatgtgtcatttccaaagctctgatgaatgttactnaactaaactgcttgaatgtatcatctggcttttttaaagagctgtcccctagcagaaaca

SEQ ID NO: 33910 - DNA, 121 bp, Artificial Sequence
  Synthesized
  misc_feature (61): n=a or c
gccaagtgcagcaaggtaaggcactatagctgtgtgcagtgacttttctggtccctgtganatcacctagagcagcctttgctaacagaggtcctgtgggaacagaaacacttgaattctg

SEQ ID NO: 33911 - DNA, 121 bp, Artificial Sequence
  Synthesized
  misc_feature (61): n=t or c
tgctttgagaagatttaatcatcatctcaacagatcggtcttacacctctgttttatgaanagactgtgaataggatttgaatgaggagctagtttttggcagacaccctgaagtcagaaa

SEQ ID NO: 33912 - DNA, 121 bp, Artificial Sequence
  Synthesized
  misc_feature (61): n=a or g
caaacataagtaggagggaagggctactcaaactaaacatctgggtaaagatgaaggaggnaggagagctccgagtccagcacagtttgagctgctagcagctagatttgcagttctggtg

SEQ ID NO: 33913 - DNA, 121 bp, Artificial Sequence
  Synthesized
  misc_feature (61): n=t or c
tagcagaagggtgaaattatgaggtgagctgttagactaggctacagttttacctagatgnagtaataaaatgctcctttttgtccttcctgccctgtacttcctgtttgataatgtattt

SEQ ID NO: 33914 - DNA, 121 bp, Artificial Sequence
  Synthesized
  misc_feature (61): n=a or t
taagacaggatgtcgttttaatttaaggaaataggtgcagatgactccataagggtgaaanttaaagtttctcactttattcacttattcatttgatagttttttttatcattctctacta

SEQ ID NO: 33915 - DNA, 121 bp, Artificial Sequence
  Synthesized
  misc_feature (61): n=a or g
tcatctaattaaacgaggcaaagtctggaagcagcagcacatccctccctagaactccacngtgccaatatcagggagcagcagcagcaatgccgttgtttcaggttgctttttggcacaa

SEQ ID NO: 33916 - DNA, 121 bp, Artificial Sequence
  Synthesized
  misc_feature (61): n=t or c
ttagaaaagacctctaagatcatctaaatctttctttgtaggattgagcatctgtagcccnctgttttactggaaaggacagttatctatttacatctcttctatgtcattcactgtttta

SEQ ID NO: 33917 - DNA, 121 bp, Artificial Sequence
  Synthesized
  misc_feature (61): n=t or g
gattaaacatggtaaaaaagtgagattttacagaaatgcatccttttgcttttctgctcanctgtaacctaaagcatctgggcttgacaaaatgaaacagccgcatgacgatgtggctgct

SEQ ID NO: 33918 - DNA, 121 bp, Artificial Sequence
  Synthesized
  misc_feature (61): n=a or t
caaggaggaatgagaacaaataaaaaaacatcttagttaaacaatatgctttcattttggnagtgtatatgatttctttaccaaagactccacactctagggaaaaaaaaaaaaatgttat

SEQ ID NO: 33919 - DNA, 121 bp, Artificial Sequence
  Synthesized
  misc_feature (61): n=t or c
tgatggctacgaaacacggcatgtatgtgtggaggtgcaatgtaatcctacacacgggtgngtgaatgttgcagctagtgggggtgcatgcatatccgtgtgcacacaaagcaaaagaaag

SEQ ID NO: 33920 - DNA, 121 bp, Artificial Sequence
  Synthesized
  misc_feature (61): n=a or g
ctacttttagacttggtagtccctcttcaaagcatccccaacccttcctttgctttgtgtncctattcagtcatgagcagaatggggcattacctgactttcaggattcatgctggcactt

SEQ ID NO: 33921 - DNA, 121 bp, Artificial Sequence
  Synthesized
  misc_feature (61): n=a or c
attgagctgagatttcttcacgttgttaatggaataaaccgttcagattattaactcaaangattgctgtgacaggagttttttgaatactcataggtaaataaattttaaataaaaatgg

SEQ ID NO: 33922 - DNA, 121 bp, Artificial Sequence
  Synthesized
  misc_feature (61): n=t or c
caagatgtgatttctcttcttttcctttttcctccttccagactgcaattctgctgatcangtgaagtcccaggattctcagcacacaccgcactccatgacaccttcaaatgcttcagcc

SEQ ID NO: 33923 - DNA, 121 bp, Artificial Sequence
  Synthesized
  misc_feature (61): n=t or c
tttcatgttaatctctctgtgcctcaattccctgcccatgccatatggataatgcggagtnttactttatgagggcattgtgaaaatacattccttcgtgtttgtgaaacattcagttact

SEQ ID NO: 33924 - DNA, 121 bp, Artificial Sequence
  Synthesized
  misc_feature (61): n=a or g
cccgttttgctccccagcatcttcccatgccacagccttgtttttccagctcgggcagagncatccagccctgcggcagccagtctgctgtgactgtttatgggccaggctgtcagcacgt

SEQ ID NO: 33925 - DNA, 121 bp, Artificial Sequence
  Synthesized
  misc_feature (61): n=c or g
actcaagtttatgattcaagtgggaaatggtagcgaggctcccattttacacatctctagntggggctgcactgaagaatgcagtggctatactaacctggacaggcaaatagcccataca

SEQ ID NO: 33926 - DNA, 121 bp, Artificial Sequence
  Synthesized
  misc_feature (61): n=t or c
aggcaatcccagatattaccttggctcctggttctaatttggactgtcctgactaacagtncctcaggagcagatttgtaactgcctaccctgccaaaatcaacagtcaaatacaagagat

SEQ ID NO: 33927 - DNA, 121 bp, Artificial Sequence
  Synthesized
  misc_feature (61): n=t or c
tctgttaatgaactcctaagcagaagcccatgttagtaccaggtttcaataaaacttacgnagaatgcagctattaaattacaatacctatgtagaacacaactaccaaatacacataata

SEQ ID NO: 33928 - DNA, 121 bp, Artificial Sequence
  Synthesized
  misc_feature (61): n=t or c
cctcattgctaaaggacttcctttccccataagaaaagaattcagccttcttaccaaaacnagccctaatgaaacacttatcaagagcagcaaatgagctgataagttggtaatgtggcca

SEQ ID NO: 33929 - DNA, 121 bp, Artificial Sequence
  Synthesized
  misc_feature (61): n=a or g
tcatcaaccacaagtctagaaagcatttcttctttgctggccaatctgggactcatactgngtttggccttcctatgagaagtgtggtaagagactttggagttgaggtataagcaatggg

SEQ ID NO: 33930 - DNA, 121 bp, Artificial Sequence
  Synthesized
  misc_feature (61): n=a or g
cccatggatatgctataagcacgtgatattcaattctgttgcttttgtctacctggtaacnttcattcttgcagcagaacatggtttgatctggtgagtggggatagcaaagcatttgatt

SEQ ID NO: 33931 - DNA, 121 bp, Artificial Sequence
  Synthesized
  misc_feature (61): n=a or t
agagagtcaactgttttttctcattcaaaggataaaagtaatagaaggttacaaagtaaanaagtgactgccctgagtatttccttggttttgtaaagaaatatgagaaaataacagtagc

SEQ ID NO: 33932 - DNA, 121 bp, Artificial Sequence
  Synthesized
  misc_feature (61): n=a or g
tgccaaagtgagctgctgcaaggaaaggaagcaaatgttgttttctcacttgaaagtaccngacatgaaaacaatggcaattaaaggaacgaataaaatgaagtgacattctttcctgtcc

SEQ ID NO: 33933 - DNA, 121 bp, Artificial Sequence
  Synthesized
  misc_feature (61): n=t or g
tgggacctgagctacttagcacacaactttttggctggacagtatctcccagtggaacccnatgaccaccaatgaccgcttgcaagaaccccctattaacgcagtacatgtgtactattag

SEQ ID NO: 33934 - DNA, 121 bp, Artificial Sequence
  Synthesized
  misc_feature (61): n=a or g
gagcccttatctcagatagttctagaaatatttcacagcattgtataatccagtttcttgntgagaatcacgaagggaggtacataatatgaagggataaaagagaagctgtcttcagtga

SEQ ID NO: 33935 - DNA, 121 bp, Artificial Sequence
  Synthesized
  misc_feature (61): n=t or c
gaataagcttctcagtttatttcagatatgctttcttttcagtgataatatttctaaaaanatcccacatgtcctttagcctgcatgatcagatttttgttccctgtagattccatgcatg

SEQ ID NO: 33936 - DNA, 121 bp, Artificial Sequence
  Synthesized
  misc_feature (61): n=a or c
aagtcagctactttggagagcctgatttccatttacagtagtttcttggccctctccactntacaagattttgaagaactgtgccttgcttcaacagattttcctgtattgcacagacctg

SEQ ID NO: 33937 - DNA, 121 bp, Artificial Sequence
  Synthesized
  misc_feature (61): n=a or g
ctctgacacttgatctccgatccaatcctccatctgtgtagtaatgggaaactgaagcatnctgagtgtgagtggtgacatttaaagatgagaatttgttgtgtctggttcctgatcaccc

SEQ ID NO: 33938 - DNA, 121 bp, Artificial Sequence
  Synthesized
  misc_feature (61): n=t or c
gaagcttctggagccatgaaggcattctaagcatgaatatagcaacatggcacaggagttngtgcactactgaggtcccattagggaccatgaggcctttaaggaatggggatggtaggca

SEQ ID NO: 33939 - DNA, 121 bp, Artificial Sequence
  Synthesized
  misc_feature (61): n=a or g
tacaggcactccactgccacgagcttaccacagcccaaagccagcactcggatgtgacgcnctgcaaagtacttggcctagaacactcctcacaggcaaaagaagcctcggacaggcagga

SEQ ID NO: 33940 - DNA, 121 bp, Artificial Sequence
  Synthesized
  misc_feature (61): n=a or g
tgtttcaggaacaattccctaagaagtatgtgtgctttttaaaaagcaatgcttagaaacngcgttgccattcacaggctatgctcaattatttaactgatggtgggaatacagcaagtgc

SEQ ID NO: 33941 - DNA, 121 bp, Artificial Sequence
  Synthesized
  misc_feature (61): n=t or c
ggccaggaaccaccggggactgaaattgcctgtaagctgggattgctctgtgagctcctgncctgggagggctgtgatggcagcgggttggtggggatgggggcagcaatgcgggagaggc

SEQ ID NO: 33942 - DNA, 121 bp, Artificial Sequence
  Synthesized
  misc_feature (61): n=t or c
tcctatttaggagttatattaattcctgtctaggtttaagcacacataaaagggtgtttgnatcccacatttgaccatggtaggagaaggcaatgttatactgtgtgtggaggtgtttatt

SEQ ID NO: 33943 - DNA, 121 bp, Artificial Sequence
  Synthesized
  misc_feature (61): n=a or g
tcttgctttctgtgtttattgcttagcttattgttcttcacagcttctttctctgacgcantatttttgaacagtaaataagacttcaaaatgtgtgcatgcttttgaaacaaagtaagca

SEQ ID NO: 33944 - DNA, 121 bp, Artificial Sequence
  Synthesized
  misc_feature (61): n=t or c
ctaaaaattatggcatacagcctccagttcaaaataggcgcacttaatcttttaagacagnccatgcttgggcagataggttatgacagcacacacacacacatacagacacacacatgag

SEQ ID NO: 33945 - DNA, 121 bp, Artificial Sequence
  Synthesized
  misc_feature (61): n=a or g
aggatttaacacaaacactgaaatattccatacctctaaacatgtactccatactttaaanagaccttatacaattcacatggatataatccatccttccttaatctgaaccccagctgac

SEQ ID NO: 33946 - DNA, 121 bp, Artificial Sequence
  Synthesized
  misc_feature (61): n=a or c
tgctctctccatctccgcagctgaatttaacctctccaaaggctttttttctcacatcccnagctctgttgctgtcctcatttcgtacaggcttgttttctaccctgcagatctctgccct

SEQ ID NO: 33947 - DNA, 121 bp, Artificial Sequence
  Synthesized
  misc_feature (61): n=a or g
catcttggcaggaagtccatagaccctgtacgtaagacaagaaagcaggttttgctaatanggaaatccccttgactttgggaattatactgcagtgacaccctgcaagtcatacgctttt

SEQ ID NO: 33948 - DNA, 121 bp, Artificial Sequence
  Synthesized
  misc_feature (61): n=c or g
aaactgttgatgtgtcactcaagatttctgtggaattcatggtaaatggacatgtcgcttnaagtggtagaaatgtgaaatcttaaaaacacttttcctgattctctaaagcgattgaagt

SEQ ID NO: 33949 - DNA, 121 bp, Artificial Sequence
  Synthesized
  misc_feature (61): n=a or g
ccagctgtttcctatgactatggtgaatttctaatttaaagtattatcatatatattacanggcaataccttccagactgaataaggatgaaatccattgtgctggtatcagataatcaca

SEQ ID NO: 33950 - DNA, 121 bp, Artificial Sequence
  Synthesized
  misc_feature (61): n=a or g
ggtagataagcaaaaggatttgtttgtttatttgtgtatgtttcaaaacacaagtgaaggngccaggaatatcttttgtaattcacatatgtaattgggattttccacttttagatcttgc

SEQ ID NO: 33951 - DNA, 121 bp, Artificial Sequence
  Synthesized
  misc_feature (61): n=a or g
acatttctcacggtcatggggcagtaaaggtttgtactcattctgtatttacatttcacantgtttaccttgatacttcattggtgatgctgttagaatgactgaattttcaaaagccaag

SEQ ID NO: 33952 - DNA, 121 bp, Artificial Sequence
  Synthesized
  misc_feature (61): n=a or c
ggagtcattgccatttcaagcatttatttctctttttgttgacaaagcgttgaaatctgcntaaggatctcctttttctagccttgaatgttagattcctggtgtacagctccctaaataa

SEQ ID NO: 33953 - DNA, 121 bp, Artificial Sequence
  Synthesized
  misc_feature (61): n=a or g
cttgagtccccaaaagaagaaataggtaacggatttttttctatgccacaaaaatctgtgnagattatacttttttcaaggggcaaatctggtgtagtctttacatcttaatccaggatca

SEQ ID NO: 33954 - DNA, 121 bp, Artificial Sequence
  Synthesized
  misc_feature (61): n=t or c
tgagaggatgttggctggcttgtgggtgagaagtcacgaaccactggctacagagatggtngcttgtcaacgccttgcaaagaggccagcagttgtcacgggttaatgtgtgtcaggattc

SEQ ID NO: 33955 - DNA, 121 bp, Artificial Sequence
  Synthesized
  misc_feature (61): n=t or c
gcattttttctcagtattctgtttctcttcctggtccaattcaggattaccttggaaaacntagtcaagagacaattcaaagatatctagggtcttggatggagtctctatgaatagaaat

SEQ ID NO: 33956 - DNA, 121 bp, Artificial Sequence
  Synthesized
  misc_feature (61): n=t or c
atccgacagattgcaggtgacaaaatctacaggtaaaatcaaggtccttaaagacagaagnggaacaaaccccagaccttgacagcattgcattttgttatgacttcttggattctctctg

SEQ ID NO: 33957 - DNA, 121 bp, Artificial Sequence
  Synthesized
  misc_feature (61): n=t or g
ttagagtggaactgaaaaggatgaacagtaagcagagttatcacaaagtgtatgttaaagntttttttcagctgcactccccaagcactatcttaaccactgcctttgtttttattgtttc

SEQ ID NO: 33958 - DNA, 121 bp, Artificial Sequence
  Synthesized
  misc_feature (61): n=t or c
gggctgctgggaggaggggtgccagggccgggcaagcaaacccagcatcagagttccagcntccctggtgttacctgacaaggagctgggacacagatggataatgccaagagatggagac

SEQ ID NO: 33959 - DNA, 121 bp, Artificial Sequence
  Synthesized
  misc_feature (61): n=t or c
cactgagagacacatgcattatttctatgctattaattttctggcacagtttaaattgccntaagttaaatctacatgagtggttgaccctctgtagaacaaaatatttgttaatgataac

SEQ ID NO: 33960 - DNA, 121 bp, Artificial Sequence
  Synthesized
  misc_feature (61): n=t or c
gagctttcaaacatgcaatttcagatttcacattaaagctctgctattcacaactcacagncagacacagtttcacttctgtctctatctgcttgccatgagaatcagaattaaagcctgc

SEQ ID NO: 33961 - DNA, 121 bp, Artificial Sequence
  Synthesized
  misc_feature (61): n=a or g
tgatttaagttttgcaatgggaaatgtatgccgtttgtgcatattcccaggtatgctgcangagggatgtttctgtcagaaaggtgtacagatgggattcaatttgtttggattcagatca

SEQ ID NO: 33962 - DNA, 121 bp, Artificial Sequence
  Synthesized
  misc_feature (61): n=t or g
attccaaagtgaaattttctcaggagaatgaaggattcattaaaaggagcaaaaattaatngtggaaagcaagccaaatttcaagtttatagtcaatgaagaggtggagggtgctttcagc

SEQ ID NO: 33963 - DNA, 121 bp, Artificial Sequence
  Synthesized
  misc_feature (61): n=a or t
tgttttatgttgtgtagatttcatggcaattccagcctttctgttgcagtactagctcagngctttttcatttggcattgctttcaaagggattctataactttattcaagagtagcattt

SEQ ID NO: 33964 - DNA, 121 bp, Artificial Sequence
  Synthesized
  misc_feature (61): n=a or g
ccaaaccaacatctgcatttcctaggctagacatactacaagtggcagcagtctttaaacntgaaaatatacacaaatctcacccttgcaaacgttggttaaccttacagcccattagaaa

SEQ ID NO: 33965 - DNA, 121 bp, Artificial Sequence
  Synthesized
  misc_feature (61): n=a or g
cctagaaatacacttgccttcggggcagaaacaaccatccatgtaatgttcctcacaaagnctgctgacttccaagtgtgagcaagtatccatgcagggtgagctgctttctctatagacc

SEQ ID NO: 33966 - DNA, 121 bp, Artificial Sequence
  Synthesized
  misc_feature (61): n=a or g
aggtcttactacacaagttgaaccagttcccatagcaatgtaaaaaagcaactgcaaaatngaatgggaacacaactgctctctaaaaccaaaacacagacgtagtgttctctgcacatat

SEQ ID NO: 33967 - DNA, 121 bp, Artificial Sequence
  Synthesized
  misc_feature (61): n=t or c
tttacttttcttatttttagggttcactttctatgtggcaaaaagtacctgtagaaattcngggaaatattttttccatagtttgtatttctgacgtcagggccaccatccctgctcaagc

SEQ ID NO: 33968 - DNA, 121 bp, Artificial Sequence
  Synthesized
  misc_feature (61): n=a or g
tcacatgcagatttctattgagctgaaagacccagtaaaggttcagatcacgcccagctgntgggatgtgtcagaaggtagaaaccacaggcaacatcctgctggaatggaattgttgcca

SEQ ID NO: 33969 - DNA, 121 bp, Artificial Sequence
  Synthesized
  misc_feature (61): n=a or t
agatcataaggaagtaattttaattgctttactgtgtgacattattagtgcaaaaaatgangtaaaaaacagtgtacagcacagactggaaattaaaaacaattcagtcaaaaatggtgta

SEQ ID NO: 33970 - DNA, 121 bp, Artificial Sequence
  Synthesized
  misc_feature (61): n=t or g
ctataaggacacttctgtggtagaagttttctgtaaaagatcacttctttgttcattttgntagtgaagtacttctgaagttaattcaagcaattacactgttgccctctaatacaaatat

SEQ ID NO: 33971 - DNA, 121 bp, Artificial Sequence
  Synthesized
  misc_feature (61): n=a or g
tctgtctttataagaataaattgtaatagacagaaaatgttaaattccttttaagtgtagnttatagagaaagctatattgtggggtcatgcctcaaaatatccctatgtgttcatgtctg

SEQ ID NO: 33972 - DNA, 121 bp, Artificial Sequence
  Synthesized
  misc_feature (61): n=a or g
agccacaatgctacactgctggagtagatggaattaactcatctccagaagagcatgtcanaagattgatatctccatggtgaaagagactagtgcattctgcagagtcacagcagggagc

SEQ ID NO: 33973 - DNA, 121 bp, Artificial Sequence
  Synthesized
  misc_feature (61): n=t or c
actgctctgatagtgattctcatgggctgcagctcctcttgggtcttctcctgcatgagcnctccatgagttgcagattgcttagggtacacctgcctggtggagtgtggggtcctctatg

SEQ ID NO: 33974 - DNA, 121 bp, Artificial Sequence
  Synthesized
  misc_feature (61): n=a or g
gagactgcaccaggagagaaaatacccaaacaacagctaaacatgcgtgcatcttggctcntactctatatcttatcaactgaatgtgtgagggtagggctggtagagaaatcttgggtat

SEQ ID NO: 33975 - DNA, 121 bp, Artificial Sequence
  Synthesized
  misc_feature (61): n=t or c
tggttcaagccaggaaagattatggacttcacaccatacacctccctgcttctccaaagantgccaggtatggttttgtcttacataaagattaaaactgaagctgacagtacataaaatt

SEQ ID NO: 33976 - DNA, 121 bp, Artificial Sequence
  Synthesized
  misc_feature (61): n=t or c
ctgaccttgatgctggagggaaatgcacttagagggccaatatacctatggcatatggaancaaatatcctgctgcttagtcattagaaaggtacttttatggagcattacacctgtggtc

SEQ ID NO: 33977 - DNA, 121 bp, Artificial Sequence
  Synthesized
  misc_feature (61): n=c or g
gatgataagagaatgaaattaaagagatgataaagagaaaagcataaatccaattgttcanttagtgcctcttaaattcagtgatgtggttaaagaacccatgattggttttgtggaaata

SEQ ID NO: 33978 - DNA, 121 bp, Artificial Sequence
  Synthesized
  misc_feature (61): n=t or c
ataggaatgaattaaaatgtgtcgactcgcggatcagaaggaaagcaatcaaacacgacgngttgtgaaaaggttcacagatctgaaaattaacaccttctgaaccagagcgtacgataca

SEQ ID NO: 33979 - DNA, 121 bp, Artificial Sequence
  Synthesized
  misc_feature (61): n=t or c
actttacccagatttttaatagctgttctaacaacaatttttccatttgtgacaaggttcntacaatactgaggggctaaatagtatcttaatgaagtctcatttacattcttctatgagg

SEQ ID NO: 33980 - DNA, 121 bp, Artificial Sequence
  Synthesized
  misc_feature (61): n=a or g
ctgtttttcttacgatatcagagtccatggaaattgagtgtatgaataccattaagcagtntggagatgcaagctatctgaagagagattatttatcacttttctttctctctgcctgaat

SEQ ID NO: 33981 - DNA, 121 bp, Artificial Sequence
  Synthesized
  misc_feature (61): n=t or c
tttacattacattagaagccacagtgtgaaatcctatgatgctctaatttacagccaatgntttcaaacttggtggataaaacgtgcttccaaaattcaaacactggatcatgaatgaatt

SEQ ID NO: 33982 - DNA, 121 bp, Artificial Sequence
  Synthesized
  misc_feature (61): n=t or c
ttatgacagcagccaggaaaaaaaacacacatactgctttctggacaactgagcaatatangcttgtaccataattgcatctgaaattccttgaaaaagaacaaagacatcaacaaaaaca

SEQ ID NO: 33983 - DNA, 121 bp, Artificial Sequence
  Synthesized
  misc_feature (61): n=t or c
tcccatgctaatagcttctggtagcacatactcaatttaattacaggtttggttctcttanattggattattttaaaaaatgctccactgaaaaaaaacagcagtgtttaaatagctacga

SEQ ID NO: 33984 - DNA, 121 bp, Artificial Sequence
  Synthesized
  misc_feature (61): n=a or g
tgctctgaatacggcctcccacttgagctttgtttgcatcctgcaccgagtgcttggtgtngattggtgtcctgggaaccacagtgcccaaagggaaaatactgctgtaagcataagtgct

SEQ ID NO: 33985 - DNA, 121 bp, Artificial Sequence
  Synthesized
  misc_feature (61): n=a or g
gtcttcgaaacagtgcaaaacagccatttctgttgggaaaagggaaatgggggctgctcantggatgaaaacccaaataatgccatctgaagctagtccagagggctgatacaaggtgact

SEQ ID NO: 33986 - DNA, 121 bp, Artificial Sequence
  Synthesized
  misc_feature (61): n=a or g
tagaagcccataaatgtcaaacgtgtttagcaagaaacctggctaagcaaataaacatttngcaggaaatctatggggatctgataccagcacctaaaacctgagttgcacacacaaacca

SEQ ID NO: 33987 - DNA, 121 bp, Artificial Sequence
  Synthesized
  misc_feature (61): n=t or c
gctcaattttgaaaccttgatatgattctcttagggcagtttctctatagtgacgcacagnattttaaccaatgaactaaaacttcaaaaatatgtaaggttaggatctgatttttctgct

SEQ ID NO: 33988 - DNA, 121 bp, Artificial Sequence
  Synthesized
  misc_feature (61): n=t or c
agtatgaagaacacagggaggggatgtcatagaagtgaaggataaaagggatttgaatgtngatggattgcagccatttaatcatgcaactatagaaatactggacaacttcagtatcacc

SEQ ID NO: 33989 - DNA, 121 bp, Artificial Sequence
  Synthesized
  misc_feature (61): n=t or c
tacacaagcccctggagtagaagcagaggttactcacagtaagagaaaagctaatccaaanagctctttaatgagcacaggggacttaatgtatgtctttgttgtttgaggtagcacactt

SEQ ID NO: 33990 - DNA, 121 bp, Artificial Sequence
  Synthesized
  misc_feature (61): n=t or g
agtattgcaaaaacagctgcatctttcacacagtcactgaaaacataaacaacaaatacanttttcaaagactactgccatggatatgctataaggagtgcttcagtcatcccaaaatatg

SEQ ID NO: 33991 - DNA, 121 bp, Artificial Sequence
  Synthesized
  misc_feature (61): n=a or t
gcaaaaaagtgcagatgagcccaagcagagtgaggtctttatactgaaaatgagtcaacgnagagccttacactgaagcacagctttgtgggtagctgagctgatgctgactgcagtggaa

SEQ ID NO: 33992 - DNA, 121 bp, Artificial Sequence
  Synthesized
  misc_feature (61): n=a or g
gctaacgaaccactaaactagatcgtgtctggggactcaggtcagtgttctgtaaagctgntagacatgaagcatcaccccagcctcctgtttgtgctgctgaatgcacgagtgagcatca

SEQ ID NO: 33993 - DNA, 121 bp, Artificial Sequence
  Synthesized
  misc_feature (61): n=c or g
tttagctaaatttaagtagaattacaaccttccctttgcagttggatggacaagtggtganatgtaatggttctcttcatcagcagaactgggatagaagagaaattcagaagctgggatg

SEQ ID NO: 33994 - DNA, 121 bp, Artificial Sequence
  Synthesized
  misc_feature (61): n=t or c
ttgctaggtaaatgcagaatatgaagaaaaggtccctggagcagttccatcactgagttgntttttcaatttcctcttccaggtagttgagtagtactagcttatgtaacaatttcatgtc

SEQ ID NO: 33995 - DNA, 121 bp, Artificial Sequence
  Synthesized
  misc_feature (61): n=t or c
agctgagaggaagaagatatagaaaggtgaaaggaaatttctgataactcttactttcttntgaaatgtaaagtttcaagcatctctaagcacgtggcttttcaggctcctctcatgcctg

SEQ ID NO: 33996 - DNA, 121 bp, Artificial Sequence
  Synthesized
  misc_feature (61): n=t or c
gcatatcagccatgttgtggccaaggcaatgtctctttctcctgtcctggctgtaactcanctgaaacctttctgagcaaaatgaccgattcttcacatttcattacgaaacatgaagaag

SEQ ID NO: 33997 - DNA, 121 bp, Artificial Sequence
  Synthesized
  misc_feature (61): n=t or c
tttctgtgatgtttatgtctaattgtttgttactgttgaagagaaaatcatgctaactccnagccaagtaaatgcaacctgtggtctgaatgacaagctaggctcttcctggctcatgcat

SEQ ID NO: 33998 - DNA, 121 bp, Artificial Sequence
  Synthesized
  misc_feature (61): n=a or c
ggaggggctgaactctgttcagttgcttttgacaaggtgttgccatttattttactcttgncttggcaattatcttgcttgtgtcccgccacctagctctggaaccataaaaaagtaccct

SEQ ID NO: 33999 - DNA, 121 bp, Artificial Sequence
  Synthesized
  misc_feature (61): n=a or t
tccagagggtctggtttaagcattcacataaaggtttaaaaagttacttcattcacgatcnttgaagaacatgccaaacattcatacaccagggagcatgtctgccaacactttgcccttg

SEQ ID NO: 34000 - DNA, 121 bp, Artificial Sequence
  Synthesized
  misc_feature (61): n=t or c
catggatttatgcccacaggcctagcctcaagtcatccccttatatctgtcctgttttctngaatattttggaagcacaggtagggagaaggtgttaatccttcctactcgcacagtgaat

SEQ ID NO: 34001 - DNA, 121 bp, Artificial Sequence
  Synthesized
  misc_feature (61): n=t or c
aactggtgtctccattggttctggacttggtacaagagccagcagctcatccttattgttngacgttatccctgtagaagaaccctgctgtgacagtgcagcaaataacagtatggtgata

SEQ ID NO: 34002 - DNA, 121 bp, Artificial Sequence
  Synthesized
  misc_feature (61): n=c or g
acttgagacaattcattgtgagctatctgaaattcctttgaagagctatcatttggagaanagagctttggtgtttgtcttcttttccttgatcatgatagaagagaatttggacttgtgc

SEQ ID NO: 34003 - DNA, 121 bp, Artificial Sequence
  Synthesized
  misc_feature (61): n=t or c
ctgttatagggtcatacatggtcttgttttcgggtgatagcaaaacattcaatggtaatgngacttctttgttagatgtcacttggcttcttaaaattaaaggagttctaattcttgtttc

SEQ ID NO: 34004 - DNA, 121 bp, Artificial Sequence
  Synthesized
  misc_feature (61): n=a or t
tgttgtttctcttctctacaaagtgcagacatggtgagagtctggagagttgattttagtnatccttaaagtttactcattagaggaaatacagtgactatcatctggctgacctttgaaa

SEQ ID NO: 34005 - DNA, 121 bp, Artificial Sequence
  Synthesized
  misc_feature (61): n=t or c
acaggacgtggcaagttttccctatacagacagacaacctgttggcatcgctgcccaatgngctcatttgtgtctgcaaacatggatcgcttttggagagccccctatcagcccagcacag

SEQ ID NO: 34006 - DNA, 121 bp, Artificial Sequence
  Synthesized
  misc_feature (61): n=a or g
ccccacatcccaacccactcctctacaaagcatctccactttattccacacaaatcccagngcatcccatcctgcagctggaagcagaggcagccactgctccccatatcccattgcatgc

SEQ ID NO: 34007 - DNA, 121 bp, Artificial Sequence
  Synthesized
  misc_feature (61): n=a or g
tttgttttttaattcttctatttctatttcaaatatttggactgtgaagtatcctatggancattactccttttccatctctgatcaagatacttagtgtcacacatactgaaatactgca

SEQ ID NO: 34008 - DNA, 121 bp, Artificial Sequence
  Synthesized
  misc_feature (61): n=a or g
cgactcgtgtgtctgcaaagagcgaataagcaaagtttgaatcagtttgactttggaagcntgattctgagcaattaccttgggaaaatacacctccttttgactaaatagatctgtcaga

SEQ ID NO: 34009 - DNA, 121 bp, Artificial Sequence
  Synthesized
  misc_feature (61): n=a or g
tcatagggcgcttggtgggaagccaaggaaaatcccttttctcttgcacaactccgaagcnagcctacacgttagaggggcagaagaaaaacgcagcccgcgtgcattggttttggggtgg

SEQ ID NO: 34010 - DNA, 121 bp, Artificial Sequence
  Synthesized
  misc_feature (61): n=a or t
gttgtcctcttcctttcctgtttccaatttccttgccatttacagggtggaatgcttgtgnaggtgtaatttatgtagcattatgaaaatattttgtaggttaacatgtaaatgatggaag

SEQ ID NO: 34011 - DNA, 121 bp, Artificial Sequence
  Synthesized
  misc_feature (61): n=t or c
ctgcacgctgctgtgtggctgaatcattgatatctcccagcctacaatggctgtaatggtntcataaagcagattatgtcaagaaagcaaggcagagaaaacccaaagtgaccctgtggca

SEQ ID NO: 34012 - DNA, 121 bp, Artificial Sequence
  Synthesized
  misc_feature (61): n=c or g
ggacaggaatttgacctaccacttcctgtttagtcatttcagttttgatcaaagtaaaagnaaaatttaacagtggctccccagtgatgggatcgaagtagctcatgcaggaaaggagcca

SEQ ID NO: 34013 - DNA, 121 bp, Artificial Sequence
  Synthesized
  misc_feature (61): n=a or g
cccagccaggggggactgacatgtgctggaggcaaaatgcattcagcacgtccaacctggngtgcttggatgccccaaagctgtgggctcagctcatgcagtggtggcaccgaggcgggca

SEQ ID NO: 34014 - DNA, 121 bp, Artificial Sequence
  Synthesized
  misc_feature (61): n=a or c
aggattgggtcccgttttcaccctctccagaaatcaagggactttgcaaaatgcagatagngtgaaccaaagcagaagctgagccactgagttggaagcaagctatcctgacctctattac

SEQ ID NO: 34015 - DNA, 121 bp, Artificial Sequence
  Synthesized
  misc_feature (61): n=a or c
tgttgggatctgggaggtgtcccctatcctccatggtctctgcactcggaggagaagccanctcctccacccaatgagtcgcagtggacagactgctctttgggggatctgcctctgatca

SEQ ID NO: 34016 - DNA, 121 bp, Artificial Sequence
  Synthesized
  misc_feature (61): n=t or g
tgcataagcagtagggaactggggaggtcaggtaggaagtgctgcatgtaatcagatccangatcctcacaggctgtcatccagctctgagattcagctagagacggtcaagaaagctgaa

SEQ ID NO: 34017 - DNA, 121 bp, Artificial Sequence
  Synthesized
  misc_feature (61): n=a or c
cactgttcaattcttttttttttttaaattcttaaaaggaggcttttctcttatgccctcnagtagaatataacaaagctgaacgtatttgcctcaaaaaagagatttccatacattcact

SEQ ID NO: 34018 - DNA, 121 bp, Artificial Sequence
  Synthesized
  misc_feature (61): n=t or g
aaagagatggagggaaaggactacaggctgccaaggcttattgttccagctgcagcaccangctgttgtgactgaccatgatcagtgacctaggaagatgagtggctgcaagcactctcga

SEQ ID NO: 34019 - DNA, 121 bp, Artificial Sequence
  Synthesized
  misc_feature (61): n=a or g
acaattgtctacttcatttgagtcagaagttattacaggaagtcatgagacaccaaggacncaataagaatgcaagtataaaatcagttcttgagaaatactgttcatcagcaaaactaga

SEQ ID NO: 34020 - DNA, 121 bp, Artificial Sequence
  Synthesized
  misc_feature (61): n=a or g
ctgtacctaccccaaatttttcttccagtcagccttgaaacagccatgtagtgaaactgcntcccctcaacaaagagagagatgtgccaccaagttttaaaaactgactggaaggagacaa

SEQ ID NO: 34021 - DNA, 121 bp, Artificial Sequence
  Synthesized
  misc_feature (61): n=a or g
tggggatgtgcttacctggttgtggaatggcactgactgaatactgaggcattcatggttnttttcctccccagtgttttagccaccaagtatataggtattctagtggccctgttttctt

SEQ ID NO: 34022 - DNA, 121 bp, Artificial Sequence
  Synthesized
  misc_feature (61): n=t or c
cagggtagcctggcagatcttgctgtactgttaactattacatcactatatattatactangttttgcttctgggaagcacaaggcaactactgatttgcatagaatttcatacttcatct

SEQ ID NO: 34023 - DNA, 121 bp, Artificial Sequence
  Synthesized
  misc_feature (61): n=c or g
tatttctcaaacacagacggtgcgtattgctgcaaacagggaaaagaattcaagttacggncaaggaacacttgtgcaagcccatggctgtgtcgcggtgctggggaacagcccagaacgg

SEQ ID NO: 34024 - DNA, 121 bp, Artificial Sequence
  Synthesized
  misc_feature (61): n=a or c
actggtttgtctgctacagtattaaggttaggttttttgagtgagtaacagtaaggtgagnggttagcagtaacttagttcctcccccaagccccataaactacccagtgttcagtgggaa

SEQ ID NO: 34025 - DNA, 121 bp, Artificial Sequence
  Synthesized
  misc_feature (61): n=t or c
ggccttttgttgtttggtagattctgcatttaataaactgcacttacattttgtaattgcngacaaattgtatgttgtgtgagatagagatctgtgtctgttctgtgccatgcttggagtt

SEQ ID NO: 34026 - DNA, 121 bp, Artificial Sequence
  Synthesized
  misc_feature (61): n=a or g
aggcaaaatcagcaagggtgttgttgggagggggcaggactggggttccctcctcccttgnttttgatgtggtggcatcaagatatgcccaggcacactccagtgggagaagagagctgct

SEQ ID NO: 34027 - DNA, 121 bp, Artificial Sequence
  Synthesized
  misc_feature (61): n=t or g
cctctaccttcccagtggctgagacctgcaagaggaacatgcccttttcttgttggaaatnccaaggaaaaccagaataacccctttctgagggctgtttttccccagcacgtcaaaggat

SEQ ID NO: 34028 - DNA, 121 bp, Artificial Sequence
  Synthesized
  misc_feature (61): n=t or c
ccaagagatgaagcacagcaaatcactgcataaaaagcattatcaaaggcaacgatatagngcagcagttgaaagcagacatctggagtgaacaaaagtgaagggtactctctttgtactt

SEQ ID NO: 34029 - DNA, 121 bp, Artificial Sequence
  Synthesized
  misc_feature (61): n=t or c
ctttctcttgccagatgatatacaccaagccctaaacctcacataagatcacagatcatantgccagccttggctgaactgccctaccccatccattgtacagtctggatttggcaccttc

SEQ ID NO: 34030 - DNA, 121 bp, Artificial Sequence
  Synthesized
  misc_feature (61): n=t or g
gcacactgcttgcagactgctttcatgccttgctgagcattacttgtgcttttctcaggangctgttgccaaccaaaccttccagcacagtgccacatgttgatactcgaagcagcacatg

SEQ ID NO: 34031 - DNA, 121 bp, Artificial Sequence
  Synthesized
  misc_feature (61): n=t or c
tggtggttgatgcattcactccatagcagcagcaccatgtactagcaattgtactaaacanatggacagaaatccagccaagaaaatatgttctgcaagttagtgctgtcttgcagccatg

SEQ ID NO: 34032 - DNA, 121 bp, Artificial Sequence
  Synthesized
  misc_feature (61): n=t or c
tgtgtgaacacttaaaactccttgaagtatcagagatacataggccttggcttcctgaccnccacctttaacctctcatgtgcttcttctgtgtcactgaccttacattataatgttattt

SEQ ID NO: 34033 - DNA, 121 bp, Artificial Sequence
  Synthesized
  misc_feature (61): n=t or c
ttgttctacttataagcatttctcctaactctcgctcgctcatgcaaagcgttcccacccntgcagaaagcagaggtctgtttcagagagcaaaaaaagaaaagaaaaaaaaaaaagaaag

SEQ ID NO: 34034 - DNA, 121 bp, Artificial Sequence
  Synthesized
  misc_feature (61): n=c or g
cagtggttttgtacatactactttctttttaaaaggaaaaggccctactctgaattaaacnacggaagtggtcatgctgcctgcagacaagacagcaaccttgatttttcattgctatata

SEQ ID NO: 34035 - DNA, 121 bp, Artificial Sequence
  Synthesized
  misc_feature (61): n=t or c
tgcaaaagggtatttcctggcctgtgctattggcacattcacccatcatattaataatgcnataatgccactcgtccctacatcataaattctcaccttgttggtgcataaaccagctgca

SEQ ID NO: 34036 - DNA, 121 bp, Artificial Sequence
  Synthesized
  misc_feature (61): n=t or c
attctgcaagattcatgtcacatctgtgctccaacattatttggtttgatcaagcctagancagcatagaagtggaagtgttcaagcagaggtacacatcaacagtcttcctacaatgctc

SEQ ID NO: 34037 - DNA, 121 bp, Artificial Sequence
  Synthesized
  misc_feature (61): n=t or c
ttaccttacacagacagattttcttagaaaaggacaagcagttctgttagactctatggcnccatccagccctttcgaaatcagagcagtttgcagaaatttggcgcatagaatgctcctg

SEQ ID NO: 34038 - DNA, 121 bp, Artificial Sequence
  Synthesized
  misc_feature (61): n=t or c
gatagaaatacaaaggtagacttcaacctcagacactcattattttaccacaacttctgtnctctcacgatgtactcaaggttttcctaagcaaaatgcaagcctttggacactgagataa

SEQ ID NO: 34039 - DNA, 121 bp, Artificial Sequence
  Synthesized
  misc_feature (61): n=t or c
taccaccctgcggttgttcagtttgctaaagcattaatgctgctttgtgaatagcagctangcttaatttgtattaatttattattagcatctgatactaaatttgtaaagctgatactgg

SEQ ID NO: 34040 - DNA, 121 bp, Artificial Sequence
  Synthesized
  misc_feature (61): n=a or g
tggtgctgctttgctttccctcattcgcgtgcactggcaggtaccgggtgctgttattccnctgactggttctcaatggcagaagggtgggattggcaagttatgtttcaatggaatcccg

SEQ ID NO: 34041 - DNA, 121 bp, Artificial Sequence
  Synthesized
  misc_feature (61): n=t or c
aaaggtaagacagtatattgttttcccttatttcatgtgtttggatgtattatagaagatnaacctcactccccaccccaaagaaaaagccttaaaccctaaggacctcactaatttttgc

SEQ ID NO: 34042 - DNA, 121 bp, Artificial Sequence
  Synthesized
  misc_feature (61): n=a or t
cctgacaggagaacagtgatggagccaagagagccattggtgtcagaaaataattgcaatngttaatatacacaacccccggttatcttcttactgcatttcacttacaaaattaatcttg

SEQ ID NO: 34043 - DNA, 121 bp, Artificial Sequence
  Synthesized
  misc_feature (61): n=a or c
aaatcaacacgggcaatgatcccacaaatgaaaaaggaagcagtttgcagggggaaaaaanccttttgcccattcgctgcagatccttcccaggctgacagtgggttcaggcttctgacag

SEQ ID NO: 34044 - DNA, 121 bp, Artificial Sequence
  Synthesized
  misc_feature (61): n=a or g
aattatgctgcctactttgcttcttgcaagcaaatggaatcaagaagtgcttagaccttgnagatgtagatcattgtccaagactgggaaaagctgctgttgactgaatgttgctgatcca

SEQ ID NO: 34045 - DNA, 121 bp, Artificial Sequence
  Synthesized
  misc_feature (61): n=a or g
tgggttttatccttgttcgatgccgtgcttgggatctgagcgtgcttgctgcctcctcccntgtttgtttgatttcaagaggaggaaatcccggctctccaagcctgcaggtgagccacgt

SEQ ID NO: 34046 - DNA, 121 bp, Artificial Sequence
  Synthesized
  misc_feature (61): n=t or g
ggtgtaaataattgagtaatgtcatggtgctaggcaggagtccaatggtaaagcttcagangagaagtatgtcctataatggcaggcttagtgtccttttttaggtgtttactcccaacac

SEQ ID NO: 34047 - DNA, 121 bp, Artificial Sequence
  Synthesized
  misc_feature (61): n=t or c
agcatgtaatattctgaggcagaactgtatatatagtgctgtagtgggctatacagagcanagctggaacttagacatacactgacttttattctacttatttatttttgataaggaagac

SEQ ID NO: 34048 - DNA, 121 bp, Artificial Sequence
  Synthesized
  misc_feature (61): n=t or c
tgaggtctcaccttttgttttaggataggaacaatgcagggaagccacactcagcagccangattgctgcaaattgcaaggaggaaaggccttccacaagctaatctgtagcttttctcta

SEQ ID NO: 34049 - DNA, 121 bp, Artificial Sequence
  Synthesized
  misc_feature (61): n=t or c
atggatggaagaaggaggggtccatgctctgagttttttgggtctttcaccaaacacccangggctaagcactgtccctcaccttcttatccttgtagaaagggtccaggtcctccagagg

SEQ ID NO: 34050 - DNA, 121 bp, Artificial Sequence
  Synthesized
  misc_feature (61): n=t or c
agccagtattttccagcattgctgttgtttgtagggaattgggtgaggcagtccattttcntattctgttctaagttttattttaactttcatgtaagtctgtgcatcagatgagagaaat

SEQ ID NO: 34051 - DNA, 121 bp, Artificial Sequence
  Synthesized
  misc_feature (61): n=t or c
tttttcttcttttttcccctctctctgtattagcaattaaataagcttacatcagtgaccntgctaacttgtaatcctaggtgtgttaccaaacaatcattatgtgcaactgcacctaact

SEQ ID NO: 34052 - DNA, 121 bp, Artificial Sequence
  Synthesized
  misc_feature (61): n=t or c
ttacagtatccagattctcaaagtcagcctctgaaaggctgatgggtggctctgctccttncacaaaatgattcccaatctcacagccacagccccgttactcactttagcagcctctttc

SEQ ID NO: 34053 - DNA, 121 bp, Artificial Sequence
  Synthesized
  misc_feature (61): n=t or g
atttacaaatgtgattgtgagcacataaaaaaggaagaatcattgaaagaatattacttgnaacacagtgtattttcatctgatacatgtaagaaccctctggatttttttattacttttg

SEQ ID NO: 34054 - DNA, 121 bp, Artificial Sequence
  Synthesized
  misc_feature (61): n=a or t
cttttcttttcccccaaagtattcattttctaacaattcaactgtgcagttcaagtcaacnccccttttgtattgtgaatttaagtagaaaacccaaaggacatttatcctacaatgtatt

SEQ ID NO: 34055 - DNA, 121 bp, Artificial Sequence
  Synthesized
  misc_feature (61): n=t or c
tgtgctacatggttatgcatattaccaaagtcttgttccagactttggagaaagattgtgngaggtggagatcagtgatttgatctaatgcaaaatgtgggtgctttcctcagggagaaat

SEQ ID NO: 34056 - DNA, 121 bp, Artificial Sequence
  Synthesized
  misc_feature (61): n=a or g
tgtgggagttatactaatgatgtagcactgtattgcttagaatttcaaatcagttcagccngagtcccttataaaaactgttttagtatttaacaacaacagctgaataattgatactgta

SEQ ID NO: 34057 - DNA, 121 bp, Artificial Sequence
  Synthesized
  misc_feature (61): n=t or c
agcaagagagatctccaaatgcacatagcggcctgcaagctggagtgccacccactgaagngtgggctggttacaaggctgcgagaacagggatgccatcagtggcttggagattttgcaa

SEQ ID NO: 34058 - DNA, 121 bp, Artificial Sequence
  Synthesized
  misc_feature (61): n=a or c
agccctgtaggactacctcagaggcaacctcagaatagcagaggaggctgacaggacattnctattaggaccttttcactatggaaattatttccacatttccctcttaaatctgcttcta

SEQ ID NO: 34059 - DNA, 121 bp, Artificial Sequence
  Synthesized
  misc_feature (61): n=a or g
taaattattctgtgcatatacattattctttccctctgttctgctttaatatgcactatcngaagtgatgaagcgctggtgcagccttcatagatgtgacttcctggtcatcttaacacag

SEQ ID NO: 34060 - DNA, 121 bp, Artificial Sequence
  Synthesized
  misc_feature (61): n=c or g
ggtctaaaattagcaaatgtgtaagtggttctgaggggaaacaccagcaggttgttacttnctaagccaacaaaagctgggcattaggatggcagttagcacagtgcagtggacagatggt

SEQ ID NO: 34061 - DNA, 121 bp, Artificial Sequence
  Synthesized
  misc_feature (61): n=t or c
caaaggtttctggtagcagattctgctaaaatctggtggtctggagatgaagaggtttggncttctttgttctaataaatttctatagccaagttgtctctttgcattgtaatcatctgca

SEQ ID NO: 34062 - DNA, 121 bp, Artificial Sequence
  Synthesized
  misc_feature (61): n=t or c
gcgctgtgttgtgttattgctgcccattgtgtgggctgtgctgtgtccttaacagcggtgnctgagaggagtgctgctcccataggaacccatttctgaagactttgagcagttcgggatg

SEQ ID NO: 34063 - DNA, 121 bp, Artificial Sequence
  Synthesized
  misc_feature (61): n=t or c
tttccaatacactggctaaaagatgtttaattgaaagccttttaaatagtgatacaagggnggtgaaacctctccccccttaggcctttgtggagggcaagtttaggctgctggatattga

SEQ ID NO: 34064 - DNA, 121 bp, Artificial Sequence
  Synthesized
  misc_feature (61): n=t or c
acggcattcaaattcaagcatagaaaagttttgttaataactgtgcttggatcacctaagntttaaagctgtagttttctcaaggccagcaaacgcactatttatactgcagcctgaaaag

SEQ ID NO: 34065 - DNA, 121 bp, Artificial Sequence
  Synthesized
  misc_feature (61): n=a or g
cacaatgctatcagcaattgacacgtgcataaaatctgttttgtgagaatatttactattntttgcaatgtgaaccagagcaggatgataacattttaaattgctaaaacaattcacttga

SEQ ID NO: 34066 - DNA, 121 bp, Artificial Sequence
  Synthesized
  misc_feature (61): n=t or c
tatccttgctctctcttttagtagaactcactactgaagccctgatggtgaaattttggtncacactgtcttccccttgaagtatcacagttcacttcccagtcccaagaagtgtattgtg

SEQ ID NO: 34067 - DNA, 121 bp, Artificial Sequence
  Synthesized
  misc_feature (61): n=a or g
aagtcccagcactaaggacaaatctgtgtttaggaatgtagtttatttagaagctttcacncaattcttttatccttgggaggtggaaatgacacgatgaagatgcttgtgtgactggcat

SEQ ID NO: 34068 - DNA, 121 bp, Artificial Sequence
  Synthesized
  misc_feature (61): n=t or c
tatgtagttcagtattcaagtttctttgttttgtttcctatagaacctttgtggtatgctnctgcccaaggcttgctaaagggcataggcacttaaagttaagcatgtctttttgaaaggt

SEQ ID NO: 34069 - DNA, 121 bp, Artificial Sequence
  Synthesized
  misc_feature (61): n=t or c
accttctaatgaagacttgtagatacctaaggatataactttaagtgtcccataaaaacanttgaaagtgcccattgctgttgatgaatttctgtacgccatgcatgacacagaaaaacaa

SEQ ID NO: 34070 - DNA, 121 bp, Artificial Sequence
  Synthesized
  misc_feature (61): n=t or c
cttttgacaagcctgatcacaaaggtttagtctgcttttatttacatcacacctcatttcngcagattttaaaccacgtatttatgccaacacttgaaagttactacacagaactgctcag

SEQ ID NO: 34071 - DNA, 121 bp, Artificial Sequence
  Synthesized
  misc_feature (61): n=t or c
agcattctgttgtcgttacccccttactccattggatgccacgagctgggctttgcatctngtccctgaagaaggacagcatcccagtgcccgccctggcccgctgctggtgtactgagtg

SEQ ID NO: 34072 - DNA, 121 bp, Artificial Sequence
  Synthesized
  misc_feature (61): n=a or t
tgaggttgcagcattcttctggtgacttactgcattgctgcaccatcctgatttgaaagcntttcctaaagctccctgctatttgagtgcctctctcccttttgtatctgctgagaacaca

SEQ ID NO: 34073 - DNA, 121 bp, Artificial Sequence
  Synthesized
  misc_feature (61): n=a or c
catccaacacactgtctttaagcaaacaacttagggcagcttacctaaatatttgtagtgnactacatcacctgctgattggaagaaaattgggaagtacttacattgccctagatccttc

SEQ ID NO: 34074 - DNA, 121 bp, Artificial Sequence
  Synthesized
  misc_feature (61): n=t or c
gctggaagcagaaacactgtgtgcttgctgccacccctgtgaaatactcattttgacctcngtgctcttcccctgtttccaacctcaaccagaacgttgcgtgctggagtgggcttaaagg

SEQ ID NO: 34075 - DNA, 121 bp, Artificial Sequence
  Synthesized
  misc_feature (61): n=a or g
taaggcacagggctttggggatgaggatcctgctctcgatcctgcctgaagctcacttagntgctaagaagaggtttgattctgactgtaaaacctgcctgagatgtctggtgctgtgcaa

SEQ ID NO: 34076 - DNA, 121 bp, Artificial Sequence
  Synthesized
  misc_feature (61): n=a or g
gcagctaaaactaagtcgaataaacaggctgtaattcaaaactaggtcactaggtggtatntaaccaggactctgagataggcaagcggcgattagtgcaatgtaatcatctatgcaaggt

SEQ ID NO: 34077 - DNA, 121 bp, Artificial Sequence
  Synthesized
  misc_feature (61): n=a or g
ctgaggtgtaagtgtgcactgaagtcagtgggagaagagtgatgcatgctgctggttcccngttctcccacagatgttctggatgcccttgggtgtcgcgcttacagcgctgtctgcctca

SEQ ID NO: 34078 - DNA, 121 bp, Artificial Sequence
  Synthesized
  misc_feature (61): n=t or c
gcaggcaatgcttgggaattaaaaccatcctttccaacagctgtgcctctttgttaccaangtgagtattagaggaactgtgggagggagctgaagactgaccagaggagcacatctgctg

SEQ ID NO: 34079 - DNA, 121 bp, Artificial Sequence
  Synthesized
  misc_feature (61): n=t or c
ctgcatgatgaaaatctgtactagttacgtgcatctctggtatctgtagaatgatatttcnaggggtgtttgaaccacatgtatactgtctgcagggtttccactagtttttcgctgagtt

SEQ ID NO: 34080 - DNA, 121 bp, Artificial Sequence
  Synthesized
  misc_feature (61): n=c or g
attcctttctttgcgttaacttaactgttttacagctcgttgctgctggaaatggtggagntggagaattccagacatcagtcacacctcggcaatctctgactaatggacagtggcatac

SEQ ID NO: 34081 - DNA, 121 bp, Artificial Sequence
  Synthesized
  misc_feature (61): n=t or c
agacttgcagggctgaatgtccaagtacaaaaccttccagtactgatacctccttcatttncttttggactaccagtgaatacccctgtgcacattggatgcgtatctctctcctgtttat

SEQ ID NO: 34082 - DNA, 121 bp, Artificial Sequence
  Synthesized
  misc_feature (61): n=a or g
caaaagataacagctgtattcacaagtgattgtgtgactgtcattctgtgaaattggatanagaacgtgtgtcatttggggccaaactgatataaacattagctagcctgcagcagagaga

SEQ ID NO: 34083 - DNA, 121 bp, Artificial Sequence
  Synthesized
  misc_feature (61): n=c or g
gagtatggcatagaaacaagcaaacctaagaaggagaggctcatgagtgtccagattttgntaagcatgaaatcccacatacttactggaaacctgtggcatttagtttcactttcaattg

SEQ ID NO: 34084 - DNA, 121 bp, Artificial Sequence
  Synthesized
  misc_feature (61): n=a or g
ttgcatccagtttgttactggaaaaagagtgtaacttgtaaaactcattctaaaccatacntgtacttccatctatctggaaaaagagaataaaacattctaaagttcttgcttgaccatt

SEQ ID NO: 34085 - DNA, 121 bp, Artificial Sequence
  Synthesized
  misc_feature (61): n=a or g
ttcatgcaactcatttactagaccatttgaaggtcttccttttacaggctgaaaagctcantataattttttcatgagataataaaaaggagttcggaaagctatgaatcacttctgaaag

SEQ ID NO: 34086 - DNA, 121 bp, Artificial Sequence
  Synthesized
  misc_feature (61): n=a or t
atttttcataaactgctgaatttaataagttgttataaactaagtgaatcaactataacancataagtacggttgtatgaggaacataagctacattctgatgagataaactaaatcagta

SEQ ID NO: 34087 - DNA, 121 bp, Artificial Sequence
  Synthesized
  misc_feature (61): n=a or g
cctagcagagctttttcattctgctctcagctgttctcaaagagaacccaacaggtggctnctggagactcaaagtggtgtggctagttgtccttgctggacgcagcatgctacagcagca

SEQ ID NO: 34088 - DNA, 121 bp, Artificial Sequence
  Synthesized
  misc_feature (61): n=t or c
tgtgcctccaacaggtggtggtgctgggggggctggtggaggagcagacacaggttgacantgggatgcactgttggatactatgctggcttcaggagactgatctgcttgagatgttacg

SEQ ID NO: 34089 - DNA, 121 bp, Artificial Sequence
  Synthesized
  misc_feature (61): n=a or g
aggaatcagagtagatgtagatctcaaacatttaattttctgtaaactcacctgtaaaccntattttacccgtatttgttttaatgcttttcttctgactagctctctctcttctttgcta

SEQ ID NO: 34090 - DNA, 121 bp, Artificial Sequence
  Synthesized
  misc_feature (61): n=a or g
aagatcacctagtccaaccccaccccatccccatcatgaccattaatcatgtccctcacantgttagctgcattcacagtgtccatcgctggagaagatttgttcctgggaccttccttcc

SEQ ID NO: 34091 - DNA, 121 bp, Artificial Sequence
  Synthesized
  misc_feature (61): n=t or c
tgggcaatgcctgtgataccagcaagcagaacgctgcccgtgttatgcatggagatggcangtgtggtccgtcagcactgatggccttttgaatggcacctgctgagggtcagcctgcaga

SEQ ID NO: 34092 - DNA, 121 bp, Artificial Sequence
  Synthesized
  misc_feature (61): n=t or c
gttagaaccaaacctctctttatattgctgttggcttattcacaattctgcaaaattacantgaaaccttcattggaaaaccatcatagccccaacttttgactcttcttaaggccccagc

SEQ ID NO: 34093 - DNA, 121 bp, Artificial Sequence
  Synthesized
  misc_feature (61): n=t or c
gacatggttcactcccttttagttgtgtgtctcaccctacactggtgatggagacactttnagcctcctgctaccaaaactgctgtctggaagccgtgctgtggcacaatgagtgttgcag

SEQ ID NO: 34094 - DNA, 121 bp, Artificial Sequence
  Synthesized
  misc_feature (61): n=t or c
ctgccttccggatttaaactacaacacatggacagaagggtctagtagttctctgagggcnctgacacttctgacacttccaaaatgtttatcacacaatgtctttaaaactaaaaaaaat

SEQ ID NO: 34095 - DNA, 121 bp, Artificial Sequence
  Synthesized
  misc_feature (61): n=a or g
aagcacagaggcaggcctgtcgccccattacgcatggagcctcttaatgcagttaaggaangctttgtttaagcaccagtaaattgccccgagcagcctgtcctttgaatgcctataaaac

SEQ ID NO: 34096 - DNA, 121 bp, Artificial Sequence
  Synthesized
  misc_feature (61): n=t or c
caggtactattaaaggaggagcagagtttcatcaatgtctgcattacaaggcaggttcatngggaagcacacggtgcacccactggtttgtgagctgtaaccttgagagcaatcctgccct

SEQ ID NO: 34097 - DNA, 121 bp, Artificial Sequence
  Synthesized
  misc_feature (61): n=t or c
aaagaaagaaaagtagtaaaggtcataccagatgctgttccttatacaatatacttatatngatgaggcagtgaagctaaaggttacatctgggaattcagcaggagaacttttcagctgc

SEQ ID NO: 34098 - DNA, 121 bp, Artificial Sequence
  Synthesized
  misc_feature (61): n=t or c
cattcatctatccgggagcagcagttggtagctgttgtgatttaacccagcaaagttcaanaccatacagccttttgctcactctcacccctcccattgtgatggggaaaatagaaaaaaa

SEQ ID NO: 34099 - DNA, 121 bp, Artificial Sequence
  Synthesized
  misc_feature (61): n=c or g
atcacccagaaagaatttccatttccataccagttaagtcattagaacaaaaatgtcatgncagattagtgagaaataacctcccttcccatcacacctttgctggacagtgctggagtgt

SEQ ID NO: 34100 - DNA, 121 bp, Artificial Sequence
  Synthesized
  misc_feature (61): n=t or c
acaagcattttagctggatatttttattacacagctacctgaggattcattttttaatgantctacaggtcttgcttactcaaaattaagttggagaccaagttgctcacagaggaagaga

SEQ ID NO: 34101 - DNA, 121 bp, Artificial Sequence
  Synthesized
  misc_feature (61): n=t or c
atcaaaacaatgtgcactgaaaacagagcacaagagaaagagtattagctgtaatataagngtggggattgcagcatgttttttttgctgagatttggagggacttataactggaagtgga

SEQ ID NO: 34102 - DNA, 121 bp, Artificial Sequence
  Synthesized
  misc_feature (61): n=a or g
cttgttgtgactccaccaactgctacttgtgcacttcatcccttctgttgcattttcactncctctagtgagagggcacctacactaagtggggttttaacccagcatgtttctgtataaa

SEQ ID NO: 34103 - DNA, 121 bp, Artificial Sequence
  Synthesized
  misc_feature (61): n=c or g
aacacttttaagatcaaatacagtgcattttactcatttaagtaaatctcctaaatcaagnggattaattggatgaatacactgagaaggatttggcagttttgtgaacttgctagttatg

SEQ ID NO: 34104 - DNA, 121 bp, Artificial Sequence
  Synthesized
  misc_feature (61): n=t or c
tgaaaacgtgccaggaagaggctgttttgttcatcaaatatttataccaacaggcaacttnattcagagcccagtcatacattttcagggagtcaccgagacattattagagtcttggcac

SEQ ID NO: 34105 - DNA, 121 bp, Artificial Sequence
  Synthesized
  misc_feature (61): n=t or c
aatacagctaagagaaatcctatcttcagagtggattagtgacctaacagctgttttctangagatgctttcagacccaataaggaccagtttagcactcaggacaaatggaaattttccc

SEQ ID NO: 34106 - DNA, 121 bp, Artificial Sequence
  Synthesized
  misc_feature (61): n=t or c
gacctggttgtcttgatataagggtgaaagagtgaagagccacttttctatctgaaattanattttgtttttccagagacaggtatcatctttctccactattcttaaaattgtatttctt

SEQ ID NO: 34107 - DNA, 121 bp, Artificial Sequence
  Synthesized
  misc_feature (61): n=t or c
gaatgaaggtcttctgcactgtagcgtctacgtttcttccaaggtaggctctttcccaaangataaggcttctaaaactggtttccttaaaccccatttgataccactggacagcaatgca

SEQ ID NO: 34108 - DNA, 121 bp, Artificial Sequence
  Synthesized
  misc_feature (61): n=a or g
gtaaaaatcaagcagtataattccatctaaggcataaaagaacatggaaagtgaatatggngaaagaatttagaaaacacagtaatgtattttgcttatcatttacgtaacagtacaagta

SEQ ID NO: 34109 - DNA, 121 bp, Artificial Sequence
  Synthesized
  misc_feature (61): n=a or g
caatgcccctataggaggtggagtgcctctagcactgaggtgatggaatgcagcgccctcntttcattaggctacagttcccttatggagggagagcaagtgataggattcaatgatcctt

SEQ ID NO: 34110 - DNA, 121 bp, Artificial Sequence
  Synthesized
  misc_feature (61): n=t or c
ttagggcaatgctactagttagactgtttctgaatcaaactgttgtttctgcaatatcgangtcttcactgactcaagatgtagacgtgaaattatcccctgcacactgtcagtgaccttt

SEQ ID NO: 34111 - DNA, 121 bp, Artificial Sequence
  Synthesized
  misc_feature (61): n=t or c
ctggtacctacagccatttgtaagtcatataagtaagatacagaatgaaataagagatggnagacagcaaaggtaggaaaaatagatcttcttgatctcaaacatatttgaactaatgtct

SEQ ID NO: 34112 - DNA, 121 bp, Artificial Sequence
  Synthesized
  misc_feature (61): n=a or g
gcctcagcggggtgttgtgcactgcagaggcatcttccatcctcagtgagaattaaacccnattgttctaagctcagaacagatgcaggagctcatgacaaggagaagtaaaagccccaca

SEQ ID NO: 34113 - DNA, 121 bp, Artificial Sequence
  Synthesized
  misc_feature (61): n=a or c
atggaaaatggggccatatataggaaggttatcgcaatgtcgctactacaggaaagcaagnatcttctaaacaaagagtgaactaaacactgtcagactcagcagagacatttgtaaagct

SEQ ID NO: 34114 - DNA, 121 bp, Artificial Sequence
  Synthesized
  misc_feature (61): n=a or g
gtgatctcagattttctatcgtaagaagggagaagcagtgctgtaatctgctctgacattnaggtaatagagtgtaagacctgatccagtcgtcagtatatctttgttgatgcagctatgt

SEQ ID NO: 34115 - DNA, 121 bp, Artificial Sequence
  Synthesized
  misc_feature (61): n=a or t
tccgggaccacgagcaaagcccgggtttggttttgggaggccatagtagaggaagggcacncttctgccctctaaaggaggagcagtcagtgctgtcacgccaagtgcacactcagctgtg

SEQ ID NO: 34116 - DNA, 121 bp, Artificial Sequence
  Synthesized
  misc_feature (61): n=a or g
cttcctgttgaattacccattgtcagacctctcctgcacggttaccattccctcttcttanctctgtttaaatgacagttgaaatctattttttgcattaggatacaaaaggtcatgacct

SEQ ID NO: 34117 - DNA, 121 bp, Artificial Sequence
  Synthesized
  misc_feature (61): n=a or g
tgtgttgctaccagtgacatgtaagacaatactctctaagcctgtggtggagcacttggcnggtgattttagactgaggtatcttaaatttgatccataaccttatctggcctactcttaa

SEQ ID NO: 34118 - DNA, 121 bp, Artificial Sequence
  Synthesized
  misc_feature (61): n=a or g
aagacatcaggttacttgtttcttatattcaaactatctccactcagttcatgatgggtantagcctaagaagggtatgatggatttaagtggctctgggtagctattttcatcatctttt

SEQ ID NO: 34119 - DNA, 121 bp, Artificial Sequence
  Synthesized
  misc_feature (61): n=t or c
gatggaagttcagcaagcaaagactcagccacctagtatttgtagtctttttgcaaaccangagagatctccacgcaaatattttttcctgttaatgagtatcaaatgcttctctcacagg

SEQ ID NO: 34120 - DNA, 121 bp, Artificial Sequence
  Synthesized
  misc_feature (61): n=a or t
ggagttacttgagacaatctctgaggagaccataaagtattagacatgaaacctttacagntttttattctcctattaagacatatttggaacaaccatgaggccacagctaccgtgacct

SEQ ID NO: 34121 - DNA, 121 bp, Artificial Sequence
  Synthesized
  misc_feature (61): n=a or g
actccactggcaaacacagcacaggctttaccctgacataagggctgccacggctcaaggngtaggaaaatgagcactgcagtatctacacatctcagcacagcattaacattcatctcat

SEQ ID NO: 34122 - DNA, 121 bp, Artificial Sequence
  Synthesized
  misc_feature (61): n=a or c
tctggcagaaataaagatgttggttcatctgcagttgaaaccttggagtattaaacacatntgggtataaaatgtctttttctatgactaaatattaccaggttttatccccttttctgtg

SEQ ID NO: 34123 - DNA, 121 bp, Artificial Sequence
  Synthesized
  misc_feature (61): n=t or c
caaatgtgtggggctagagaagaggctatatctgaagagaaacaggtttgttgagcagaangcattaatgcaaattcagagaattgtttaggctggaaggggtctcttgggatgatgtagt

SEQ ID NO: 34124 - DNA, 121 bp, Artificial Sequence
  Synthesized
  misc_feature (61): n=a or g
gcctttctgtgctggagcatttcagctcgagaagaaggtcattgcttcttcagtcccactntgggaagagtttggtcaagaagacaaaatagcatcactgggatgactggggacgtacgta

SEQ ID NO: 34125 - DNA, 121 bp, Artificial Sequence
  Synthesized
  misc_feature (61): n=t or c
cactcccctcgagaaatcccctgaagtgctgtaaaaccaggacgctgcaattagacgctcngcggatgccagaggacatccagttatctgagcaatgctgctgagccaactgctcctgccc

SEQ ID NO: 34126 - DNA, 121 bp, Artificial Sequence
  Synthesized
  misc_feature (61): n=a or c
ccccggaggctgctgcggggttccgctgcgccttttgttccgtatcccgccgatataaccngcgctgcaggctcccaaaagaaccaggaacgccgctactaacgcaaataccgtgagttct

SEQ ID NO: 34127 - DNA, 121 bp, Artificial Sequence
  Synthesized
  misc_feature (61): n=a or t
gctttatacaaaatagtaagaagagaggtactaagttaaaaacagctgagctcccatggcncaggcagtccatcagctgaatcacaataattgaccacgagcgtgttcttagcatgcccca

SEQ ID NO: 34128 - DNA, 121 bp, Artificial Sequence
  Synthesized
  misc_feature (61): n=t or c
tgtcggaggagtgggatttgtggtgactgggatttttgaagcaggtctaaatcctgctggnttgcaaagagagtaaattctaaagggtcacaaatgctgataccacttgggagcttctgcc

SEQ ID NO: 34129 - DNA, 121 bp, Artificial Sequence
  Synthesized
  misc_feature (61): n=t or c
tctcaccctaatagtcagagatcagaaagctgggtagaagcctcctctcttatatgttagnatttctgcttggctttattggtgacgaagggcctgacccacaacctggtgaagcctgtgg

SEQ ID NO: 34130 - DNA, 121 bp, Artificial Sequence
  Synthesized
  misc_feature (61): n=a or g
agcaatctttaagatcaacttcataagtaaacagtagaaaaatcctcatgggaatctaacntggcattaaaaaacaccacaacttcagaagaaatacattaactgaagtttgggttagggt

SEQ ID NO: 34131 - DNA, 121 bp, Artificial Sequence
  Synthesized
  misc_feature (61): n=a or g
agtgaccagaggcagtgaacagacacaggaaagctgacatcactggctcctgcatagccantgattaaatgacaagaggttaaagctttgcacacgaagacacaccacacaagaaaagaga

SEQ ID NO: 34132 - DNA, 121 bp, Artificial Sequence
  Synthesized
  misc_feature (61): n=t or g
gcaaattcctcagtgctgaaaaccatcagaaagaagtgaagcatctcccaaagcctgtccntggtggcaaaactcttgtttcttgtcagcttcacaccttgctgttgttagaacaagacca

SEQ ID NO: 34133 - DNA, 121 bp, Artificial Sequence
  Synthesized
  misc_feature (61): n=a or g
tacaggagcttttgtcttttgaagtacagtaggcacacaaatcccattattttctaatagnattttacacacacctttccctcaccagtttgaaactcatttgagctgctcatacagtttg

SEQ ID NO: 34134 - DNA, 121 bp, Artificial Sequence
  Synthesized
  misc_feature (61): n=a or g
ggtgcacctcatctggccttgctgaggattatgtagtcccatttctcaactctgcatgtanatatcattccttccatctatcatgtcaagcataccactcagcttgctgtcatctgcaaac

SEQ ID NO: 34135 - DNA, 121 bp, Artificial Sequence
  Synthesized
  misc_feature (61): n=a or g
ggctagcaaatatccaaaataatatttgagtagggaaaagcagaactgcaggggaagacgncatcaaaaaggggctttgtgttctgcaactttcattttgtctagctaaccatttatatag

SEQ ID NO: 34136 - DNA, 121 bp, Artificial Sequence
  Synthesized
  misc_feature (61): n=t or g
tcaaaataacggaaagtacataaagtaatgtaagaaggtaataggtagctatgtcagaaanacagcacttcagagtatggcagaactgctgaaacaacttcatgtccacctttaattctca

SEQ ID NO: 34137 - DNA, 121 bp, Artificial Sequence
  Synthesized
  misc_feature (61): n=t or g
tatttcatgctggatctgttgcaagatggatagaaggattcagaatctgttataagaaggnaatcattggttagcacaattaaattacgaatgacatagattatgacaactgatacaaaga

SEQ ID NO: 34138 - DNA, 121 bp, Artificial Sequence
  Synthesized
  misc_feature (61): n=t or c
cttttcacaacccaaagatttacagcatcccacacccaaggcaggtaacttctctgatggntaccagtcttcatttgaaaaataaaaccaacaacaaaactaagaaagttattcacagcat

SEQ ID NO: 34139 - DNA, 121 bp, Artificial Sequence
  Synthesized
  misc_feature (61): n=a or g
tagtttatgaatgaatgttttcttagactgcttgagttaagagagattagctacgtaacantaggtcactcctcaatatatctaattttgaatctgttaaagtctagctttcaaacaactt

SEQ ID NO: 34140 - DNA, 121 bp, Artificial Sequence
  Synthesized
  misc_feature (61): n=a or g
tttgtaaaataggttacaggtattgtcagaggatggataaatacatgttgtaagcaaaatncctaatgccctagtaagcaagtcagtaaaaaactaaaaatgtggttatctgttagcaaac

SEQ ID NO: 34141 - DNA, 121 bp, Artificial Sequence
  Synthesized
  misc_feature (61): n=t or c
tgtgtggggcattagaagaagtttaacagtagggtagcattcactggtggcacggagatanttggttgcttcaggtgcggtgcgtaatgaggaactctctcaatttctgcctcctttctaa

SEQ ID NO: 34142 - DNA, 121 bp, Artificial Sequence
  Synthesized
  misc_feature (61): n=a or g
gtattttgaaaagttcactgatatgactaataactaagtgaaatcattttctattgcaatnttagtcttggtgcacttttaccttatttctctgatggcatgctacgttacagaacactgt

SEQ ID NO: 34143 - DNA, 121 bp, Artificial Sequence
  Synthesized
  misc_feature (61): n=a or g
gaccgcattctaagctatgccggactgtgggttggtggatatgcctgagaaagggaaaaanccctgagaggcctctcagttctgctctgaaatgtgtgttctgtgcttagagaaaaaagac

SEQ ID NO: 34144 - DNA, 121 bp, Artificial Sequence
  Synthesized
  misc_feature (61): n=c or g
gaaggtcagatttgagaggctactaatggattagcctttggatcttttttctttgacttanatgcatttaagcctctagcatttctaaaatggcaaatgcaagagtaacttactgaatgag

SEQ ID NO: 34145 - DNA, 121 bp, Artificial Sequence
  Synthesized
  misc_feature (61): n=a or g
cctcatgtaatccaaaaatggaaccaaaatggaacaaaaatgtaatcgggacttaaagatnaaaagctgtcagcagctggacatgcacacttcagtgaataaaggaaacgttccacatcag

SEQ ID NO: 34146 - DNA, 121 bp, Artificial Sequence
  Synthesized
  misc_feature (61): n=a or g
atggcctttagcaacttccttgcctcctctttgctttgaagttctttgggtaaagacagtnaacctcctccctcctcactccagtgaatttagattgcctaaattagtcttcaggtgccta

SEQ ID NO: 34147 - DNA, 121 bp, Artificial Sequence
  Synthesized
  misc_feature (61): n=t or c
tactagaagaccggtaacatttccctgtgcctcatggatgcacacaagcagccaggactcnttgcaagctgatggcaagccaaaaaagacagtacgatttgagaggctacaaaacttgttg

SEQ ID NO: 34148 - DNA, 121 bp, Artificial Sequence
  Synthesized
  misc_feature (61): n=t or c
atgaagttctattcagtcacatgaaggacaaggagaaaggagagcaagccagcagatgaanatgggtgaaacagagagcaatgtgggaaacgggggtgtacagtgaggcacaactcagctt

SEQ ID NO: 34149 - DNA, 121 bp, Artificial Sequence
  Synthesized
  misc_feature (61): n=a or g
ccaaaatgttgtttttacaaagccataactgacagatttgtagtgtttgaatgctaattcngatgtttccaatttgttatttaacccttttctttttccagaggagaagtacaaagtggaa

SEQ ID NO: 34150 - DNA, 121 bp, Artificial Sequence
  Synthesized
  misc_feature (61): n=a or g
gctttggccaaagtctcttagccccaactagcacaagcagcagcacatgttctgagcagcnttcagctgaccatatccctggactgcagttagcagcacagagaaatgctgcttacttaca

SEQ ID NO: 34151 - DNA, 121 bp, Artificial Sequence
  Synthesized
  misc_feature (61): n=t or c
atgaagcgttcgcatttctcctgggtttttcagtaaaaaaatcattcttccaggaggaatnatcaaggattccacggagaaagatttggccaaaacccctctgtaaaaggcctgccagcag

SEQ ID NO: 34152 - DNA, 121 bp, Artificial Sequence
  Synthesized
  misc_feature (61): n=a or t
gtcagtcaagcacttaaatccaacatgttgaggcatttgtctctattcctgttgcacaagntacagtcagcaaataatggacgtttttcttctttgcaacacttctagtgctctgagaagt

SEQ ID NO: 34153 - DNA, 121 bp, Artificial Sequence
  Synthesized
  misc_feature (61): n=a or c
atcacaggttcgtctcgcactcaggattgctgcaagcacggtctagacaaaggctcttggnaaaccattgctcagcaccctcaacagagatcagctccttctgcagtgcagaggcaaagag

SEQ ID NO: 34154 - DNA, 121 bp, Artificial Sequence
  Synthesized
  misc_feature (61): n=t or c
tgcattcaagcaggttttaccccatgatgcttgacatgtctcatttttcaacttagaaganggtggtaatgtccattttcattcagagaacatttctctttaaaatagcatttttaatgca

SEQ ID NO: 34155 - DNA, 121 bp, Artificial Sequence
  Synthesized
  misc_feature (61): n=a or c
gccagtgttattcattcttgaccataccttcttgagctgagttgaaaatcccctaaactantattttgatcatcagttttgcttgttttgttttttattgtcacttaagctactttttctg

SEQ ID NO: 34156 - DNA, 121 bp, Artificial Sequence
  Synthesized
  misc_feature (61): n=a or g
gagaaatacttttcatttttgcccttatatctggaaaatatacttaaacgaactcttcctntttagagataagcttcctcattattccttgacttagaagtcaaatataacattcaggttt

SEQ ID NO: 34157 - DNA, 121 bp, Artificial Sequence
  Synthesized
  misc_feature (61): n=c or g
caggcacatctcaatgaactgatactaaatgtaatggtaacttaatgtacaaaaaccagantataaacactggacctagaagactgggagtcataaagcagatattagcagcaaaatgagg

SEQ ID NO: 34158 - DNA, 121 bp, Artificial Sequence
  Synthesized
  misc_feature (61): n=a or g
ttgaacttacagtgcatcacatgaggtaacttaaagtgtcacccgaatgattgtgaggctntactgtgtgacatttggaattgagaaggttgaagatgcatggctgatttttttcttttcc

SEQ ID NO: 34159 - DNA, 121 bp, Artificial Sequence
  Synthesized
  misc_feature (61): n=c or g
ggaacgctgtgattctcttcaatatgataatgaactctacacttctgtaagctcatatgtncaagtacctctaagctgaagcagtctgcaattaagtagtattgcagttctaagaaagaag

SEQ ID NO: 34160 - DNA, 121 bp, Artificial Sequence
  Synthesized
  misc_feature (61): n=t or c
tgaacagggggagaattgaagaggaagcaagaatcagaaacagtaaaactttcataaatgncagttcagttcttcagtattttaacaatggagcatgcgcacaccatgtactgtacacata

SEQ ID NO: 34161 - DNA, 121 bp, Artificial Sequence
  Synthesized
  misc_feature (61): n=c or g
ctctcctacacagcaggtaagggagttggagatgagactgcagaacacattgctctttgangtctgatctaacctgggaacccaagccacttttggaaaaagactgccactatgctaagtc

SEQ ID NO: 34162 - DNA, 121 bp, Artificial Sequence
  Synthesized
  misc_feature (61): n=a or g
agggaagggggtggggaaaggctaaaagcaaacacaaacgacgcttgcttccctccgaacncacagaacctcttcctcccaaacattaagagggaacatttccttttaggacaactgcagg

SEQ ID NO: 34163 - DNA, 121 bp, Artificial Sequence
  Synthesized
  misc_feature (61): n=a or g
ttgtgcgtgctctgtgctaatagcttccaagcaggggaaagaggagatgtgctccttgtantgttaaacgtggccggccaaggagaaaggagcattttgtttgtaaacagcagcacacagt

SEQ ID NO: 34164 - DNA, 121 bp, Artificial Sequence
  Synthesized
  misc_feature (61): n=t or c
ctctggtttcacaccggcgtattacaaacggctgttactggcaacgtgatggtactgaaanctgcttggatggagagcgaggagttatcccacttgtgagcagccagagtatccttgtgct

SEQ ID NO: 34165 - DNA, 121 bp, Artificial Sequence
  Synthesized
  misc_feature (61): n=a or g
ctaatctttatttggttctgcattcctaagagacaacttaggtttgacatgccgctttcanttagaaggtcagacttaattgtctatctgatgggcagaggagtgcccaagtactgtttca

SEQ ID NO: 34166 - DNA, 121 bp, Artificial Sequence
  Synthesized
  misc_feature (61): n=t or g
ggcttcacctcatcaggctcaagggcaggaagaaagggcacagaaggaggagggaaatgancagtcaattaggcagtcgcctacaaatatctgcatgtatgaaaccaactattgggcttgt

SEQ ID NO: 34167 - DNA, 121 bp, Artificial Sequence
  Synthesized
  misc_feature (61): n=c or g
cgcttgcttgctctgcccccctccagaggccgtgggctgacacatggagaactggggaatntacactaacctgctctctgctgtgacaatgatcctacagttgtttctgagaacaggcagg

SEQ ID NO: 34168 - DNA, 121 bp, Artificial Sequence
  Synthesized
  misc_feature (61): n=t or c
gaaccaaccagtgcaatactcacttcaatattctacatctttatccttaatcattcatctnctgctcagaccaactgagaacagctgacgatggcactgtgtgaaagctctatgaaagctg

SEQ ID NO: 34169 - DNA, 121 bp, Artificial Sequence
  Synthesized
  misc_feature (61): n=a or c
ctatggcattaatcaataaaaatagtgagtaatttccccccagggagaaacattctgtacnttttcattttatttctttgggagttgataggagctgagggaaaaggcactgacttctctt

SEQ ID NO: 34170 - DNA, 121 bp, Artificial Sequence
  Synthesized
  misc_feature (61): n=t or c
ttctccagatgtggaaaaaaatttcttttttggatcctgtggtccctatcagtgaagacanttgtccttgtttcccataacctcctggctcttgttgagtagccttctcttacagctctcc

SEQ ID NO: 34171 - DNA, 121 bp, Artificial Sequence
  Synthesized
  misc_feature (61): n=a or c
acctcccttctatcactctcacaaaacctttgctagcagcatgactaaggacaagggttcntctttgacacagttttttggaaaagaggtatcaactctcttctggtcctttttctcacca

SEQ ID NO: 34172 - DNA, 121 bp, Artificial Sequence
  Synthesized
  misc_feature (61): n=t or c
acataactgccttctccaccataaccattagcactattaccatgggtaagtgcctaggacncaatttaaataacacaccctttttcaggcttcccaagcataatctcaaagagcttcaatt

SEQ ID NO: 34173 - DNA, 121 bp, Artificial Sequence
  Synthesized
  misc_feature (61): n=t or c
aaatgcagcaataccagagcttgcataattcccacaggagttcaggcctgtctcacatccntctctttggaagggcttggcactgggcacagcatagccagcacagtaacacatgcactgg

SEQ ID NO: 34174 - DNA, 121 bp, Artificial Sequence
  Synthesized
  misc_feature (61): n=c or g
tatgagaataattctgcaggcagctgtggtgatgtggtgtttccctgtatgtgctgagcanatcgctgcttctgtattggttcggctgtgcattgcaatgctgatgtgaggtgctacatac

SEQ ID NO: 34175 - DNA, 121 bp, Artificial Sequence
  Synthesized
  misc_feature (61): n=t or c
ttgtggctactgactgttgcttctgtttgataagggagaacttacagcagccagacataanaaaaacctcttttactaggtttggctttttgagaagttgtggattttgtgtatgtagaaa

SEQ ID NO: 34176 - DNA, 121 bp, Artificial Sequence
  Synthesized
  misc_feature (61): n=t or c
gcctgttacacgagatttgttcacagggacactatgctttagtactctattaataggagtncaagattaaatctggtaaccttcgaactagtggcacatgatatgctgttgtgaagtgtaa

SEQ ID NO: 34177 - DNA, 121 bp, Artificial Sequence
  Synthesized
  misc_feature (61): n=a or g
agtgatgactatgacacttgggatatgattcaaaaggcaatttatgagagtgtgcatgtangattagcagtttgcaagtgaaaggtgggttgcaaaactactgagagagggcccttaatac

SEQ ID NO: 34178 - DNA, 121 bp, Artificial Sequence
  Synthesized
  misc_feature (61): n=t or c
tcctcactgcctttgtcaggccacagactgttctcgcaggtgttgaggtgtgatgattcanagtcagagtatacattattgtcacgttcactatatgatcaccactatagccatacccaat

SEQ ID NO: 34179 - DNA, 121 bp, Artificial Sequence
  Synthesized
  misc_feature (61): n=t or c
aacatgaaatattaggagtttctttgccccttcatgttcaaacagctgatagagtgactcngatgtgaaaatgacaccaccagctagctacatcaggagtcacaattttgcacagagaaac

SEQ ID NO: 34180 - DNA, 121 bp, Artificial Sequence
  Synthesized
  misc_feature (61): n=t or c
agggaagagaattacctaaggacagggttagcctgtttgatcaatgcataatcagataacngctccagcttttttacaagtctttaagcaaagatcagccactcaaattctaattcctttt

SEQ ID NO: 34181 - DNA, 121 bp, Artificial Sequence
  Synthesized
  misc_feature (61): n=a or g
ctgaaaattccaaaggattcattgctgtaaattggtagaaataaggaatatagagaaggantggctgaagaactgcctgttttaggagcttgtattttgtgtgaaatcagtgttctatgca

SEQ ID NO: 34182 - DNA, 121 bp, Artificial Sequence
  Synthesized
  misc_feature (61): n=a or c
ctcaggtatcgttatgcctatttgcacttggcctgctccagaactgttacacgtgtaggangtctgcttcctgcgcacagagtaggagcttgggggtttgcatacatcctaccacctgcga

SEQ ID NO: 34183 - DNA, 121 bp, Artificial Sequence
  Synthesized
  misc_feature (61): n=c or g
aagagatgctatttggcaatagcataaaacttctcttctacagggatggtattaaccatantggtagactggcagactcatggtttgtaagacttcttttaagagaacaactctgtacagt

SEQ ID NO: 34184 - DNA, 121 bp, Artificial Sequence
  Synthesized
  misc_feature (61): n=t or c
aaacatcttcaaagtcttcaagggtactgcaattttttagaagcctaaacataaaagctangtgagcttacctcggataggacccagtgctgcatcctttgctaatgcagttaaatcactt

SEQ ID NO: 34185 - DNA, 121 bp, Artificial Sequence
  Synthesized
  misc_feature (61): n=t or c
gttttttgggtactgaaaagaggttgttgcaggattagagccttgcctttgggagagcagnagtcttattgccaatattgaactggagctgtcaagggaattttgaagcatactttctgga

SEQ ID NO: 34186 - DNA, 121 bp, Artificial Sequence
  Synthesized
  misc_feature (61): n=t or g
atttataaatggtagctaacatattttcccaaaacaaagttgcagtttgttcatttaatgnctggaatttgcaggatattttaggagataggggcatgttctccatacataataagtacaa

SEQ ID NO: 34187 - DNA, 121 bp, Artificial Sequence
  Synthesized
  misc_feature (61): n=t or c
gagtgccctcagctgaaaaaaaaatcaggaaaaacaaattagattaactgaacagctatantgaacctgagcactaacttttgatctaagtaaacttattttaaactggaacaagttaatt

SEQ ID NO: 34188 - DNA, 121 bp, Artificial Sequence
  Synthesized
  misc_feature (61): n=c or g
ctactcagcttgcctgagcagggcctatcttttgtgccgtacccagctaagagatccccanttttaacccaggtaccctgaagctctctaaaacaaatgacaggaaggcaacaccatcttc

SEQ ID NO: 34189 - DNA, 121 bp, Artificial Sequence
  Synthesized
  misc_feature (61): n=a or g
gagaagggaggtggtggcttcttacacccctggctgagccatctgaaatcaattgtgccanactgactttttggaagccacgtagttttagcttttgtagttttggaggtataggtgggac

SEQ ID NO: 34190 - DNA, 121 bp, Artificial Sequence
  Synthesized
  misc_feature (61): n=t or c
ggttttttttaaaaaccatatgcattttaactggtgcatgttagagttatttacaaacacnggtcaaatgtgatgtgtgtttgtttaacctagtttactagctgagttaaaaggcagaact

SEQ ID NO: 34191 - DNA, 121 bp, Artificial Sequence
  Synthesized
  misc_feature (61): n=a or g
agacaactgaatgcagaatatttgaggattgcctcaaaacagtagtatgtctttgttagcncaaagctttgcttgcacacagcgagtttggagagcgggcagagcatgcatgcatttgttt

SEQ ID NO: 34192 - DNA, 121 bp, Artificial Sequence
  Synthesized
  misc_feature (61): n=a or c
atcactggaaatttctaaagctaaaagcactcctcttcctttcatttctccaaagaggtanaaagtcaggactgaaaaaacacattctggaagcagccaaatgagattgcccctgcaggtg

SEQ ID NO: 34193 - DNA, 121 bp, Artificial Sequence
  Synthesized
  misc_feature (61): n=a or g
gtcccatgtgatgtaaatattttgttttcctgctcccatttttcagccaaaggaaatcagnagggactcgagaatcccatacctgccttcatgcttaaatgcaggtgtctcccaccaggct

SEQ ID NO: 34194 - DNA, 121 bp, Artificial Sequence
  Synthesized
  misc_feature (61): n=a or g
ccactgatcagttctcttattcatggaccccatttttgtttttgtaacagtgtttaggtcncaaactcagtaactgaagaacaagcagttgccttcactctggctctgatgcaagtcctga

SEQ ID NO: 34195 - DNA, 121 bp, Artificial Sequence
  Synthesized
  misc_feature (61): n=t or c
aacgaaaacctggcttgcagcagggcaactggagcttaagggctcccagacatgtttttangtaaatcagacgccatgcgttatttgaagacacattttgaaatgtaatttattagcgggt

SEQ ID NO: 34196 - DNA, 121 bp, Artificial Sequence
  Synthesized
  misc_feature (61): n=t or c
tgggtctggaggaagaatcttcaatacatttatgacctcctcagtgtataacacattactncttgataaatattagttatttcttactgaagtcatgttattataaaagaatttcagtaat

SEQ ID NO: 34197 - DNA, 121 bp, Artificial Sequence
  Synthesized
  misc_feature (61): n=c or g
ctcccaagagcagccaggcaggcctctgctaggggacttggggtctccagccctctcctgngcagacacagccagcagaagcttggcctttcccttgaaacaagtggccaagtcactgccc

SEQ ID NO: 34198 - DNA, 121 bp, Artificial Sequence
  Synthesized
  misc_feature (61): n=a or c
aaaacaccaaaaaacagcaagaaatccctaaggtttttgtccctatggacagtggattaanataatttagagcagaaagacaaatgtcagtgatggacaaatgtaccagttgaaaaagatg

SEQ ID NO: 34199 - DNA, 121 bp, Artificial Sequence
  Synthesized
  misc_feature (61): n=t or c
gttgtatgggtttcatttgcggtatccggaattgttctgtgtgacaatctctattcagagnaaaggcagaaaaatgagagggcagtcccaccctccattactgttggtgtcttcaggcaag

SEQ ID NO: 34200 - DNA, 121 bp, Artificial Sequence
  Synthesized
  misc_feature (61): n=a or g
aagtcccagagtatggcaacagctgctatatgcagaggtgttcagaactctttagagaatnaaaaacctaatactgtaaccacatctgatgctcagtcgtgaggtttatctggactaaccc

SEQ ID NO: 34201 - DNA, 121 bp, Artificial Sequence
  Synthesized
  misc_feature (61): n=t or g
taaagagttctatgtcattctgagttctttgtcataaagagctctgtgtcacctcatcacnctgtgttacagttttcacccctcaaaggttagatttatcacctctcagtgggattacaaa

SEQ ID NO: 34202 - DNA, 121 bp, Artificial Sequence
  Synthesized
  misc_feature (61): n=t or c
ttaatgtgctttacgtccctccctgaaaaatagtggttgtctgccactatcatctgccttnatattgcaaaggaggaactactgggatatctgatgaggtggtccatactgtagaactagg

SEQ ID NO: 34203 - DNA, 121 bp, Artificial Sequence
  Synthesized
  misc_feature (61): n=a or g
aatgtctatttctactctatttccagttgaccaataatacttttgagcatctgcaaagccngacacaagaaaaggagtagggaggagaaggaaggaaggaagtctgtgttagatactcact

SEQ ID NO: 34204 - DNA, 121 bp, Artificial Sequence
  Synthesized
  misc_feature (61): n=a or g
cgtatacattaacatgaaagaataaggaaaaattgagcaattacttccccagattttcagnaataatattaacattcctgatcaaataaaatataacatgatgagaaactgctttctaaaa

SEQ ID NO: 34205 - DNA, 121 bp, Artificial Sequence
  Synthesized
  misc_feature (61): n=t or c
ggtggaataggtgacctccatagattcctaattattctgagattctcatcacctacagcangttctctttatgtttacctccaactctggtatttaacagctatcacagagaataaattcc

SEQ ID NO: 34206 - DNA, 121 bp, Artificial Sequence
  Synthesized
  misc_feature (61): n=t or c
aactcttcctgggacattttaatggatgtcatatacaagataggactgctaattgtttttnctaacagaagccttaactcacctctcaggagccttagtttggtgtaatttaataggctaa

SEQ ID NO: 34207 - DNA, 121 bp, Artificial Sequence
  Synthesized
  misc_feature (61): n=a or c
attactctctgctcagagatattgatctctaaagcttctaaaatctgtatcctccatttcnttggtgaacactcagctagacagaaatggatagcacaggacatagtgcatcataggaatg

SEQ ID NO: 34208 - DNA, 121 bp, Artificial Sequence
  Synthesized
  misc_feature (61): n=t or c
aaacaccaagttctcattattgtatgcccactttagttcatatactggcatatacattacnttcatatgcatgaatgtaaacttgcagcagaggaaggtgaagaaaagccatgtagtatgg

SEQ ID NO: 34209 - DNA, 121 bp, Artificial Sequence
  Synthesized
  misc_feature (61): n=a or g
ctgttgtcacctgtgttttagatgtctgcatttcaattttcaatttcaatcactgcacacngagtgtttaatttacttctttttcacatcagtggcagtagtagtcctttccattttctct

SEQ ID NO: 34210 - DNA, 121 bp, Artificial Sequence
  Synthesized
  misc_feature (61): n=t or c
ccaccgaggtgcagccaaaagcttgcatacagggtaatcacacaggacacccccataatgnctttcttccacttcactgaaagctctgatgtctatttaggaaacagatgtagcaggatct

SEQ ID NO: 34211 - DNA, 121 bp, Artificial Sequence
  Synthesized
  misc_feature (61): n=t or c
tttaaaagtgtgaaagacagataagagatggatgtgaatttcatcattcattttcttcacnccacttcctttccctcatagttctattgctcaatactgcataaataatgagaaatacttc

SEQ ID NO: 34212 - DNA, 121 bp, Artificial Sequence
  Synthesized
  misc_feature (61): n=a or c
tcctgttcatttgtcctccatctctactcccaaacaaatgcttcttgggtccttctgctcnccttctgccagcactcctctgatccactgagccaattcagcttactgacctcaaattaaa

SEQ ID NO: 34213 - DNA, 121 bp, Artificial Sequence
  Synthesized
  misc_feature (61): n=t or g
aattactgagcgctttggggctgtaatccaatttgtggatatttcatttaaagtgtgccangagtgaattgtcccacattgatgaattgataggccctgggctgataatgtcactgagagg

SEQ ID NO: 34214 - DNA, 121 bp, Artificial Sequence
  Synthesized
  misc_feature (61): n=t or c
atctccttcctcatcttgatagcaattttttccctctttctttacaaaagctagatcttanttcatctgtcaggctccagatggtaattagggagctggatagaagtcctggctctttccc

SEQ ID NO: 34215 - DNA, 121 bp, Artificial Sequence
  Synthesized
  misc_feature (61): n=t or c
tcagcatgcaagggtgattttcccatttcctttgggattaattctgtctgtgcccaacagntgtggataaagctctcctgatatcactgtctgaacagctttccattctcctcctgtctcc

SEQ ID NO: 34216 - DNA, 121 bp, Artificial Sequence
  Synthesized
  misc_feature (61): n=t or g
aattaaaatttaaaagctgggtactctattttgcagaaaaatctacagaacgttggaaatngattgacttttttcctcaagtcaactttgtaagattacgtcttttaattatgtgttgcag

SEQ ID NO: 34217 - DNA, 121 bp, Artificial Sequence
  Synthesized
  misc_feature (61): n=t or c
ctaaagttcagaaattcactatatgataattagccacataggttggaaaccaaatgattcngataatttcatcaaagtacggaacaatatatggtgaagagacaacacatactgatacagc

SEQ ID NO: 34218 - DNA, 121 bp, Artificial Sequence
  Synthesized
  misc_feature (61): n=t or c
tacaagtatcaagtagcaagtagttaagtgtgcggttaaaggctgattctttaaagcaaancatttacttgcataaaattaagaaagcgcttacatacttcacagaacatggtctgtgaag

SEQ ID NO: 34219 - DNA, 121 bp, Artificial Sequence
  Synthesized
  misc_feature (61): n=t or c
gtaacacaactcaagttcaccacaagcaccatttcagtttctcctgaaacacccccagtcnacatcttaccttttggtgtgcccaggaaaatagcgaatgtatttgttgtcatgcagcgag

SEQ ID NO: 34220 - DNA, 121 bp, Artificial Sequence
  Synthesized
  misc_feature (61): n=t or c
aggtgttcagtctttatagaccctgtagattattattatcaaaaagatctacatgctggcnctagaatgtcttgtcgagaccttccacactgtatattgatccagctgaatgtttccagct

SEQ ID NO: 34221 - DNA, 121 bp, Artificial Sequence
  Synthesized
  misc_feature (61): n=t or c
aggaaaaaaaaaaaagcatagtttggaatgaagttgctttatatttgagttagaatgtganttcaaaaaatttcctgaactctctctgccttctgataccaacagaagtactattccttct

SEQ ID NO: 34222 - DNA, 121 bp, Artificial Sequence
  Synthesized
  misc_feature (61): n=t or c
tcagggatcatgaacctctgcatatatggtttatattgtattcacacactctgaatctttnttaccctcttgttcctaactgttgctgttgagctcttttccaaatctgtaaatggcaaaa

SEQ ID NO: 34223 - DNA, 121 bp, Artificial Sequence
  Synthesized
  misc_feature (61): n=t or c
aacacgccaattactgtgatgccaaagaaaaggacttccatatgtgtaattgtttccagangtactccctacaattaattattgcatcatggttgccatcatgaataagcttgttaattgt

SEQ ID NO: 34224 - DNA, 121 bp, Artificial Sequence
  Synthesized
  misc_feature (61): n=a or c
atctatataacaaaaagaaaaccgtatctcttttatatttggacatagatatgattaggtngttctgaaggagaagtagagattaaaactctaagcatgtttttcccagtcccaaccaagt

SEQ ID NO: 34225 - DNA, 121 bp, Artificial Sequence
  Synthesized
  misc_feature (61): n=a or g
ctgagctaatacctgcttgctggaggttctcatcatttgccttcaggatgcagcaggatcnatgtgctgtgctagccaggacattgggatagccaacacttttgtccatttaacggtgcta

SEQ ID NO: 34226 - DNA, 121 bp, Artificial Sequence
  Synthesized
  misc_feature (61): n=a or t
tgtttctgatgttaagtgtcaaagtgcagctgagctcttcattgcagccacctaagatacncaagtgccaattctcagacaggttctggacacagtattacaccaactcatcagaagactg

SEQ ID NO: 34227 - DNA, 121 bp, Artificial Sequence
  Synthesized
  misc_feature (61): n=t or c
ggagaggctttttggtagtcattgccaccaggggataacccaaatctgcgactgactcctnttcaggagctgtgctttgagacaatattaccaacaatattcaacctaagttttaaaccaa

SEQ ID NO: 34228 - DNA, 121 bp, Artificial Sequence
  Synthesized
  misc_feature (61): n=t or c
gaacttgaaccgacttcttagggatctcccccgtgcctactgccattaagctgttcattgngcttctgttgtaacaggaggtaccatatggaaagctcattacgctactccactgttcaaa

SEQ ID NO: 34229 - DNA, 121 bp, Artificial Sequence
  Synthesized
  misc_feature (61): n=a or t
catgcttattaatcatggaagaatgattgtaaagaatttaaaaatgtctcctacaaacgcnatctctgtgagcttcttccagcaggcctcctaactgaataaaatgcctttctttgaagca

SEQ ID NO: 34230 - DNA, 121 bp, Artificial Sequence
  Synthesized
  misc_feature (61): n=a or g
agatgcggcagtcagacctgctgatgctgtggaagaagcagtgtatattaggaatgtgatnatactcatcccagttatcttttgtgaatgtccttttgatgttactgtattagatacatca

SEQ ID NO: 34231 - DNA, 121 bp, Artificial Sequence
  Synthesized
  misc_feature (61): n=t or c
agcgctgcatgccactggtgaaagatacgttgcaaatggttatttttcatatactatccanggtaaacagcatcattcattcctattcccttgctccagacaaatcaatgattgttaatgc

SEQ ID NO: 34232 - DNA, 121 bp, Artificial Sequence
  Synthesized
  misc_feature (61): n=a or c
tcaagtcaaacagactaaataggactattcatgaaccagataattgttctgagaaaacttnattaatgtctaagcctagcagcttttagtttccattttatttacctattctctgagtaga

SEQ ID NO: 34233 - DNA, 121 bp, Artificial Sequence
  Synthesized
  misc_feature (61): n=a or c
gcaatcagtatcactctgtggacagttttacgtttgaaagcctttcttccgagttgtttgncttagaatgggagggactatgagtgcttgttggctaggcatggccagacagccagtatag

SEQ ID NO: 34234 - DNA, 121 bp, Artificial Sequence
  Synthesized
  misc_feature (61): n=a or g
ccagaggagagcggaaatgagaggctgcccctccatcccagagcctgtctggaaactgaancctctccctgccccttgaataacttgctaccataagccaccagtgactgctgaccttttg

SEQ ID NO: 34235 - DNA, 121 bp, Artificial Sequence
  Synthesized
  misc_feature (61): n=t or c
tctggtagttcttatcatccagaaatttgggctgctatagagtgagcattaagcaatgccnggatcctgtgctgtgctgtgatgcatatgggacgtccctcggaggcctggagagctgctt

SEQ ID NO: 34236 - DNA, 121 bp, Artificial Sequence
  Synthesized
  misc_feature (61): n=a or g
gaagtggttttctcacaagttttacatggtcattgtggtgggcggtggttgaaagaatttnctctgggtttgggagttgcactttgtagcacctacagtttctacagtgtaatgatttctg

SEQ ID NO: 34237 - DNA, 121 bp, Artificial Sequence
  Synthesized
  misc_feature (61): n=a or g
aatagctgtgtcacttgaagttgtaaactgtggctagagagccctggagaagcctcgactncccagagcagatagaaagtacagttcttctgaatgtggatgatactgaagagaagcagcc

SEQ ID NO: 34238 - DNA, 121 bp, Artificial Sequence
  Synthesized
  misc_feature (61): n=t or c
ctgtggtgacgtgaattatctcttctttgaccatatctcctctttgtaccgaattgtagcngtttttcatttcctccaatatacagtaaaatggctggttcactcagtgaatagttgaaaa

SEQ ID NO: 34239 - DNA, 121 bp, Artificial Sequence
  Synthesized
  misc_feature (61): n=t or c
tccttccctgaaatctgagcttaaatcataaaacaaaagcattgcttcacagccacacatngacatttaaattcttcaatatttacagggggatgagggacggatccagcactgtgctaac

SEQ ID NO: 34240 - DNA, 121 bp, Artificial Sequence
  Synthesized
  misc_feature (61): n=a or c
taatgtttttttttttttttttttatgttacttcttacattcctgattaaagggctaatantactgctttcagtgggatattgataatggaacatattctcccaaatgcattgtcaagtct

SEQ ID NO: 34241 - DNA, 121 bp, Artificial Sequence
  Synthesized
  misc_feature (61): n=c or g
taatttggccctttctcagcccgtgtttcttcaaaacactcctgagacgtgaaatacaaanaccatgggtagggaaggaaatccaagaacatggggttgaaatgatgttaatcaatgtaac

SEQ ID NO: 34242 - DNA, 121 bp, Artificial Sequence
  Synthesized
  misc_feature (61): n=t or c
gctctccatcctgccactgggccgagggcacaattccgtgctatggatgcgatcggagcangtactccttccccatgcaacactgtgctttctgaagcttccctctgctccttgcatgagt

SEQ ID NO: 34243 - DNA, 121 bp, Artificial Sequence
  Synthesized
  misc_feature (61): n=t or c
tctcatttatttctataacagagctctcggtcctgttagttgcagtgtaagtgaagccaantggcagtttccacagcctgcttaggatatgaatttctgcagaaacctaacactttgtcag

SEQ ID NO: 34244 - DNA, 121 bp, Artificial Sequence
  Synthesized
  misc_feature (61): n=a or t
taaacaaagctgtgcatggaatctttgataaaatgtcatatgtatcgaagcatgttatgtntgcacagaattgactctggaaattgtaggatttcaggatttgtatattttagaaattggg

SEQ ID NO: 34245 - DNA, 121 bp, Artificial Sequence
  Synthesized
  misc_feature (61): n=a or t
gttcttttttttctggaaaccactgccaggattgctacctttcctccttttctctaagaancagtctgtatggacatccagccatggcagaagcaccaaaatatcctccagtaggtgtcca

SEQ ID NO: 34246 - DNA, 121 bp, Artificial Sequence
  Synthesized
  misc_feature (61): n=a or g
gagtcatcctatatttcactggattgttggagccattcttactcatgtcatcctctgaagnaaagaggggtaagacagtagataaaggagtgtcattcatttgggattactttaagttctc

SEQ ID NO: 34247 - DNA, 121 bp, Artificial Sequence
  Synthesized
  misc_feature (61): n=a or g
ctgaatagatctggtttgtaccactgtacatgaggaagtattgttagacacctcagcactnttttgcacatcattgctctctttaaccatttcaaagggccagaagcaacagagaagcatt

SEQ ID NO: 34248 - DNA, 121 bp, Artificial Sequence
  Synthesized
  misc_feature (61): n=a or g
catggtcactgtcgcgtgaaggggctgcttggctcaagaaagcatcgtcctccaagcaccngtgtgggaggaaaaggggatgagttaccatgggtatctccacgggtacagcctggttctt

SEQ ID NO: 34249 - DNA, 121 bp, Artificial Sequence
  Synthesized
  misc_feature (61): n=a or g
gcatcgttctcaaagggtatgaatctgaagcaaacgttctggagatagtgttaggaggagnaggtgatctttcaatgagaaatagacctttgagttggcagatactggagttctcccaagt

SEQ ID NO: 34250 - DNA, 121 bp, Artificial Sequence
  Synthesized
  misc_feature (61): n=a or g
tgaaatttcctagtcacatgctgggtgtgcatgtggggagatatggttttgaaaaagtggnttagatacagcaattggtgcctaggtgtctgccacatgtactgaattgtcctgcaagtat

SEQ ID NO: 34251 - DNA, 121 bp, Artificial Sequence
  Synthesized
  misc_feature (61): n=t or c
aagcaatagtgattttataggtttggcagtatttattcttaatcgcttgctttggaacccngacattgcagctgaatatagacatcccactgtgcctcacctttaccgagaaggtaactgg

SEQ ID NO: 34252 - DNA, 121 bp, Artificial Sequence
  Synthesized
  misc_feature (61): n=a or g
gcaaagcatcgcagccccgggaacgctgcagcagagaggtgctgttgaagatggagctcanctacgatgcgtgcaacagttggcagtggttgtcattcagaaaataccttttcctatcaac

SEQ ID NO: 34253 - DNA, 121 bp, Artificial Sequence
  Synthesized
  misc_feature (61): n=t or c
gctccctccgtaccgctgctctgcccaaaatgtgtcagtccgagtggattgccaggcagcnggccaacccgtctgcaatgtaccgaaaaatctgtcagtgggggccaccacctgccatccc

SEQ ID NO: 34254 - DNA, 121 bp, Artificial Sequence
  Synthesized
  misc_feature (61): n=t or c
tgcccagtttgtagttggcatcctttgactcaagggcccactgcttgttgtttgtcaggcntcaccttctgcagaattgcttcctagccagctctccttacctgtgctaatgtgtggggtt

SEQ ID NO: 34255 - DNA, 121 bp, Artificial Sequence
  Synthesized
  misc_feature (61): n=a or g
agagaagagttagctccttctgaatatgagccctctgttgagggtggcagcaagaggcacnacaaatctccaagctcactttttggtgagaaggtctatcatagttctgagactcccacac

SEQ ID NO: 34256 - DNA, 121 bp, Artificial Sequence
  Synthesized
  misc_feature (61): n=a or g
ctttccatcttatttcttacctaagcaggctgagaaacgtatggatttacataaagtatcnaaaactgtatgcattgtggatgtgcaccactgctgttttgttgttagaagactttctggt

SEQ ID NO: 34257 - DNA, 121 bp, Artificial Sequence
  Synthesized
  misc_feature (61): n=a or g
tagtagaaaccgatgtatcttatgttaaacttggaagttgagggggtggaatggttagganctcacgctctgcttgctttcatcccacagttctcatagtggtgaatgaagtataagtatg

SEQ ID NO: 34258 - DNA, 121 bp, Artificial Sequence
  Synthesized
  misc_feature (61): n=a or g
aaaaaaaaaaaccaaaaaaccaaaacaacacaaatacattcataacaccaaagcataaggncatacctcagaagggtaaaatgctgatgtcacctgaaaacatggcagcattctgacttgt

SEQ ID NO: 34259 - DNA, 121 bp, Artificial Sequence
  Synthesized
  misc_feature (61): n=a or g
atagaccaaataaatttgttgacctcagactcaaacagtactcaaaataagcctgggtccngctttaaatacatgcctaatttctgtggtaggccaaagaaccctggaaggtgattttgat

SEQ ID NO: 34260 - DNA, 121 bp, Artificial Sequence
  Synthesized
  misc_feature (61): n=a or g
atttacttatttattttaaaaggtcttaaaagatccaggacaatagtatatcttgctaccnctttcagaattttatcctattcagggttcccactttaacttgcagtgaccacttataacc

SEQ ID NO: 34261 - DNA, 121 bp, Artificial Sequence
  Synthesized
  misc_feature (61): n=a or g
cctacgcagttatgctttctgggcagtgctctgctcgtccttctgctggctcttcccatcnggtctgcccagctctgatcggccatcagctccacctggagcattggcccaaaccaggctg

SEQ ID NO: 34262 - DNA, 121 bp, Artificial Sequence
  Synthesized
  misc_feature (61): n=a or c
tgttgcccacagcctgcacccaagatgggttcacacagtctctcaaattcatcctatgtgngtctacagatacagagagaggggtgagcagtgtttggagtgctggcgtgcagcctggtta

SEQ ID NO: 34263 - DNA, 121 bp, Artificial Sequence
  Synthesized
  misc_feature (61): n=t or c
ttctatattgtatatactgcataacttatgaccaagttgaccttctggtgttttcagctgnatctacatcagtacatagaagaccaaatactgcttatagaattgaagtcaactcagaggg

SEQ ID NO: 34264 - DNA, 121 bp, Artificial Sequence
  Synthesized
  misc_feature (61): n=a or g
tgaaaatcccagcctacaaagacttaagtgctactccaaatgtatagacaatagtgtatancaatgtggatcttattgtctcccttgtaatccgtcttgccaatatttacccccttgccaa

SEQ ID NO: 34265 - DNA, 121 bp, Artificial Sequence
  Synthesized
  misc_feature (61): n=t or c
tgagcccccagacgctgtccaaatgaagagcgagaatggagctctttgatcttcatctctnctgcccccgccctgtgtaattaaagggagtgaagaaccagcccctaattaaaaggaggga

SEQ ID NO: 34266 - DNA, 121 bp, Artificial Sequence
  Synthesized
  misc_feature (61): n=a or t
ctggaaaatatgttgaaagtcaagcacactgtatatctgtgcctaatgtcacagattatanataaaaccttgtattcttgtcctgtccattccgacagggatcattcagagggtgagaact

SEQ ID NO: 34267 - DNA, 121 bp, Artificial Sequence
  Synthesized
  misc_feature (61): n=a or g
ttaagagaggtggggagaaacaataaaagacatgaactgaagctgacttgagcgaatgcangcaccagaaaacccatgaggagcactggagcacagtaaaaataggagcaaggtttccaag

SEQ ID NO: 34268 - DNA, 121 bp, Artificial Sequence
  Synthesized
  misc_feature (61): n=t or c
ataaagccatatatttgggaaaataaacctatgcaactgacaagagtttctatgagaaaangtatatcatgattactaatgcatcaatttcttctaaaattaaaaaagcatcagatgttga

SEQ ID NO: 34269 - DNA, 121 bp, Artificial Sequence
  Synthesized
  misc_feature (61): n=t or c
ggaaggaccaacaggagcacttcctgtacaggagtcttagtgaaatacatgtttcaaaatngattattcttgcctaattccttgtaaaatcaatcaataaatagaaagcaggcagggcact

SEQ ID NO: 34270 - DNA, 121 bp, Artificial Sequence
  Synthesized
  misc_feature (61): n=t or g
gaaaattattctccatttggagagcacaggcagagcacatctaacagcaattcaaactganaggtatttggtttgcttttaaggttgactgtcatgtttttctcaatgagaatgtggtaca

SEQ ID NO: 34271 - DNA, 121 bp, Artificial Sequence
  Synthesized
  misc_feature (61): n=a or g
tattaattgggtgcctttaaattaaatgctgaagagttcttcttggtgtttggtgtgttgntacacatagttttatcaaaagagataaactgctatcaacctatgattcatattagttgca

SEQ ID NO: 34272 - DNA, 121 bp, Artificial Sequence
  Synthesized
  misc_feature (61): n=t or c
gttggaataaaggaagtccaagtagtgagttgataaggaactatagtttagattttcacgngtaaaatggcctctgcaaaatgcttgcacgaatggagatatagttccttcttttttgctc

SEQ ID NO: 34273 - DNA, 121 bp, Artificial Sequence
  Synthesized
  misc_feature (61): n=a or g
tcagagtactttcagtatggcatttgattattatattatgctacctctagtagctcagccncttggaggataagcatacacagagaacacatttcttcaacacttttcttaaacaagctcc

SEQ ID NO: 34274 - DNA, 121 bp, Artificial Sequence
  Synthesized
  misc_feature (61): n=t or c
acactcactttgcctcagtacttcatttttcatttttacaaagatgaaaagttggtcctcntgacagcttaccaatacgtaatcggaaattgttaaaggagtgtcggttgatgccatccag

SEQ ID NO: 34275 - DNA, 121 bp, Artificial Sequence
  Synthesized
  misc_feature (61): n=a or c
acatctgaatggtgccgtggtggcactgatctgcatagatttcactggtagttcaaggganagtctgcagccttcctcctagagctttcaggtaggatgctggcgctgagtataccagcaa

SEQ ID NO: 34276 - DNA, 121 bp, Artificial Sequence
  Synthesized
  misc_feature (61): n=t or c
tgacaagagacgtcattgtgcttctgggttgcctggcccgtacttcaggagataggctatncagggtgatttcagagcaacacattaatttacaatagaaatatatatgtatatatatatt

SEQ ID NO: 34277 - DNA, 121 bp, Artificial Sequence
  Synthesized
  misc_feature (61): n=t or c
acttataaaatgattcaaacggcttctttcctccttccacacattcacagagattttagtnttggaagaaggcttctgttgacgtgataaaccattaaatgccacaggaaaactgagtcct

SEQ ID NO: 34278 - DNA, 121 bp, Artificial Sequence
  Synthesized
  misc_feature (61): n=a or c
gtcagcgctcatgcagtcatcactgcttgtatttgcctttgaggagtgtggaggtagggcntgagtatctcctaaagataggagaaagtcttctcatctgaattgtgaatgcatcaaacac

SEQ ID NO: 34279 - DNA, 121 bp, Artificial Sequence
  Synthesized
  misc_feature (61): n=a or g
tttgcttgttagaatgaatcttagccaaagaggacaatttaaaaccttagaagtgaatttnatacattgaacctgcacatttaatgctgtgtgtattaaagaaagtctttggccataatac

SEQ ID NO: 34280 - DNA, 121 bp, Artificial Sequence
  Synthesized
  misc_feature (61): n=a or g
tagatattgtttaaaaaaatcaccaatagcctattcagggctgtgtctttgtgtgctcatngtagcctgtctctttaagtacgttgagttgaacaactacccagcaggtgaaaaaacgttc

SEQ ID NO: 34281 - DNA, 121 bp, Artificial Sequence
  Synthesized
  misc_feature (61): n=t or c
gaacggctcttagcgggaaagctccggactagcaaacacagaaggctaaaattctgtctcntctcaaaacagctgtagctacagctctgttaggtctggtagtttttcgttgcccactctc

SEQ ID NO: 34282 - DNA, 121 bp, Artificial Sequence
  Synthesized
  misc_feature (61): n=t or c
gttagagccaagcaggagatacttcaacatgtttgccaaagcacagctttcctaaaagcanagctctcctagtgttacactgcaatattagccttggacctgagcccaaatcctgatgtgg

SEQ ID NO: 34283 - DNA, 121 bp, Artificial Sequence
  Synthesized
  misc_feature (61): n=t or c
aagagagagggtaggggctcatgagaagaggtgggggacctctttgctaaattattgatgntagttgtgaaaccatttcagtagaaattgtttgatgcccaatggaaatgcttcatgtatt

SEQ ID NO: 34284 - DNA, 121 bp, Artificial Sequence
  Synthesized
  misc_feature (61): n=a or g
tcataagcaaatgggaaagatatcagtgggatcctccttgattttcttagatctggtattnccagcatgaatgaagtaaacagtactagtctagagaagagataatgaaatcacagtgaaa

SEQ ID NO: 34285 - DNA, 121 bp, Artificial Sequence
  Synthesized
  misc_feature (61): n=a or t
agaaagatcatttgcactgtgctctatattttagagtagcagtatatcctctctacaacanaactgttttgttatagacaaagcttatgtttctgaagcaataagcaatgtgccagaaagc

SEQ ID NO: 34286 - DNA, 121 bp, Artificial Sequence
  Synthesized
  misc_feature (61): n=a or g
acaaaggaagatggatccagccttgacagttctatgcataataactgcggtcactttctcntggagaagagagtctccagccaatcacataacccaaattgctgtgccagcataatggaga

SEQ ID NO: 34287 - DNA, 121 bp, Artificial Sequence
  Synthesized
  misc_feature (61): n=t or c
gtgcatttattctcactgcatctctcctggtcttttttttccatgtatttcctctctaagnattatgtctccatggaagaggttcagccccatcttacatcacaaccagtgtcaccctatt

SEQ ID NO: 34288 - DNA, 121 bp, Artificial Sequence
  Synthesized
  misc_feature (61): n=a or g
tagttcttcgagagtttctcatctatatggatgttaaatgaaatactggaataaacctacngaaacatgaataactattttcactgtgggttctctctctcttctttatgtacatacctgt

SEQ ID NO: 34289 - DNA, 121 bp, Artificial Sequence
  Synthesized
  misc_feature (61): n=t or c
gcaaatgcctccgcagactgcttggcattggctctgctaagaaaactgatttggggaaccntgtattgagccagaccgaggagggcccaagggttggctttgctctgctggtccgtgtcaa

SEQ ID NO: 34290 - DNA, 121 bp, Artificial Sequence
  Synthesized
  misc_feature (61): n=a or g
cctcagccaagccttgtctctgtgaagtggttgggctgctaatgcacagccacctcattcntggagatccaacatcttgttagaccaattcatgtaacccttaagtcctagggggaaactg

SEQ ID NO: 34291 - DNA, 121 bp, Artificial Sequence
  Synthesized
  misc_feature (61): n=a or g
tctgctttccagtcaaacaaatcaccttggttggtttagaagtttagcagaagagagttanctcttttaaaaactaatgacaaatatttccttagtatctatagatagggttgtttttcta

SEQ ID NO: 34292 - DNA, 121 bp, Artificial Sequence
  Synthesized
  misc_feature (61): n=t or c
aaggcagtgagtaatgctgaagcagtgcatcacgagctgtgaatacattctgtgtattgtnttagcaactcttgtttggaatggagagggaaatctgtgaaagaacttacttcagtgcaac

SEQ ID NO: 34293 - DNA, 121 bp, Artificial Sequence
  Synthesized
  misc_feature (61): n=t or c
cattttaatttatgttatagtattttttattagtggattttggtcttttctactacctctnatagctgtgcttttttatatctacatttcttgagctcatacatctcttgcctagcatctc

SEQ ID NO: 34294 - DNA, 121 bp, Artificial Sequence
  Synthesized
  misc_feature (61): n=c or g
agacagcagacactttcaggggatcagttttccatctttatgagacaaagattccctctcntggggtgcatgctgcctctccagtgtagtcaagtccaaagaagaggctctatgcttccga

SEQ ID NO: 34295 - DNA, 121 bp, Artificial Sequence
  Synthesized
  misc_feature (61): n=t or c
cggcggtggactgtcctgttcacaccagttctggggcatttggtaggaaactgaagttacnaaaagctgagtaggctgaactaggcacacgaaagtgtgcgacctttgctgcttgtctttc

SEQ ID NO: 34296 - DNA, 121 bp, Artificial Sequence
  Synthesized
  misc_feature (61): n=a or g
atggaacgcaccatacagaatcaccagctgcagcaggtggagtaggttttgagagcccacngcacgcaacagtccagctatccagcaagtcctagccacatagagctctgtttgtctctct

SEQ ID NO: 34297 - DNA, 121 bp, Artificial Sequence
  Synthesized
  misc_feature (61): n=a or g
acctaaataaatatttaccatttctgctgagattggttatcagaaaatgttagctgcctanaactttatttaaacatacagatttttgagtatttttgcttgagtcatgattgagttctta

SEQ ID NO: 34298 - DNA, 121 bp, Artificial Sequence
  Synthesized
  misc_feature (61): n=a or g
ttatagacagagccagcagcacccctagagctgctcaagagagacacctgaaggcaaaacntggagagactccggaaaaccaacccgacactgccttgaaaataggaaatacttgattgct

SEQ ID NO: 34299 - DNA, 121 bp, Artificial Sequence
  Synthesized
  misc_feature (61): n=a or c
ctagagatctgcaaatgaagagaagagggagatggagtggaagaggggagggagataaatnattcctcaaatagagttaataaagccgcactatcaaagaataaaaacaataaactgaaga

SEQ ID NO: 34300 - DNA, 121 bp, Artificial Sequence
  Synthesized
  misc_feature (61): n=a or g
taaagaacaacgctgtccatggacatgatgccaacattctctatcattcctgactcatcantgatgggtaactgggcatatatttcatataacaatacacaaactgagtgagttaacttgc

SEQ ID NO: 34301 - DNA, 121 bp, Artificial Sequence
  Synthesized
  misc_feature (61): n=a or g
tttagagggaccaggatgccaactagttgaagagaatcaggcaaccgtagttcaatctatnaacactgattgtggatttcaactctacctagagtattcaaaaatgcagtctggaaacact

SEQ ID NO: 34302 - DNA, 121 bp, Artificial Sequence
  Synthesized
  misc_feature (61): n=a or g
tgttgtttccatgggagggaaggatgggagtggggctgtccccttcccctaacatctgttntcatcacaccctgatcatactgtattttcaattccattgtattttgattgagtgggtctg

SEQ ID NO: 34303 - DNA, 121 bp, Artificial Sequence
  Synthesized
  misc_feature (61): n=a or g
tgcgggtggggctgtgctgagctgaggaggccgtgtaagcagaggtaagctgaattttagntttcattccaaaggggagtgcctgtataactcagttctggctgtatgggataatggaacc

SEQ ID NO: 34304 - DNA, 121 bp, Artificial Sequence
  Synthesized
  misc_feature (61): n=a or g
ttggagtggaagatagggtggaaaggaacatttgtggaagcttcaagaactgtattagganagttggtggatgtttgccttaacctgaagttgttttgaaaggaggtgaaatcataaggca

SEQ ID NO: 34305 - DNA, 121 bp, Artificial Sequence
  Synthesized
  misc_feature (61): n=a or g
agagagttttctttaaagttttctattaacaaaaggaggcaatactcacgaagtgttgagnatgtagagcagctgccttcagggccactagttaccattaaaagaattggggatgtacttt

SEQ ID NO: 34306 - DNA, 121 bp, Artificial Sequence
  Synthesized
  misc_feature (61): n=t or c
ggagtggggtgatctggtagcccttgtaagcccagaggatgctctccttccagtctggctntgtgtttgtctccttatttcccaaagtttgcaggcaggattcctctgttgggcacccgca

SEQ ID NO: 34307 - DNA, 121 bp, Artificial Sequence
  Synthesized
  misc_feature (61): n=a or g
tttcaagcagtagtgacaacagttggaagaacaccacagcaggcagattctaagcactccntccagtacacattttaacagatattctcacatccacctcaaaaacattaacttgacatgt

SEQ ID NO: 34308 - DNA, 121 bp, Artificial Sequence
  Synthesized
  misc_feature (61): n=a or g
gtgagtcatccttctgccctaattttatcttcgggaactgaagagtgctctgtgcttgacnttcactccctgtgaggctccacggaattatttttacatacatcctaatttttataagtaa

SEQ ID NO: 34309 - DNA, 121 bp, Artificial Sequence
  Synthesized
  misc_feature (61): n=c or g
ttgccctgttgtcaagatcactgagggactctgggacccctgtagccctgagtttggggancatgactgaagtaatgataacctcctgttcaaccccaagcttgtgcaggatttgctgttc

SEQ ID NO: 34310 - DNA, 121 bp, Artificial Sequence
  Synthesized
  misc_feature (61): n=a or g
attccacacataacatggctttatgtttacaggcacaacaaacttgctgagcaacagcacnttcaatatgttccctccagcacgtcaagctgataggacaagagggagtggcttcagggcc

SEQ ID NO: 34311 - DNA, 121 bp, Artificial Sequence
  Synthesized
  misc_feature (61): n=t or c
ctggtaattttattccagagatcatttgttcccaccgttgctgctgtgaaaaaatatcttntgagcatccctccttaggggatacctaatgtcctttggaggcaaagatacccttgcaagg

SEQ ID NO: 34312 - DNA, 121 bp, Artificial Sequence
  Synthesized
  misc_feature (61): n=t or c
tcttagctggaggaggatccatctttctccagaatgagtcccacaccagttgggaaggaantctctaaaattgctcctcctgtcagacatctgctgagcaccacttgagccgcagaccaac

SEQ ID NO: 34313 - DNA, 121 bp, Artificial Sequence
  Synthesized
  misc_feature (61): n=t or c
caagaatccatgttttggaagcagaactcatctcactaactcacgtccttctccaactccnttgctgggaggagagctggaagcaacggcgaagcagagaactgagaacgcaggttttctg

SEQ ID NO: 34314 - DNA, 121 bp, Artificial Sequence
  Synthesized
  misc_feature (61): n=t or c
gagaagggcatagccccaatgcctgctgttggaagagtcatcacagtgaaactgtaatttnattttaactgcgtcttcacccatgacttttagtctgaccaatgttagcaacagcagtgtt

SEQ ID NO: 34315 - DNA, 121 bp, Artificial Sequence
  Synthesized
  misc_feature (61): n=t or c
agccaaagcctttttgccagatgttactaaaaggcacactgttgccaaaaggctgttctgntatctgtttaagacaaggctttggattagttctaccagaattataaacctagataaactt

SEQ ID NO: 34316 - DNA, 121 bp, Artificial Sequence
  Synthesized
  misc_feature (61): n=t or c
tgatgctagatcatagccacagtggttaagacattattattttcaaaattctcactgtaangaggaaaaagaggtcataagaattgttaccctgtatttaagagagcaaacttcaatctat

SEQ ID NO: 34317 - DNA, 121 bp, Artificial Sequence
  Synthesized
  misc_feature (61): n=t or g
atttatttaaggctgaaaaaataggcagggctcaggatatctatgaagaaaaaggaagtcntaaacccttggaaaggagttgtaaagaaagtagcagcacaatcaagtgacttcagtcatg

SEQ ID NO: 34318 - DNA, 121 bp, Artificial Sequence
  Synthesized
  misc_feature (61): n=t or c
ccataagtcaaaaagtaaagcaatatgcagagagtacatcgagtcatacatggacagttangaaggctgtagtaatgtgaagaaatgtttaccacctctgttaataaacagaagggaaaag

SEQ ID NO: 34319 - DNA, 121 bp, Artificial Sequence
  Synthesized
  misc_feature (61): n=a or g
aggagctgcatttggtaccagacatgaaaaaactgcgtgcaatccatgtccaagtaagctntaacatggatttcacatacatggcacagcatttttgctgtgcccaagggtagccacatgc

SEQ ID NO: 34320 - DNA, 121 bp, Artificial Sequence
  Synthesized
  misc_feature (61): n=a or g
ttttgttatcaatacgttaaacccagatgaaaatcaccacctctgtgttaaatgatgcatnctgagcagcttgttaaatacacatcctaaaaccatatcctatgcagtttcaacattaatt

SEQ ID NO: 34321 - DNA, 121 bp, Artificial Sequence
  Synthesized
  misc_feature (61): n=a or g
tgttgcttctatcactccattggctcttcttcattgggtagttgggacttggcctctaggnaagttctgctgggttttagattttctgcctttagtcatccaagaggaaaatttgcagagt

SEQ ID NO: 34322 - DNA, 121 bp, Artificial Sequence
  Synthesized
  misc_feature (61): n=t or g
ctgtatgtgcacactgcaccttgcaaggaaaatgatgatctgcagagaagtacttaacacnggtttgctaatagtcttctctgtctccctctgtagtgaaaaagacaagatcaccacccgg

SEQ ID NO: 34323 - DNA, 121 bp, Artificial Sequence
  Synthesized
  misc_feature (61): n=a or g
ccttggaatatgctctgacagcaggcttgctactctgagcttctgaaagtgccctcaagcntaatctgctccacttaatgttgtttcttctttccaggactcaccagacagtgatgatgag

SEQ ID NO: 34324 - DNA, 121 bp, Artificial Sequence
  Synthesized
  misc_feature (61): n=t or c
gggctacgttctagcttccacatccattagcatcttttcctccagaagagggaagagctgncagctggaccacaggagcacatgtcacactgttgaggggatgtcatggttttgtaacttt

SEQ ID NO: 34325 - DNA, 121 bp, Artificial Sequence
  Synthesized
  misc_feature (61): n=a or g
ccagcttcagcatcactatgacaaacagtgaaaagcaagagagcattcacccaccgcctcnaactgcaaacttcaccttcttgcagctgttataattaaaaacaaattaccaatctgcagc

SEQ ID NO: 34326 - DNA, 121 bp, Artificial Sequence
  Synthesized
  misc_feature (61): n=a or c
ttagccatgcttaaaacttcccgcaacttcattccaatataatttagaagactagacaagnaatcatatcttctgtttcagactaattattttcctcatagatggagaaagttgctgttgc

SEQ ID NO: 34327 - DNA, 121 bp, Artificial Sequence
  Synthesized
  misc_feature (61): n=t or g
aaatgagtcagccagaaaatagacacctttaagtgatgcttgctgtaaacacacatgtatncatgccatgtatgcatgccatgtaacagcgtggcctcatgatggtcctgaggaaagagtt

SEQ ID NO: 34328 - DNA, 121 bp, Artificial Sequence
  Synthesized
  misc_feature (61): n=a or g
atgttttgggctaagtatcacaaaatgtgaagacacttctgggacatgttcatagagcacnttaggttgaaattacaggttgtcctgtggtcaatagaagtttacaagttacgggtgttta

SEQ ID NO: 34329 - DNA, 121 bp, Artificial Sequence
  Synthesized
  misc_feature (61): n=t or c
tgaggtggatcgtataaacagggtacctctgtagtaagtgtagttacaagagttggcatanggaaattaatgattgaagaaaaagctgtaaatattttagccaagcatttgagacattgcc

SEQ ID NO: 34330 - DNA, 121 bp, Artificial Sequence
  Synthesized
  misc_feature (61): n=c or g
aaactttcttttttacagatattcataagcacttagcacagttgtcctgggtttggagcantttccatctgtttccttcgtcttcctcctcaccgcccccacttcatacttcggatttctc

SEQ ID NO: 34331 - DNA, 121 bp, Artificial Sequence
  Synthesized
  misc_feature (61): n=a or g
gctaaattgcaatgctattacatctctaaatcaacaaaattatagatctgattctccaaanctcttgcaaattctatttcagtttgctctactatttcaatacgatccagagtaaataaaa

SEQ ID NO: 34332 - DNA, 121 bp, Artificial Sequence
  Synthesized
  misc_feature (61): n=a or g
aaaagtcccttccaacacaaatggttctgtgaaaggttgaaggtctccatcccatccccanctgtgggttcccccagggttgagcattggcaaacgcgttcacatgagatcaggatcactc

SEQ ID NO: 34333 - DNA, 121 bp, Artificial Sequence
  Synthesized
  misc_feature (61): n=a or g
gcacatgaaatgattcgatgtttgcctcttgagtagaaatgtacactgtggtaggtagganaggagactcctgctttggtcatgtgagtcattgcgcactcctcctgctgtacctgtagat

SEQ ID NO: 34334 - DNA, 121 bp, Artificial Sequence
  Synthesized
  misc_feature (61): n=a or g
atggagtcatggcctagttttataagaggacatctccctggggaatttgtacaccagaagnagatggggctattgtttgctgggcctttacaatactagacaagcagatcatacagctgtg

SEQ ID NO: 34335 - DNA, 121 bp, Artificial Sequence
  Synthesized
  misc_feature (61): n=a or g
aaaaccaaaaagcatttgtttttagatccttgccatgccatatttaattgtgagaaacagnccaagagcaatactcagtaccttacgaaacggacaacgttcatactttccatatagaaac

SEQ ID NO: 34336 - DNA, 121 bp, Artificial Sequence
  Synthesized
  misc_feature (61): n=a or g
atgttagggtctatgcgcaaaaaaatcctggatgtcttctggtaggtttcaacaggtcctnatctgacagcttctttcattggacagtgtttaaaaatgtgggtttcagtacgtgctgtca

SEQ ID NO: 34337 - DNA, 121 bp, Artificial Sequence
  Synthesized
  misc_feature (61): n=t or c
catttgaattactgactagcaatggagattatgcacaactgatgacagtggagcaaaatanggggtctgttgtactacatctggcaaccagatctttggtggcaaacttccactgctgaag

SEQ ID NO: 34338 - DNA, 121 bp, Artificial Sequence
  Synthesized
  misc_feature (61): n=t or c
gccctccctagaggaacagttaatctgagatagactgtctaaaacccaagagctgaggtgncctgcctagaaaggcaatgcttaacaaagcctgagtggcttggtgacactaagtttatgg

SEQ ID NO: 34339 - DNA, 121 bp, Artificial Sequence
  Synthesized
  misc_feature (61): n=a or g
attcccaatctctctgttgtggaacacagaagcagaggacactgaagggtaggtagctcanactgctgttctgtgaagcttttgacctttcagttcaagggcaatgttctgggttgcattc

SEQ ID NO: 34340 - DNA, 121 bp, Artificial Sequence
  Synthesized
  misc_feature (61): n=a or g
tgtcaactgctctccagctgcctccctgaacccaccatgctactggctcttggctcctatntcctccaggttttctgtgatttccagtgaccattgtggactccataaccagatcaaaata

SEQ ID NO: 34341 - DNA, 121 bp, Artificial Sequence
  Synthesized
  misc_feature (61): n=a or t
atgatattctaaaatgtaataaatgtccccaaagagcccaaatgatgttgaaagttgtatntttgtaactttgttagcaattgtaattgctgcatggtaaaagcctttatgcctccttatg

SEQ ID NO: 34342 - DNA, 121 bp, Artificial Sequence
  Synthesized
  misc_feature (61): n=c or g
cctgattagacaaattttgtcctgggtgacagagctacttcaatatggtatattaggaggnagtggtagcttcagataagaggtggaagacagatttcagatggatcaagctctcccatct

SEQ ID NO: 34343 - DNA, 121 bp, Artificial Sequence
  Synthesized
  misc_feature (61): n=a or t
attgtgacagaattggcctagcttcaataaatgtttggttttgatgaacagcctcttaagnagttctcaaagtagttctgtttctgctatgtcatcaacataaaactggatatattccata

SEQ ID NO: 34344 - DNA, 121 bp, Artificial Sequence
  Synthesized
  misc_feature (61): n=t or c
attgatcttaaacctcacaaaatcatttatttaaatacatcatcaacctgaaactatttcngtaaacccataaagagtcttttatgagagtataaattcataatctccagtcctaggggat

SEQ ID NO: 34345 - DNA, 121 bp, Artificial Sequence
  Synthesized
  misc_feature (61): n=t or c
tatgcagttaacagagctgaggtcgttcttttacacctgaggattcttgcctaattaacanggccctaaaggaaataaggctatcttaattttatcttttacctgagaaaatgtctgagag

SEQ ID NO: 34346 - DNA, 121 bp, Artificial Sequence
  Synthesized
  misc_feature (61): n=t or c
aaacaaaatttaaatttgctctagcaactacaggcaaaattcaggaatcttgactgagatnttcaaagctgctcacaggacttatttaattcctatcaacattttacagcaatggaacaga

SEQ ID NO: 34347 - DNA, 121 bp, Artificial Sequence
  Synthesized
  misc_feature (61): n=a or g
agaagttgctactttctggcaaccagcaacttgaggttgttgtctgggagtgtttgtagtngaagggattgaatggaaacatgcaaaaaccactattcagagcatcttttgaaatttactg

SEQ ID NO: 34348 - DNA, 121 bp, Artificial Sequence
  Synthesized
  misc_feature (61): n=t or c
tactgtgtaagttctattcagcaaataaaacccatccagttttgtggtagatgcagatccngattattacatgttgacaaggtcatatatctattaattggattggagatgggatacaaaa

SEQ ID NO: 34349 - DNA, 121 bp, Artificial Sequence
  Synthesized
  misc_feature (61): n=t or c
aggtacattttatccttcgttacctctggaattatgatccaattatgctttaacgcagccntcagtcagacagaactcttgttgactttcatgagagtttgtctaattaaaaggtgagttg

SEQ ID NO: 34350 - DNA, 121 bp, Artificial Sequence
  Synthesized
  misc_feature (61): n=c or g
gtcaccaatgaagctttggttatcagatggcatctgcatggcctcaacctccatgctagancttgggtttgcaaataacttccgaactcacacacagtctaataggtaacgtggtaaaact

SEQ ID NO: 34351 - DNA, 121 bp, Artificial Sequence
  Synthesized
  misc_feature (61): n=t or c
tcacttgaaaaatgcctgagtgcgtattcagctatacataagatttgtccagcaaaacagnggcttttcaaactgtagaggagtttgtattcagcaggagatgaaaaataaatgacaaaat

SEQ ID NO: 34352 - DNA, 121 bp, Artificial Sequence
  Synthesized
  misc_feature (61): n=t or g
cacttctgtataggcataaagccttattcttgggtaccatgaaagtattgaacgtgaatgnggaaatcaccctgagagctttggttctaggtaactgcagcatgacatcatttcaggatag

SEQ ID NO: 34353 - DNA, 121 bp, Artificial Sequence
  Synthesized
  misc_feature (61): n=a or g
aaacagaggctctatttcccagcaatatttgtgtttgcagcgtgcacagtaggtctaaccncagcacatacagataaacacaaaaatatctttctggctggtgtaagatcccataacgata

SEQ ID NO: 34354 - DNA, 121 bp, Artificial Sequence
  Synthesized
  misc_feature (61): n=a or g
ctatcccataacccataacagtgggttaatctttggcttaaaagattatgcaacttacgtngtgtggtgccatactgttatcctccctaacttataatacatatctggcccataacaagtg

SEQ ID NO: 34355 - DNA, 121 bp, Artificial Sequence
  Synthesized
  misc_feature (61): n=a or g
cagtatatatatatatattatagcagtaactgtctataaatcattgtattctatggaactngcatcaccaaacaccaaatgaggagtacataagctgttagcttctcattacaggactaca

SEQ ID NO: 34356 - DNA, 121 bp, Artificial Sequence
  Synthesized
  misc_feature (61): n=t or c
gggtcatcttcagggtgggggagagggaaatgctctatcttccagggatgatgatgagaangtggtgtatgactggaaaattaattggacttagtgttttttggagttacaaggtacggtc

SEQ ID NO: 34357 - DNA, 121 bp, Artificial Sequence
  Synthesized
  misc_feature (61): n=t or g
cctgacttgctttgcctgtgttctttatataccagtgttgcaattggcctacagtgctacnaggtgaatttttaattgtaacttattttgtacagtccatttgaaataattctgtatatct

SEQ ID NO: 34358 - DNA, 121 bp, Artificial Sequence
  Synthesized
  misc_feature (61): n=a or g
tgtccgctgggctgggtggaggtgtgggaacgccagtcagatagagggggattggaaacangagagttagctgctgtaacaagctgcagtagcagcacctctaccagtggattaaaacctg

SEQ ID NO: 34359 - DNA, 121 bp, Artificial Sequence
  Synthesized
  misc_feature (61): n=t or c
gtaataacaagggcagtaattcccctgatctactgcttgattttcgtggtaggattgctgntgaatggcgtggcagcatggatctttctctgcatctccagcaagaagagttttatcgtct

SEQ ID NO: 34360 - DNA, 121 bp, Artificial Sequence
  Synthesized
  misc_feature (61): n=t or c
aacaccaccatctgagataggtgggaataggccagaagtgaatgtaagctaactttgcccnttctgtgtcacagaatgtacttgaaatgctctacagattcattgcagtttatcccatccc

SEQ ID NO: 34361 - DNA, 121 bp, Artificial Sequence
  Synthesized
  misc_feature (61): n=t or c
aagggaaggacagaacgtgaggtagcaaaagatttcatcagaaaaaatctcaatatccagngatttagtgagtgtaaatagaacacctagcttggtatatttgaccatcctgttactgaag

SEQ ID NO: 34362 - DNA, 121 bp, Artificial Sequence
  Synthesized
  misc_feature (61): n=a or g
ttatccatgttcatgctgaaactgatatttttctgtgtggagtaaagaatttatacttttntacagcataccaagacattagtattgaatgtgttcactgtgagataatctattcacatca

SEQ ID NO: 34363 - DNA, 121 bp, Artificial Sequence
  Synthesized
  misc_feature (61): n=t or c
agagcagaagcagccttaaatttgctcctgattagaatgaagcgtccacacatcaccgtgngcctgctgactaaaggccatgtttggggtgaaactttagtgaactataggccaataagga

SEQ ID NO: 34364 - DNA, 121 bp, Artificial Sequence
  Synthesized
  misc_feature (61): n=a or c
tttaagtaatatcttacttaatatttacagttgcccagatttctgaagctgtaattagttntgtgcaatgaagactgacttatttatctgagcataaagctatgttgaatagacaagtagc

SEQ ID NO: 34365 - DNA, 121 bp, Artificial Sequence
  Synthesized
  misc_feature (61): n=a or g
agcatgctgagcattcttgtagaaataatgaaatgccttttgctgcaaaaaatggccaacnttgcggtggctcttctggcttttgcttcacgttaaaccagtgatctcagagaactgtcaa

SEQ ID NO: 34366 - DNA, 121 bp, Artificial Sequence
  Synthesized
  misc_feature (61): n=a or t
tatccaatagctgactgctcagcagttcttatgcagccttgtatcaatgcacttaaatccnctgaactcaatttctgcaattttcattgagtattaaccaactgagagctaaccagtcatt

SEQ ID NO: 34367 - DNA, 121 bp, Artificial Sequence
  Synthesized
  misc_feature (61): n=t or g
cagttggacacatactctttctcaaaagtcttaatgatgaacttttgtccataacttatantcagactcaacatcctcacaatagaaaatgtgagagatttgtttgtaaccaatgactaag

SEQ ID NO: 34368 - DNA, 121 bp, Artificial Sequence
  Synthesized
  misc_feature (61): n=a or g
aatgtcaccacctaaggaagtagaagtgctctgcttgctttacagtagaaccagttacatngaatgaatctctgacaatgctgctgtaggatttaagatcatttaaggagagcttccgtta

SEQ ID NO: 34369 - DNA, 121 bp, Artificial Sequence
  Synthesized
  misc_feature (61): n=a or g
gcaacctaactaaatattatagtcttattcctatcatccattaatgtcattactgttgacngtagtgtatcttttaaagagcaacagttcagcatgatttgatgccagtcagtctgaatta

SEQ ID NO: 34370 - DNA, 121 bp, Artificial Sequence
  Synthesized
  misc_feature (61): n=a or g
taacctgttagtggccagggatgggggccagggcttgtgcaaacccagcttgggggagagnggatggagggaggaatctgctgaacaacaaatgcaacaaaataaatagtgcagaaaaaga

SEQ ID NO: 34371 - DNA, 121 bp, Artificial Sequence
  Synthesized
  misc_feature (61): n=t or c
gactaaaatcacctagtccaaccatatcccagtattaggcccaacagatgcacatgcccangactgaagatgagtgctgtcactcatcagatgctgtttttttccccctgaggatttcaat

SEQ ID NO: 34372 - DNA, 121 bp, Artificial Sequence
  Synthesized
  misc_feature (61): n=a or g
tccttcagaacagtattgttcttttgtttttgtacctttgaaactgtcctttgcgtaatanaattaactcaacttacaattttcagaataattagcgcttactcaagataatttgccacgc

SEQ ID NO: 34373 - DNA, 121 bp, Artificial Sequence
  Synthesized
  misc_feature (61): n=t or c
ccaggtcagggaattcagagggagcacagttatcatttatggggagaactgatttttgtangcatagtaaaagtgaaaataaatggaaagaggagctgctggtaattaacctgcatgctca

SEQ ID NO: 34374 - DNA, 121 bp, Artificial Sequence
  Synthesized
  misc_feature (61): n=a or g
tccttcttaattcatttgtgtcctgcctgcagaagaagtgagggcttccgaacagctaaantgtcctctttcacagggaccagctgcaggttatacaactacgttacaaattagtgcagaa

SEQ ID NO: 34375 - DNA, 121 bp, Artificial Sequence
  Synthesized
  misc_feature (61): n=c or g
ctccatcgacagaaatgggattcagcttcgcagcaagcagtaatgtttgagagagctgatnttacctttacttgtgaattccactggactcaaagatgttaaggcactccagagccaacga

SEQ ID NO: 34376 - DNA, 121 bp, Artificial Sequence
  Synthesized
  misc_feature (61): n=t or c
tgtcaacttgatggatatgcttacagcagtggtgtttctctgccagatcagcaggaaagcncatagctatggttagcccttttaagcaggtgcagattacttttgttttgaaattaagata

SEQ ID NO: 34377 - DNA, 121 bp, Artificial Sequence
  Synthesized
  misc_feature (61): n=a or c
aagcaaaaataacacttcttagttggacaacaactgctgttgggaggcagaaaccccctangattgacaaaatgttcctgcaggggggaaagcagcatgaagatactggtgcttaatctgt

SEQ ID NO: 34378 - DNA, 121 bp, Artificial Sequence
  Synthesized
  misc_feature (61): n=t or c
cagctacgtgcaggcacttctgctctctgctgcttgtggatgctctggagtgagagaagtngtctgaaaggccttgactagaaagccatgctgcccactcatctgaccaaaatgcctttgc

SEQ ID NO: 34379 - DNA, 121 bp, Artificial Sequence
  Synthesized
  misc_feature (61): n=t or c
gcagcgtttaaaaaaaacttccttcaagggagcatttaaaattttatcaggtctggctgcngtggcagatctggaggatatacagtttcccttgcttgctcacagctccatcccctgaggc

SEQ ID NO: 34380 - DNA, 121 bp, Artificial Sequence
  Synthesized
  misc_feature (61): n=t or c
tagtttacctcagaacagaacaaacctggtgaattttagttctggtgagacctctgcagcnagctccatttctaccttataataacaggaggcagattgcccacggaaatttactttgttc

SEQ ID NO: 34381 - DNA, 121 bp, Artificial Sequence
  Synthesized
  misc_feature (61): n=t or c
aatgattgcctttagtgaaacatagttacagagaaagtgcacatctgataggaaagttacntcagtcattagaagttagggagacaaaagctttacctcatcagtgataaacaaatccttt

SEQ ID NO: 34382 - DNA, 121 bp, Artificial Sequence
  Synthesized
  misc_feature (61): n=t or g
atctttagctgagcttttgactcagggttggctgtcccaaagttccttgaaaaacagctcnaagcttaccatgctatgccagaatctagaagtgacccaggcacaatccccagccctctgc

SEQ ID NO: 34383 - DNA, 121 bp, Artificial Sequence
  Synthesized
  misc_feature (61): n=a or c
tttctgtatctggaataaggaggtaaacccagaaatgacaacagcacttctcacaacctgngatcctcaaagcacagctgacaactctgtgaagatcacattcaatgttatcaaatggggt

SEQ ID NO: 34384 - DNA, 121 bp, Artificial Sequence
  Synthesized
  misc_feature (61): n=a or c
tgctttgctgatttctccaggtcctacaaggaaccagtaagaagctcttgtcagcaaaatnctctcagcggtacagaagaggctgtattccaggagaggacaccttgctgcctctgcaggg

SEQ ID NO: 34385 - DNA, 121 bp, Artificial Sequence
  Synthesized
  misc_feature (61): n=a or g
tacaaaacgaacaaatgacccaataccctgcttgctaggttttattgtgactaatatggcnctaagggagatggtttagcaatggcattcagcaggtcaggttaatggttggccttgatga

SEQ ID NO: 34386 - DNA, 121 bp, Artificial Sequence
  Synthesized
  misc_feature (61): n=t or c
tgcattacgcctgctgcctggcagttaagcgtttatgggcttagctgtgtcctgtatcggnttccagcctcttttcatatcattccctttctcatcctgtcatgagtgtgatattcctgac

SEQ ID NO: 34387 - DNA, 121 bp, Artificial Sequence
  Synthesized
  misc_feature (61): n=a or t
ttgccttttttcctcccctctcttttagttgctctagcccctttgtaaaagtcaataaacnacattaacctccccatgctgaatctgttttgcccatgatggtaattactgagcaatctct

SEQ ID NO: 34388 - DNA, 121 bp, Artificial Sequence
  Synthesized
  misc_feature (61): n=t or c
tttgtgctaaagcagagaatatcggtctctcatagaaaatgcagctagttaatttatttcngtattcactgtcagatcagtcttgcagggtgcagcccacctatctggctgcggagaactc

SEQ ID NO: 34389 - DNA, 121 bp, Artificial Sequence
  Synthesized
  misc_feature (61): n=t or c
gctgcctaagtaagctcaattagtagtgccacctacagcaaaggagagataccccatatcngtttcaggcctccaacacagctatcattgctgtgttcattcatttgcagagatagaacta

SEQ ID NO: 34390 - DNA, 121 bp, Artificial Sequence
  Synthesized
  misc_feature (61): n=a or g
cactaatcagaaatatcacgctgttgtggatggctccacttgaaggccctgaaggcttcanttgagcgtttgcatctcttcagttttgcatgtcgtggagtaaaaaaaatggcattgtcac

SEQ ID NO: 34391 - DNA, 121 bp, Artificial Sequence
  Synthesized
  misc_feature (61): n=c or g
atgacacaattatagaaacacatcttatgtacaaaaatagataaaaaaatgtagaagctanagttaagcacaaatgactctgatcacttaatgactcatgatggctcactgcaaatctgag

SEQ ID NO: 34392 - DNA, 121 bp, Artificial Sequence
  Synthesized
  misc_feature (61): n=t or c
ggaaaaaaaatagctgaactcaaattacccacggccttgagacttgcatgtggtcagaaanggctagtttaggtatgaagatgatctgtaaacatcctctaattcattaaacgttgtggtt

SEQ ID NO: 34393 - DNA, 121 bp, Artificial Sequence
  Synthesized
  misc_feature (61): n=a or t
aatgttttgcctccgattaacttcaattaattgttcaaaagaggaaggttagacctggagnaataatagaaggttaggagtaactcatcagtggaaggctcctctgtcctgtggcatttga

SEQ ID NO: 34394 - DNA, 121 bp, Artificial Sequence
  Synthesized
  misc_feature (61): n=t or c
ctgtgggcttggggaattgacgtggggaggaaacatgaggctgtgtgaggcgtaggtctcngtcagtggaagaagacaagtctcagtttggggactgatgtctgcaggctgctaacttggg

SEQ ID NO: 34395 - DNA, 121 bp, Artificial Sequence
  Synthesized
  misc_feature (61): n=a or g
aggtttgcaacattaccagaaattttacattgtggggaaatatctagtaagattttcagtnctgtctatgtacttaatatctgtttgtataaagggtgttaggttttgaagtatttctgaa

SEQ ID NO: 34396 - DNA, 121 bp, Artificial Sequence
  Synthesized
  misc_feature (61): n=a or g
ttcaaaactaccaagctcccaccaatttgactctgatgagcacgcaatcccaagtttctanttttcctttaacatgttctcatattttctctcacaacccttaattttatgattttttcca

SEQ ID NO: 34397 - DNA, 121 bp, Artificial Sequence
  Synthesized
  misc_feature (61): n=a or g
atgagctgagtgagcaaaaaattacttttcttttatagacaaactcttctgaaacagaacnaagtcaaaaaaattcacacgagcagctgacaggagaggtggagaactcttgacttggccc

SEQ ID NO: 34398 - DNA, 121 bp, Artificial Sequence
  Synthesized
  misc_feature (61): n=t or c
acttccagcgacagatcctcgctcagcttaaagccgaaatcactgcaaggagagacatgancttagtagggaagggagagcaggacaacagagctgctttgctgtgctatttttgcaaagt

SEQ ID NO: 34399 - DNA, 121 bp, Artificial Sequence
  Synthesized
  misc_feature (61): n=a or g
agagaatcttcagcagtcggtgcaatttccactgtagcaaatctttgctaaataaaatgangtactgtcatgctagaagtctttcctagttacttttactgaaggaaatcaagttggtaac

SEQ ID NO: 34400 - DNA, 121 bp, Artificial Sequence
  Synthesized
  misc_feature (61): n=t or c
ctctttgtgtgggtaacttgtttgcacgacatttgaaacgtgttaaccatatgtgtctgcncaggcttaggtcagaagtcaggacagccaattactgcactgtcacctgaggacaacagca

SEQ ID NO: 34401 - DNA, 121 bp, Artificial Sequence
  Synthesized
  misc_feature (61): n=a or g
ttatttagtagtaaaatttctgaaacctattgactgtggcacctagagaagactttgctcngcatccagtcactgagattctctctattcctttattgatgtagaaaactgataacagact

SEQ ID NO: 34402 - DNA, 121 bp, Artificial Sequence
  Synthesized
  misc_feature (61): n=t or g
tagctacctatgcttatcccataggatagaacagttgacatcagtcagcttgttttcttangtggaataccaacatttgtgcactaaaatcatatctagcaggttgaacagcttgaggtct

SEQ ID NO: 34403 - DNA, 121 bp, Artificial Sequence
  Synthesized
  misc_feature (61): n=t or g
tcacatcttactacacactctcttaaaatgccttccaaagcattgtaaacaccagggagancatctacagccctttgtgtagaagtaaaattgcactgcaagttttgtaacattctgtact

SEQ ID NO: 34404 - DNA, 121 bp, Artificial Sequence
  Synthesized
  misc_feature (61): n=a or c
cactacttatttatttacttattttgttaagaaacatgcactgagatgaattcagtgaagnaatttaagcatcagtttggtttatatgctggagctatcattggtaacgctaacttcaaac

SEQ ID NO: 34405 - DNA, 121 bp, Artificial Sequence
  Synthesized
  misc_feature (61): n=t or c
ataaagaagacaaagtgaagccatcttgttttctgtctctttctcacacaaactatgcaantgaaaaagatcataaaaatttttcttgtagacaactacgcagcaatactaaataattcac

SEQ ID NO: 34406 - DNA, 121 bp, Artificial Sequence
  Synthesized
  misc_feature (61): n=c or g
aaactgtccattcttcgtggcccctgctcattgctgcttttctggtcagtcttcctttgtnaatcaaaggacagcatagagtatatgaattggaattgcacaactttggaaatttctgaac

SEQ ID NO: 34407 - DNA, 121 bp, Artificial Sequence
  Synthesized
  misc_feature (61): n=t or c
gcttcaaatttagaccttcttaggtaagcacaaaaatcagcactgagaaaagtagatctgnatgttcataatagatacaattctgaagattctcaggtgtagtcaaggagcattcttggag

SEQ ID NO: 34408 - DNA, 121 bp, Artificial Sequence
  Synthesized
  misc_feature (61): n=t or c
acttagactttaaaaaaataaattctcatgttgcataagaataacacagaccatcaactantggtcttcagtgaaggcctcaaaacacagaaggttgggtaccttcaaaattcaccattaa

SEQ ID NO: 34409 - DNA, 121 bp, Artificial Sequence
  Synthesized
  misc_feature (61): n=a or g
ctgtcctgcacgctgccagctgtgatggaaggtggtgggaaagcatttggtgctgctgagnagcgttgtttgtctgaagatgacaaagtaccttcagggcccataaggataactgccatct

SEQ ID NO: 34410 - DNA, 121 bp, Artificial Sequence
  Synthesized
  misc_feature (61): n=t or c
tgagccggcgctggggcaataggggatcgactccatggacaaacccgatggagcactcttncctcacccactgcaaggagcagcagccaagcagccaatcaaccctgctcttctaggaggg

SEQ ID NO: 34411 - DNA, 121 bp, Artificial Sequence
  Synthesized
  misc_feature (61): n=t or g
aaacctttgttttaaacaaagaatgaaggcagccatgcctcagcaactacaagcccatcantccgctgtaaccatcatccaacttgttacctgtgtgtgcttgctcagacactgataggga

SEQ ID NO: 34412 - DNA, 121 bp, Artificial Sequence
  Synthesized
  misc_feature (61): n=c or g
tccatgctgcacttggggaccgcactccactgctttgcaggagcagaagccccgaagcaancttcctaatggcattgccacatggtcaaaaaagatgggtttctttttctttcctgagcta

SEQ ID NO: 34413 - DNA, 121 bp, Artificial Sequence
  Synthesized
  misc_feature (61): n=t or c
tatatttataataaaaataagaacaagttttcagcatttacattttccctgacatgtcagngttggtaagaatgtgtcagaaacacccatttagagctgagctatcatcatcttcatatac

SEQ ID NO: 34414 - DNA, 121 bp, Artificial Sequence
  Synthesized
  misc_feature (61): n=a or g
cagacaatttcagttcatcttatcttccctttgctcctctacagttccacagacttccacncacaggcagaaggtactcagcctcctccattcccatccatcagctaacagcagcagtgcc

SEQ ID NO: 34415 - DNA, 121 bp, Artificial Sequence
  Synthesized
  misc_feature (61): n=a or t
ttattaggtcagcagcattcatcttctgtgaaagctgaaacgagcacatataactgccagngtctttaaggtcaagaggatttttttcttactatgaaatgtggtacttcacttgaattct

SEQ ID NO: 34416 - DNA, 121 bp, Artificial Sequence
  Synthesized
  misc_feature (61): n=a or c
acagccgcatcaagtgggacttgaaaattcctcatagtaacctgctcgtaactaaagcagngctcaagtgactccaagggcctcttctggtttaggctcctaaagccatctgctttgtgtc

SEQ ID NO: 34417 - DNA, 121 bp, Artificial Sequence
  Synthesized
  misc_feature (61): n=c or g
ggatggccctcctcaccagttacagcagccacattctgctcgtaatacaggaagacagggntgtccaggagcagacacagcacaaagccctctcctacctagagctgccataagaagtgag

SEQ ID NO: 34418 - DNA, 121 bp, Artificial Sequence
  Synthesized
  misc_feature (61): n=c or g
ccctgcaatcctgacctcacaccgcactcagatcaaagctgcccacagcagattctggtantgctttaccactggattatccttcacttagcatccctacaacggctcagctcgctgccca

SEQ ID NO: 34419 - DNA, 121 bp, Artificial Sequence
  Synthesized
  misc_feature (61): n=t or c
taaaaaaaaccacaaaacaaaacaaaaaaacccttggttgaagttacagtggattctctcnaatatagccttcatgaagcacagtgataacaacttgcttttgcttgtgcaagttgaatgt

SEQ ID NO: 34420 - DNA, 121 bp, Artificial Sequence
  Synthesized
  misc_feature (61): n=t or g
ggacatggccaagctcacgggcagagctcctgtttctctccagctgctttggccacatcanctcaatgccctttgctggctgtgaacacttccctccctcgcaccctcccagcaatctcat

SEQ ID NO: 34421 - DNA, 121 bp, Artificial Sequence
  Synthesized
  misc_feature (61): n=t or c
tttatggtgatggaagcacttcagactgagagctgctcaggaacgatttcatccccttccnagtgctagagcatggcttgcacccagtcacagaggaaaggcagtccagaacaatccagcc

SEQ ID NO: 34422 - DNA, 121 bp, Artificial Sequence
  Synthesized
  misc_feature (61): n=t or c
ggagtattgaaaacacgagttgcaaatgaagacatccatatgaaagagggtgttgtacaangttacaccaaatgataggcccatgctgctatgcacttagttggatatgaaataaaatgac

SEQ ID NO: 34423 - DNA, 121 bp, Artificial Sequence
  Synthesized
  misc_feature (61): n=a or t
ccttttttcttcttatttttaaatctgatgtgcatttgggacatgccagggacagcaatangggcacttgttctaagtggcagactgatggaggtgggaagggctgtaaagccctactctg

SEQ ID NO: 34424 - DNA, 121 bp, Artificial Sequence
  Synthesized
  misc_feature (61): n=t or c
gaaactgtctaaaaacagatcatgaaacatccgtgccagagagtagggtttcagttaaccnactgtgtaggccaaacccagccacccactgaaacggggagctacagatccagccaaggcc

SEQ ID NO: 34425 - DNA, 121 bp, Artificial Sequence
  Synthesized
  misc_feature (61): n=t or c
gatacaagggcacagttccagactggagtttataaacttgtcctcatgtttgatgtgaaangcagtgaatgctgtgtagagcttgtgttttcactgctgggattcttttgctttgagtggt

SEQ ID NO: 34426 - DNA, 121 bp, Artificial Sequence
  Synthesized
  misc_feature (61): n=t or c
cccaaaacctccaggtcggcagagccctcggaacccggaccggctaccatcgcctgcttgngtaaattgtcccgtaattatcaccgtatgcacaaatcggactgtattaatcgctgcagaa

SEQ ID NO: 34427 - DNA, 121 bp, Artificial Sequence
  Synthesized
  misc_feature (61): n=a or g
cccaaaaatgcttcctgtgtcctgtgaaggagagacatatcttcctaagacctccagttgntgaccatagccaccatggaagattcttagatcatttccagataattgtattttcatggta

SEQ ID NO: 34428 - DNA, 121 bp, Artificial Sequence
  Synthesized
  misc_feature (61): n=t or c
caaaaactggaaaggaaaatcctcagccagggttttctgcctgacagctgcacagtaaatnagctagcatctaagaaacacacactgcaacaggttgcccaaggaggctgtggatggtggc

SEQ ID NO: 34429 - DNA, 121 bp, Artificial Sequence
  Synthesized
  misc_feature (61): n=a or g
cgcttagcagctccatttccatcactaagctaaaggtgagaaagcctagagttaaagtagnaaggtgttgcaagagtttgtttttcttagccagacaaagaaaagtggaggaaataaatgc

SEQ ID NO: 34430 - DNA, 121 bp, Artificial Sequence
  Synthesized
  misc_feature (61): n=t or g
ataacattttatatttgccagttgggaacatatgttttatagagaaaatagttgtaaaggncttacaagcataagcctaatccataaatagtaaacagaggcagacagaaaggaaaagcag

SEQ ID NO: 34431 - DNA, 121 bp, Artificial Sequence
  Synthesized
  misc_feature (61): n=t or c
agcatcatggaaaggagttatcagtagtctgccacggtgcttacaacatttagagttaggntttagctcaaaactacagcttcagttcctattattatcaccaccatttgattccagagtc

SEQ ID NO: 34432 - DNA, 121 bp, Artificial Sequence
  Synthesized
  misc_feature (61): n=a or c
ttggtacataagcacgtcatttatctcctctgtctacaaggacctcatgaattgtatatanagcattgccagcatcttctgcttgctcaggcctgatacttcccagatagctgcaaagaat

SEQ ID NO: 34433 - DNA, 121 bp, Artificial Sequence
  Synthesized
  misc_feature (61): n=t or g
tctcaaagataagtgatataaaacaaaggagtttctagtctcacgttcagttttctgtaancctgttcagatctagaaagcccaatgagaagcaacatccatatgtagctgtgctatcgtt

SEQ ID NO: 34434 - DNA, 121 bp, Artificial Sequence
  Synthesized
  misc_feature (61): n=a or t
gagggactgtccctatactgttaaaaattcagggtgagcgttcctgatggctttaatgagngcagcactttaatgagtgcagcactgagctgtaagagttcaatcctttatagctgcctgc

SEQ ID NO: 34435 - DNA, 121 bp, Artificial Sequence
  Synthesized
  misc_feature (61): n=t or c
tataggccataagatacatgcccattgaggacaagaacatggaaaagaatatgtagcactngttattgcatatcacaagttgattttagagtctcattaggactctaaaatgaggtctgaa

SEQ ID NO: 34436 - DNA, 121 bp, Artificial Sequence
  Synthesized
  misc_feature (61): n=t or c
cacctgagtccattgagctccctttgccctggaacaacaatgcttcttgcagttgtcctanatggtcctcacttattaaagctgcaatctgaaattgtgttacaaaaaggaaaaatataca

SEQ ID NO: 34437 - DNA, 121 bp, Artificial Sequence
  Synthesized
  misc_feature (61): n=a or t
aggtgactgctattttcctagtgttgatagacatttacaaaagaagcataaggagaggccntctttacatcttgactcaattttatgtacacaactgaatacatggaactggagcaggctg

SEQ ID NO: 34438 - DNA, 121 bp, Artificial Sequence
  Synthesized
  misc_feature (61): n=a or t
agccaggaaccttagtatttattggtgggcaatacattcctactcatggacattttttatngcttgcaagtcaaagcctgtgaggactcaaagagtcatgtaagaaggaaataatagcctt

SEQ ID NO: 34439 - DNA, 121 bp, Artificial Sequence
  Synthesized
  misc_feature (61): n=a or g
ttagaagctcattttcaaagcacgtgtgatctaccttggcggagccatggcatgtaaacantcctggggtgttcacaaagcgaacgctaaataccttttcactataggaagaacttgtctg

SEQ ID NO: 34440 - DNA, 121 bp, Artificial Sequence
  Synthesized
  misc_feature (61): n=t or c
ctgggagaagatcaaacccaaccactcacaaacagctggcactgtcttcctctacatacgngttaacatttgtccaagattactgtccttagagtgaaacggagccctgggagcactgctg

SEQ ID NO: 34441 - DNA, 121 bp, Artificial Sequence
  Synthesized
  misc_feature (61): n=a or c
ttgcaagctgtcttcagaattaaggggtttgtacatctcctagtactttctgtatgtgagntgagatctatttctcagtacagtgatagcaaattttatgctctttccagatatccacact

SEQ ID NO: 34442 - DNA, 121 bp, Artificial Sequence
  Synthesized
  misc_feature (61): n=t or g
gcagtgctgcaatgccctctcaaaccattttttaaccttcggatgctcatgcttttatttncaagagtgaaatacatttctgtaaatatttttcaatattcacttaaatgtttctaactat

SEQ ID NO: 34443 - DNA, 121 bp, Artificial Sequence
  Synthesized
  misc_feature (61): n=t or c
gccgttccagtcgcccgccgcccgcctcaccttggtcttgccctctgagaatccatagaangtctccaatgctttttttgtctctttgtccaactcagatagataatccttcatcgaactg

SEQ ID NO: 34444 - DNA, 121 bp, Artificial Sequence
  Synthesized
  misc_feature (61): n=a or g
ctctgttactttcttgtgcacacttcccaaattccctctagtttggatttagccgtgcacnttcccgatttgcaagcatcctacatgcattccttcatttttacaggtccttgaacattta

SEQ ID NO: 34445 - DNA, 121 bp, Artificial Sequence
  Synthesized
  misc_feature (61): n=c or g
tgatctgacaagttcttggagtacttcagtagacaaattttatatagaaactagatgaaantattaaaggaagtttgtatatgtttcattctaataaagagataataactcattgaagatg

SEQ ID NO: 34446 - DNA, 121 bp, Artificial Sequence
  Synthesized
  misc_feature (61): n=t or c
tacatttatttccatttccatctctatctgcaactactttcctttgagattttaggtcccngaacttgcactgtgatccttctctatttctctcttctactcttaactttaaatgagcctt

SEQ ID NO: 34447 - DNA, 121 bp, Artificial Sequence
  Synthesized
  misc_feature (61): n=t or c
atacagaaaaacacggggaatattttggggacatcatacttgatttattctaattctcaangaggagactaaattataccaaaaacaaaaggccagaattgttatataaaattatttcatt

SEQ ID NO: 34448 - DNA, 121 bp, Artificial Sequence
  Synthesized
  misc_feature (61): n=t or c
cctgttcaaaacaaagcagttaaaaaaagcaattatttcaatccacataaagctgcagttncaatattcctgctgccttcacttggtcttcagtgggaacttattttgcacggggctacaa

SEQ ID NO: 34449 - DNA, 121 bp, Artificial Sequence
  Synthesized
  misc_feature (61): n=a or g
ttcaatgtctatttcctcattagtgatccaagtgatagtttgttaaaacacgacgctaaanagcggctcaaaacagtgtttaatacatttggacaaaagaatataacaagaaatcgtgcgc

SEQ ID NO: 34450 - DNA, 121 bp, Artificial Sequence
  Synthesized
  misc_feature (61): n=a or g
ccaggattgactcttggaaaaacacttcttttaaagataaaatctgagttcactaacaatnagcaataaaaccagttcttcattgtaattgttagttcctttggaggctgcataattaatt

SEQ ID NO: 34451 - DNA, 121 bp, Artificial Sequence
  Synthesized
  misc_feature (61): n=t or g
gcatttcgtgcatagttccttgaatttaaaaatcaagtgtctgaagtatgtgtgaaaattnactttttccatctgtcctggagtgtggattactgcagaaacaattgctttgtgcatgaat

SEQ ID NO: 34452 - DNA, 121 bp, Artificial Sequence
  Synthesized
  misc_feature (61): n=t or g
gctgttggccgttaaagtagatgaatattatgagcctccacagagcaacaagctgaagtangattgtcctctgcggactaagacaaaggtgatacatacttactggagtctcatgaaggag

SEQ ID NO: 34453 - DNA, 121 bp, Artificial Sequence
  Synthesized
  misc_feature (61): n=c or g
tagttatcccattgtgttaatagagggcagtaagataagaataactaccagtcctcagtgnttcccacgtttattttagttttcggacacctctgtacattttgtggacaagttgctgagt

SEQ ID NO: 34454 - DNA, 121 bp, Artificial Sequence
  Synthesized
  misc_feature (61): n=a or g
atatgtaggtttctggcagaagttcttatgatgtacataccaggaaaactgcatggaaaantccacctctctatgaatatgtgcaaccaaagcattatgactggaaatgtctaaggatgta

SEQ ID NO: 34455 - DNA, 121 bp, Artificial Sequence
  Synthesized
  misc_feature (61): n=c or g
tgagcaggtgaggggaggaagccatggtgctttgcctggaaaattgctggtgttgtcacantgtgctggaagacatgggacgttttaaaacaagcatgcttctaatgactggaaggagaaa

SEQ ID NO: 34456 - DNA, 121 bp, Artificial Sequence
  Synthesized
  misc_feature (61): n=t or c
aacctgataacttctatggctacatcccatcaacatgtggggcaattaaacagagcaacangcagagatggaaccaagttacctcgcaggaactgtgcagccagcagcaatgtaatcggca

SEQ ID NO: 34457 - DNA, 121 bp, Artificial Sequence
  Synthesized
  misc_feature (61): n=t or c
attctttattaaacacacgggacaacataagaagaaagaacagtctttataagacagtttnatagcctgaggtgaagacatgaagacagcatgcattggaaacatagtcatcagaggcagc

SEQ ID NO: 34458 - DNA, 121 bp, Artificial Sequence
  Synthesized
  misc_feature (61): n=c or g
ctttccttgcttcctgagcagtctccttccaaatggtattggaaattagtacctgtaagtnatttacttttatgccagttgtcatctgcaaaatcatggctttttaaatttcttgggattg

SEQ ID NO: 34459 - DNA, 121 bp, Artificial Sequence
  Synthesized
  misc_feature (61): n=a or g
tggagtgcagctggggtggaacaacagctctcttccctttcttgcaggaattgtttaatgngtgtcctgttttgcccagccttgctctgaatacagcactctaaatggcctggtgtttatt

SEQ ID NO: 34460 - DNA, 121 bp, Artificial Sequence
  Synthesized
  misc_feature (61): n=t or c
agtcagatgggctgcaggtaatatcagcgaagggaggagacgcttgccacgctggtggttncaggcacaaatagccttcccacagccttctctttcctcaggctatgctctttctcaataa

SEQ ID NO: 34461 - DNA, 121 bp, Artificial Sequence
  Synthesized
  misc_feature (61): n=t or c
agaaatccctcagagtgagaacaagaatcctctgaattccctgaacttctcaaggttgtcntttaacaaaggagagctaaaagcagattcttctggcatgtcctgctgtcagtgagggcac

SEQ ID NO: 34462 - DNA, 121 bp, Artificial Sequence
  Synthesized
  misc_feature (61): n=a or g
tctgcccccacatccctgtcttctccccagttataaagatgctgtcttgtattccaggaangaactcaggattattgcgaaacagggacaataggtaagtgtcctgatccctatgggttcg

SEQ ID NO: 34463 - DNA, 121 bp, Artificial Sequence
  Synthesized
  misc_feature (61): n=a or g
taccagctacaactccaatcttccaaatttcaggcagaggacaggaatgaatcattttttnatgttaacatcactgcaactttctgagggctgaatttgtaggctctcagttttccctcaa

SEQ ID NO: 34464 - DNA, 121 bp, Artificial Sequence
  Synthesized
  misc_feature (61): n=a or g
gtggtcttctctgaaggcattagttttataaagtaacatctatgaatatctgggttttacntcatcctctagcatttttaccagtctaaaatgagagttcaaatctcctaatgtcggtcat

SEQ ID NO: 34465 - DNA, 121 bp, Artificial Sequence
  Synthesized
  misc_feature (61): n=t or c
tagcaagctgccacttcccattaatcaaggctatgataggagaaggctgagtttgacatgngcaggtgctttttctcccagcccgtctcagtcattttcagatcttggcccagcgccagaa

SEQ ID NO: 34466 - DNA, 121 bp, Artificial Sequence
  Synthesized
  misc_feature (61): n=t or c
cgcagctccccaattagcaacaactgatctgacaaacttgacatcaccagtccttctcttncatcaagaatgggtcaaagctgcaatgggacatcgcaggaccacacaaagtattcctcct

SEQ ID NO: 34467 - DNA, 121 bp, Artificial Sequence
  Synthesized
  misc_feature (61): n=t or c
cctgcataatattttaatccaactgtagttggcatgataccacgcatcaaatagaaacatngtgttatcgtactgatgtgttagcactacctctctccttgtagcagcccggcttattcac

SEQ ID NO: 34468 - DNA, 121 bp, Artificial Sequence
  Synthesized
  misc_feature (61): n=a or c
aagtttgttttccaaaaacaaaaaccaatcctgacaaatcattggaagcacaaaacacttntacacaagattgtaagatgtgttgttatattatcttggaggcataagatgtagtggcttt

SEQ ID NO: 34469 - DNA, 121 bp, Artificial Sequence
  Synthesized
  misc_feature (61): n=a or c
aaattaatcattttggtgcaactgtgctaataattatttaggggaggatgaacagctgaangaacaaaattgaacctgacaagagaatgaaaataaataaacctcaagaaggatgaagagg

SEQ ID NO: 34470 - DNA, 121 bp, Artificial Sequence
  Synthesized
  misc_feature (61): n=a or t
tccagcttaaatgggatgaatcattatttttaaatgcatacttctggggaaataacaaaancagagaatatgattagctgagatgcagattttcaaagctaaggtgatgtgaatctctacc

SEQ ID NO: 34471 - DNA, 121 bp, Artificial Sequence
  Synthesized
  misc_feature (61): n=t or c
ggatgtttccaaatggctctcgtgggcaaatgctcgtgacttctgcactaattcatggctnagatgttagtaaacctctccctgcaccaaacacatgtggtaagttaggagcaaagcattc

SEQ ID NO: 34472 - DNA, 121 bp, Artificial Sequence
  Synthesized
  misc_feature (61): n=a or t
attaatactggataacatcagtgagctgttttagagctagtcctgacttgctttcgttacngaccttagaccataaaactataatgtgctgatcaaaataccctgttaaagttaggaggga

SEQ ID NO: 34473 - DNA, 121 bp, Artificial Sequence
  Synthesized
  misc_feature (61): n=c or g
atcatttttatctttggatgaagcagcgttgagttggtctgtatttgaacaactcaaaganctgaacagccactgattaatgctcacaaccgctgattaatggccaataaggcagaccata

SEQ ID NO: 34474 - DNA, 121 bp, Artificial Sequence
  Synthesized
  misc_feature (61): n=t or c
aaacattttcacttgagtatttctgtgcttttatttctgtttacaccctttgacagtagcntgtgctatttggggtttcagaaaagatgtcaatgtctaccgaaaggtagagcttaccttt

SEQ ID NO: 34475 - DNA, 121 bp, Artificial Sequence
  Synthesized
  misc_feature (61): n=a or g
tgagacttctctcaaaaggaatttcaaatctcagctttcctatgtctcagcactactaccntcatttgatttcaacagcttaggagaaaaagaaataagaagaaaaatagtgaaaaaaggc

SEQ ID NO: 34476 - DNA, 121 bp, Artificial Sequence
  Synthesized
  misc_feature (61): n=a or g
tatatttttgcttccctcctctatcacattagtttttaatccaacacctaatttcattgangaatttatattggaagaggtatctaaagatcttttctcccagcttctcaactaaagcagg

SEQ ID NO: 34477 - DNA, 121 bp, Artificial Sequence
  Synthesized
  misc_feature (61): n=c or g
gttccttcagttcccttgcaatgaaattctcgctcacatacattgactacagctacctggntcccatcagtactacctgatggaaagtagaagtctacaaatctcactgcagaggtttggt

SEQ ID NO: 34478 - DNA, 121 bp, Artificial Sequence
  Synthesized
  misc_feature (61): n=t or c
tgtatttctgatgttcagtatctttaacatttatcattttcttctgcactgctcacattcnttcttgaattcttctgatactactgaagtaagaattttgccaataacttcagaattgagc

SEQ ID NO: 34479 - DNA, 121 bp, Artificial Sequence
  Synthesized
  misc_feature (61): n=t or c
tacaagtgtgtaaaaaagaaacctcaattaacatgtttacatacgtccaaaatgcaccttntgcagataccatgaatcttggaaacgcacaggactctgttttgtcagagcatgctggcac

SEQ ID NO: 34480 - DNA, 121 bp, Artificial Sequence
  Synthesized
  misc_feature (61): n=t or c
cacagtgtgaatgaaatttctgtaagtaaggaagcaaacactgggaaaagatacctggggncagtggatagcaccccatcactgcatgactttaagaacaagttacgctagcacgacacaa

SEQ ID NO: 34481 - DNA, 121 bp, Artificial Sequence
  Synthesized
  misc_feature (61): n=a or t
tagattgtaataggatgttgtgccacacttgcctaagaagaccctgatattaaaaatactnataaaaatgtatagtctacatccttttgtttcttaattttgttttttccttccctttcca

SEQ ID NO: 34482 - DNA, 121 bp, Artificial Sequence
  Synthesized
  misc_feature (61): n=a or t
ctcactgtaagtaatcaaaaaaataaattcttactgaaaattgtctggttacaaaatggtnctaaatgcaagcaaaatacaattgttggaagaacagcgatatgaataaatctgacagtaa

SEQ ID NO: 34483 - DNA, 121 bp, Artificial Sequence
  Synthesized
  misc_feature (61): n=t or c
acaactttccaattttcttctccagcatccagctactgtttgagctaagcctagaactagncttcctgaagcctctgtagtttgtgtcaaaagaaaaacataaatcaggcagctatactgg

SEQ ID NO: 34484 - DNA, 121 bp, Artificial Sequence
  Synthesized
  misc_feature (61): n=t or c
gaagggctgaggacggtcccagtggcaacagtgttcctatggtgtagggataaaggcgganaccatacggataccccatagggtaccactgggatgctccagggggtaccatagggatatc

SEQ ID NO: 34485 - DNA, 121 bp, Artificial Sequence
  Synthesized
  misc_feature (61): n=a or g
gctaggctttcacactgtgcactgccatcactaatccacatgtcaacatttacataacacnctatgggcctcactgagcaatgtaggactagttattagatggaggtgttactggcatata

SEQ ID NO: 34486 - DNA, 121 bp, Artificial Sequence
  Synthesized
  misc_feature (61): n=t or c
caccagtggacaaaattagaattgacaatacctaatcctagtgcatatggaatagctacangttgtctcagcgtgctcatacaaatgtctccttactcataattcaagaactcattacata

SEQ ID NO: 34487 - DNA, 121 bp, Artificial Sequence
  Synthesized
  misc_feature (61): n=t or c
gcccacagtctcccaagagaagtattacctctattacttattcccatgtgaaactctgttnatggtttcaaattctagtagcaaatgacataaaactccagaagaccatttctacacactt

SEQ ID NO: 34488 - DNA, 121 bp, Artificial Sequence
  Synthesized
  misc_feature (61): n=a or g
cactccctttaaatttagatactccactttgtaatttttattcttaaagatttcacagatntttgctctagaagactcagcttacatctgtacacgcacagaatcccacccatggccctga

SEQ ID NO: 34489 - DNA, 121 bp, Artificial Sequence
  Synthesized
  misc_feature (61): n=t or c
tgtaccatgactacagagaataagagacatataaagggaaagctcgtgggttgttcagcanatctatggcagagctgaataaaatgtccagtttcttggccattggatcacgcactgtaca

SEQ ID NO: 34490 - DNA, 121 bp, Artificial Sequence
  Synthesized
  misc_feature (61): n=a or g
tcataagatttcatttcaggcttaatgcagcagccacacagagccatacactcaatgaacnggttaggaagggaatatgaagttgttggagagaggatgagaggtttccatgacttgtact

SEQ ID NO: 34491 - DNA, 121 bp, Artificial Sequence
  Synthesized
  misc_feature (61): n=t or c
ccttcgtgcccactgtgaccaacctcactgagctcctcacggaccgcaccgaggaaagggncaggaaggctctggaccacagaacatctgtttttttaataaatataaacatacctatata

SEQ ID NO: 34492 - DNA, 121 bp, Artificial Sequence
  Synthesized
  misc_feature (61): n=a or g
aaatccacatgaatgcgagggtgctccagcttaactatgccctgaaagaagaggatgagtngtggacaggagggtggcgcagagggtgggacagaacaagcactctcaggcaaacaaagct

SEQ ID NO: 34493 - DNA, 121 bp, Artificial Sequence
  Synthesized
  misc_feature (61): n=a or g
gctgacataaatattgcagtgataaggttcttaaatcatgtgaggcaatgggactgctttngaattttgttaatagggtactgcattgcagttttttccttttgagattcttactcttttc

SEQ ID NO: 34494 - DNA, 121 bp, Artificial Sequence
  Synthesized
  misc_feature (61): n=a or g
atggtttttttgtcactcttctctgcagccactgtagagcttctcagctctgctgaatacncacctttctgatttcttcctggcacacaagacatggagaattttgtgttctgtcatttat

SEQ ID NO: 34495 - DNA, 121 bp, Artificial Sequence
  Synthesized
  misc_feature (61): n=t or c
tgccaacacagataaattcacagctgctctgtagtttacacatgagctagtcacagttctnctgatttcctttttcattcctacctgcactagttctctattttcattctttttttcctgt

SEQ ID NO: 34496 - DNA, 121 bp, Artificial Sequence
  Synthesized
  misc_feature (61): n=a or g
tcacatgcacacgttactgttgctcattttctggtgcagagattgatggcaacttgtttcnatgtgagctgctgcgtctcattttcccattgcattttacaagggtttcctgacttcttca

SEQ ID NO: 34497 - DNA, 121 bp, Artificial Sequence
  Synthesized
  misc_feature (61): n=t or c
tctttaaatatctccttacctctataaatactatactctttgcctatgcagatacattcanagtgtacttctacgtgcaggtgaaaaaatcagaccatgaagttgtttggaaacggcccat

SEQ ID NO: 34498 - DNA, 121 bp, Artificial Sequence
  Synthesized
  misc_feature (61): n=a or g
ctcatgtgttcactggtcctcatttggactaggctctctcacagcatcttttgagagaccnaatgttcattttgcacttggaccagatctggacccacatgtatatgtgcaaagatacaca

SEQ ID NO: 34499 - DNA, 121 bp, Artificial Sequence
  Synthesized
  misc_feature (61): n=t or c
tgggaatgtgtgctctagacaaccaagctacatctaaaactctccctacatactaacaganggaggactggaagcattggtaccatgctgtgtcatcattaccatctgctgacaatgtgtg

SEQ ID NO: 34500 - DNA, 121 bp, Artificial Sequence
  Synthesized
  misc_feature (61): n=t or c
tttgtcccgaactcttctgagctctcgaggcaggtaaaaggcggttgctcggtgatgcatncaatgggagctgcacggttttcctcttaaccacctgtatggccctcactgtgctgcagct

SEQ ID NO: 34501 - DNA, 121 bp, Artificial Sequence
  Synthesized
  misc_feature (61): n=a or g
agcgtctctggaaaaaaaagaaaaaaaagagtgacaacagcttcctaatcgctacttttancataactttcaaaataagagaaagaatccctcgtgcaattgtaaaaagaattaaacaatt

SEQ ID NO: 34502 - DNA, 121 bp, Artificial Sequence
  Synthesized
  misc_feature (61): n=a or g
caaatacctctgcaggccccgtcgggtggaaatcgcggctttgctcgacctgaccgagcgncaagtcaaagtgtggttccagaaccgcaggatgaagcacaagaggcaaacacagtacaaa

SEQ ID NO: 34503 - DNA, 121 bp, Artificial Sequence
  Synthesized
  misc_feature (61): n=t or c
tagttaattgtcactgttcctacatgatttattaaagttgtggaataattaaattacatcncatctatcttcttacattgtctggataactaccgtgttaaagaaacacaggtagaagtga

SEQ ID NO: 34504 - DNA, 121 bp, Artificial Sequence
  Synthesized
  misc_feature (61): n=a or c
tactaactattacatgtaaacaccccgactgcttcttgctttgtttactagttacctggtnaataagtcttctgaaaaagttctgctatcatatagttgagctttagctatggacaatctc

SEQ ID NO: 34505 - DNA, 121 bp, Artificial Sequence
  Synthesized
  misc_feature (61): n=a or c
cgagagagatcacatattcaactttccagtctgtcccctgaatgcatggcttaagatatangaaacctgagcattacttgaggccccagcctacatttagactaagttagacagtgattaa

SEQ ID NO: 34506 - DNA, 121 bp, Artificial Sequence
  Synthesized
  misc_feature (61): n=t or c
tcttgtctgtcctctgtagcttctcttcccacataggacacgaaagataataaagatactnttgataaagaaataaggatttcaatacaagcacaatccttattcttttttagtatcattc

SEQ ID NO: 34507 - DNA, 121 bp, Artificial Sequence
  Synthesized
  misc_feature (61): n=a or t
tacttattttaagctgtgaaatactaattttaaactcttctagggctacagtaaaagaaanggtctaaacagaatcgcacaaaacctctgtggaaactaagagtaaaaataatcaagattc

SEQ ID NO: 34508 - DNA, 121 bp, Artificial Sequence
  Synthesized
  misc_feature (61): n=a or c
ttgtgttactaagaacttagcctttgttccctgtctttcactctgtgaacaaaggtaaggngaggggaaagaaagtgagtgtaagggaggctcagttctccgcttagcctaaaaaaagctc

SEQ ID NO: 34509 - DNA, 121 bp, Artificial Sequence
  Synthesized
  misc_feature (61): n=a or g
ttctcagcagtctcacagtgcttttggaacagccggttcttctgctgcgtttgcaaaatcnggccctccacagctgccttctttctacaaaattgggtcaaagcgagcgaatttcgatgaa

SEQ ID NO: 34510 - DNA, 121 bp, Artificial Sequence
  Synthesized
  misc_feature (61): n=t or c
tatcttgagaacttctctgccaacccatagtatgagtgctctgcatgacacacaccttcantgctacaggtccaagatgactaaactaaatcaaataaatcacgtcattactttttcttaa

SEQ ID NO: 34511 - DNA, 121 bp, Artificial Sequence
  Synthesized
  misc_feature (61): n=a or c
agagtgtaactgtcaagagtttctggctgaaaattagcctatgccataagaaaaagaagtnctgaagcatcttttccatgtctccaaagaaaccaaaggcacagtcatgtggccaagagat

SEQ ID NO: 34512 - DNA, 121 bp, Artificial Sequence
  Synthesized
  misc_feature (61): n=a or t
gtcacttcagctgcagctgagacagagcttctatagctccttctattgcaaacaacttccngctcaaagcaaaacagtctgtgaagcaaacactgaagaaatgcaaagggtttctgtgttg

SEQ ID NO: 34513 - DNA, 121 bp, Artificial Sequence
  Synthesized
  misc_feature (61): n=t or c
agccattatattaggtgagtagcaagacagtgtcctggatgtctcaatgtccatttgacangaaaaaaggcaagaattacttgtttaaagctactagtgtaaactgggagaacatctgctt

SEQ ID NO: 34514 - DNA, 121 bp, Artificial Sequence
  Synthesized
  misc_feature (61): n=c or g
acttgcctcaatgtccttatttcatgagcattgctgtacagaattatgctgtaggtacctnaggtgctttggcctgtgtgtttgacagaaacctttcagtccaatcagtaagagttttggc

SEQ ID NO: 34515 - DNA, 121 bp, Artificial Sequence
  Synthesized
  misc_feature (61): n=a or g
aattaaaggaaaacaaatctttatcacaccatgaggctcatgaagttcacagtatgtaganttcctctgttaatactgatacattttggaatactaatacatctggtagactgggattttt

SEQ ID NO: 34516 - DNA, 121 bp, Artificial Sequence
  Synthesized
  misc_feature (61): n=a or g
ctctggtagatcttaattgtcaatattggaactgatgctctaaattcctgagtgtttttcnttaactgctgtgggtttcagaggttaatggttaaacgttccccttaggttctggacagag

SEQ ID NO: 34517 - DNA, 121 bp, Artificial Sequence
  Synthesized
  misc_feature (61): n=t or c
tttatttatttagcttttaagctatatacatataatgttcataaccatatttgttctaganggtgtctttacagaccatgcactatgcatgatcagtgaatgatggagtatttcatccagc

SEQ ID NO: 34518 - DNA, 121 bp, Artificial Sequence
  Synthesized
  misc_feature (61): n=t or c
gcagcgtacacatgctgtcctctccctctcaggttcccagctgcatcccctcacaatttanttcaaccatataaacaactatttcacacagcacttatctgtcaggcatggggaaacaatt

SEQ ID NO: 34519 - DNA, 121 bp, Artificial Sequence
  Synthesized
  misc_feature (61): n=t or c
ccagtcctattgccaagacaatttttgtaaatcaagtataaattggtttctgtccttaaantagaatattagaatcacaaaatggttaggaggatgttgaagatcccagttccaacccacc

SEQ ID NO: 34520 - DNA, 121 bp, Artificial Sequence
  Synthesized
  misc_feature (61): n=a or c
gtagtgcagcgaagtttgagggcagcttccttgtgctctgtataaggcagcttttctaccntacggagaaagaatggcagcacctctgactttgttcttcacagttgctcctcagtgctcc

SEQ ID NO: 34521 - DNA, 121 bp, Artificial Sequence
  Synthesized
  misc_feature (61): n=a or g
tgtgcctccttatgcccctgagaattcccgcatgtgctgctcagtaccctgcattatggcntagctgtgcatctgcatggagtttctgtgtggtgtcgtacaaataggacacataggacac

SEQ ID NO: 34522 - DNA, 121 bp, Artificial Sequence
  Synthesized
  misc_feature (61): n=a or g
gtgggacagctggtaaaagctgcaaacatcagctactggtgacagaaagcctttgctgctnaaaggcctcgaggacgggcactgcccttctccctgcattcaccacaattgtcaaatgggg

SEQ ID NO: 34523 - DNA, 121 bp, Artificial Sequence
  Synthesized
  misc_feature (61): n=a or g
ccaggctatggtgtccacccgtaaggatgccccaggtccctctgtggtaccctaaccctantcctaaacctaatgcaatgcaatgctatgaattgaaatgcagtttgctaagtgaaatgca

SEQ ID NO: 34524 - DNA, 121 bp, Artificial Sequence
  Synthesized
  misc_feature (61): n=a or g
atgtggttttactgtaatgttcatattatttgcaagtagtgctgcagaataaaggcagccncacacctgaagatgtgtcctgcagtacctaaggacgtagcaatcctgaaaggagggacag

SEQ ID NO: 34525 - DNA, 121 bp, Artificial Sequence
  Synthesized
  misc_feature (61): n=a or g
agcaatgtttccattccattgcttgagaataagatcaaccaagaccacagatgcacagagngcaaaacatattcagacaagatccaaccgcctttccttgcaggcagtatatctggaatgg

SEQ ID NO: 34526 - DNA, 121 bp, Artificial Sequence
  Synthesized
  misc_feature (61): n=t or c
aatactgcttggccctcaggtctgtagtgaggaagttgaggaggtggtgagtgggaactgnaagggtgagcttggttagaggaggactgctatagcgaaaggcaggaaagccaatcacagt

SEQ ID NO: 34527 - DNA, 121 bp, Artificial Sequence
  Synthesized
  misc_feature (61): n=a or c
cctgattctctctcaccaatgggcaccacgaactgttgaccagatatctccaaacgtatgncctcatttcagtatcagcatccaaggccaatctggctgctcagatatctttttaacaaat

SEQ ID NO: 34528 - DNA, 121 bp, Artificial Sequence
  Synthesized
  misc_feature (61): n=t or c
tatgccatagtgccgagattatagaagtcagtatttgttcagaggcttttactggagaccngtagaaagtagaagctataactcatactgccaaagaatgttcctgttagcacaacttgtg

SEQ ID NO: 34529 - DNA, 121 bp, Artificial Sequence
  Synthesized
  misc_feature (61): n=a or g
agttgcaaccggcccaaagcagcaatctcagtttttcatgttaatgctctgctaatgcatnttatcaggggtcacaccaaagcacaaaggtgtttcccctgacacctccaaatgacctcgt

SEQ ID NO: 34530 - DNA, 121 bp, Artificial Sequence
  Synthesized
  misc_feature (61): n=t or c
caattgatattgttttgtaaagttttattttaatatacaggaaagagatatgtttctaccnttactctggggaggtcagactatacaggcttaaactaattagagaaaaatcaatgtcaaa

SEQ ID NO: 34531 - DNA, 121 bp, Artificial Sequence
  Synthesized
  misc_feature (61): n=c or g
tttataatacaaattaagtatggttgttcctttgacattgattgctttattcttaagtctnctgttaaggagaaacctgaataatataaccaatcatattacatgaatgaaaaatatctag

SEQ ID NO: 34532 - DNA, 121 bp, Artificial Sequence
  Synthesized
  misc_feature (61): n=t or g
ctcccaacccctgaaaggttgactgagttgtgcgtctgattttttcagacagaagtgatcncagggaaagaattaattgataactgtcattgattttgtgtgtgtgtgcatgtgtgtgtgc

SEQ ID NO: 34533 - DNA, 121 bp, Artificial Sequence
  Synthesized
  misc_feature (61): n=a or g
tcttaggcaattttggattggaatgccataattcactgcagcatgtagagaaactgcctgnaagttaaacagatgctaagaaagtatcttacttctcttcctaaaccactcgtcttccctc

SEQ ID NO: 34534 - DNA, 121 bp, Artificial Sequence
  Synthesized
  misc_feature (61): n=a or g
gggaaaagctgaattgcttcagcatctattcatacctcgtccggagctggtcaccaatccnttcccaaggccatcaaggaagcggtgcccactgtgggttgggtgcgaggggagagctgag

SEQ ID NO: 34535 - DNA, 121 bp, Artificial Sequence
  Synthesized
  misc_feature (61): n=a or g
tttgaaagggtgtttccaatgatttcttattcacatagctaacatgaaagagaatagaagngagagaaaggcagagggaacaaggaaaaggagagaacgttgttggaatagaagtcacaac

SEQ ID NO: 34536 - DNA, 121 bp, Artificial Sequence
  Synthesized
  misc_feature (61): n=t or c
ataaaaaaaccctcaaaaaataaattgcttctacttcatgttcttagaaatacttcctaanagtatcttaaggcacactgaattatgaatttccacatggcttttgccagtgaaagttttc

SEQ ID NO: 34537 - DNA, 121 bp, Artificial Sequence
  Synthesized
  misc_feature (61): n=t or c
aaaacagatggtgtaggcaacaatcttcaacttaaatgagaggctacaagactggtttccntccctttgggaatacccatgttagccccaaaagtggcttatgtcacgtaatgtcctgaga

SEQ ID NO: 34538 - DNA, 121 bp, Artificial Sequence
  Synthesized
  misc_feature (61): n=t or g
gctccagcagctgcctctgccccataagggcacggcgaggtgagcgctgccttcccaatgncagcataaccctggcgcttctcccaggagatgctcctttgcctctctgctgcaaatgttt

SEQ ID NO: 34539 - DNA, 121 bp, Artificial Sequence
  Synthesized
  misc_feature (61): n=a or g
tatcatgccaacacctggtcagctttgccctaaggggcctttcttatctccatatgctctntgattgtgaaaggacatgttttatcctttttataaacagtttcagcaaggtaatcttaca

SEQ ID NO: 34540 - DNA, 121 bp, Artificial Sequence
  Synthesized
  misc_feature (61): n=a or g
cagtctgaagttttaaaatctgataactgatttggattatgccaaggctaaatgttcttcncaccacattttttataagcaacgagaagttgcttgctgaggatatttttgttttatatat

SEQ ID NO: 34541 - DNA, 121 bp, Artificial Sequence
  Synthesized
  misc_feature (61): n=a or c
taatcaactctaaatctgttcatgtaaccgtatgtgcattctctcttggtgttccttgtgngacagtaacatccaaccacttcacagaataaactgagacagaaaagccttggataagcaa

SEQ ID NO: 34542 - DNA, 121 bp, Artificial Sequence
  Synthesized
  misc_feature (61): n=a or g
agcaattcaggggaaaatatacaaacagtatagagaacagattgaaaatataattactgcnaaaacagagaaaacttatgaggagagaatcatgcaagggatgaatgaataatataagaca

SEQ ID NO: 34543 - DNA, 121 bp, Artificial Sequence
  Synthesized
  misc_feature (61): n=t or c
gcacaaaatctgcaaacagggaatattgcaatgtttactcctctgtgaggccatgaaccangacctctttcccaattattcttgtgcatacaaagcccaatcccacacatctttcttattt

SEQ ID NO: 34544 - DNA, 121 bp, Artificial Sequence
  Synthesized
  misc_feature (61): n=t or c
gatgggaaattcaatctggagcattgtaataatatttcttttaaatcacagtgacgacagngttgtttcctgtaagagatgctcgtgatccctcccctggtgcagactgcaggaagcccta

SEQ ID NO: 34545 - DNA, 121 bp, Artificial Sequence
  Synthesized
  misc_feature (61): n=t or c
gtttgtcagaagaaacaggcaaaggagaacatcttctctctggtaaatgagaagagggagnaagtctaagggtcagacaacttgcatcccaaggtcatgaaggaactggctgatggctgcc

SEQ ID NO: 34546 - DNA, 121 bp, Artificial Sequence
  Synthesized
  misc_feature (61): n=t or c
tgcagctttgcagcccgggaaagggagggaggatttggtagatctttagtttgcagtaaancagagcagatggttattgttttctcacttttcttaatggtttgttttatctgcactgctg

SEQ ID NO: 34547 - DNA, 121 bp, Artificial Sequence
  Synthesized
  misc_feature (61): n=t or c
ctatgcaggcatgatatattttgagctatatcttttgtattactgcattagaaatcctcanagatgaggaacttgagaaacttgaaaagtctacaaaatgttacagaattatcttaacttg

SEQ ID NO: 34548 - DNA, 121 bp, Artificial Sequence
  Synthesized
  misc_feature (61): n=t or c
agaaggggacagaatagagccaagtcaaaactgccagaaccatatgaaccaggtctgttcngtaaacacatatttggaaacgaacgtggtacctaagaatacagacatgggccattctgac

SEQ ID NO: 34549 - DNA, 121 bp, Artificial Sequence
  Synthesized
  misc_feature (61): n=t or c
gtcactgagtttcagcagcttcaacacaggttttttgctcacagtcagattggtgttaaantcaaaagatgatattgcaccaacaagttcttttactacgtgtaatactagaggaagctga

SEQ ID NO: 34550 - DNA, 121 bp, Artificial Sequence
  Synthesized
  misc_feature (61): n=c or g
catttgtgaacctggggagagggtctattccttgctagcccttcatcccttgtgataagtnagatctatgaagactagtgctgaaggagcaagggcaacacagcatgcacacgtactctgg

SEQ ID NO: 34551 - DNA, 121 bp, Artificial Sequence
  Synthesized
  misc_feature (61): n=t or g
agaaaactgtgatctgaagtccctttaactaacatttcccatgaggtctgagaatcaggcngggaacctagagtgtacctaaaaataagtgtttaacattacatactgacctatgacacac

SEQ ID NO: 34552 - DNA, 121 bp, Artificial Sequence
  Synthesized
  misc_feature (61): n=a or g
ccttgggttttgtggagagtctcaaagtggttccacaaagggcatgaaggcagttatggcnatggatagacagttatttaaacagcattcattcccattagcatctgacttttaaacttac

SEQ ID NO: 34553 - DNA, 121 bp, Artificial Sequence
  Synthesized
  misc_feature (61): n=t or c
tacagcagtgtgtcctgacccatgaatatgattcttaggtaacattaccacaaatgctaanaattctcataaaacactatagaacgcagctggctcgtacatgttcccaaaacctgaaaaa

SEQ ID NO: 34554 - DNA, 121 bp, Artificial Sequence
  Synthesized
  misc_feature (61): n=a or g
tatattaggactaatttcatcaagaccatcataactaaagccacaaagctgaattgatgcnatgtctgctaatatatccacaatcacattatctcctttgtttgtaggtcatgccaatgta

SEQ ID NO: 34555 - DNA, 121 bp, Artificial Sequence
  Synthesized
  misc_feature (61): n=a or g
caaactccatattgatcattcagctcatgaagctcaaataaggaatctgtggtctgtaatncaaaatagacccatgactatgtaacggtcacaatatctgtgaaggcaaaaatcagacctg

SEQ ID NO: 34556 - DNA, 121 bp, Artificial Sequence
  Synthesized
  misc_feature (61): n=a or g
tgctttttggtgaattgccagcatcacctaaaggtccatggcagagctgaattcttccctnttttcttgggtttcccaagctgggctggtatggcagaacagctctattcagaagcagcat

SEQ ID NO: 34557 - DNA, 121 bp, Artificial Sequence
  Synthesized
  misc_feature (61): n=a or g
cacctgaagaaagcgtaagtctaacgctgactgcaatacacttcacagtgaacaaaacacntcaataaactcagccatttcttttcagatagtgaattaggagatggagcaacaaatatca

SEQ ID NO: 34558 - DNA, 121 bp, Artificial Sequence
  Synthesized
  misc_feature (61): n=c or g
agccgcagctgctgcaacccataagaagcgcagtaatgtgttcactgactccccattgaancatatcattctgtcaggaaccaccatggagcatccagtgtagcctttctaccgcagcaca

SEQ ID NO: 34559 - DNA, 121 bp, Artificial Sequence
  Synthesized
  misc_feature (61): n=c or g
ctcatttttactttcattaagcaaaataatccacataggcaccctacagtacaaaaccagnatccttactaggacagaatgcagagaaatctgaagggttggcctttcggcacatgaaggg

SEQ ID NO: 34560 - DNA, 121 bp, Artificial Sequence
  Synthesized
  misc_feature (61): n=a or c
gtacctattttgaaatatatttttgtttgttaggagattaggtacagtggtgttatcacangtattttctctaagatttcgcaaacttgcgtatagtttaagacaacagttgtaaggattt

SEQ ID NO: 34561 - DNA, 121 bp, Artificial Sequence
  Synthesized
  misc_feature (61): n=t or c
aacagttttagagatagcaagatgttatcttccccttacactaaacagcacattaaagtgnacgtgccagagccacacatcagttgtatagcattgcagccagggtgtagaccttctttag

SEQ ID NO: 34562 - DNA, 121 bp, Artificial Sequence
  Synthesized
  misc_feature (61): n=a or g
ttaaatgaatcacaatccagcatcatttccccctttatatatgtttgccagaaagtgaagnggcagtaaaaagcgttcctgaagcctgaacttgtaagcaaaggatcactgcagccacact

SEQ ID NO: 34563 - DNA, 121 bp, Artificial Sequence
  Synthesized
  misc_feature (61): n=a or t
aacagccttacagtttcactttaataaggtcaagattaagaaagatttaagcccaggtggngggctttgtaaggaagtcggaatggatcaaaaacttgctatgccttatcctcatgaaagt

SEQ ID NO: 34564 - DNA, 121 bp, Artificial Sequence
  Synthesized
  misc_feature (61): n=a or g
gacagcagccaggctttcagcgccccgcagtctctgacaccaggaatgcagcacagtgtanattcacgcccaatttttgagcctctacaatagggtttgcagcaacagtggccatctgcat

SEQ ID NO: 34565 - DNA, 121 bp, Artificial Sequence
  Synthesized
  misc_feature (61): n=t or c
cagtgtgccctgcagcgattcgtgctgcaatcctttatcaattcctgtcaggcattattcngccagcttgtaatcctatagcagaagtctgcataaaaaaaacgctcaggaaagaaaaagt

SEQ ID NO: 34566 - DNA, 121 bp, Artificial Sequence
  Synthesized
  misc_feature (61): n=t or c
cagctttttttgcttacttatttgtctgaccccacagctaagagcgtctaaaaagaacaangacaagaaaattctattagttgtgagagattacagcaccacccagtgcttcctgttacat

SEQ ID NO: 34567 - DNA, 121 bp, Artificial Sequence
  Synthesized
  misc_feature (61): n=a or g
attctgctgaaatccctcctggtttcagaagaaaaccatttaaagtcaattcatttcatcncgccaagtctgaaggatgaaacaatttgaaacggagaaaactgccacggtgtctcctttg

SEQ ID NO: 34568 - DNA, 121 bp, Artificial Sequence
  Synthesized
  misc_feature (61): n=a or t
tacagctgggaaaaataccacaatctcctactactgcctactgagtgcataaaaacttggntctctcaacctgagggagaagagaggccttcctcatgcgcagtgttgatatttttggaga

SEQ ID NO: 34569 - DNA, 121 bp, Artificial Sequence
  Synthesized
  misc_feature (61): n=c or g
catatagctgtaaaaattttggctagagttacttctgagtttctgctgtgtaatttagggnccatactctctaggcacatgaaaggacagagatggcaagtcacagtagaggggggatact

SEQ ID NO: 34570 - DNA, 121 bp, Artificial Sequence
  Synthesized
  misc_feature (61): n=t or c
agtttataattctaacagactgcactgttcctcagatgtgaacattgccagccagagtctntaagcacaaaccctcttaaatcatctttttcctggaatcataaagaagaaagaaaaagtt

SEQ ID NO: 34571 - DNA, 121 bp, Artificial Sequence
  Synthesized
  misc_feature (61): n=c or g
gcatgagcatttatactccctcttttcctaaattaaccaaaactacagtcatctatgctanctctcagagccctttgcaagctacatgagttaaaactaacagtcatgctgtgagttttca

SEQ ID NO: 34572 - DNA, 121 bp, Artificial Sequence
  Synthesized
  misc_feature (61): n=a or t
caaagcacatccagtgagaaggtttcctccagaaatctaaaatgaacacttacatggtccnaaatgcagatttgttacccagtgtgcagtaagctgatctcacacagagagatgagatata

SEQ ID NO: 34573 - DNA, 121 bp, Artificial Sequence
  Synthesized
  misc_feature (61): n=t or c
tctcatactattgatgggagtgaacctattggcatctggggtgcaaacatttgagcacaangcatattacagagctacacataaattgtacaacgatgttggagttggacatggcttgaca

SEQ ID NO: 34574 - DNA, 121 bp, Artificial Sequence
  Synthesized
  misc_feature (61): n=a or g
tgggtggagaggcatatggggaaagctggcacttcatcttatttctggtaattagaatatntgagaaaatgcatagaaatgtcgttatgtatattatatatagtacttcacacaaagaaat

SEQ ID NO: 34575 - DNA, 121 bp, Artificial Sequence
  Synthesized
  misc_feature (61): n=t or c
cctgtaagggtcatcaactccaactcctggctctgtacaggacaacccaaaacccaagccntatgcctgggagtgttattcatattcttcttcagctctggtggcttggggctgtgcctaa

SEQ ID NO: 34576 - DNA, 121 bp, Artificial Sequence
  Synthesized
  misc_feature (61): n=t or c
tgaccaggatatctcaggactccagggaataaaccagaagatgaagcagcccagctaccangtggtcatctgatagcaccgagacaagggaggtggaggaaggaagcagtactgtgattcc

SEQ ID NO: 34577 - DNA, 121 bp, Artificial Sequence
  Synthesized
  misc_feature (61): n=t or c
cctgcgacctccagccacccaccatcacaggtgacggtgtccaggttttcctatttttcangtgagaatgatctacacagcccagtgagttactgaattttgcagggtgcttcacctctac

SEQ ID NO: 34578 - DNA, 121 bp, Artificial Sequence
  Synthesized
  misc_feature (61): n=a or g
agtctgtccccttctttcttatagcaccccttcagataccgaaaggacttggctctggatnaggcatgtgcttgagtctatctgcccagccccacattgtgtttgctctcagctctgcccc

SEQ ID NO: 34579 - DNA, 121 bp, Artificial Sequence
  Synthesized
  misc_feature (61): n=a or c
cattttatggtttactttttacagataatgatgtgtttgcacagattagctttcaggcaanttcgccacacattttatgtcctctcacattgtaagtatcctgcaataagcaccatgcctt

SEQ ID NO: 34580 - DNA, 121 bp, Artificial Sequence
  Synthesized
  misc_feature (61): n=t or c
taatgcctcaattgctcttgttcagtctgaatattttccgcgctcttcggtgacagcaaanctttgggaacttttgctgatattttgatccagatgcgtgaaagctcctcatcttattatt

SEQ ID NO: 34581 - DNA, 121 bp, Artificial Sequence
  Synthesized
  misc_feature (61): n=t or c
gatttatgataatactactactgaagacttctgaaggcgggatgcagtgtgatcctatttnatgtttgaatgctctagaagaatttactgtggggcattctgtgtaatcgggactactgtt

SEQ ID NO: 34582 - DNA, 121 bp, Artificial Sequence
  Synthesized
  misc_feature (61): n=a or g
tgcagggctcaaccacaaactgtgctgagcattttatggcaccagtctgcaagtgggagcncgttcctcagaaatgagggatgctgatatcaacaccgggacactgagctgcacctgcgcc

SEQ ID NO: 34583 - DNA, 121 bp, Artificial Sequence
  Synthesized
  misc_feature (61): n=a or g
acatgacacctgccccaagcagtttgcaatctaaaattagatatgctacagtgagtgggantaacatgtcatgatttttgttgcagtgtaagagctggtgggctcatcaaacaaaccagaa

SEQ ID NO: 34584 - DNA, 121 bp, Artificial Sequence
  Synthesized
  misc_feature (61): n=a or c
taaggaatctcactgctcctatggactaggtgggcactcaagcacgtgatgaactgagccnatctccaggaacaccagccttgctacacagctgtcatcgccacactgctctcctctgcac

SEQ ID NO: 34585 - DNA, 121 bp, Artificial Sequence
  Synthesized
  misc_feature (61): n=a or g
ccctctgtgcagacaaattttacttcatgataacacttcttgcacagttcatattgtttgnattattttcggagctagcagtaagatttttaactgttgttgcacattatctcctttgcta

SEQ ID NO: 34586 - DNA, 121 bp, Artificial Sequence
  Synthesized
  misc_feature (61): n=a or g
cattgctagagcattgtagttgaagacttggtcactctccctcggaaccacttctctccanggaatacctaacaaagcaaactttttgagacttcatatcagtctttttcagatataacca

SEQ ID NO: 34587 - DNA, 121 bp, Artificial Sequence
  Synthesized
  misc_feature (61): n=a or g
aatgaagatccccaccacgcacctctactacagtggtgtacagcaacggttacatgaaganagaaattgtgggtacctgacgctgtggaggtagatgcctggtcatcctctggctgtactg

SEQ ID NO: 34588 - DNA, 121 bp, Artificial Sequence
  Synthesized
  misc_feature (61): n=t or c
gggaaagagcacagaccctgtgagacactatgccatcagcttgtcctcacagacacactgncttttcaattccatgcattcattatctcaggacaacaaatttcagccaacacatgtaaga

SEQ ID NO: 34589 - DNA, 121 bp, Artificial Sequence
  Synthesized
  misc_feature (61): n=a or g
gaaaaaaaaaaaagttgcaatattctaatggccaaagtattggtggaacttccttccttcngaaactcttgggaaagcttctcccaagttatggcatacgactggccaagcaccagaacaa

SEQ ID NO: 34590 - DNA, 121 bp, Artificial Sequence
  Synthesized
  misc_feature (61): n=t or c
tgctgtgtgtgtggggaacaaatgcattttcgggagtctggatgtactagattgctcctgnttgcccatgtgcacaccagcttttggcgtccgtttcaaccttcaaactgagtgtaagaaa

SEQ ID NO: 34591 - DNA, 121 bp, Artificial Sequence
  Synthesized
  misc_feature (61): n=t or c
aacttcagtaggcaggatattgagctgaattggaacttgcgtgaaatgttgtaagatatgntgtaagactttcagttgactgcagcaagtcagaacttcaggtttttctctttctggaaat

SEQ ID NO: 34592 - DNA, 121 bp, Artificial Sequence
  Synthesized
  misc_feature (61): n=a or g
tgtcttatgtacaaaacatgcaaaagcattgactgaagccttaataatttgtctaaaagcnaagaataagaaaatcctcattgaagttaatgaaagtggtctcttagagtaaaacacatgc

SEQ ID NO: 34593 - DNA, 121 bp, Artificial Sequence
  Synthesized
  misc_feature (61): n=t or c
tcctctcttgtgaaactgtccctttttaacccaagtaaatcatcagcacttgctgtgacgngggagagggcctcccaggctgagttcttctccatgcaaggaggaagctgcttcagctttg

SEQ ID NO: 34594 - DNA, 121 bp, Artificial Sequence
  Synthesized
  misc_feature (61): n=c or g
ttcctctacaactttcacacttagatgcattttgcttatacatatcttcagatttgcttcncaacaaaggagttttaataacaaaggggctattggcacgtgttaatgtgtttgtaaatta

SEQ ID NO: 34595 - DNA, 121 bp, Artificial Sequence
  Synthesized
  misc_feature (61): n=t or c
tgtgttgctattacatctttcttttgtgctctacatatggtctgctaaaaaatgaggtaanagcatagtccttcgcataacactttgcagcagtattctgaaaggtacacaaagtgttatg

SEQ ID NO: 34596 - DNA, 121 bp, Artificial Sequence
  Synthesized
  misc_feature (61): n=a or g
gcctcagcatggcacaggggctgcattcctctgcgtgcacctccagtttctaagcagtttncatgagttgggtggtagagctggagcagcagtgtgcgaggagtgtccccacaccccaagg

SEQ ID NO: 34597 - DNA, 121 bp, Artificial Sequence
  Synthesized
  misc_feature (61): n=t or c
agatgtctatgaaccaaagcctgtagttcagccatgcttttctagatcacatcttcaccanctgcaaaactctgaacgtctcacttccaaccaacactaggatttctaaaattactgttaa

SEQ ID NO: 34598 - DNA, 121 bp, Artificial Sequence
  Synthesized
  misc_feature (61): n=t or c
tttaataaagcttctgtgtgacttgtcttaaattgtactcgcatgattacatactgggagnctctgtattctccagcacccccaaagacaagcagatgttaaaacagcagacagcaatctt

SEQ ID NO: 34599 - DNA, 121 bp, Artificial Sequence
  Synthesized
  misc_feature (61): n=a or g
aagatgaaaatggtgctgatgtaagtatgtgaactctaacagctatgctttgtagcagccngacacttttccaggacttgttagagagctataataacctttcatttataacaacctgggt

SEQ ID NO: 34600 - DNA, 121 bp, Artificial Sequence
  Synthesized
  misc_feature (61): n=t or c
agtactgctgctgtatacacaaagtctgcatgcgaggctggatattttgctctcatgaaanacttgtacacacttgtacacacagatatgcaagctgacaaactaggaagtatcagttatt

SEQ ID NO: 34601 - DNA, 121 bp, Artificial Sequence
  Synthesized
  misc_feature (61): n=a or g
ggtgaggccgcacagcgcagagcacagcgggacaaccccttccttcacttggctggcaatnctctgcaaacttcttactctgaagaagggcctgtgtgcctgacagactgcctgttttgtc

SEQ ID NO: 34602 - DNA, 121 bp, Artificial Sequence
  Synthesized
  misc_feature (61): n=a or g
atgaattttacaaccctaaattttatgacattgaaaaaaaatttcagccaccaaggtcagngacaagaatagaagcagaaggcaattctgaatgtgacagatctctgtaattaccaaaaac

SEQ ID NO: 34603 - DNA, 121 bp, Artificial Sequence
  Synthesized
  misc_feature (61): n=t or c
aaatttaaaacataaaatgacaaatttctaatacctaataaaacaggatgaaactcattcngaaagtcttagtttatgtaaggttacatattgtgttccaaagactgttacctacttaggt

SEQ ID NO: 34604 - DNA, 121 bp, Artificial Sequence
  Synthesized
  misc_feature (61): n=t or c
tattctttacaaatccttcagtgtgcttaagaagaatggtgcacaaaaacctttaaggagncaatttcaggtactcttctttcattcattttatttaatatatatttttaaatgttagcta

SEQ ID NO: 34605 - DNA, 121 bp, Artificial Sequence
  Synthesized
  misc_feature (61): n=t or c
atgtgtgacaattttaatgagctctcacttcttcccagcctcgtgtcttctgcagaagcantgcagaatcttctttttgaacgtgatggagttttgactcttgggtctcctgtttgttttc

SEQ ID NO: 34606 - DNA, 121 bp, Artificial Sequence
  Synthesized
  misc_feature (61): n=t or g
actggcgttccacgcagctactgagggccacagagaaaccctctgaagtaccaagccaatncaacagagataagacttctattcttatccatggtgcctgcaaaacaaggactaacctctc

SEQ ID NO: 34607 - DNA, 121 bp, Artificial Sequence
  Synthesized
  misc_feature (61): n=a or g
agattctggcctgtgaaacttgcttccaggcttgcttctggatattcatttgaaagaatcntttacatgaaagcaatgaatatcaggtactcatccttcaattatgatggtagtttggatg

SEQ ID NO: 34608 - DNA, 121 bp, Artificial Sequence
  Synthesized
  misc_feature (61): n=t or c
aaaccctcaagattgagcttattggaatgagaactgcttgcttgttcagatagggaattancttagaatatttagtaccatggaaacaaacaaaatttacaaccttaattttactattatg

SEQ ID NO: 34609 - DNA, 121 bp, Artificial Sequence
  Synthesized
  misc_feature (61): n=a or g
tgctgagctcctcaaacccaggcagccatgctgagcatcaccccatttagtaccttgggantaaagcatcagcccattctttcatgattctttttttttttttttttaataccctaacata

SEQ ID NO: 34610 - DNA, 121 bp, Artificial Sequence
  Synthesized
  misc_feature (61): n=a or t
gttaaggagacaagaaacaaacagtagactgagaaacgtcaagagaactgtcttgcaaacntatagtagtcacagtacagagcagagaatccccctgtgtttaagatatagttcccctaaa

SEQ ID NO: 34611 - DNA, 121 bp, Artificial Sequence
  Synthesized
  misc_feature (61): n=a or g
ggaacaaagtgcctcctcctgaacaacgatggtattccttagagttcttcaggaaagcagnaaggaaagaaacgttcagtcttaacttggaagcaaaccttcaaacgactttcttccacgc

SEQ ID NO: 34612 - DNA, 121 bp, Artificial Sequence
  Synthesized
  misc_feature (61): n=t or g
atgtcccttccaacccaaaccaatctatgcttctatgaaagaagaacacgagtggaatcangaaacccaatacgttcctcaagacctgtcatgaggaacatgaagttatgaggaatatcaa

SEQ ID NO: 34613 - DNA, 121 bp, Artificial Sequence
  Synthesized
  misc_feature (61): n=t or c
ggcctggattctgttggattctaacctggagagcatccaaatctttgattatttgataagntgtcaacattatgcttagcttaggaaaaatacaaacaataagagattcttaagaaagatt

SEQ ID NO: 34614 - DNA, 121 bp, Artificial Sequence
  Synthesized
  misc_feature (61): n=a or t
ttagacatgtacttatccagactacaggcaaggtgataacattagtctgatcctatgaagngaagaatcagtttaccaccaccagatggtagaccagtggagttcacagactttacgatgt

SEQ ID NO: 34615 - DNA, 121 bp, Artificial Sequence
  Synthesized
  misc_feature (61): n=t or g
gtactgatgtttggtttttgttttttttttttgtgggagggagtaggaaaaacactgtaangtctatcttcaagccagaaaagccctagaaaaaatcggtagattaggcaaatgaaaagct

SEQ ID NO: 34616 - DNA, 121 bp, Artificial Sequence
  Synthesized
  misc_feature (61): n=a or g
gaggtacagcacagagggattgctgttaacagtctgttctagtgtaatagtttccaggtcnttctcataagatcctgccctgggaaattacttaaaacaggaatcatcatgtgggaaagct

SEQ ID NO: 34617 - DNA, 121 bp, Artificial Sequence
  Synthesized
  misc_feature (61): n=t or g
tccttctatttagatgcattcttctctgtggttctgtttagtagagagaaaccacacattntttatatacctaatatttgcctgcttctgttctggcttctgttatcttatttatcctaat

SEQ ID NO: 34618 - DNA, 121 bp, Artificial Sequence
  Synthesized
  misc_feature (61): n=a or t
ttggcctgtagtagcataagtataggcacaacctgagaaccatggggttgttcccctaaanccaaaaaggctttagctgaggtacatccagaacaaagttagctgtctttgccttgctgca

SEQ ID NO: 34619 - DNA, 121 bp, Artificial Sequence
  Synthesized
  misc_feature (61): n=t or c
tgaacatcagcagcttaaataaccacagcttcaaccgctgcagactgaaaccagacctaanatcagaagcaacatttacctggttaggagcaatcacatcaattcactgcgaagcgaggtg

SEQ ID NO: 34620 - DNA, 121 bp, Artificial Sequence
  Synthesized
  misc_feature (61): n=a or c
aaaagaatgtgagatttttaaaaatatacttagttcaatatacttagttcacaaatgtggnacttcgaactgttaataaaccataaggagaataattataactcttccgcttctgggtaaa

SEQ ID NO: 34621 - DNA, 121 bp, Artificial Sequence
  Synthesized
  misc_feature (61): n=t or c
attttattccagactatgagcttggcagttgttagcccagatacgatattctatctctctnggtacaacagctttcctttgcactgcaaacgtatttctaccatgtaatgagcttccgttg

SEQ ID NO: 34622 - DNA, 121 bp, Artificial Sequence
  Synthesized
  misc_feature (61): n=t or c
ccaaaatggaacagaaggatatgaatagatgcgcatacaagccaagaaactcaggttaaantgttctttggaacaaaatctgcatccaagaaatgacttgacttgaactatgatatatctt

SEQ ID NO: 34623 - DNA, 121 bp, Artificial Sequence
  Synthesized
  misc_feature (61): n=t or c
gaagacaaaattcttccaaaacaagttcgcataaatgtttgtatctgtacctaagagacanataatttaatagagtttttccagtcatactgtaatattctgatgtctgataattacttaa

SEQ ID NO: 34624 - DNA, 121 bp, Artificial Sequence
  Synthesized
  misc_feature (61): n=t or c
cagtgtactatcagcagtgtaggtacacgaaaacatcaggtgtaggctcagccagagagcnggtagcaaatagctgtggggacaggaacagacatcttgtgattccaattttctttccttc

SEQ ID NO: 34625 - DNA, 121 bp, Artificial Sequence
  Synthesized
  misc_feature (61): n=t or c
atccattacagtattctacgccaattctacaacccaaactctaccgctaactaatgcttcnacgtatgcatagtgcctcctggttgtcgcccgggtggtcgtggggaggaaggtcacatgt

SEQ ID NO: 34626 - DNA, 121 bp, Artificial Sequence
  Synthesized
  misc_feature (61): n=t or c
gtgagccttgacttcgctcttattcatcctagttggcctttataggtacttgccttgcctntccttccaaacgggttgccggactataagtgggtagatttgtttgttgtggcataatatt

SEQ ID NO: 34627 - DNA, 121 bp, Artificial Sequence
  Synthesized
  misc_feature (61): n=c or g
attcttatttcaataaatataagtctttccctgcaggcagtaagtagtgttatttaacacnaagtgattcacagtatagtattactgtactatacagttgcatgtttctgagtgaaaaaca

SEQ ID NO: 34628 - DNA, 121 bp, Artificial Sequence
  Synthesized
  misc_feature (61): n=a or g
agtataagtggcttgggtaacatcagaagttatacctgaggctacagctgctgaaagactntggggatgttgatttacaaggctcacatttttttcacttattgaagctgttggttttaaa

SEQ ID NO: 34629 - DNA, 121 bp, Artificial Sequence
  Synthesized
  misc_feature (61): n=a or g
atatgtctcctagtgcctcttcagttgccagcaaggtcttcctttctcatcttctaagacnactcagaaagcattaagaaagtccatacttacccagtataatgatcctactcactggaac

SEQ ID NO: 34630 - DNA, 121 bp, Artificial Sequence
  Synthesized
  misc_feature (61): n=a or g
tgctgattctgttctatagaaaagaaaagaagaactttccctgcaaatcaaaacactcacntcaacaaaaactgataccacttaaatcattttgtggagctgccacttgaatacactgcag

SEQ ID NO: 34631 - DNA, 121 bp, Artificial Sequence
  Synthesized
  misc_feature (61): n=t or c
ctgccctatgttttcctcattccacctattttcaatacttgttcctctcctcatcctcctntcttgctgtctgtagtctcttcccctcctttctttacagtcatttccattttctttgaaa

SEQ ID NO: 34632 - DNA, 121 bp, Artificial Sequence
  Synthesized
  misc_feature (61): n=a or g
attactgcaggcaaaatatcaaatacaggttagaagtatgtgtgtgagcatgtggataacntgatgtctttatctctggtgcctcagagtttattgctgctcacttagctaggtaaattgg

SEQ ID NO: 34633 - DNA, 121 bp, Artificial Sequence
  Synthesized
  misc_feature (61): n=t or c
agaatgtgacacagacaaaaagagtacgagtgagacaaacacagtctgatcttactgtgtngtgttatcagtggccatgtctatctagaaaagtgcctctccatcactctcaccgtgtggt

SEQ ID NO: 34634 - DNA, 121 bp, Artificial Sequence
  Synthesized
  misc_feature (61): n=a or c
ccccatcatcacatttgtaagcctttcatgcccaacagtacaacctcttgtacagtatacngaagagcttcctaacatacactatatacagctgtatactgcttaacagttaagcaaactg

SEQ ID NO: 34635 - DNA, 121 bp, Artificial Sequence
  Synthesized
  misc_feature (61): n=c or g
tagaaacacacaagaagatttacatcctcctctgtttttttgtgattcttggaatgaaacngagtcacctttagtattgtcatagatcggatattgcagattctacatcaaactgaggcag

SEQ ID NO: 34636 - DNA, 121 bp, Artificial Sequence
  Synthesized
  misc_feature (61): n=t or c
aagaggctaaacccacagtgacagcctatgtggaacaccattttcatgtcccactgttgcnctcttctataagcagtacctgtgagaaagtagctctctgcttttattttggttctctcat

SEQ ID NO: 34637 - DNA, 121 bp, Artificial Sequence
  Synthesized
  misc_feature (61): n=a or t
gtcatcatatgataaacagggcagattttaaatccagaaatactgacagaaggttttaaanccaaaagttacagaacctagttcaattagagacatatttctagaagtatttagagactta

SEQ ID NO: 34638 - DNA, 121 bp, Artificial Sequence
  Synthesized
  misc_feature (61): n=c or g
aggactcagagcagggctgtcctgggacagaggccgggttcttcccaccctgttctcacanagaagcctgaaatcttgcatggttctatgggggagagccccagaaccccactttttctcc

SEQ ID NO: 34639 - DNA, 121 bp, Artificial Sequence
  Synthesized
  misc_feature (61): n=a or g
gtataaataaggcttgttttatcttaactttctacctagaacattttctttcaatatctcncctgttacagaagtggtttgtgaagagtataactaattacgagggtaaaagaggtggata

SEQ ID NO: 34640 - DNA, 121 bp, Artificial Sequence
  Synthesized
  misc_feature (61): n=a or g
cagaaattgcatagacaatagcaatttttaacatgaagtccgggtctgtataacactctgngagtaaagctgctctgaagtatataacaggcatctacaaagatgttttctggtttctgtt

SEQ ID NO: 34641 - DNA, 121 bp, Artificial Sequence
  Synthesized
  misc_feature (61): n=t or c
aatatcataaacaggtatagttagttttctgttgagggttggatacagtaggaaaagacantgaggaaaatccccacaacagtttgcttattgtctacaggtctttctcaggagaacacgt

SEQ ID NO: 34642 - DNA, 121 bp, Artificial Sequence
  Synthesized
  misc_feature (61): n=t or c
aaatctcacctccatttgctgtggcttcacctggttactattccactcccatgagaatgcntgacatcagaatggggtttggagtggggacttattccagtcacacagagcacatgaagga

SEQ ID NO: 34643 - DNA, 121 bp, Artificial Sequence
  Synthesized
  misc_feature (61): n=t or c
tccagagacaagcccagatgggcttaaggtgcaacgggtctgcaatggggttgcgagtcangaccctgggagaaggagtggagcagagacctagcagcaaacagagagggatgctcctgct

SEQ ID NO: 34644 - DNA, 121 bp, Artificial Sequence
  Synthesized
  misc_feature (61): n=t or c
gcaggcagaatccatacagcagcatcagcaagtgctggatttcctcttatccaagtttttnactgcccccaagcctccctcaaagctatggcaagagctgtgcatatgcaacatgcctatg

SEQ ID NO: 34645 - DNA, 121 bp, Artificial Sequence
  Synthesized
  misc_feature (61): n=a or g
gctgattgtatcctatgtttaactttaggatgttggtggaaaacagtttactggagaatgnattccaatccctagtaaaaactacctgaattttgaccttccaaaagtataacttttagaa

SEQ ID NO: 34646 - DNA, 121 bp, Artificial Sequence
  Synthesized
  misc_feature (61): n=a or g
tgcaacgtatccctatctaataccgaacagatactatccacttgctgaggaatagcaaagngagtctccagaaaatttctctagtgcgtgctggagtccagcttatgacactttcctgaca

SEQ ID NO: 34647 - DNA, 121 bp, Artificial Sequence
  Synthesized
  misc_feature (61): n=t or c
ggaggtgacggcgctcaccgggcgctaagtttccgcacaggggaagctcatggtcagaganaccccagatttttggtttctggcactgaaccgctgcatgggcagcctgccagggctgggc

SEQ ID NO: 34648 - DNA, 121 bp, Artificial Sequence
  Synthesized
  misc_feature (61): n=t or c
ggctatgaccattgaagctattttggatagagccaacaaagcaaagctgcaataagctgangagtgtaaattcaggatttgaaaatccatgaaaggtagaactgaaggaagccactaatct

SEQ ID NO: 34649 - DNA, 121 bp, Artificial Sequence
  Synthesized
  misc_feature (61): n=t or c
tccctgccccacaaaaaccagcaccagcccagtgatgccaacagagtttcttcacaagtgntaaagtggttctgtgatatgtggtccaggagtgtgtatgggttagtggctactggcagat

SEQ ID NO: 34650 - DNA, 121 bp, Artificial Sequence
  Synthesized
  misc_feature (61): n=a or g
ttgaaaatgtagaagtccagggatatattttgtgggactttttcgtcattgcaggcttcanagtttacacaaaggccagatgtacttgctggcttttttagccatgaaaatatcttaaata

SEQ ID NO: 34651 - DNA, 121 bp, Artificial Sequence
  Synthesized
  misc_feature (61): n=t or c
aggcatgctgaggcgtttgcttttcccctttataagctgtggtctccctttctatgccctnacacccttgggatgcccactgcagctcttaccagcaagtagccctgcgctctcacagcag

SEQ ID NO: 34652 - DNA, 121 bp, Artificial Sequence
  Synthesized
  misc_feature (61): n=a or g
ggattgacagtcttctgctgccctctgcagggaagcttcggtcacaatgtcaggatgtgcntctacatccaaggcatgtctggattgtcagcactcacgtgtgtccctatggacataaaga

SEQ ID NO: 34653 - DNA, 121 bp, Artificial Sequence
  Synthesized
  misc_feature (61): n=a or g
ataactaactgaactgacaaacattccaacatagatatacgatcatcattagcctcccaanttagaggatcctttagcctacaggtgtatgcacatagccttctcatcaactccataccgt

SEQ ID NO: 34654 - DNA, 121 bp, Artificial Sequence
  Synthesized
  misc_feature (61): n=a or c
tgaacgaaactaaagaaacatttgtcccacttcagaagagctgagcttcctagtcctgctntttgctttctcattgactctacctctccttgggtcaattaaagtttcttcagcacatcta

SEQ ID NO: 34655 - DNA, 121 bp, Artificial Sequence
  Synthesized
  misc_feature (61): n=a or g
ttcctagtgacctcctattcacattacctacatgaggactatttgctgtaaacagatatgnaaaagttaatataagatctatggaaatatctatgtgtaggtcttgaatgttggagtctct

SEQ ID NO: 34656 - DNA, 121 bp, Artificial Sequence
  Synthesized
  misc_feature (61): n=t or c
taaaagctgaggttttatttttatacatacacaaaaatggtaaataccccagaaagctaanaagccatgaagtttaggattcattcagtgctgtgatagaataaccaaaacaacaactagt

SEQ ID NO: 34657 - DNA, 121 bp, Artificial Sequence
  Synthesized
  misc_feature (61): n=t or c
attgactctactgacttgttttatcagtcagctggaagggatgcctggaaatgtctaatanacaaacccagctcaaaacaagatcaaagtatgctgcatcatcaatttggattttgagcat

SEQ ID NO: 34658 - DNA, 121 bp, Artificial Sequence
  Synthesized
  misc_feature (61): n=t or c
cccttctctgccaattgtgctgatgtgctacctgatgtagctactgctatgacattggatncaatttttagtttgacctgaaatgtatgtctgttttccacccacaattttgccaatgtaa

SEQ ID NO: 34659 - DNA, 121 bp, Artificial Sequence
  Synthesized
  misc_feature (61): n=a or g
attctggtagcttgagtactggaggcagatgagaaaaagactgtgagcatgcagcaaatanaagtgttactgtcaaaatttgatttcttcaggtaattcttcagattctgtaccatcctat

SEQ ID NO: 34660 - DNA, 121 bp, Artificial Sequence
  Synthesized
  misc_feature (61): n=t or c
cagcaacaggagactgattcactgttggagatacgcagcctctttgggcaacataatctanagcgtcactgtccaaatgaaggtttttttcaccccagtgttggctgttattgacataata

SEQ ID NO: 34661 - DNA, 121 bp, Artificial Sequence
  Synthesized
  misc_feature (61): n=a or g
aacctcagcaggagacacagggctggggaaaggctcaccaggagccagtccagagatcgcnatgttctcccgagagtaaccaggcaacaggaatgggagcacccagttggtgcggagcctt

SEQ ID NO: 34662 - DNA, 121 bp, Artificial Sequence
  Synthesized
  misc_feature (61): n=t or c
tgaggctctctgcaacataaccacaggtttcaagtgcctacacaacatgatcaattaaaancactgcctaatatatcagtcctctgcacgctacaaagtcatctccagagaacacgatagg

SEQ ID NO: 34663 - DNA, 121 bp, Artificial Sequence
  Synthesized
  misc_feature (61): n=a or c
gctctgctgcatggtgggtgttctttagcattgctgctgtgaattaaaacattgactttanactaggaactatttttataactgttggaaacaaagtcttgaaaacaatttcaagatgtaa

SEQ ID NO: 34664 - DNA, 121 bp, Artificial Sequence
  Synthesized
  misc_feature (61): n=t or c
attagtaaaaagaattattgctattcatgacattatagcatagtacctcagataatgtatntggtaattctctgccaaactatgtgaactttggcttgttttcagtttatatggctacact

SEQ ID NO: 34665 - DNA, 121 bp, Artificial Sequence
  Synthesized
  misc_feature (61): n=a or g
tacttcagcctacagaatcttattagttcctcatgcaaagagtgttcacgccataaaaccntcctggaatccctttgatccacgctgatacagtttataaattgatgttaatatttagagt

SEQ ID NO: 34666 - DNA, 121 bp, Artificial Sequence
  Synthesized
  misc_feature (61): n=c or g
aactgaattaaaaacttgtatattcagatccctttctcaaagcaacaaattctccagatgnacatgggaaagtaacagtcctacccctgcctatgcagttgcacctgttgagctcacagtt

SEQ ID NO: 34667 - DNA, 121 bp, Artificial Sequence
  Synthesized
  misc_feature (61): n=t or c
agaagggaaaaggcaggctttgaatcacaatgactcactcggttgttacttgtttcttttngtatgaagatcaaccataatgccataatgtgtctgcagtgaaaaggctggagaaggaaaa

SEQ ID NO: 34668 - DNA, 121 bp, Artificial Sequence
  Synthesized
  misc_feature (61): n=a or g
caaagcatcttatgcctctgaaaacaagaagagtagagaaggcataggagcaatgagacangattggaaggcagcagactttgaagtgaaggaaagattggtgtgaatgataacggactgc

SEQ ID NO: 34669 - DNA, 121 bp, Artificial Sequence
  Synthesized
  misc_feature (61): n=c or g
gctgccagatagaaaaatgagagcccatgctggatgaacatgtaaggacccaccccagggncaggacccaccgcagccccagcagccaacaggaggatgctcaatgttttggtgggctttg

SEQ ID NO: 34670 - DNA, 121 bp, Artificial Sequence
  Synthesized
  misc_feature (61): n=t or g
gatggactcagaagagcacagtgtgggcagagctcttgtaatgcaatgaaaagcatccctntgaatggcttcatctgaccaaacaaagctgtagaggcttcggaaccatctggacagtccc

SEQ ID NO: 34671 - DNA, 121 bp, Artificial Sequence
  Synthesized
  misc_feature (61): n=c or g
tttattttggaggaggaagaaaggaatgaaactgcactaaaaaacagctgttgcatgaaanaatcatttttacatgtcatgttatctatactttatgctggagagcatccaatctgcctga

SEQ ID NO: 34672 - DNA, 121 bp, Artificial Sequence
  Synthesized
  misc_feature (61): n=t or c
atgtgtacagactaggagaagatgtcattgagagctgccctgtgaagaaggacttgcacanttctgttagatgaaaagcattagagtagccaacagtttgcatttgctgccgtgaaggaca

SEQ ID NO: 34673 - DNA, 121 bp, Artificial Sequence
  Synthesized
  misc_feature (61): n=t or c
ttatcacacccaactcctctgaatgaggcccaaacaagaaagcacgcatgattttatcagngttcctgaactgctcgagccagtctaaaacttaagtgggtttaagcttgtcccacgtaaa

SEQ ID NO: 34674 - DNA, 121 bp, Artificial Sequence
  Synthesized
  misc_feature (61): n=a or g
tacccgtgatgatgcatgctcattagatgttggtgttaattgcgtatgctgttgaaagccnaggtgtggtgttgtgctgtagcctacatgactctcagtgagggacgaccaaaggagcttt

SEQ ID NO: 34675 - DNA, 121 bp, Artificial Sequence
  Synthesized
  misc_feature (61): n=t or c
tgataacctggagatttcacgtagtagtactactaagatgaaaattaaatgtcaacccacnatctaggcaccatttatattcccatcgttaaagagccaaagagagaaaaaaacattattt

SEQ ID NO: 34676 - DNA, 121 bp, Artificial Sequence
  Synthesized
  misc_feature (61): n=t or c
gcgccctgctgcccaacaaagatgaagaacccacccagcttcacacgctgccctcttccanctgtagcctccactgcagcacaggaccacaccacacagcaaagctcagcctgcagcaacg

SEQ ID NO: 34677 - DNA, 121 bp, Artificial Sequence
  Synthesized
  misc_feature (61): n=t or c
aagccaccttcataggccaactgaagtttttgcccatgctatgaagggtttttctctaagnaaaatcaagccactcatcctctaattagttgtgtatttttttttcctcccaggtccattc

SEQ ID NO: 34678 - DNA, 121 bp, Artificial Sequence
  Synthesized
  misc_feature (61): n=t or g
tctggagatgaagtgataatagtcatggcctgctgctctggtaaatggtgtgctgggtggngggatgcgggatgctcggtgtaggacacctgtagccttcgtgctgggcagggactgacag

SEQ ID NO: 34679 - DNA, 121 bp, Artificial Sequence
  Synthesized
  misc_feature (61): n=c or g
tagggccagggaatgggattattgaattgcagattccggtcaaggccttttgtcaaaagtngtgctggagacctagtggcttttatgtgcaatgcctggcaagttactacagtgctgcaaa

SEQ ID NO: 34680 - DNA, 121 bp, Artificial Sequence
  Synthesized
  misc_feature (61): n=t or c
tgcccatactgtgaaacagctattttatttacacttctcaagctctggctatcaagtactngcactacatcacacaatgccagcaaggtaaaatagcaatcaagaattcaccccaaagaaa

SEQ ID NO: 34681 - DNA, 121 bp, Artificial Sequence
  Synthesized
  misc_feature (61): n=t or c
aattgctcttttagcctcaccactcagcacggtagcaaaagaaaaggagacgaccgtctgngatctccgggtcagccgacgccaatgggctgcagctcccccagcaggctactgcggcaga

SEQ ID NO: 34682 - DNA, 121 bp, Artificial Sequence
  Synthesized
  misc_feature (61): n=a or g
agaaacttgtgatgttctggagtccaagtcccagttaagggtaagactgaaatgtaggctntaataatagttggttgcaatttgaaattttagaaaggaatctgcagactgtacaagtaag

SEQ ID NO: 34683 - DNA, 121 bp, Artificial Sequence
  Synthesized
  misc_feature (61): n=a or t
ctgcttcatctctttgctgaagttctgctgctgcttttcagtgcttgggaaatcagtcctnagggccacaggtcacttaaatatctgtacatcgcagtttgatgggggcattgtgcttagg

SEQ ID NO: 34684 - DNA, 121 bp, Artificial Sequence
  Synthesized
  misc_feature (61): n=a or t
aagggaggttattcttctcacacctggcatctgaagggatcaaattgtctatcctccctcngtctaggatgtcacaggtcttgttgttgaagggctggtaatgcactgcctggctcctgct

SEQ ID NO: 34685 - DNA, 121 bp, Artificial Sequence
  Synthesized
  misc_feature (61): n=a or g
aaccagacagttatcttgtataacaccttatggagaatctgccttaagcaaacaggagccntgttaatgtatttttggaagagctagtgtagaacgagtaaggagtcagcttttggacaag

SEQ ID NO: 34686 - DNA, 121 bp, Artificial Sequence
  Synthesized
  misc_feature (61): n=a or t
aggatatacatacatctctaagcagaacaggcagcagcttgatctgttattcagatgctangtactttggtaaatacagtgagtacgtaaaaacagtatgaacatagaaaaaaaaaatcag

SEQ ID NO: 34687 - DNA, 121 bp, Artificial Sequence
  Synthesized
  misc_feature (61): n=t or g
gaacagcaaggcagaaaggcagagaaagccatgtgcatattagagacgaaccatcgtactncagaaattaagtaatagcctagaggcactgatgtaagcaatgacatcactttgtgcaaaa

SEQ ID NO: 34688 - DNA, 121 bp, Artificial Sequence
  Synthesized
  misc_feature (61): n=t or c
tttaaatacgatcatgcacaatattaatgttccaggtgacaagttttctctattgttttcntgtgtagcatgccattagtacaggagtcctaaactctggctcttcagttactcatacaga

SEQ ID NO: 34689 - DNA, 121 bp, Artificial Sequence
  Synthesized
  misc_feature (61): n=a or g
tgattccatcagcttatgacagtcagtagaatcctgctccacaagtggtgtcacaactgtnttacattactcattgcaaagaggagtggtagaatttgacagttaattagctatgaatata

SEQ ID NO: 34690 - DNA, 121 bp, Artificial Sequence
  Synthesized
  misc_feature (61): n=a or g
atagaactgtatggatgtttgcagtctgggccatcactgagctaatgcttagaaagacgangagtgcaaggcctctataaaattagttttaactgtaatttccatcaagcagacaaatcga

SEQ ID NO: 34691 - DNA, 121 bp, Artificial Sequence
  Synthesized
  misc_feature (61): n=a or t
aggctatgcattcaacaccaagaagcaaaaaactgaaagtctgggcttcatcggtttccancctatgctaaggttttgaaaaaccactcaagactggggaagggggggggaattctctatg

SEQ ID NO: 34692 - DNA, 121 bp, Artificial Sequence
  Synthesized
  misc_feature (61): n=a or g
cctcagaggtccatgtgtgccccaggttaaagctagctgagatgagttgggttctcttgcnaagtgattcaggagccctacagaaaaccccttgatctgctgatatgccagcaagactgga

SEQ ID NO: 34693 - DNA, 121 bp, Artificial Sequence
  Synthesized
  misc_feature (61): n=t or g
aggtgtttgttttttttttaaagactatttcattctttcaaattctgttttgatatacttntaaacaatattgccacccctcctattcatggcatccgtaggatctgtctcacgcctacag

SEQ ID NO: 34694 - DNA, 121 bp, Artificial Sequence
  Synthesized
  misc_feature (61): n=c or g
cttgtccatgttggcacctccataaatcccaggatggctctcccatcttctcacatgacancttgggggtttgcaagacagatgggtgaccagcaggacctatggaaagacaaactgggat

SEQ ID NO: 34695 - DNA, 121 bp, Artificial Sequence
  Synthesized
  misc_feature (61): n=t or c
actaagataatagaaatctcatttttggaggtaaacattcatgtacccattttgttgttgntgttaaaattacagacatatactaatgaaaagagaacttcccctctcctctatcttaata

SEQ ID NO: 34696 - DNA, 121 bp, Artificial Sequence
  Synthesized
  misc_feature (61): n=t or c
acaacagacaagtgatcagccgatattgcataatcaccacttctttctcagtctgtctctnggtgtaattaactaatcttcttcaaataaaactgagggatatcctggaaacagatcactc

SEQ ID NO: 34697 - DNA, 121 bp, Artificial Sequence
  Synthesized
  misc_feature (61): n=a or g
tctcagtattatactatgaaatctctgtattactcgtacaggaatttgagtaaagcgtaanccttcattaagttgatcacatttcctgcaatactatgtataacacttactttgaggcagt

SEQ ID NO: 34698 - DNA, 121 bp, Artificial Sequence
  Synthesized
  misc_feature (61): n=a or g
gacagcgttgagcagagatgtttgtgccgtacagaagtgtcagctccctgccaaattaatnctgtgatgttgtgcttgcaaagtgtatcggattcttcagtttgagggagtaaccattgta

SEQ ID NO: 34699 - DNA, 121 bp, Artificial Sequence
  Synthesized
  misc_feature (61): n=a or g
cctatgggcagaaacgcaggcagtgtgctgtaaaagaggaactcagacaagcagcagtgcncccctgcacacaaatccaggctctctaaggaatgcctcattccagccccagactgccacc

SEQ ID NO: 34700 - DNA, 121 bp, Artificial Sequence
  Synthesized
  misc_feature (61): n=t or c
aagtttcagctgcttgggtaggaaaggaggttcattacaatctctcagtaaagctgatatngatataggaaacttttttcctagattttgcagtaccttgaagtttgaagaattacagggg

SEQ ID NO: 34701 - DNA, 121 bp, Artificial Sequence
  Synthesized
  misc_feature (61): n=a or g
ctgtacttctgccataagctttaaagccatcacacatctttaattttaagagtttttctanttctaaaaatagatttctcacttctttccatgtattgcagcaatcttacaacccagttaa

SEQ ID NO: 34702 - DNA, 121 bp, Artificial Sequence
  Synthesized
  misc_feature (61): n=a or t
tatgaaacttgcaaataaaaggaaaacacagtctactgttcatctcagaacataacttcangtgatcatttgcttactattttacactgattttcaaaaatgacaattcaaactaacagaa

SEQ ID NO: 34703 - DNA, 121 bp, Artificial Sequence
  Synthesized
  misc_feature (61): n=a or g
gtgtatgtagataatcactttgaaggatgtctctgccctccctgtagttcttctccagatnttctagtctggctttcttagaccttgcttgcaaaagcccatgttctgcatatgctaggtt

SEQ ID NO: 34704 - DNA, 121 bp, Artificial Sequence
  Synthesized
  misc_feature (61): n=t or c
ggagatggcccaaagcacccctgctgatctgtgcagttctcaccacgtgttggaggcatangatgctgaggcttgttagagaaagcttgccacaattcttaatagggacataacaattctg

SEQ ID NO: 34705 - DNA, 121 bp, Artificial Sequence
  Synthesized
  misc_feature (61): n=a or c
tgtagataggcaatgagaagtgcccacacttctggctcttcttccatttgaagtactgctncaagatgatatttgaatagagaatccagtctttttcttgcaacgtaatttaagcttcttg

SEQ ID NO: 34706 - DNA, 121 bp, Artificial Sequence
  Synthesized
  misc_feature (61): n=c or g
tgaaatgatgatcttcttaatttatctaaaagatctcgtctggaggatgtttctttgatgngtgcacaaaataaatatatgccataacaaaacagctgtaaaattaagctgtgaaagattt

SEQ ID NO: 34707 - DNA, 121 bp, Artificial Sequence
  Synthesized
  misc_feature (61): n=a or g
acctacagcaatgaacacaggtaatagggtgtcattattacagagctatctgtcagagtangacatgcataagaattaggtgtcttggaaaaagctgtgaaaaaatatctctacttctgtt

SEQ ID NO: 34708 - DNA, 121 bp, Artificial Sequence
  Synthesized
  misc_feature (61): n=t or c
gtatgacagtgtttttcttctgaaaagggatgatgtgctgagccagagcagatcagctccngaggaggtccactgggatgcaaacagtgacccgtctgcaagcgagtctgccctgggatta

SEQ ID NO: 34709 - DNA, 121 bp, Artificial Sequence
  Synthesized
  misc_feature (61): n=a or g
aaattaacacgtccaattgtttggcaagtgactactgaaattttgccttctacttatttgntggagctaaaaaaggtatatttattaactgcacttatgaaagggaaggccaggtatccaa

SEQ ID NO: 34710 - DNA, 121 bp, Artificial Sequence
  Synthesized
  misc_feature (61): n=t or c
ttgaagaattatgtaccctcattaacgtttgcttaaatcaggaaataggacagaaaagagntgaagccagcacgcctactgctccgtagactgctatggtgagcactgagtgtagaactcc

SEQ ID NO: 34711 - DNA, 121 bp, Artificial Sequence
  Synthesized
  misc_feature (61): n=t or c
caactttccatgaaacatgggttcaacaatcccctaaacaacttaaaactgtgactgattngctttctggaaggtaaatgccaatttgcaaactttgccagttcatgaaacaaatggatta

SEQ ID NO: 34712 - DNA, 121 bp, Artificial Sequence
  Synthesized
  misc_feature (61): n=a or t
attagccccgtctctagcagtgaaggctctttcagatgtagttccatgctaacaggagagnccaattaatactgctatctgtacacaagaaaataattaatctcaacgtcatcgggttgaa

SEQ ID NO: 34713 - DNA, 121 bp, Artificial Sequence
  Synthesized
  misc_feature (61): n=a or g
ttaatagtcactggcttctgtcttaggctttccagattagaaggagaaggggaaggccaancatgaattgccaaaacacattttaaaagcagttttactgacttttttgttgttgttcaca

SEQ ID NO: 34714 - DNA, 121 bp, Artificial Sequence
  Synthesized
  misc_feature (61): n=a or g
aagtggagctacaagctgtgagggctaatagattttgagcaattagaggcctcctggtgantcaggtttcatacagaggactgagacctgatgtatcagtcacctctcctttatatcaact

SEQ ID NO: 34715 - DNA, 121 bp, Artificial Sequence
  Synthesized
  misc_feature (61): n=t or c
tctagctctccagaagtgtatgatgaacacttctgtggctgcacatggagttggaaccatntatcgcagagatgaaggctggcagctccttcagagtacataattttgcaggaccagaagg

SEQ ID NO: 34716 - DNA, 121 bp, Artificial Sequence
  Synthesized
  misc_feature (61): n=t or c
gaggtgcaacaaagtattctaccctgagacaagaagatgccctgttgctgtgtctccttcncactaacagctggtgacccgacaccacattccaagaaattctactgttcataagatatgc

SEQ ID NO: 34717 - DNA, 121 bp, Artificial Sequence
  Synthesized
  misc_feature (61): n=t or c
agcgtactccagtttgggcaccacactgagatggatgaataggattggtgttttcttccangtgaaccacactcccttcctaattttcttttcaatatgttctaaacacatgctgtttagg

SEQ ID NO: 34718 - DNA, 121 bp, Artificial Sequence
  Synthesized
  misc_feature (61): n=t or c
tctgcacttagatgacactccttgatccaacagaaaactatagctctcatgtttagacagngaagagaacacagcaattacgttattggaaggtggaggaagtagttacaaagattatttt

SEQ ID NO: 34719 - DNA, 121 bp, Artificial Sequence
  Synthesized
  misc_feature (61): n=a or t
tagaggacattgaccaagtattacctaggaaaagtagataaggtagataaggtagataccntgtgatagataaactagggaggatatatttctcagatacatcttaagttgttgtatagct

SEQ ID NO: 34720 - DNA, 121 bp, Artificial Sequence
  Synthesized
  misc_feature (61): n=t or c
taactgttctgtactggactgtagtgatgcctacgtgtacataaacaggattttatgtaanggttggtcttgaggaaaccctggtgataactgtttttatcagagtattaattattgcctc

SEQ ID NO: 34721 - DNA, 121 bp, Artificial Sequence
  Synthesized
  misc_feature (61): n=t or c
cagcttggcttctgtgaatacgtgtatgctgggggctttcacctccggttcttttcctgcngctgggattggtctcagctccctgtctcagtgcttcccccgttcccctgtatatcccaag

SEQ ID NO: 34722 - DNA, 121 bp, Artificial Sequence
  Synthesized
  misc_feature (61): n=a or g
agttgtcgagaaggctttaaagcatgctcttgcaatggcaaatgacataggctgaaatacntgtttctccacaggagagaccttaatggaagagggctatggaagtagtttgttatgtgaa

SEQ ID NO: 34723 - DNA, 121 bp, Artificial Sequence
  Synthesized
  misc_feature (61): n=a or g
gccctgctgagaaaatacagcatggcctggcctgtggtctcttttcatgcttctctggaancatcgatccttggagacagcctggtctgcaggtgcactactgagatttccttctgcttac

SEQ ID NO: 34724 - DNA, 121 bp, Artificial Sequence
  Synthesized
  misc_feature (61): n=a or g
tatcagctttttctgcttcaggggtgggtaggctattacttacttggtttgtatcctcttnttctgaaaaagattgaaagcagagctaaaatcccaaaccttgttcttcccaaagttggga

SEQ ID NO: 34725 - DNA, 121 bp, Artificial Sequence
  Synthesized
  misc_feature (61): n=t or c
ccaacgagcccagagaccagagttcagatctcacctagacccaagtcagtgttctgagganaaggcttactcattcaaagtcaaatggcttaataaaggagggtggaggctatgttctcca

SEQ ID NO: 34726 - DNA, 121 bp, Artificial Sequence
  Synthesized
  misc_feature (61): n=a or g
ataaacaagttacttcttaaggcttatataaattgttctctcagggaagggatgaaagcantattatttatttaaaacttgacaagaatttgggagacgagttgaaatagaatacaataag

SEQ ID NO: 34727 - DNA, 121 bp, Artificial Sequence
  Synthesized
  misc_feature (61): n=t or c
atgttatacaggaaaatatgcactagtaaagtagtgattaacacactgatagttagcaagnggtattctattagtggtcattgtgcataatagagggtatttttggaaaccttctgtctcc

SEQ ID NO: 34728 - DNA, 121 bp, Artificial Sequence
  Synthesized
  misc_feature (61): n=a or g
tctactgttttgaatccaggccattctatgattctatgaaatgttacaaacaaacggaggncaaaaattaatataggtgaaatcaatgacgaggagaaagaacatgtagagagactgttgt

SEQ ID NO: 34729 - DNA, 121 bp, Artificial Sequence
  Synthesized
  misc_feature (61): n=t or c
acagaagggtcttccatgatgtgcaaggagaatgcctcaagagtacagtgaggaatgtgtntcagagagatgaatgagcatgccctgagctctgcactaacaggaaggctgctatcaatgc

SEQ ID NO: 34730 - DNA, 121 bp, Artificial Sequence
  Synthesized
  misc_feature (61): n=t or c
agcccaacaaccaaagttaaagtcttgggacacggggaatcaaaagagatatacaaagatnacaagaatctcacttggtttaagaacaacaatgaagaatgtggcactaccagtacaaact

SEQ ID NO: 34731 - DNA, 121 bp, Artificial Sequence
  Synthesized
  misc_feature (61): n=a or c
aacaccacaggaaaaaaaaaatccaaaacaaaataaaacccaaaccaccctaaaaaagctnagtccattctcccatctgtcaccgtgttcctccttgtgcagcagatggatgcagtgactg

SEQ ID NO: 34732 - DNA, 121 bp, Artificial Sequence
  Synthesized
  misc_feature (61): n=t or c
ctgggtgttttttatcctcaggtatcttttctcatcagcaatgtacagctatcactgaacnaactggctgccatccttaacactataggcacccacatcctagagatgtaaatatttgttg

SEQ ID NO: 34733 - DNA, 121 bp, Artificial Sequence
  Synthesized
  misc_feature (61): n=c or g
ggaattcaaaaattgtggattcaataaagggtgctagattgctagcttttacatgatgcanttcatgactttgctttcaatgtgttacagtttacactggtgaggtgactgagcacatcta

SEQ ID NO: 34734 - DNA, 121 bp, Artificial Sequence
  Synthesized
  misc_feature (61): n=a or t
gataagcttaaaaaactattgctatctgaaagataaaaagttatttgtgttgggctgagtnaagttttactttccccgtaggtcagaacgcattatgcacttgtgcttttatgtttcagca

SEQ ID NO: 34735 - DNA, 121 bp, Artificial Sequence
  Synthesized
  misc_feature (61): n=a or g
gtatgtatttctccttcacacttcagctgcacactgtttcagcgatacccagacaagatgncaaagaagcaataaatagtgcttctactcctaagaagtagaagtaatcaccttttcttcc

SEQ ID NO: 34736 - DNA, 121 bp, Artificial Sequence
  Synthesized
  misc_feature (61): n=a or g
ccaaaggacataggggctggtgagagctgggtctctcttcaccccacattttgcaagtacnccttgttagcagcagagtggtgaaacacctcctactccccacagggaagagctgatgacc

SEQ ID NO: 34737 - DNA, 121 bp, Artificial Sequence
  Synthesized
  misc_feature (61): n=a or g
atattcaaaacaagtagtgtttagaattttactctcagctggctattgttctgcttacatnaaactggaacttacatacttttatgtagcttttttttttttttttttttttttttgtatt

SEQ ID NO: 34738 - DNA, 121 bp, Artificial Sequence
  Synthesized
  misc_feature (61): n=a or g
tgaccaagagagttctcagccttgggcattccaggtcagatgtcattctgcctgtttcaancaaagacctagaagcaaagactttcatatcaggcacttttatttcaagagtgacagatct

SEQ ID NO: 34739 - DNA, 121 bp, Artificial Sequence
  Synthesized
  misc_feature (61): n=a or g
cagacagtgaaaattaagaagaacgtgtcccaccttacgcctattctgccaatctgtcgcngttgttcttctagctccataggtttacatgggttttttttcttttttttttctttttttt

SEQ ID NO: 34740 - DNA, 121 bp, Artificial Sequence
  Synthesized
  misc_feature (61): n=t or c
aattattttcctagcaaagtctaagtctcagagttgcagaaggaaaaatgtgccaaaagancttactgaacttactaaactgaaatcttcttatgcagattctccatgttttatctagtat

SEQ ID NO: 34741 - DNA, 121 bp, Artificial Sequence
  Synthesized
  misc_feature (61): n=a or g
tttgtttaattcatttttgaagatgatttttttttttaagtgagaaagttctgagtcatgntatgaaatgaagtaggaccacatgcttacaacataatatccaatttgaactaagtgtgtg

SEQ ID NO: 34742 - DNA, 121 bp, Artificial Sequence
  Synthesized
  misc_feature (61): n=t or c
catcgcctattgcatgtttgcttagtgtgagaaatactgtctacaatgacagtgacaacantgtatgtttacccaatgtaaaagacaaaaggttgttttctcattgaaaacaacatcctga

SEQ ID NO: 34743 - DNA, 121 bp, Artificial Sequence
  Synthesized
  misc_feature (61): n=t or c
tcaaaccacgtgagcaagttaccatgaggggggcttatgcaggtagctgtgctttactgantaatctgctgtgtcttgcaaagaaatagctacacactacttgcctgctgctctgcacggt

SEQ ID NO: 34744 - DNA, 121 bp, Artificial Sequence
  Synthesized
  misc_feature (61): n=c or g
aaaaaaaaaaaaaaaaaaggaaatagaagtttaaaaagtcagaaaatggctcagatttatnattagttcaatatgaaattacctttgaattccactctggtacgtgtcagtgttaatttct

SEQ ID NO: 34745 - DNA, 121 bp, Artificial Sequence
  Synthesized
  misc_feature (61): n=t or c
atcctgcatccaagcaatttgtcaaagaggtcactctaaatacacttttaagtttctcaanaaacaatgatttttcaaaacaactaacttcacagcattcagcacagtttattttacttgt

SEQ ID NO: 34746 - DNA, 121 bp, Artificial Sequence
  Synthesized
  misc_feature (61): n=t or c
ttacctcctaagctgtgcaattcttaggaccaaatcgaactttacttccctgtcccactgnacaacaagctcaagctgcccagtcttttctttgcaccgatttgttctctctgcacagaga

SEQ ID NO: 34747 - DNA, 121 bp, Artificial Sequence
  Synthesized
  misc_feature (61): n=t or g
tcttcattgtgaagatgattgattttcatctttcagtgaatcttctctgttccaagtattngaatctgtggaagcttctacttgtgtgtccaccctttttctgcatttctcttagctgttt

SEQ ID NO: 34748 - DNA, 121 bp, Artificial Sequence
  Synthesized
  misc_feature (61): n=t or g
gcctggccaagatactaaatatttcaagatagcattttcaaatgcagaactcaggagactntggggttttcttcagcagctttttccccattttaaagagtgggagcgatggtgaaaccat

SEQ ID NO: 34749 - DNA, 121 bp, Artificial Sequence
  Synthesized
  misc_feature (61): n=t or c
agatattcagtaacacctttaacctctaccacgtatccaaaattaagtaacagcagaattngtgtattcattaaattgaaatgttcaattctgcatgaactcattaagtgcaaggagtagc

SEQ ID NO: 34750 - DNA, 121 bp, Artificial Sequence
  Synthesized
  misc_feature (61): n=t or c
ttgaggctgggcaggttaagacatttgaggcttccttccaacctgagatattcctaacagnctgaaataaaagtcaccagcttctctggaaatgcagcctgacccctggtgactggctacc

SEQ ID NO: 34751 - DNA, 121 bp, Artificial Sequence
  Synthesized
  misc_feature (61): n=a or g
aagggcacaatgaatggtacaaagaaaacatttgctgacaagcacagtaatgagaaaagcnagcaaaatattgtttctgtaaggccagaagagattgctgaaaatattcattaatcagtat

SEQ ID NO: 34752 - DNA, 121 bp, Artificial Sequence
  Synthesized
  misc_feature (61): n=t or c
cttggctggaggtggtcacataaggatgagaacactcaggtgggctcgtgtgactgttggnatatttgagggcttatggaacagctcagaggagttcagaggagttcagctttccatacca

SEQ ID NO: 34753 - DNA, 121 bp, Artificial Sequence
  Synthesized
  misc_feature (61): n=t or c
gggacagcttttcctccaaaaaattttcctcccagagctgctgttagaagtgatgctttgntggtacccacggctgtggccactgagggctgtatccctctgtacccagtgggctggtgtt

SEQ ID NO: 34754 - DNA, 121 bp, Artificial Sequence
  Synthesized
  misc_feature (61): n=a or g
tttaaatacctgaggtttggcataagcacttctttggactgtgccctcagttaattttcangcaggtatctgcagaataatcattaggtgttgattttcttttcccactggaacgactgtg

SEQ ID NO: 34755 - DNA, 121 bp, Artificial Sequence
  Synthesized
  misc_feature (61): n=a or g
tgtggttaaatgctagtaagtgctagaagaagtgtaggaaaagggattttaattgctatgnataatcatattcttacacactgagtaggtgtacttagaaaatcaatctgtacagtattct

SEQ ID NO: 34756 - DNA, 121 bp, Artificial Sequence
  Synthesized
  misc_feature (61): n=c or g
ccagttattttcccttctcattccttttgtttcctattatgagaaggctgtcaatagcganttggtagtgtaatataaagcaatatccaaatgaatgacattttagaaagaaaaatgtctt

SEQ ID NO: 34757 - DNA, 121 bp, Artificial Sequence
  Synthesized
  misc_feature (61): n=a or g
ctatgaagttctcctcctgaaaggataaaaaatgcagcaccaaaactaatacaaaataacnagttcctttgtatgtcatctgttcccttttcaaattaagaaatgcagcataatgactggc

SEQ ID NO: 34758 - DNA, 121 bp, Artificial Sequence
  Synthesized
  misc_feature (61): n=a or g
ttttgttttgctcgtctgactgctcataaacaaaataggaaatggaggcttatcttcaacnaatcttcctgcatgcagaggtcagcactgaacaaggaatgggcatttttgaaacctcttc

SEQ ID NO: 34759 - DNA, 121 bp, Artificial Sequence
  Synthesized
  misc_feature (61): n=a or g
ttctgagcttcgtggccaaagagatctacaaaattaggtgtgacagctgcccacaatcccntgctgaagagggaaggtaaaaaccatttggacaagtatttttgtttcgttgtagaggcga

SEQ ID NO: 34760 - DNA, 121 bp, Artificial Sequence
  Synthesized
  misc_feature (61): n=c or g
aaggggtgggaagggagaaaggagcttctggctcagtgtaagtacttcttgtgtactagantgaaaagcttgggcagggcaaagtgatcattaaatggctacagtatgctgcctgtctaat

SEQ ID NO: 34761 - DNA, 121 bp, Artificial Sequence
  Synthesized
  misc_feature (61): n=a or g
acatttagaaaatcaaattgattagaacagaaacaaactgttcatgtgatcaggtctgganaagaagatattcatgtggtctgttagatgtgttgagattttatgagtgtgaattgtgagt

SEQ ID NO: 34762 - DNA, 121 bp, Artificial Sequence
  Synthesized
  misc_feature (61): n=t or c
taaaacggcactgcaggtggagtagttctgctaatgtagcaaacagtgcacaggccgtgangtgcactgtggctgcttggagaagctgtgggtgccccatccctggccaggttggatgggc

SEQ ID NO: 34763 - DNA, 121 bp, Artificial Sequence
  Synthesized
  misc_feature (61): n=a or g
aaatagttaaaaggcagctacttttcctaaaaagcagaacaaaataataaatatgtcatgntttctccaatgaactagaagtacagtaacatgaattacttagtttgctgggaaaggtaca

SEQ ID NO: 34764 - DNA, 121 bp, Artificial Sequence
  Synthesized
  misc_feature (61): n=a or g
ttcacaatccagcagaagttcacagtttagaaagcatatttccaccaacacctgagtgctnaagcacacgtggattcacgcaaacagaaaccgtattctcgtggcaaatattttatcatct

SEQ ID NO: 34765 - DNA, 121 bp, Artificial Sequence
  Synthesized
  misc_feature (61): n=a or g
gttcaagttttgaccttctttttcctctgagtgttgctgcttcctggccagccttccctgntcaggtctgtaactgttttcagaactagaatttctccagatgtacacatttatgttggta

SEQ ID NO: 34766 - DNA, 121 bp, Artificial Sequence
  Synthesized
  misc_feature (61): n=a or g
catgtcctgggcactggtgggctcagcagcaattgcctggtctgcctgaagatggaatatntgtgagggaagggtgtacacaagctggacttgggtgccaaaaagcagcctctccatggag

SEQ ID NO: 34767 - DNA, 121 bp, Artificial Sequence
  Synthesized
  misc_feature (61): n=t or c
acaggatgctgtcctgcctacccagggctttccagccactccatttggtgttccaaacagngctccaaacagtgccaccgccacccaggtcccagctccagcccaggaacctgcaccttct

SEQ ID NO: 34768 - DNA, 121 bp, Artificial Sequence
  Synthesized
  misc_feature (61): n=a or g
tcttccagctccattttcagtctcttttcattcagatttgagtagctagtgctaaaccatnaattggctaaatggccctgttcttggcaccactgatatacccataccagcaaaatcggtg

SEQ ID NO: 34769 - DNA, 121 bp, Artificial Sequence
  Synthesized
  misc_feature (61): n=t or c
aagtcacagtccttccaggcaagagagatctgaatttctaatgcggaacccctgtgttcangataaggttctcaagtgttgcaggttatcatcagagctgttggaggcctgagagcctact

SEQ ID NO: 34770 - DNA, 121 bp, Artificial Sequence
  Synthesized
  misc_feature (61): n=t or c
caccagtaagtgaatgactgacattcaaagtatacaaaagcataattgctatgaagaattntgagaagcgtaacagataaaaaccacaaaagagaactagcattgcacactattaaaataa

SEQ ID NO: 34771 - DNA, 121 bp, Artificial Sequence
  Synthesized
  misc_feature (61): n=a or g
tgtaaataaaatgtgccgtaaaatgagggagaatgggggaaacaaaacaatcactgttacntgcctccacttcaagaactacgtttttcattcaagtggtccagtccttcaacacagagta

SEQ ID NO: 34772 - DNA, 121 bp, Artificial Sequence
  Synthesized
  misc_feature (61): n=t or c
gaaaaaggtccgtgcgataccccttcctctttctgttcttcctcctcctggtgcaggtttnctctgcatggctgtgttggtctctgactaaacccagtaactgcagcatgatttgcaagag

SEQ ID NO: 34773 - DNA, 121 bp, Artificial Sequence
  Synthesized
  misc_feature (61): n=a or g
cagcccagccagagagcattttatgtgtgaaatgaagtaactcgagtctttactccaatcngtacatgttgtctgtaaatgtaactgtttgtttttattttttcccttccttttcctttat

SEQ ID NO: 34774 - DNA, 121 bp, Artificial Sequence
  Synthesized
  misc_feature (61): n=c or g
caagcaagggtaatagggcacttgtgtgtgcgtgtacagacccggacctgcctgcttacanattgcttgggcttagttcagtaagataaaaatcacagcaaaaagtgccggggaggtcatt

SEQ ID NO: 34775 - DNA, 121 bp, Artificial Sequence
  Synthesized
  misc_feature (61): n=a or g
tgtgctatataaatgcatatatacacacacatctgtggatttaattgcttatatatgtgtntaaacaatcacagatacacacgcactcacatatcatagaataatagaatcagtaaaatca

SEQ ID NO: 34776 - DNA, 121 bp, Artificial Sequence
  Synthesized
  misc_feature (61): n=a or c
cttgtatttaaaagcaatgttggaataaattgggctttctgtttaattatagcttagtacngaatcattttgcatactatgcaagtacaaacaagaacatgtgcagtggctttgactgcaa

SEQ ID NO: 34777 - DNA, 121 bp, Artificial Sequence
  Synthesized
  misc_feature (61): n=t or c
ccactttttttttttatatctgaacacatcacacagattcatcagctgtgccagtcaaccnttactgtatttccttatctgttgcactaaatagctctcttaatatcaaataggaagttat

SEQ ID NO: 34778 - DNA, 121 bp, Artificial Sequence
  Synthesized
  misc_feature (61): n=c or g
aacatgaacatcaccgtgacaaacagaacacagcaaactgaacaagtcatctttttgccanttacttagcttcttttcacactgcttttcataatacttgctttaagttgaaagctttcag

SEQ ID NO: 34779 - DNA, 121 bp, Artificial Sequence
  Synthesized
  misc_feature (61): n=a or t
taatggtacatgtatatgacaggtaacaatgataaatatctctaagagtcactttctgttnatgcagggccagtaactccattaaaatgacaacaataatacatctgaaatcatcctctct

SEQ ID NO: 34780 - DNA, 121 bp, Artificial Sequence
  Synthesized
  misc_feature (61): n=a or c
tgaatctgttttcggtgcagacacttcacacaccagctacacgcacgcaatggctgccttnttcctttgtaatcaacaaaatattcacactttggatataaaatgggctatttttctactg

SEQ ID NO: 34781 - DNA, 121 bp, Artificial Sequence
  Synthesized
  misc_feature (61): n=a or g
atgcacgcttctgggagcagcacagccctcctgacctcaccagctttttcctagcacctgnaaggacacgggaagtgcagggagagcaggactatggattcagcaagagtgtaccaagagg

SEQ ID NO: 34782 - DNA, 121 bp, Artificial Sequence
  Synthesized
  misc_feature (61): n=a or g
ggtagaaattcatagctttttcgctggttggcgctgacctcttttgtggccttaggaatgncacttatgtatgtatgcaaaacatggcagaaatattaacacctacaagtcgttaagcttt

SEQ ID NO: 34783 - DNA, 121 bp, Artificial Sequence
  Synthesized
  misc_feature (61): n=a or c
cagctgaagtgcctctaaaccactgtacgcaaaataagcagtatgatttgtaaactacagnacaattagaaaactgtgacccaattgctgtgacagaaaccatccaactggcactctgcag

SEQ ID NO: 34784 - DNA, 121 bp, Artificial Sequence
  Synthesized
  misc_feature (61): n=t or c
gttaatagtagtgttcgtgatgagagaatcagttgtctattttgagctatagaatctgttnaagtttagtctgggattacttacctttgaagtaaaggcagttaagaatcatcataagcgt

SEQ ID NO: 34785 - DNA, 121 bp, Artificial Sequence
  Synthesized
  misc_feature (61): n=a or g
atttgtatttaaaatcaaatgagaggggaggagccatggagtctcaagctcagccctaggnatggagcactaaagcccttccagcctggggagaggttggaagtgagagccttccacctgt

SEQ ID NO: 34786 - DNA, 121 bp, Artificial Sequence
  Synthesized
  misc_feature (61): n=a or g
tatttgggtttagagagataagatttgcaaatctaaatcccatacaagaatatcactacancttctccctttcataggatctaccagtacttaagtgaacaaagctgtcttaatggcaaga

SEQ ID NO: 34787 - DNA, 121 bp, Artificial Sequence
  Synthesized
  misc_feature (61): n=c or g
ttcagtttgaagtcacacagtttacaagcgaaacccatagccaaacagtaaaaacagacancacaacaattcagcacttgcacgtcttctggaaaacatgcaaagacacgaccataaaaaa

SEQ ID NO: 34788 - DNA, 121 bp, Artificial Sequence
  Synthesized
  misc_feature (61): n=a or g
aagttttactgattacaccaagtaaaaatacaagaaatgtatttgctgctgaagcttactngagtaggaatatgtgtgacttcaaaatgaatttacaagaagaaagaagttataccagtgc

SEQ ID NO: 34789 - DNA, 121 bp, Artificial Sequence
  Synthesized
  misc_feature (61): n=t or g
gaataacagagagtggctgagattttattcattatttacccaggctttaggtttgtgcacntgcctcaaagcaaagctaatatgatgttttaaatttcctgttaccgtggtcagatttctc

SEQ ID NO: 34790 - DNA, 121 bp, Artificial Sequence
  Synthesized
  misc_feature (61): n=a or g
ggaatatattttgtattattgtataagtaacatcaagtgctgacagatcagttttttgcanatcactgtatactgcagtctgtaatgaacctgtgatattagataaggagctgctgaattt

SEQ ID NO: 34791 - DNA, 121 bp, Artificial Sequence
  Synthesized
  misc_feature (61): n=a or g
tgacttctgactttcatgctttcactagtgcagtgcagttcattgggagaacacattcagngctccaaaactctggtgatgttgagcaagctattcaagctttgatatttatccaaactct

SEQ ID NO: 34792 - DNA, 121 bp, Artificial Sequence
  Synthesized
  misc_feature (61): n=a or g
tgagactcaagcaaatggggggggaaaaaaaaagtgctttcatgttcattctcaggcagcncccctgacagatttgtacaccgaagaaacagagtggtgtcaaggctgcagttaaaaacgg

SEQ ID NO: 34793 - DNA, 121 bp, Artificial Sequence
  Synthesized
  misc_feature (61): n=a or g
tgcttaatgatatgcctctaaatgtttgcttgccaaacattggcatttgaatcaaaggtcngtgtcaagtggcttacttgggcttcctttttctgagcacagcctggctgcagctgcgatc

SEQ ID NO: 34794 - DNA, 121 bp, Artificial Sequence
  Synthesized
  misc_feature (61): n=a or c
accagaaaaagaaacctctactcatctctttgcagtcctgagcagtgaatacagagtaagnatctcagatgatgtcaagtacagaggcagcaacttgggaacatgttggggccacccaaga

SEQ ID NO: 34795 - DNA, 121 bp, Artificial Sequence
  Synthesized
  misc_feature (61): n=a or g
tgtccttgccatggtgcccaccagcctcaggacctgcccagagatgctcaaaaaccagganactcagtatgtcaaaagaaggaaagcaccgtaagcgcagcctgtccacctctcagatggc

SEQ ID NO: 34796 - DNA, 121 bp, Artificial Sequence
  Synthesized
  misc_feature (61): n=a or g
gcacgctccccatgtgccatcaagccacacaagccgcattgcacttgcatttatacagagntcggtggcttgcacttggctccagccagcagcccagcactctgtggagctccatccccat

SEQ ID NO: 34797 - DNA, 121 bp, Artificial Sequence
  Synthesized
  misc_feature (61): n=c or g
ttgtatgcttgctcaatctggaacatctagtgttatgatcagaggcatagtattcactcanttaattgctttctcactcttggatgatagctaactccctcactgcaaattcagaggtcac

SEQ ID NO: 34798 - DNA, 121 bp, Artificial Sequence
  Synthesized
  misc_feature (61): n=a or g
agtggttaacatttctaattaagctatcgcacatgccgcatatattatgtaattatactcnacgcagaaggagcaactctgaaattacaagacaaggacatacacacaacaaaaacttaat

SEQ ID NO: 34799 - DNA, 121 bp, Artificial Sequence
  Synthesized
  misc_feature (61): n=t or c
atctagagacttaaatgaatttgttcacgttgctaacaattcaagaagcaaataaaagggncaaagtctgatacaagggggatactgaggacatctcctgtgttctaacacctgcgtcatt

SEQ ID NO: 34800 - DNA, 121 bp, Artificial Sequence
  Synthesized
  misc_feature (61): n=a or g
tccatttgccgtaattcagcctccttatttaatcccgtaattctgatgaagaacgtggacntattttgttatactaaccatgaactttttctgagccaaatctttgctgttgcaacctata

SEQ ID NO: 34801 - DNA, 121 bp, Artificial Sequence
  Synthesized
  misc_feature (61): n=t or c
gtttcatactggaagttgtggtagacaataacgtaaatttattgaaaaagctgttgttaantttcagtagttgccagtgaaattatttggaggctgtaatatatgatgtagtaaatatagt

SEQ ID NO: 34802 - DNA, 121 bp, Artificial Sequence
  Synthesized
  misc_feature (61): n=a or t
tgtattcaattgcatacatatccagcatctacaaatgggaaatgctttttaggaaatcacnttttaaatttcagtgagtagccatttagcatcacatgtgacaaagaactaaaatttgccc

SEQ ID NO: 34803 - DNA, 121 bp, Artificial Sequence
  Synthesized
  misc_feature (61): n=t or c
actcttgacatctctgaatgctttgataaagagcccatgtttgattcctgaaacacactgnggaatattactaatccatcatgcaggcacccatttcatagaccagtgtggaatactcaag

SEQ ID NO: 34804 - DNA, 121 bp, Artificial Sequence
  Synthesized
  misc_feature (61): n=a or g
tctataacagactccgactaggatgtctgccttgttggctcacctcctgatagagattcanccttatcattcccatcccagtttgaaaactgacattttgtttattcctgaccaaatgttt

SEQ ID NO: 34805 - DNA, 121 bp, Artificial Sequence
  Synthesized
  misc_feature (61): n=a or c
catattgtttcctgagataggtttgcagctgatgctggctagtatggatggcctggtgtgnggagcaaagccgtttcacgtgaggctttctgtaatgcagctcccggctgtttgtgattca

SEQ ID NO: 34806 - DNA, 121 bp, Artificial Sequence
  Synthesized
  misc_feature (61): n=t or c
gaaaagaatggatatatatgaagttactgttaattcaatattaaatttgagacagaataangaagggtcataatgttttaaacagaaaaagaccaaaatgctctgacattgttgggacaat

SEQ ID NO: 34807 - DNA, 121 bp, Artificial Sequence
  Synthesized
  misc_feature (61): n=t or g
ccttactggagacactagctctctgtatgagccacacactggtgtcacaaaccccattctncctgagttcctttaacaagaggtagtggagggtttagatggagcccagagaaacgtggac

SEQ ID NO: 34808 - DNA, 121 bp, Artificial Sequence
  Synthesized
  misc_feature (61): n=a or g
agaattggcctcgcacgacacagatctgtgtgtccctgtgctgctgtttcccattagtaantgtggatcccacaggtgtgctctgggcattgcagccccccggcgctctcacccccaccgt

SEQ ID NO: 34809 - DNA, 121 bp, Artificial Sequence
  Synthesized
  misc_feature (61): n=a or t
ctcactgagagcaatactgcagtgctgtaagctttgagtggtctgtttagacaaaaagaantgagataaaactagccacttaaaaatttgatcacagccatcacaaattatctaatttaac

SEQ ID NO: 34810 - DNA, 121 bp, Artificial Sequence
  Synthesized
  misc_feature (61): n=t or g
ggttcacaccactgaactcttctccttgcccattaaggcttgaaaaatcaacccattcaangcattcatgtaactcacactacctgaggagtgaggtcagcaggtaggagctgagactgaa

SEQ ID NO: 34811 - DNA, 121 bp, Artificial Sequence
  Synthesized
  misc_feature (61): n=t or c
actagctcatgtaggttgtaatgcagtttatcataactgccacttcactgtaagtgaggcnctcttaacttaaaaaattaacctagagtaacactttgagtatcacctacaggtgatactc

SEQ ID NO: 34812 - DNA, 121 bp, Artificial Sequence
  Synthesized
  misc_feature (61): n=c or g
ttcccaaaagcacacgggcactctgacatttgggaaaactacgagggcaagcagatcaaancaggtccccaaagtaaatctgagtggctacgtcacagtctgctgctgtgacacctcttga

SEQ ID NO: 34813 - DNA, 121 bp, Artificial Sequence
  Synthesized
  misc_feature (61): n=a or g
ggactgaaaacgttctggttttgtttttgttgttgttgtttttaccttttttccagcaaanagctctactttcagtatcaatacccatcagccaacctctcacacctgtgtttctccctca

SEQ ID NO: 34814 - DNA, 121 bp, Artificial Sequence
  Synthesized
  misc_feature (61): n=t or c
ttctcttttctttggccaaaaccaagagaggataacatgctttggtttctcttgggaaccnggttgcatccccaacattgtcttggtgggcacagggcagcagtatttgagtacagtgttc

SEQ ID NO: 34815 - DNA, 121 bp, Artificial Sequence
  Synthesized
  misc_feature (61): n=t or c
ttttatctgtaaaatatgctcagcagcccttcctttctacacttcttttctctgttaaaanttgaggacaaggagtgtctcttttctgtttgtctatcacttagtgcaatgaagcctctgg

SEQ ID NO: 34816 - DNA, 121 bp, Artificial Sequence
  Synthesized
  misc_feature (61): n=a or g
tccttgcacagtacaaggagcaagcagatctggtcatggaaacagagaaagaaaggttagnaatctgagatagtcacttctagggtaactccttccttcttagaacaagttgacatgtggt

SEQ ID NO: 34817 - DNA, 121 bp, Artificial Sequence
  Synthesized
  misc_feature (61): n=t or c
aacaaatgattccaggattctataacattttggtattggaagacaatgagggttccagggnaagtgctccaccaggatacccttcactggtggctgtgcccatgcctcacccctgaaggga

SEQ ID NO: 34818 - DNA, 121 bp, Artificial Sequence
  Synthesized
  misc_feature (61): n=t or c
ctcattgtgaggtgtgcatttccatttagtgtgtgccaggaagtaatgagaaggctttgtnccgctatttcataagtctttaaaataagagttgttcaatatgaagaataatgaagtgtct

SEQ ID NO: 34819 - DNA, 121 bp, Artificial Sequence
  Synthesized
  misc_feature (61): n=t or c
attaataatgtacactgttcaagcaggtctctcaccaatactctgtacttttctgcttccnatttcttcagtttttatgcatacaccctgcttgattactcttctcacattgccatgtact

SEQ ID NO: 34820 - DNA, 121 bp, Artificial Sequence
  Synthesized
  misc_feature (61): n=t or c
tccagccaacttctctctctaaacaacttaatagcgtgggcttacagcaaaacaatatcantgtaaacattttgtccaaaagatacagggtgaaaaattgcattacagttagaagaatcaa

SEQ ID NO: 34821 - DNA, 121 bp, Artificial Sequence
  Synthesized
  misc_feature (61): n=a or g
attgtcccctgcaatctacactaacatgctaagtcagccaagtgcaccatgtcatagagancaaatgtcaagcctagggatgacatacttagtattaccaatttcgttaggcaaggctcta

SEQ ID NO: 34822 - DNA, 121 bp, Artificial Sequence
  Synthesized
  misc_feature (61): n=a or c
ggagttagatatttaaagggtataaatctaatcaacaactacatgaaatctctgtatttanttttcacacatgacatttaagacttatttctcattcaggctttttgattggaagaaagta

SEQ ID NO: 34823 - DNA, 121 bp, Artificial Sequence
  Synthesized
  misc_feature (61): n=t or c
ctcagggtgggctgcacaccctgcaaggagccatgtgcatggggtaacagtcagcacttgncctgtagaggtgtcccgcaacgactcctgctccgacctgcccgagatccagaacggctgg

SEQ ID NO: 34824 - DNA, 121 bp, Artificial Sequence
  Synthesized
  misc_feature (61): n=c or g
actttgctcaagatgataccctgcaaaagaaaagtttcttcacaagagtccaaaacttgtntttctgagcagtctaacagcaaagctgaagtatgagccttctgcacgtgggaaaacagca

SEQ ID NO: 34825 - DNA, 121 bp, Artificial Sequence
  Synthesized
  misc_feature (61): n=a or g
gggggaaggaaacaaggaagaaaaaccttggttctggaatgctgctgatgggtttccatantttggctgataatgtcaccatccctgtgagccagctgctgtgccccaggcactcattccc

SEQ ID NO: 34826 - DNA, 121 bp, Artificial Sequence
  Synthesized
  misc_feature (61): n=a or g
ctctacagagtacagctttcttccgtaaaagagatcctctctatgatatccataatcaccncattcatgtcagaatgttactctttttccaagggttcctgaagtttcttggatgctactt

SEQ ID NO: 34827 - DNA, 121 bp, Artificial Sequence
  Synthesized
  misc_feature (61): n=t or c
taaaatgtctccttctcaacttcagtgttagattcaaaacaatgccagagcagctggtaangacaaaagtgagcaaacaacagtgtgctagtcaaactctttcatactctgacaccatgtt

SEQ ID NO: 34828 - DNA, 121 bp, Artificial Sequence
  Synthesized
  misc_feature (61): n=a or g
attacatgtttacattcatatgcattatgctaaatgcattcagtctagtcttaagttcttnacagtccagagatgcccctggatattactgtggaatctgtgaaacagagcaggagctggc

SEQ ID NO: 34829 - DNA, 121 bp, Artificial Sequence
  Synthesized
  misc_feature (61): n=t or c
catgtaagtgaaggaaacccacgtgagaactctacagccaatgaatcctacattttcctcngtctataatttttattgaacttcttaaaatagcgtgtgctagtttgcctttgctctaaaa

SEQ ID NO: 34830 - DNA, 121 bp, Artificial Sequence
  Synthesized
  misc_feature (61): n=a or c
ctgcctgcctttccacccctctctctctgtggctgtttacagaactgcagaggtacgttgnacgaaactgacttaaatgacagcagtggaagactttctgcttagtttaagtcctctgtag

SEQ ID NO: 34831 - DNA, 121 bp, Artificial Sequence
  Synthesized
  misc_feature (61): n=t or c
tggcaaaatggctaacatttgaaaactgtgatttgccaaggaaatagttctgcttaggtcncagtgtccagcttcattttgaagaaaactgatttttatttaactgtaataaatgttggaa

SEQ ID NO: 34832 - DNA, 121 bp, Artificial Sequence
  Synthesized
  misc_feature (61): n=a or g
gatgtgtgtagagctgcacacatgttgaagtctctggaagacgtatgcctaataagtagcnctggggaacactaatgtcaaatgtgtaattaaaaattgtcaggaccagcaaatttctgaa

SEQ ID NO: 34833 - DNA, 121 bp, Artificial Sequence
  Synthesized
  misc_feature (61): n=a or g
aacatgagtccagcatcacaagcatgaagcactcagtgggtgttatgattctgagataacnaaggggaaatgctgctacatgctcccctttaaccctatcactctttggtacttgttttcc

SEQ ID NO: 34834 - DNA, 121 bp, Artificial Sequence
  Synthesized
  misc_feature (61): n=t or c
ctctccagggcaggaaccacccaaaatggccaccccttgagaccaagcccagggttttgangtatgaacagtctgagtatgctctgctggtctcctctgtgatatatcacaccccagcact

SEQ ID NO: 34835 - DNA, 121 bp, Artificial Sequence
  Synthesized
  misc_feature (61): n=a or g
tacccacaacctattaagcaataagaagtcatttcccagcataagagcagggctacgtatncttcaatggtatgacaaacaaagtcaggttcctgtgcagagccttccacaaaatgtccat

SEQ ID NO: 34836 - DNA, 121 bp, Artificial Sequence
  Synthesized
  misc_feature (61): n=a or g
attaaaccacaacagatgcctaccgattaggagtatttcaacaaccctaaatgaagccatnctctcttttcttatgcacacaacttttctaactgaccgtgcctccactttgctgtcactt

SEQ ID NO: 34837 - DNA, 121 bp, Artificial Sequence
  Synthesized
  misc_feature (61): n=a or c
ataatgcatatttgacacctcacacatatacacacaccacactttcaagcatttgtgtctntgtgagcatgcttacatgcacacactttttataaaagaaagacatcaaggaaaaggatta

SEQ ID NO: 34838 - DNA, 121 bp, Artificial Sequence
  Synthesized
  misc_feature (61): n=a or g
ccatggcactttttgtgttacagctagaaagagttgcactgttcctctggcttattactcntgtgtcgttacagtgcaccgtttgctgtcttttgcagagacaccctgagacctcctgtcc

SEQ ID NO: 34839 - DNA, 121 bp, Artificial Sequence
  Synthesized
  misc_feature (61): n=t or g
acccactccacactgcaaatatcttgaagccattggactgtgtcagaggacattagctgcntctgcaccagcatttagcacaactgtttggctgcccggcaatcttttcttgcaggccttt

SEQ ID NO: 34840 - DNA, 121 bp, Artificial Sequence
  Synthesized
  misc_feature (61): n=a or g
cacatccctggtgaagcgaagttgaagaatggttacagtctgccagggagatgctaagganaactggcaaatcactgcaggagattaaaatgcgcagacatacataacaagtcccattttg

SEQ ID NO: 34841 - DNA, 121 bp, Artificial Sequence
  Synthesized
  misc_feature (61): n=t or c
gatttttcaacttactgattttcagaaatgagaaagcagttaatatccttcagacttctgnaaatggataactcctattgaaggggaccagtagctggaagcataaagcatggtctgtccg

SEQ ID NO: 34842 - DNA, 121 bp, Artificial Sequence
  Synthesized
  misc_feature (61): n=a or g
gcgtgctttcctgaaaacctaaaggatgcttttggctatcaagttggcaaagtttgttccntgtagaaagcaatttgtattttcttagactgactttgtctaagttgttattttagtctga

SEQ ID NO: 34843 - DNA, 121 bp, Artificial Sequence
  Synthesized
  misc_feature (61): n=t or c
tatgcaatcactagatgcatcttacaagtcatttttgacagatgaggtacattgatatcangtacagacacacgcatgtaagaatttcttgaagataaggacttccatttctttaaagtca

SEQ ID NO: 34844 - DNA, 121 bp, Artificial Sequence
  Synthesized
  misc_feature (61): n=t or c
agaaggtccttttagtcagatctaaagtacagaacctactgtcttcactgctacactccanggcaaaagtgttcatcctggtggtaagaaggcggctgcttctcaatgaagtgtcactaga

SEQ ID NO: 34845 - DNA, 121 bp, Artificial Sequence
  Synthesized
  misc_feature (61): n=a or g
cccaacaagaacacaagaaactgtactagatactaagtccttagtggacagttacaaaatncataaaagcttgaagaaaagcaatttgtttttttgcaactcaaccaaaggtccctgcttt

SEQ ID NO: 34846 - DNA, 121 bp, Artificial Sequence
  Synthesized
  misc_feature (61): n=a or g
tgtgagtcgtccatcgaacctatgattaaggaactggtgtggctcagagtattaaaaaggntgctggacttaaataacattcaacataaactcaggcaatggtccttacaaatgtattgtc

SEQ ID NO: 34847 - DNA, 121 bp, Artificial Sequence
  Synthesized
  misc_feature (61): n=t or c
tggaaccaaaataacaaaatggcttatattttatgcatacagttatggtagtccaggtctncatgaatactataattttagaacaatagtgttcaactgtgaaataaaatagattttaaaa

SEQ ID NO: 34848 - DNA, 121 bp, Artificial Sequence
  Synthesized
  misc_feature (61): n=t or c
gtaatgaggcagaacttatttcccagcccctacaggtggctttgtcagctctccaaattgngtgtgacgaggcaggttcccaattgatctctcaattagggctttgttgatattggataaa

SEQ ID NO: 34849 - DNA, 121 bp, Artificial Sequence
  Synthesized
  misc_feature (61): n=a or g
cgggaatcctgtcctctgagctggagcatcaggcacaagtaggaataatttcagtcatttngattttatttgctttgttaactattagctctattgcgcccttgtgctgcttatatctgtc

SEQ ID NO: 34850 - DNA, 121 bp, Artificial Sequence
  Synthesized
  misc_feature (61): n=t or c
gctttcagagacatccatctggctccagaaggattgcagaactatcccacctgctgcatcncttctgcaaaggtgttctggtggttgcaaggaggagtggggaactgctgctcacaaaatg

SEQ ID NO: 34851 - DNA, 121 bp, Artificial Sequence
  Synthesized
  misc_feature (61): n=a or t
tcctcatccacagattttaaacactttataagctccattgcacctggaatctgtaaggaanacacttagtcttcaaggagaaaattccagttctgttttggtcttcatgacagatctgtga

SEQ ID NO: 34852 - DNA, 121 bp, Artificial Sequence
  Synthesized
  misc_feature (61): n=a or g
gttactgagggtgagaggaagggggactggagctgggtctttccctggtgatagtaaatgngagtttctctggctctgaactctcctgttctcaaatcctctggcacagaactgtctctta

SEQ ID NO: 34853 - DNA, 121 bp, Artificial Sequence
  Synthesized
  misc_feature (61): n=a or g
ggaataaattagaaaatatagcattcttcaattttcttggcaacatagtcataataactgntggcaagatgttcccactgcacaatgttcctctggcagccacgcctaaatttgtgttcta

SEQ ID NO: 34854 - DNA, 121 bp, Artificial Sequence
  Synthesized
  misc_feature (61): n=a or g
agttttgacattcacaagcataaatagatgctggctttgtaagttttctactttactgcancaggggaaataagatattcccaggcaattgaggaggatctacaacaaaattacgtgcatc

SEQ ID NO: 34855 - DNA, 121 bp, Artificial Sequence
  Synthesized
  misc_feature (61): n=a or g
agttaaaacactagttaggtactgtaggtttagaggatgctttaggaaccaaagaatttgntggcttgtgtaaagttatatacattctgtcatttttagactgacttttatattttcatca

SEQ ID NO: 34856 - DNA, 121 bp, Artificial Sequence
  Synthesized
  misc_feature (61): n=t or c
gatataaggaacaagcatttgtaatgtataattaaagatttgctttaattttcgctatcangtctacgcttcatcatcccagaatttaccagtacattgcaggatgtactgcacatttcca

SEQ ID NO: 34857 - DNA, 121 bp, Artificial Sequence
  Synthesized
  misc_feature (61): n=t or c
ctgctgaaaaagaaaagtgttcctagaaaatcctgtagctcatccaaaaaccgtgttttcntgcctcggaattttaccctcaaggataaattggcagcacttggtgctagcagtggttgtg

SEQ ID NO: 34858 - DNA, 121 bp, Artificial Sequence
  Synthesized
  misc_feature (61): n=a or g
gatgccaggatggctctgcttggtggcaacaaaaagaagcagtgccagttggtgccagtcnggctctgttcagaaaggagaagacatcccacccttccgaggggattttcccactgccact

SEQ ID NO: 34859 - DNA, 121 bp, Artificial Sequence
  Synthesized
  misc_feature (61): n=a or t
tatctgttgacatgtcaatcataatgttgatttaatagtatttactgttctttatctgttnggctttttatagtcttgcatgacctggtgtgttgagccgttcggttagttaagcccttgt

SEQ ID NO: 34860 - DNA, 121 bp, Artificial Sequence
  Synthesized
  misc_feature (61): n=t or c
gcagttccttttgcagttgctgctagaccagaaacatgagcacctgatttgctggacatcnaatgatggcgaattcaagctactcaaggcagaagaagtggctaagctgtggggactcaga

SEQ ID NO: 34861 - DNA, 121 bp, Artificial Sequence
  Synthesized
  misc_feature (61): n=a or g
ttcactagcagacctgccaagtaagcaaaggtctctcaagttctttacagcaagccaaccnagcaccgggtataagggttgctgtggctttaggcttagttaggctgtttcactgggctgt

SEQ ID NO: 34862 - DNA, 121 bp, Artificial Sequence
  Synthesized
  misc_feature (61): n=t or c
actgcgagcctgtggtttctatttgacatctgacgtctgccaggtctttcatcatcatcanacaaccttttcacgtcgagtcattaacacacacaaaaaaaaaattgtcaaacttaaaaaa

SEQ ID NO: 34863 - DNA, 121 bp, Artificial Sequence
  Synthesized
  misc_feature (61): n=a or g
aatacattcttttgatgtcctcacacttttctaatgaaaatttaataataatacatgacanttgtatttctgaggtgaagtaaaaattgcactggataggagacatttttaatgcactatg

SEQ ID NO: 34864 - DNA, 121 bp, Artificial Sequence
  Synthesized
  misc_feature (61): n=t or c
gtcacacttcctttcaaagatgagtaccaacagttacaatcttgaagtttttaagggagcncgtcttttgatagctcttcatctttataataattcaaaaatctttattacactcaatgat

SEQ ID NO: 34865 - DNA, 121 bp, Artificial Sequence
  Synthesized
  misc_feature (61): n=t or c
aggatactgtggtgtgttatacagtgttagcaagggtcaatataggcatttccttggctangctgtctttaagcaactgataagctcgttaaaggctaggtgaagtatcccagtactgtga

SEQ ID NO: 34866 - DNA, 121 bp, Artificial Sequence
  Synthesized
  misc_feature (61): n=a or c
gctgtttagttccatatacttgttgctgttgttctctttttattacagaggtctacatctnaacagcagacagtaaatctgtgagttgtaaatagacaacttatgtcatgtcttaaataat

SEQ ID NO: 34867 - DNA, 121 bp, Artificial Sequence
  Synthesized
  misc_feature (61): n=t or c
tttttcgaccttgcagctgcaaagtgccactgctgacacagcaggaggagcacgaatgacnggccgtagtagtgtaggatttgctgaagccggagtcagtgggaactccccataccagact

SEQ ID NO: 34868 - DNA, 121 bp, Artificial Sequence
  Synthesized
  misc_feature (61): n=a or c
caggtcaaacctgaatacgaacttctgaaagaaataataatcacagttaaatcttagcagnagtctcagtgaataacctctaccttagcattaggtaccttaggttaggtttctctgcaaa

SEQ ID NO: 34869 - DNA, 121 bp, Artificial Sequence
  Synthesized
  misc_feature (61): n=t or c
ttctaaacaatgatttacagcagtaatcctcctcctctcactcagcaagactgcctctgcngggcttgattccatgacatgtaagtctaattgtcatatgaggtcatatagggtttatacg

SEQ ID NO: 34870 - DNA, 121 bp, Artificial Sequence
  Synthesized
  misc_feature (61): n=a or g
tctgccccccatacccacacagcaacatactgtcatgcgataaatgtggcccagacggtcngttcagaaaacatcactttgggccactcattttctcctgtgtagatgtggacatccgagt

SEQ ID NO: 34871 - DNA, 121 bp, Artificial Sequence
  Synthesized
  misc_feature (61): n=a or g
ttgggttctccttaagcgcatgcctaaaactgagcacggttaagtccttttctggaagacnggctgagcagagggatttccttcactgatgagctactgacgatttgttctattcagctgt

SEQ ID NO: 34872 - DNA, 121 bp, Artificial Sequence
  Synthesized
  misc_feature (61): n=t or c
ttgtatgtcaagtgttaaagcgagctgggaaaaacttatttgtataatccaaaccataganaatgcaagtacaataaaaactgacaatattattgacatttattaagaaactatgttatag

SEQ ID NO: 34873 - DNA, 121 bp, Artificial Sequence
  Synthesized
  misc_feature (61): n=a or g
gactcagggccctgtgccgtggagcagagatgtctcagagcactttacccagcatgtcacnactgggctgccttatgtaaggatgaacccaggcttttcctggatgagggagggctgggat

SEQ ID NO: 34874 - DNA, 121 bp, Artificial Sequence
  Synthesized
  misc_feature (61): n=a or g
ttgggtattctagttttatgtcatatacaacagacagtagaataggaacatagggcaagtntgtccatatctctcacctgaaagttatttatctggcttaggggtagtttctgaaagatct

SEQ ID NO: 34875 - DNA, 121 bp, Artificial Sequence
  Synthesized
  misc_feature (61): n=t or c
aagcctttaagttcagtgtcaataggcaaagtgtttccatggcatacacagtacttcagtntctgacgagcaccatgccaggttatgtgccaagtctctgtgtgctgggtctcctctctgt

SEQ ID NO: 34876 - DNA, 121 bp, Artificial Sequence
  Synthesized
  misc_feature (61): n=c or g
aacctttactgactagtacagatgcaatgttttgatgagagttattggatttacacaatancaaagtgagaattgaagactattgtatttattttgttttttcctagaactttttagaaca

SEQ ID NO: 34877 - DNA, 121 bp, Artificial Sequence
  Synthesized
  misc_feature (61): n=a or g
tggtgattcattaagataatgatttaagtaggaggcttaagaaagccagggtggattaacntccagagcttctcccctccatcccaccacctgctcttttaagagaaaggacaaattccaa

SEQ ID NO: 34878 - DNA, 121 bp, Artificial Sequence
  Synthesized
  misc_feature (61): n=a or g
gagtcgctggcaaggtgcaccacatggtgagggaaaggggagggatgctgcttcatcactnagagctgttaattatttctcctaattactttgctgaacttaggttgcaccactaactgta

SEQ ID NO: 34879 - DNA, 121 bp, Artificial Sequence
  Synthesized
  misc_feature (61): n=t or c
tggcacagtgcatccctcttacagatgcacgcgtgggcacatggcattaaccactcaagtntgtgtgcttgctcccgtagtctttgaatgcatctccggttgtcaatgaaggagttaaggt

SEQ ID NO: 34880 - DNA, 121 bp, Artificial Sequence
  Synthesized
  misc_feature (61): n=t or c
accagagctggttaaaaccaggagaaaccatttagctgagggctgccttcacaccttatcngagcactcaccgtgtcactcgagggctctgtccccagcaccattcctcccaccaagaaca

SEQ ID NO: 34881 - DNA, 121 bp, Artificial Sequence
  Synthesized
  misc_feature (61): n=a or g
tagatattttaggcagagaaatgtaatgcctgaccagctcggatacagaaattttgaagtnttttttcctcatctctgtcagaacctgaatagatacctttctgtcaaagagggtccactc

SEQ ID NO: 34882 - DNA, 121 bp, Artificial Sequence
  Synthesized
  misc_feature (61): n=t or c
ggaatacaagtattgatgcatttgcagaaagcagtacaagaaatactaaaaaacacacttngatgttgccatttgtgaatatcagctaaggtaaaaacagaatctgtgtatttttatcgtg

SEQ ID NO: 34883 - DNA, 121 bp, Artificial Sequence
  Synthesized
  misc_feature (61): n=a or g
agccacatgatctcaaactgttttatatacatacatgcacaagatagatgtatttgcagantaagaaggatggaaaatccccatatgaagttttgttaccttacttggaaggtaacaagtg

SEQ ID NO: 34884 - DNA, 121 bp, Artificial Sequence
  Synthesized
  misc_feature (61): n=t or c
gcagtaacttcttagtcacaaggaaaaggtggtgattgcaaactcatgccttctaaggatnctcttgaagacacaaataaccaaatattagcagatggacatcttctaagtctgtgactgg

SEQ ID NO: 34885 - DNA, 121 bp, Artificial Sequence
  Synthesized
  misc_feature (61): n=a or g
atgcatgtaaatagtcaccaagaactgccaggcttcattgctgaaggtaacagggttgccnacgcagcctgctgtgttgcctgtgaccttcttggcgctgcgcgatcctcgcatgggcagt

SEQ ID NO: 34886 - DNA, 121 bp, Artificial Sequence
  Synthesized
  misc_feature (61): n=t or c
tgtgtatcctgatttttgtacaatctactggtaaattagaaatgaaagtagttcaagtttnaccaacccacccaattaagttgtttaatggagaaattgatttttggttcccagtcattac

SEQ ID NO: 34887 - DNA, 121 bp, Artificial Sequence
  Synthesized
  misc_feature (61): n=c or g
cagatgacctccctgcccacatcctgcagcacaaggctgagcaggccacagacgtgtgctnttttttagcactactgtgagggtgattctctgagaaagaattggagcattcagtgttaat

SEQ ID NO: 34888 - DNA, 121 bp, Artificial Sequence
  Synthesized
  misc_feature (61): n=a or g
aaggtgccagtgccatcaatggccatcattgcaataccatacagcactgcagtttctggcnagtttaaagcaattgcaatgcaatccaatgaccattctgatattccatgctatctgccag

SEQ ID NO: 34889 - DNA, 121 bp, Artificial Sequence
  Synthesized
  misc_feature (61): n=a or t
gttttcactgtacttcaaaagatctctcactgcctggcccttaagagccaacaactaaacntgtcctacaatcagtgtcaatgcatttctcatgatcattcagagaagctaaggtaactgt

SEQ ID NO: 34890 - DNA, 121 bp, Artificial Sequence
  Synthesized
  misc_feature (61): n=t or c
ctttcctgagctctgccacatcgctggtcacaaagcccacaccaccacgtgttgcccaggnagtaacttcagcctgaactccatttacaggcagcattgtgttaaaacccctctcatccgt

SEQ ID NO: 34891 - DNA, 121 bp, Artificial Sequence
  Synthesized
  misc_feature (61): n=t or c
catccatctcaccttctcttgaattgaaggctgtttcaaacccttaacagtaataagaatnatactgtagtccagatgttgggcttggttctccaaagtggttctagattagcgtgtaagg

SEQ ID NO: 34892 - DNA, 121 bp, Artificial Sequence
  Synthesized
  misc_feature (61): n=a or g
ctgggcatcagatattttgagggctctctcggtggattttaggcaaaatctgctggaggtnaggaaagaaggcactaaatctaattttctttgtatcagcagccctttctccttgcaggac

SEQ ID NO: 34893 - DNA, 121 bp, Artificial Sequence
  Synthesized
  misc_feature (61): n=a or g
ttgaacaataatgtgattgcccacagtctgttcacctgggatgtgagtggggacaaatctnatccagggcagctacacctcatgcttcaggctcattgctggtgtccatcagggtgaggca

SEQ ID NO: 34894 - DNA, 121 bp, Artificial Sequence
  Synthesized
  misc_feature (61): n=a or g
gcaatctaggaaagagtataaaaatgcactaaacattagaacaatagtttaaaaattttcngcaggaaatacttccaagaaatttgaacacagggaatgccagtctgaagtgccctcacca

SEQ ID NO: 34895 - DNA, 121 bp, Artificial Sequence
  Synthesized
  misc_feature (61): n=t or c
aactgaaggtgtttctgggcagaagtgcattgctatttcagcagagcccagcagcaggcangctcttcctatgagcttcactaagaacagaggtggactcttggcatgtatctttgggtgg

SEQ ID NO: 34896 - DNA, 121 bp, Artificial Sequence
  Synthesized
  misc_feature (61): n=t or c
cttacaagaattttgcaatcccttgtcactgtttgcttaacactgattaccatttactacngagatgagctcagagtagcccttgctgggaaccttgaataaacccaatcgctgcctgcag

SEQ ID NO: 34897 - DNA, 121 bp, Artificial Sequence
  Synthesized
  misc_feature (61): n=t or c
ccagtccgtggcattctgagaagcatcaagtcaacaaatgttgtgacttatgttgaaaaangggtaaaaacaatattaaatcccatatttaaactgctccgtgagctgaataatgcgagtc

SEQ ID NO: 34898 - DNA, 121 bp, Artificial Sequence
  Synthesized
  misc_feature (61): n=a or g
tttacatcaaaataaagagagtgtatgttttaaagtagcagttttcaacattttgtcccanataaagtcattattatggacagcaaacccaggagggaagatcactgtaaattgatcctcc

SEQ ID NO: 34899 - DNA, 121 bp, Artificial Sequence
  Synthesized
  misc_feature (61): n=a or g
aagaaaaagcagccaattcttggcaaggactttaaccataagggaaaaatgtcttgaaatncatttacatttataatcttgctagactatctctgcgtgggagttcttttattgcgttttc

SEQ ID NO: 34900 - DNA, 121 bp, Artificial Sequence
  Synthesized
  misc_feature (61): n=c or g
ttggtattgcactattctcagacacactgagatgtcaaggctgatcttggttggtctctancaaaatgagatctctagtacccttcacacatactaaaaaaagaaaatcttaaaaattcag

SEQ ID NO: 34901 - DNA, 121 bp, Artificial Sequence
  Synthesized
  misc_feature (61): n=a or g
agctgtcagcctgcattccaagcatcattctgggttccattgctatgaaagtttcctttcnactgcagtgtgatccattatcgtggcaggcccaggcaggtaagttggcaggcagaccctt

SEQ ID NO: 34902 - DNA, 121 bp, Artificial Sequence
  Synthesized
  misc_feature (61): n=a or g
tccctgaaatatataaagctttagaatctatataggcaataggttgacaaactaagtatcnttattaggtcagatattgtccttcaagcacttgagacttctgatatgggatcaacaaaaa

SEQ ID NO: 34903 - DNA, 121 bp, Artificial Sequence
  Synthesized
  misc_feature (61): n=a or g
aactagagatccatcaatgtcctttctattcaaagaagagcagctctaaaggaatcatagnatattatatcatttagaaaatgaaacgtgtgatcctatctccttgtgacttgtgaattcc

SEQ ID NO: 34904 - DNA, 121 bp, Artificial Sequence
  Synthesized
  misc_feature (61): n=t or c
gacatttccatgaaaaggggcattctgagttcccaaaggtaaaagatctaatttgtcatantcagggaattatgtggtttcttacctgggaactaaactcaagcaggaagatagaggaact

SEQ ID NO: 34905 - DNA, 121 bp, Artificial Sequence
  Synthesized
  misc_feature (61): n=a or g
ttgtaacaatttttttacattatccatctcttcagaaatgttggaatccagaacactttantggggaatggcaaaataaccaatctccagcagcatgccaacaactacttgtcacttcttc

SEQ ID NO: 34906 - DNA, 121 bp, Artificial Sequence
  Synthesized
  misc_feature (61): n=a or g
aagactggtgaatggataaagctcgtatttgaaagaagcaatttgctcacaaccatggtantgcactgtagctggcaaccagagaagcatgtatgtcagaagggtgtggggatacttaatt

SEQ ID NO: 34907 - DNA, 121 bp, Artificial Sequence
  Synthesized
  misc_feature (61): n=t or c
gtaaatgttaggggtatggtttgtaattttgttcagatatatttctcaagctgggtgaagnactccatgcagagccccatcaatagttctgcacaccctgttcaatgttgctaattggatt

SEQ ID NO: 34908 - DNA, 121 bp, Artificial Sequence
  Synthesized
  misc_feature (61): n=t or c
tttcagtgctaaatggaaacctgagactgatggaagtaggattccgcatgtttcttcttgntgttgtttgaatgaagtgcagaaggcatgctgaaaatcctacctctacactaacatttaa

SEQ ID NO: 34909 - DNA, 121 bp, Artificial Sequence
  Synthesized
  misc_feature (61): n=t or c
ggacaacaatttttagtgtattcttgagtaaagacacgcataaaccttcatcagaaaatgnactaatacagtaagctagcctggaatgtcagcgctgcaaatactcatgttcaggcaatgc

SEQ ID NO: 34910 - DNA, 121 bp, Artificial Sequence
  Synthesized
  misc_feature (61): n=t or g
aaaaaaaaaagtcccgcacagagttttctccttttgccgagctactccggccatttagagncattaatcactgaactgaaccccgccggtgtgttctcggtgcggtgcagcagtgtgtcag

SEQ ID NO: 34911 - DNA, 121 bp, Artificial Sequence
  Synthesized
  misc_feature (61): n=a or g
atgatgagagattggcctctggggaagatgggagttccagcataacaaaataaaggcactngatttgaaggaagtgaacaagtacagtgacagactctttctagtaaagaagataaaatgg

SEQ ID NO: 34912 - DNA, 121 bp, Artificial Sequence
  Synthesized
  misc_feature (61): n=a or g
acaaactggaacacagcaagttccatatgaatacttcaagaaaagaacagagctttatacnagtgatataagtacatatgcaattgtacaactagacccagttgcattctctcctaagtga

SEQ ID NO: 34913 - DNA, 121 bp, Artificial Sequence
  Synthesized
  misc_feature (61): n=a or g
ggggagctgggggaacctcagcccccacaacagggccacttcccattaaaacaagacaatntgaatcccttccttcccacctccttctccttcattgatccccaaaagtttcagaaagcag

SEQ ID NO: 34914 - DNA, 121 bp, Artificial Sequence
  Synthesized
  misc_feature (61): n=t or g
gctccatcaatgcaagcacacaagtgttgggagccatcttgcaggattccatgctgtccancacctacctaaaaatgaggtttctataatatagaacacttcctactgttcagaaaaacca

SEQ ID NO: 34915 - DNA, 121 bp, Artificial Sequence
  Synthesized
  misc_feature (61): n=a or g
aggcagctctcctatcttgtacctttgccgtacatccaggtaggactgtaaagacagctcntatatgttgtgcttagaaccgaagagggccatatcatacaggtttaaatatgctttatac

SEQ ID NO: 34916 - DNA, 121 bp, Artificial Sequence
  Synthesized
  misc_feature (61): n=t or c
ttccaaatacttcatctgcaaacttaaattaatgtgttctctccatgcagattaatactgngtgactttgttttcatgtaccaagtagtcagggatataaacaaacccagcaattacgtga

SEQ ID NO: 34917 - DNA, 121 bp, Artificial Sequence
  Synthesized
  misc_feature (61): n=t or c
tattttccttttactgtcttcgcatttttttttttggttgttacacactagtacttaatanaggcagtgaaaataaaaagataaaagagggttctgctaagtaagagttagaacttacctt

SEQ ID NO: 34918 - DNA, 121 bp, Artificial Sequence
  Synthesized
  misc_feature (61): n=a or c
cacctcttcagttataatgaaaagcaagcaacatgggactgagacgaacagaaactgctanggtcttattagctgttacactacaaagttatatcaacctatgtataaataaggtaaaaag

SEQ ID NO: 34919 - DNA, 121 bp, Artificial Sequence
  Synthesized
  misc_feature (61): n=a or g
tgacatttaaaaactgtttttacaatagaaattgtcgggctcttctccatcccaacttcantgatggatgaggggaaaatgcctatgtgtttcctaggaaaataaacctttcaggactcag

SEQ ID NO: 34920 - DNA, 121 bp, Artificial Sequence
  Synthesized
  misc_feature (61): n=a or c
catcctgtttctgtttagaaagtgcctcagtccttccttgtcagtaaagttgcatccacanctctttgctctggtttgaccttagatgctggccaccagtcctgagtgactgctgtaagga

SEQ ID NO: 34921 - DNA, 121 bp, Artificial Sequence
  Synthesized
  misc_feature (61): n=a or g
cgattgtccaatttacatgtgcacagccagaagcaggacgacagccatcttgcaacctggntgcctaaagcactgccaacacagtgatcccccggacccagcaccgcactgcactgctccc

SEQ ID NO: 34922 - DNA, 121 bp, Artificial Sequence
  Synthesized
  misc_feature (61): n=a or g
ttttgctggagctcagaaatgtcatccaatagagtaagattatatatctaatctagaaggnctttaatgaggctgccattgttctgtgctatgttggttaagggtggcctccaactgaatg

SEQ ID NO: 34923 - DNA, 121 bp, Artificial Sequence
  Synthesized
  misc_feature (61): n=a or g
tgaaatacatttcatgaaacgctattctttgctcagctagcacttaatgactggagctccnggccaactacagaatcctaaaatgaggccatcaacatcgcccaattactgctgttattaa

SEQ ID NO: 34924 - DNA, 121 bp, Artificial Sequence
  Synthesized
  misc_feature (61): n=t or c
ggcagacttgctatgtggaacccaatcagagaactctcattaaataagcatttagtttctngcttaaaggtaacagttagctactctactatagttggtctcccactaagcaatttccatt

SEQ ID NO: 34925 - DNA, 121 bp, Artificial Sequence
  Synthesized
  misc_feature (61): n=t or c
gggagcgactgtctggaatcagccagaggaaattcagtgcctgggagggataagtggatgngcagagaggcaacaggatggcaggagggaatcgaggggctgagacggatcactgacttag

SEQ ID NO: 34926 - DNA, 121 bp, Artificial Sequence
  Synthesized
  misc_feature (61): n=a or g
ccgttcatgagccctccagagaactcggtgcctaagcagtgctgtgaagaagcacattccnaaggaggaatgggctctcacaggccctgggacttcactgttcagcagcaaaatgatatca

SEQ ID NO: 34927 - DNA, 121 bp, Artificial Sequence
  Synthesized
  misc_feature (61): n=t or c
gatgatgaaccagctggtggatcaattggcctttgccaatatcattacccattgctcacanacctcacagagagaagcagcccactaagctgtcatttctatcttccattcatttgaatcc

SEQ ID NO: 34928 - DNA, 121 bp, Artificial Sequence
  Synthesized
  misc_feature (61): n=t or c
ctccgggtgcggtgacactctcccagccacagcaaagcagcaggatggagggctgagttangtggttctttctctcacaggtttccatttcctgctctagtttctccacccacagtccaag

SEQ ID NO: 34929 - DNA, 121 bp, Artificial Sequence
  Synthesized
  misc_feature (61): n=t or c
ctaacaaatacttggaccggagtcaatttgatacaattgtatatcaaattccttggacttntgcagactgacacgtggtttgaaatttttgtgcttttattatttcttaacgagctgattc

SEQ ID NO: 34930 - DNA, 121 bp, Artificial Sequence
  Synthesized
  misc_feature (61): n=t or c
ggaagggggaaaacacagacgaacgcacgactcggacattgggtccaaaggcatcctggtnttctgtgctgaatctccatacatttgggctgagcttcaccaaaccgattggtctgatcag

SEQ ID NO: 34931 - DNA, 121 bp, Artificial Sequence
  Synthesized
  misc_feature (61): n=t or c
gtcagcagagaccctgaattaggtcaattatatcaaaatatttcaattctgtttggactanatttggtttgggcctctcttgacagaatggtcttgcagaaaaagcactggatttctgcat

SEQ ID NO: 34932 - DNA, 121 bp, Artificial Sequence
  Synthesized
  misc_feature (61): n=t or c
gctaaatcagaataattaactgctctctatatttttcttataaaaggaacttcatcttcantgtgagttgtatagaagtaacacagtaggaaattatctctacagttaaaaggaactcact

SEQ ID NO: 34933 - DNA, 121 bp, Artificial Sequence
  Synthesized
  misc_feature (61): n=a or g
atacttaaggtgagatgctttagcctccagtattggagattttggtaaagaaggcatgtcntgcacactgagttggggatttagaactggacatgaaatcacaataaaactggagtttaca

SEQ ID NO: 34934 - DNA, 121 bp, Artificial Sequence
  Synthesized
  misc_feature (61): n=t or c
ctattcactgcagttctgaaaagcatttttgccacaaggtggcaaactatgtctacaggtncaaatcgaaaacaagatgcagaggtgtcaaaacatctctaaaaaccttatatttcctgtg

SEQ ID NO: 34935 - DNA, 121 bp, Artificial Sequence
  Synthesized
  misc_feature (61): n=c or g
tgctctgtcagggttatgaaattctatcttaagcgtagctagagcccgaattatgcgtgtnagggagtcaattgcattatagataatcagaggtttgtattccttgcaagcctccaaatta

SEQ ID NO: 34936 - DNA, 121 bp, Artificial Sequence
  Synthesized
  misc_feature (61): n=a or g
aaaagccccatgtttgcaagtgattgcaccatgctccttccctacatttcatttgggcacnactgcaacttttctaattcaggtgcatgaagaaggtaaagggatttttcagctcagaagc

SEQ ID NO: 34937 - DNA, 121 bp, Artificial Sequence
  Synthesized
  misc_feature (61): n=a or g
acagcccgctggcaacagtgacaaaaagggatgtgcagttcaaaaacgcgccattttaccnacaaagagaaagaattgtacaggcatgtgcagttatacctgccagcagcataactcagcc

SEQ ID NO: 34938 - DNA, 121 bp, Artificial Sequence
  Synthesized
  misc_feature (61): n=a or g
tttgttgccagggctttaaaaaaaaaaaaaaagtaaatattaatagtgctaaagcaaaagngagagatcattacagaaaagctacagtaaaaattcaggtaccaaagtaacagctgataaa

SEQ ID NO: 34939 - DNA, 121 bp, Artificial Sequence
  Synthesized
  misc_feature (61): n=t or c
catgactggagagtaatgcctaaaattttgccttcagaatgagaggtggatgaatacacanattttcgttatttcatcttcatctcaaaatgattatgtgaatgccagctgttttactata

SEQ ID NO: 34940 - DNA, 121 bp, Artificial Sequence
  Synthesized
  misc_feature (61): n=t or c
atgtactaatcttttaaagctaattaccggacaaaataaaaagaaaggagcattcaatttnatatttaaggattatggatttcatcttctaatctcactggacaacaggagaaatgagcat

SEQ ID NO: 34941 - DNA, 121 bp, Artificial Sequence
  Synthesized
  misc_feature (61): n=c or g
tcatgaagaacagacactcctctcttgctctatttaaacaaacgtccaatatcattggtanttttgtgcacatcacccaagccagcaccaattgctttcacttccacgttacccaggaata

SEQ ID NO: 34942 - DNA, 121 bp, Artificial Sequence
  Synthesized
  misc_feature (61): n=t or c
ttcatttaagcagatctgctcacaaaggaaagctttcattggagtttacatcaccctaganatggaagtcaataaagcttaatccaaggaaagcaagcctcattagttttattattttttg

SEQ ID NO: 34943 - DNA, 121 bp, Artificial Sequence
  Synthesized
  misc_feature (61): n=t or c
tattaaacttatgttattgttgtctctattaaccatgttcacgcttttgctaaaatagatnaatgaagtcttacagctcttcttgtttccagaaaggactgcccatatcagttatttgtta

SEQ ID NO: 34944 - DNA, 121 bp, Artificial Sequence
  Synthesized
  misc_feature (61): n=a or t
tgtttaataaggacaaatacataaacagaacatgagagcgcagaaagcccaggtattcttnaccctataactttcagcatcaatcctataaacacctcctgagcttgttcctgtgtgctgt

SEQ ID NO: 34945 - DNA, 121 bp, Artificial Sequence
  Synthesized
  misc_feature (61): n=a or t
tccttttcctactgtgcagtctttgcagtctgtgaccttattggagcagcataattctgcntcagaatgaggggcaggcagtaacaacaacaaacagccgagatgttggctgtaacaatta

SEQ ID NO: 34946 - DNA, 121 bp, Artificial Sequence
  Synthesized
  misc_feature (61): n=t or g
ctaaaccaaaaatctcctaaaaccccagcctacttggtccaacatcctttttgtgtgcatntgcatcttacttactcagtctttattcttggaattcatgaccattgttgcctgttttaaa

SEQ ID NO: 34947 - DNA, 121 bp, Artificial Sequence
  Synthesized
  misc_feature (61): n=a or g
ctgtgtatctcacagaaaggagagatgaaaatatcaactgggccaaagaaactgagagaanaattcagaaaaaacatagtaagggtaatcagaatagataataaggcaaaacttgcatatg

SEQ ID NO: 34948 - DNA, 121 bp, Artificial Sequence
  Synthesized
  misc_feature (61): n=a or g
tcaccaccctatgtacagaaatgtgtcctacaactctttgagtggagaaaaagcaatagtntttaaggaccattctcagtatttttcctattttgttgatttaatcagatagacaaaaagt

SEQ ID NO: 34949 - DNA, 121 bp, Artificial Sequence
  Synthesized
  misc_feature (61): n=t or c
tcccttgtaaaaagggagcaatcccgctccagtcagttaaatcacaatctttacgctcagngttgcattcacatttatttgagtgcagagaactcccggtcacatttttattctttacatc

SEQ ID NO: 34950 - DNA, 121 bp, Artificial Sequence
  Synthesized
  misc_feature (61): n=t or g
atgactcttcagagaagtacgtacatgtttctgatctgttttggcaaaccctgatgagatngaagagatggaacatacttgcatctgaacttaatgccagctggggaatgggctgttgact

SEQ ID NO: 34951 - DNA, 121 bp, Artificial Sequence
  Synthesized
  misc_feature (61): n=a or g
tgatgcaaaaagtggattttttcctttttctgaaggagacttccttttagcaaatctgatnaaggtaactccagcttgaactcctctgaagaagatcagtgtagggaagaatagcatgtta

SEQ ID NO: 34952 - DNA, 121 bp, Artificial Sequence
  Synthesized
  misc_feature (61): n=a or g
taaacttcccatcaccaaggctgattcagatgctcagatagcttaaatactcacttaacanccaataacttttggcaaagtgtgatgcttactgtgttctaatataaactcaagaaaaaaa

SEQ ID NO: 34953 - DNA, 121 bp, Artificial Sequence
  Synthesized
  misc_feature (61): n=t or c
gaaccagccaaggatgcagaaaatactgaaaattactgagattgtgaagcagttgccctcnactgaccacccccaaccagcaaattcatgctaatgcagtctgttttgcagctgttaagaa

SEQ ID NO: 34954 - DNA, 121 bp, Artificial Sequence
  Synthesized
  misc_feature (61): n=t or c
atacactctccacagcctgttctttctgcagctctgaactatttccattgcaggtgtgttngtgtttctgccagatcacctggcaatttactgtggattctgggaacttcaaagctgaatg

SEQ ID NO: 34955 - DNA, 121 bp, Artificial Sequence
  Synthesized
  misc_feature (61): n=t or c
aactgaagcctttggcaagccactgcaaggcaaaggctgccttgtgagcatagctttcacnagacacaaaaaaacctgtgcagaagaaagaccaaaagccaaaccacaagaaagactcgga

SEQ ID NO: 34956 - DNA, 121 bp, Artificial Sequence
  Synthesized
  misc_feature (61): n=t or c
taataaatgcattctgcattatactgaatacagaagaaggctgataattacttgttatcangttatgtaggtttccaaatcagtgattttgggctggatacacaggcatttgtattcagat

SEQ ID NO: 34957 - DNA, 121 bp, Artificial Sequence
  Synthesized
  misc_feature (61): n=a or g
atatatcttgactatctgaggaaaaacggcatcatttaggactatgttcacctccaggttnttcagacaataagcactgaactcgaagttacgatctagctcaaattagaattacaccccg

SEQ ID NO: 34958 - DNA, 121 bp, Artificial Sequence
  Synthesized
  misc_feature (61): n=t or c
cacacatggtccttgatccaacaactggaacaaccagtaaagattgctattttgccataancactaagatacaaaaagatatcatcttgaaagcacattccaacaggcacacatgcactta

SEQ ID NO: 34959 - DNA, 121 bp, Artificial Sequence
  Synthesized
  misc_feature (61): n=t or c
aaggaatgagaagttctattcttgagaatgtgtaactttttaaagtcttgggtggtatggnacaggaaagaagtacatttattaaaattaaaatgcacaaaaaatgtttcatgactaagta

SEQ ID NO: 34960 - DNA, 121 bp, Artificial Sequence
  Synthesized
  misc_feature (61): n=a or g
aagtgtcaatacaaatactggtcttaatgatacatcactacccttacacttaaatgcacanaacagatcggcagatacaaactgtatctactctcaattgattgcatgatgttactttctc

SEQ ID NO: 34961 - DNA, 121 bp, Artificial Sequence
  Synthesized
  misc_feature (61): n=t or g
aatgctcagtactgctgcagtcaagttttcttccatgatgtgaatatctgtgattcaaaanatttttgccatatgttctggtatatgatttcatttctcctaaggctcatattgttatttt

SEQ ID NO: 34962 - DNA, 121 bp, Artificial Sequence
  Synthesized
  misc_feature (61): n=c or g
attattcctaatttctgttagggccggtgggctctgggtttggcttatgatcttatgatantgaagagaaactctgattcaacttttttttttaattatttttttaatttgacattcagta

SEQ ID NO: 34963 - DNA, 121 bp, Artificial Sequence
  Synthesized
  misc_feature (61): n=a or c
gcactgagtgcctttcagctgtgctggtgagataaaaagggggcagccccaagtgcagggnctgtggcttgtagggaagggaagcacagtgtggaagggctgctctctcctgagttcaggg

SEQ ID NO: 34964 - DNA, 121 bp, Artificial Sequence
  Synthesized
  misc_feature (61): n=t or c
tatactagcgagaatgtcccctgacatggagctgatttttatatctgttaaatttaccacnagctttacagatgccgcaatctcttttattccagctctagcaattataacgtaatctgtg

SEQ ID NO: 34965 - DNA, 121 bp, Artificial Sequence
  Synthesized
  misc_feature (61): n=a or g
aagagaatcaaaagcaagtaaatgcgtgggtctcaatttcctatcatttcatagcaaaacngcaaagggaatgcaccctctgatggcagagttgagagatatgtccatgtctggggaggag

SEQ ID NO: 34966 - DNA, 121 bp, Artificial Sequence
  Synthesized
  misc_feature (61): n=a or g
aagagacaagtctgcagtataaaaagataaacaaaggtaaggaacacagtgagactaagcnatctctagtagatctacagagcagactgctggcaggcacataggtagaactcaatcagtt

SEQ ID NO: 34967 - DNA, 121 bp, Artificial Sequence
  Synthesized
  misc_feature (61): n=a or c
agctccatcccaggacaaatatagtggcaaagaggtctttgccgcccaaagggcagtattntgtgctgaggtgctagggaattgtaaggctttcagatgacaaaaagtgtgtggaagccat

SEQ ID NO: 34968 - DNA, 121 bp, Artificial Sequence
  Synthesized
  misc_feature (61): n=c or g
ggagagaaagacaaccaaaaggctatttaagccacgacaaaaccctccaatctatagtacncagagaacaggctgggatgtgctgtaggctgccctactgtgcttcagcttcaactgcctc

SEQ ID NO: 34969 - DNA, 121 bp, Artificial Sequence
  Synthesized
  misc_feature (61): n=a or t
aaaccaaataatgtttttttttctgagtagtccaagcaaagtcctttctcttgataatttngttgttattgttcatagtatcttgaccagaccttgttcagcaatacaaaatattgttctc

SEQ ID NO: 34970 - DNA, 121 bp, Artificial Sequence
  Synthesized
  misc_feature (61): n=a or t
attagatgtaggcagtacctcgtagcactttggttaagactattcttcttgcatttcaaantaagtgaccaccatagctgtttttcttttcagatttgttttggggattttaaggttgggc

SEQ ID NO: 34971 - DNA, 121 bp, Artificial Sequence
  Synthesized
  misc_feature (61): n=a or c
gtgcaaaaacagttttcatcattcagaaatcaggttttggcaaggcagtcaagataaacanttgctttctagggatgttactaaagcagaacgaaagaaatggtgaagtagttgcatgttt

SEQ ID NO: 34972 - DNA, 121 bp, Artificial Sequence
  Synthesized
  misc_feature (61): n=t or c
tcttttacaggaatctttgtgcttgccttgatttctatatttgttaaataaactcactggnttatttaacttccataaacccagaccccattttaacctcttccaaactgttgatttccag

SEQ ID NO: 34973 - DNA, 121 bp, Artificial Sequence
  Synthesized
  misc_feature (61): n=t or c
ttgaagatgaccaaagcagtctggaacagaacatgttccaaagctcttccaatacaattcngcttccattaaggctcaatacaacttttacgtttcaaattgaaagacactttcctgaaca

SEQ ID NO: 34974 - DNA, 121 bp, Artificial Sequence
  Synthesized
  misc_feature (61): n=a or g
agaaagtgtggagggaaagtgtatttaatgacatgtttcctccgtactcagctgcttggcntgtttctgcaggctgggtaaagagacgggctcgtgtgctgctgaacgtgcaggcacaggc

SEQ ID NO: 34975 - DNA, 121 bp, Artificial Sequence
  Synthesized
  misc_feature (61): n=a or g
tgattatgtatatatattatatatatatatataaagaagcaaaacaatgtggacacaagcnaagtgtttcgaaaagagaagggcagcactgctggaggcacagcctgttactgtgacaact

SEQ ID NO: 34976 - DNA, 121 bp, Artificial Sequence
  Synthesized
  misc_feature (61): n=a or g
gctcccagtgaaaataggaacttgtactttctttaaaaaatggagcacaactcttgccacntcaggcatctgagggctttgttttctagtgttaagtttgggtagtcaaagttagatttga

SEQ ID NO: 34977 - DNA, 121 bp, Artificial Sequence
  Synthesized
  misc_feature (61): n=a or g
cgctccagttttcagatcatccttcttttcagtaaagacataaaacgatgaattcttagcnctacaagtaggtatgctcttcattggtcatttcttgtcctttattgcattgttcttcctc

SEQ ID NO: 34978 - DNA, 121 bp, Artificial Sequence
  Synthesized
  misc_feature (61): n=a or g
atgagagcatggcacaagtatcagatgccaatatcattgccttaaaatagcaacgtcttcngattatcttggaacacttcacaattacgttctgagcagagtactttctatgcaatacatg

SEQ ID NO: 34979 - DNA, 121 bp, Artificial Sequence
  Synthesized
  misc_feature (61): n=a or g
tactgtgataagggagaatgtggccagttttagcagctggatgggactttcatgctagggntgaagccagcccggtgttggactggaatgactggagatacagatcaaccaggaggtgagg

SEQ ID NO: 34980 - DNA, 121 bp, Artificial Sequence
  Synthesized
  misc_feature (61): n=c or g
ttggtggtttttgttttttttttttgagacagagctctttttagaacaaaaacgtatcctngagagcctcgtgcaatgaaaagaatactgtcattaaaaggtatttattatcccataattc

SEQ ID NO: 34981 - DNA, 121 bp, Artificial Sequence
  Synthesized
  misc_feature (61): n=a or g
acaggaaggaggatcaaggaaggggtggcatcactagtaccacagttaactacatgcagantggaggtgagtgagatatggctagataggaagaccaggggtgatgtgcacagagagcttc

SEQ ID NO: 34982 - DNA, 121 bp, Artificial Sequence
  Synthesized
  misc_feature (61): n=a or g
gtgccactacaagagatctacatacaagacttagacaatattgataacttgctaaaagaantctgcctgtaaattcagcaactctgattgttaaatcatgaagttccagtaaatggcactg

SEQ ID NO: 34983 - DNA, 121 bp, Artificial Sequence
  Synthesized
  misc_feature (61): n=a or g
ctacaagctgtaatgttttgtcgagatggtttatgttactgaatgattataaatgtcttgnaagatgtgtggtgaagccaactgattaaatttaggtctcccctctcaaatacgctgcgac

SEQ ID NO: 34984 - DNA, 121 bp, Artificial Sequence
  Synthesized
  misc_feature (61): n=a or g
gtgaatcactgtacatggtaggcttcagtttgacctgatgaaagatactgtagttccatcnttcttctatgagaagggagtttatgtatgagtttgaaaaaagaaaaaagacaatattcag

SEQ ID NO: 34985 - DNA, 121 bp, Artificial Sequence
  Synthesized
  misc_feature (61): n=c or g
gcaaggagtaacctggaagattcgtgctccgctttgtgttcctgtcaataaacaagtgctntccgtgccccttgcctcctgcagaaagggatcctccacccccagctgatgtgcagggaga

SEQ ID NO: 34986 - DNA, 121 bp, Artificial Sequence
  Synthesized
  misc_feature (61): n=a or g
cagcaggaagacgatttacttacagaatgggtaatccgccatttgatttaatgaccctgtntactgaaaatatatgggtgaagtaaatagatggaaagaaatatggggtaaaagagaacaa

SEQ ID NO: 34987 - DNA, 121 bp, Artificial Sequence
  Synthesized
  misc_feature (61): n=t or c
tctttgatcatcataacaccttaatcgttggaccacatatcctcaccttcctatttcttancctacctccctaacaggatcacaaggaaagttaggcacattatctaactattccttttag

SEQ ID NO: 34988 - DNA, 121 bp, Artificial Sequence
  Synthesized
  misc_feature (61): n=c or g
ccttctggaaaacatagccaggctcttgggaattagaaaagaggctggttatgaaaaactnttgggctgttgctacataattcatgtcttaaattcattgaactggtactgcacaaatttc

SEQ ID NO: 34989 - DNA, 121 bp, Artificial Sequence
  Synthesized
  misc_feature (61): n=t or c
tctgttgtgctgctaacacccattctcctgggatgagacaaccctattttaacatactgcnttctctgcaggggatagcgcttcattagcagcctcaaaaggtgggagggaagcaagttag

SEQ ID NO: 34990 - DNA, 121 bp, Artificial Sequence
  Synthesized
  misc_feature (61): n=a or g
cggcgtcaccctcgtcgtcacctcactcccattcaggacgctggtgatgttagttagaggntgaaagaagtaaaagcacttagcgtgacagaggaagcgccgctggggccgctagcagtgc

SEQ ID NO: 34991 - DNA, 121 bp, Artificial Sequence
  Synthesized
  misc_feature (61): n=t or c
aagaactatatttaacatttttaagttgtttgttctgtccacagtttctgtcaaacatcancagtgctgtctttctctgtcttcctttcactaatggcaattgtaattgatttcagagcct

SEQ ID NO: 34992 - DNA, 121 bp, Artificial Sequence
  Synthesized
  misc_feature (61): n=a or g
tcatacttcagagctggcacccaaatgcaggtctgccttcccctcaagaatgtgcttttgncagcttccttaaaactgcacctgcacgaccacctcataagcctcagaaaagccagcgtta

SEQ ID NO: 34993 - DNA, 121 bp, Artificial Sequence
  Synthesized
  misc_feature (61): n=t or g
tctatcatccttcagtcagtctcctcattttcacaaaacttaaaatcaagagcttcaaatntaggaacttaagaactttaggaacttaagcatttaacactcttcaaatgtactggaaatc

SEQ ID NO: 34994 - DNA, 121 bp, Artificial Sequence
  Synthesized
  misc_feature (61): n=a or g
tatcagcacctttgcaaactatgcaaacatggaatatccccttgtacggctgtaaaccacngtttgtaacaggccatcagctttgtactgaatttttaaggcctcaggactaatgtttgtc

SEQ ID NO: 34995 - DNA, 121 bp, Artificial Sequence
  Synthesized
  misc_feature (61): n=t or c
gcttgagctatttcggtttaagtgcagtcagagctgtcatttgaatgaaattagaattgtnggacactggtttatgtaaaaatggttctgcatgaaggatcccaaaactgatgattttctg

SEQ ID NO: 34996 - DNA, 121 bp, Artificial Sequence
  Synthesized
  misc_feature (61): n=t or g
ccatgccttacctgaagtctgaattcttacctagataatatttgaagtaagtttgaaatcnagcttgaattcctgatttattaacagctggttacaagatatttaggagaccctgtcataa

SEQ ID NO: 34997 - DNA, 121 bp, Artificial Sequence
  Synthesized
  misc_feature (61): n=t or c
tctaaaaatcccccttggtagaccttgtccagctccacactaaatgccttcctcagccagnctgaccatacaggctaggtctaaactacaaaataaatattcactaggaaagcagaggaaa

SEQ ID NO: 34998 - DNA, 121 bp, Artificial Sequence
  Synthesized
  misc_feature (61): n=a or g
tttacggtgctggttacaggccttcttcattaggcaagcagagggaagttctttgtctatntcttgcacaacaaaatatttccattcaaacaatatctcaaggtggtcactttttaatcag

SEQ ID NO: 34999 - DNA, 121 bp, Artificial Sequence
  Synthesized
  misc_feature (61): n=a or c
ccaaacagatcagttgagaaaagacgagattttgtgattgccaatcataataggaaactgnactggagtagtctcatccattccagtgtttctgaatgcaacatgctaaccatctttttag

SEQ ID NO: 35000 - DNA, 121 bp, Artificial Sequence
  Synthesized
  misc_feature (61): n=a or g
ctcagatcttattttgcaagaacattttatcctttcttcttttatctcagtcatatcaccnctttctggcagtaaatacattagggaacaaatatttttggggtgaggcacaggaagagta

SEQ ID NO: 35001 - DNA, 121 bp, Artificial Sequence
  Synthesized
  misc_feature (61): n=a or g
cacagctaaccattaaatgcagctccacctaactttctacaaaaagcattaacacaagtcngtcttcacctgtcattttagcagctgttttctgccccagctccctttccctaacaaattc

SEQ ID NO: 35002 - DNA, 121 bp, Artificial Sequence
  Synthesized
  misc_feature (61): n=a or g
gtctacaaaatcttttgtacatagagttctctctgtctgggtcttgttctggctgaatgcnccagaattctgatgtaataatcgcgttgctgtggttgtcacaggactgagtgaaaactga

SEQ ID NO: 35003 - DNA, 121 bp, Artificial Sequence
  Synthesized
  misc_feature (61): n=t or c
agggaaagaaaacttaactttatggctgattctttggcatttgcagaactgtacagaatangtaggaaaagacctagcaggttatggaatgtgagttttctaggtagtcattcagcttcat

SEQ ID NO: 35004 - DNA, 121 bp, Artificial Sequence
  Synthesized
  misc_feature (61): n=a or g
ccctagagcagtctcctgcccaagggctgcttgtaccatggagactggaatgaggctgcancttggatgggacttctctgctattgcactacagtgttttcagttgactaaaatttgctat

SEQ ID NO: 35005 - DNA, 121 bp, Artificial Sequence
  Synthesized
  misc_feature (61): n=t or c
tcagcattcccatctacagaaacctcacgaataaggtggaggagttacattatattactantgcttgatgcaacacctttaagagatagatggcaaaggattcagaatgagaattttgttt

SEQ ID NO: 35006 - DNA, 121 bp, Artificial Sequence
  Synthesized
  misc_feature (61): n=a or g
tggaattctcctatggtttttgttctcagttgtgtgacagtaccttcagtcatacttgtcnttgtctctcagttttctctgttcagctccagaaagtttgacttggtcaccttcataccat

SEQ ID NO: 35007 - DNA, 121 bp, Artificial Sequence
  Synthesized
  misc_feature (61): n=a or g
agaactgatggatgagagcagcaagtatctggcttcagagaaactagacaggctttccccnagggctgaaggaggatggttagaagggacagtcctgtgattctctggctatggggacaaa

SEQ ID NO: 35008 - DNA, 121 bp, Artificial Sequence
  Synthesized
  misc_feature (61): n=t or c
aactgaaactgagaaatacaccagcatattgaaactcttttaactttcatttaacattagntaggtgatgagcatatatctgtcaaagtgaggtgatcggtctttcttgtatgctgttgct

SEQ ID NO: 35009 - DNA, 121 bp, Artificial Sequence
  Synthesized
  misc_feature (61): n=a or g
acagcaaaacaggcatctaggcctttatttctgtacaattctcttctactgtgactaacanatttttccacttagcatagaagagggatcataattacatttgagggatggacaacagttt

SEQ ID NO: 35010 - DNA, 121 bp, Artificial Sequence
  Synthesized
  misc_feature (61): n=a or g
accaatttcatactactgataaaatatgaacacatctgcatgaactgaatttctcagtccntaatctgtgtatgcagcacacatgataaaccattcatactgttacagctttaactggact

SEQ ID NO: 35011 - DNA, 121 bp, Artificial Sequence
  Synthesized
  misc_feature (61): n=t or g
taatgcataactggaaacactaaagacttggcctaagatgactcagaatattgtgattttnagaaaatacactctcaagtttatggcctcctaggtactgtactgctgctgtatggaacaa

SEQ ID NO: 35012 - DNA, 121 bp, Artificial Sequence
  Synthesized
  misc_feature (61): n=a or t
ctggattaagattctttgcttctgaaaccatcttttaattatgattccctccctcacgggnattacatttgctgtaaacacttgctagcatgggacaccaagttcatctatgagcataccc

SEQ ID NO: 35013 - DNA, 121 bp, Artificial Sequence
  Synthesized
  misc_feature (61): n=t or c
agtcacacttactaaatcaagtacacatcattatagctggcgtaagaaatatttacatttngtatttgatgaaattattacaggtaactggcatcaggaaaagtcatccattctctgcata

SEQ ID NO: 35014 - DNA, 121 bp, Artificial Sequence
  Synthesized
  misc_feature (61): n=a or g
agccttactgtctgtttcacttccacccactgaaatcctgctgaattttgctgaaaatctnctgagtgttacaggtctgaatttggtggccccgtatgttgggcagccccctgcagtcacc

SEQ ID NO: 35015 - DNA, 121 bp, Artificial Sequence
  Synthesized
  misc_feature (61): n=t or c
tttgtagatgtgaaacaaagcacctttagaaaaggcctccaggtaaggtgcctgcaatgangacgtatccaagtttttattgaaatgcttaaaggatgctatactttctcttctgttggca

SEQ ID NO: 35016 - DNA, 121 bp, Artificial Sequence
  Synthesized
  misc_feature (61): n=t or c
aaaacaaacctctgggtatttctctgtgatatgaagagtgccacaatacctggctggtccnggaacatcaacacactttcagtgctggccctctcttcttggttgctgcagccctaatcgt

SEQ ID NO: 35017 - DNA, 121 bp, Artificial Sequence
  Synthesized
  misc_feature (61): n=a or g
tagccacggatttcaggatgatctgcctggagactgcccacagaggctgtcctgatgtaanagatgctgtgtgtggaaaagtactcctgcccctctggagacattagatctaaaaatctat

SEQ ID NO: 35018 - DNA, 121 bp, Artificial Sequence
  Synthesized
  misc_feature (61): n=t or c
gagcgtgatccgagctcaggggatttaaagaaggagaagaggcaccttttgaaggcaactngtttgggttgtgtttatggcacaggcccacagatggttgctgcattgcaccgtgggttag

SEQ ID NO: 35019 - DNA, 121 bp, Artificial Sequence
  Synthesized
  misc_feature (61): n=a or g
ctgattatagtcatccagcacttttatacaagcacaaaatgcggtctggcttaagcttcantttgtgtctctctttgaagaaggtgtaatcactgcttcgcaccactaagtggagtgagaa

SEQ ID NO: 35020 - DNA, 121 bp, Artificial Sequence
  Synthesized
  misc_feature (61): n=a or g
taagacatccagataaggacataaagggcagcaactaaatcctaacaactcacagagcagngacagaacgcagacaaaagatcaccaatgatcttagcccacaaggaatataaaacagcaa

SEQ ID NO: 35021 - DNA, 121 bp, Artificial Sequence
  Synthesized
  misc_feature (61): n=t or c
tcttcaagtctctgaatgctttcatcacctgcctcaaagccttctgtgtcagctccatccntctctgagtcacaatgatcagagctgaatgtggcatttggagatcatcccacctgtttct

SEQ ID NO: 35022 - DNA, 121 bp, Artificial Sequence
  Synthesized
  misc_feature (61): n=t or g
gactgctggcagctatgttaccacctttcaaatcagtgagttctttttactttcagtctgngtcgtttactagatgttacaaatcacacaagcaaaattcatggcaagttgcatcttatgg

SEQ ID NO: 35023 - DNA, 121 bp, Artificial Sequence
  Synthesized
  misc_feature (61): n=a or g
acactgccgggaatgcccccacagcattcagaaggctccaaaacctctatcatcacagccngcagacgcagagcacggatgtcacaggaaaaaatcagagatctgcacccacagtgtggac

SEQ ID NO: 35024 - DNA, 121 bp, Artificial Sequence
  Synthesized
  misc_feature (61): n=a or g
ggagaaagcacaccagacaaaagagtaaactgagaagcctagggagggctaaacaagaacnaagaacagagggatgcttctaatgcagttaaaccaatgcccccaaaaatacacagtcaca

SEQ ID NO: 35025 - DNA, 121 bp, Artificial Sequence
  Synthesized
  misc_feature (61): n=a or g
tactggtttcctccttccctctcatctgagctaactgatcccaggactgcaggttctctcngggttcagtttttgcactatttacctgtactacaaccagtacaatgagcccatgggacct

SEQ ID NO: 35026 - DNA, 121 bp, Artificial Sequence
  Synthesized
  misc_feature (61): n=t or c
tgggtccagcttgtgctcctggcagtgcctcaggtagtggttgtagagggaactcctgggnaggctcacgccttccgctgtctcatagttgtccaacaaccactggagctttaggcatggg

SEQ ID NO: 35027 - DNA, 121 bp, Artificial Sequence
  Synthesized
  misc_feature (61): n=c or g
gcagtgtagggaacctgtgccttgtttttcaccaccaggctctcctcaggctcctgacatnctgctctgcaggtccaaccttcccaccctaccctaaagaaggggaaaaagagcagcagcg

SEQ ID NO: 35028 - DNA, 121 bp, Artificial Sequence
  Synthesized
  misc_feature (61): n=t or c
atagtgagaggaaaaaaaaatcctgatgtaaaaatacagtaagatgctgttggagcatttnacatcagtgagatccacagctgcaattatttttggcagatctgtggagaaatgggtcact

SEQ ID NO: 35029 - DNA, 121 bp, Artificial Sequence
  Synthesized
  misc_feature (61): n=a or c
aggtagaggcctgaatccgctcaggatgagcaggagtctatatttgcagcagtgtgctttnttaactgtaacaaaacctttggtctgtactattggactgcctgccttggaatccttgaca

SEQ ID NO: 35030 - DNA, 121 bp, Artificial Sequence
  Synthesized
  misc_feature (61): n=a or g
cctccagtcatctgcctctgtttgctgttgttttgttgctaaattagctcggctgcttttnaattctgtgatctggggcatacctgcaagtgaactgcctggctttgtatttctattcaga

SEQ ID NO: 35031 - DNA, 121 bp, Artificial Sequence
  Synthesized
  misc_feature (61): n=a or c
gtatgtataaaaatacagcggtgctgttatgctgaaaagaacccgatttcagatttgcacntggcacactcggtgttactcctgcacacggctgttaaagacaagagccaagaaggaagga

SEQ ID NO: 35032 - DNA, 121 bp, Artificial Sequence
  Synthesized
  misc_feature (61): n=c or g
aagttcaaacaggtacagtgcaactagcatcttgtggacgttttgatggcttcttctttanatcaagctttgtacctgatgctgtagtctagtactttcctcctctgtgtgcggtgtgtgt

SEQ ID NO: 35033 - DNA, 121 bp, Artificial Sequence
  Synthesized
  misc_feature (61): n=t or c
gtttatgtacattttcctttgtgttgcttcgaaatgtttggctgaaatgggcctccatcanaaaacttaatgcgaagagaagtgagctagtcagcagagaaggttgttgtcagatgtgtgt

SEQ ID NO: 35034 - DNA, 121 bp, Artificial Sequence
  Synthesized
  misc_feature (61): n=a or g
ctgaaaaagcaaaacactttcctagttctgtgcattaattgattgcttaatggtttatcancactttcttctatacccctcacatgcgttcttcctgctgctgcacaggtcagccaggtga

SEQ ID NO: 35035 - DNA, 121 bp, Artificial Sequence
  Synthesized
  misc_feature (61): n=a or c
ctgaacgtttgggggtcttttgacttcaccatcctggttctgtcttcttaaaggagctttngaagatggagaagatgctttcatgtttaagcagtgccaactgtgttttaatcttactgct

SEQ ID NO: 35036 - DNA, 121 bp, Artificial Sequence
  Synthesized
  misc_feature (61): n=a or c
ttccgtcccgcctcagagtgagccgatacccgtctgacttttctcccggtttccctcatgntccgtgttattatttcttctgtctgatgtttgttctgggatctggggatcgctctggccc

SEQ ID NO: 35037 - DNA, 121 bp, Artificial Sequence
  Synthesized
  misc_feature (61): n=c or g
gagcctatgatgatgaggcaggtcctcaactgagtgacaacttcaggtcttgggctcaagnacagggttcataagaccaagcactggatcaggaaagcaaaggcacaggtggaactaaact

SEQ ID NO: 35038 - DNA, 121 bp, Artificial Sequence
  Synthesized
  misc_feature (61): n=a or g
ctggggattagatgcaaaaccttaattacagttatcttaataatggtccctgaggggcagnttgaaagtacctgtgaaacaggctgtgtgcatggaggagcattattttagtgaatttgat

SEQ ID NO: 35039 - DNA, 121 bp, Artificial Sequence
  Synthesized
  misc_feature (61): n=t or c
cctgttttccagcactgtccttgggctctggtgggacgcagggacttgacatcccggctgnacttgcaggaggctcgagaggctgggtaaaaggcgctgatgttgttccacactgagcatt

SEQ ID NO: 35040 - DNA, 121 bp, Artificial Sequence
  Synthesized
  misc_feature (61): n=t or c
ctgcataactcatatttccaggtgggctttctcagcatcctacctattgatataaattaanaacatcttgttacttcaaaatgtgggtgcatccacttcacttggggatgaagaacgtttg

SEQ ID NO: 35041 - DNA, 121 bp, Artificial Sequence
  Synthesized
  misc_feature (61): n=t or c
tctggtaccttttggtgaccaaggcagcctgttatcctcacctttgcttgttttgcaaggngtcattgttatatgtgagtgaaggggtttgatgcaggaataacttttcccttcctcctct

SEQ ID NO: 35042 - DNA, 121 bp, Artificial Sequence
  Synthesized
  misc_feature (61): n=a or g
ttcttcagttagaaaaggaaactcgctgcaaatttcatggacagtaaagaaagaaatgtgnagaaaccaaagaaagaagttaaacaaaaaaggggccagtctgtttatagcagaatcaaaa

SEQ ID NO: 35043 - DNA, 121 bp, Artificial Sequence
  Synthesized
  misc_feature (61): n=c or g
gaaaaatggaaggtagatgagaactggccttctaacaccatatggcaaacccagactgagnacagcctccccagatcccagatgagaccccatttccccaccagaccatcagcacttctca

SEQ ID NO: 35044 - DNA, 121 bp, Artificial Sequence
  Synthesized
  misc_feature (61): n=a or g
tcacccatcacctatgcctatgcctttctgcatccatctacacaatgtctaatggcaatgngcagcaactgtggaatggcttctgattggtcacatctcttagttacacatcttttctact

SEQ ID NO: 35045 - DNA, 121 bp, Artificial Sequence
  Synthesized
  misc_feature (61): n=a or g
ccagtacactgtaattctttcaccgaggtctgtatggaaaacaagtaacctattgcaaacntaatggtagcaaacaaacaagtgtgcatagccccagtacgtacaccccgtgcacacacac

SEQ ID NO: 35046 - DNA, 121 bp, Artificial Sequence
  Synthesized
  misc_feature (61): n=t or c
cacagaggtggcttgctgtgacacacggtgcttgctgcctttcagacctccataacaccanggcaggcattgagagccgcagtgctcctcgtgctgggagcgccttcgatgggagctgcct

SEQ ID NO: 35047 - DNA, 121 bp, Artificial Sequence
  Synthesized
  misc_feature (61): n=a or g
ttttccaaccttaatgagtctgtgcgctttgaagtgatggtaaagatacctccctgaatcnctgcagaggggacaagttggacacagatccccaggtgtccccacactgggtgcaggtctt

SEQ ID NO: 35048 - DNA, 121 bp, Artificial Sequence
  Synthesized
  misc_feature (61): n=t or c
tacatccatcctatggcacagagaaaaagagaatctgagacttttctccaagagtaccatngtggtaattagttttagcaatattaaactgagtttaatgggacccattcaggatctgcgt

SEQ ID NO: 35049 - DNA, 121 bp, Artificial Sequence
  Synthesized
  misc_feature (61): n=c or g
tagtcacctggcaaatcctttcatgctctgggcctgtgctctccatgttctaacactgttnaatggacccccaaatgcttacttcatcaggtcaacacagcgtaacacactcagagagcgt

SEQ ID NO: 35050 - DNA, 121 bp, Artificial Sequence
  Synthesized
  misc_feature (61): n=a or g
agaaattcattgtttaatgtttattttagacaacatgcagtattaacttcagatcttgacnattcagaatattgtattccagctttagaaatgtgatccccgccacccatgtagaactctg

SEQ ID NO: 35051 - DNA, 121 bp, Artificial Sequence
  Synthesized
  misc_feature (61): n=t or c
atgccccagaaatagggctctgatttaacaatatgacatcaactacacagagaagataaancgtgttacagatgcacacacactccagtttttcttagcaccgagaaccccatctgcactc

SEQ ID NO: 35052 - DNA, 121 bp, Artificial Sequence
  Synthesized
  misc_feature (61): n=t or c
cctgggtctgcagagaggtttgtaagtaaagtgagattagaagaccatttaaaacacagcnatgaatacagctctgtttcggttttatgttagaatccccattttcaaaccaaaacacaga

SEQ ID NO: 35053 - DNA, 121 bp, Artificial Sequence
  Synthesized
  misc_feature (61): n=a or g
ataccaggtgcttaaatatcacaaggtgaggtacaaggacagtcttgtcaaaggaaaagtnatagtaactttttagcagtactaccataactctgtgaagagagggaaagcacactttaag

SEQ ID NO: 35054 - DNA, 121 bp, Artificial Sequence
  Synthesized
  misc_feature (61): n=a or g
tctcagggacatcagggtgatcagccttcacaaaaagtaaaacagaattaatcagaacgtnaagtccttcagcatctgtgcctgctacttttgcagtatctgcaataccttgccatctccc

SEQ ID NO: 35055 - DNA, 121 bp, Artificial Sequence
  Synthesized
  misc_feature (61): n=t or c
agcccactggaaacaagcagttctccaaataagaagggcatctgtcatacaaacacagtancattgcctacaaacataaccttggaaggttccaagcagttcaggagagccgctagcacag

SEQ ID NO: 35056 - DNA, 121 bp, Artificial Sequence
  Synthesized
  misc_feature (61): n=a or g
tctgctgtgtttttctagcttgtgcttaaagcttcctgggagaccagtcttaagacgtccnctacagccaggtgggatgaatgaaagcatcattaaagccatgctctctgcaaccaagaag

SEQ ID NO: 35057 - DNA, 121 bp, Artificial Sequence
  Synthesized
  misc_feature (61): n=a or g
tgagaaaaaaattggaaacactaagaggaaacaacggattttaaaacaacactctacttgnctcttaccatacgtctgctttaaaaaaaggagtttaatctcaaaatcaaaacattttttc

SEQ ID NO: 35058 - DNA, 121 bp, Artificial Sequence
  Synthesized
  misc_feature (61): n=a or c
tcataattttatcaggacagttgctatcagacattattgatcttgtagattttgcagatcnatctgtactaatcagtagtatttgctatttcacacaagcaaatgaaaaatagtataatgg

SEQ ID NO: 35059 - DNA, 121 bp, Artificial Sequence
  Synthesized
  misc_feature (61): n=a or g
aacaagacttatctgtcatcatttacttgccaaactgatctgccacctaatttgtttttcntgttttgtgtctgatgacggacaatttactgcaggttcttcaaattcagcccatgaattc

SEQ ID NO: 35060 - DNA, 121 bp, Artificial Sequence
  Synthesized
  misc_feature (61): n=a or t
accacaaagttatagcaggcttccttacttctgcagtccatgtcttactagacaatttcanttttcaaatacacttacgctaaactctacttttaatttatgtatagcctaatatccctta

SEQ ID NO: 35061 - DNA, 121 bp, Artificial Sequence
  Synthesized
  misc_feature (61): n=t or c
acgagatgaagaactgaaggaaatgcactcacctgtaacagacgtgacctggcatgcaacncccaccatgccatggctctcagccacatcagggtaagagccctacaagaggaccaggcca

SEQ ID NO: 35062 - DNA, 121 bp, Artificial Sequence
  Synthesized
  misc_feature (61): n=a or g
tatccttttcttgtgagcccattgtcacacaacaccacttctgtctcattttatgcaggcnggcaaatttgacatcatccccaccatgaccactattggctctgggattggcatttttgga

SEQ ID NO: 35063 - DNA, 121 bp, Artificial Sequence
  Synthesized
  misc_feature (61): n=t or c
cactgtgctctcaaatccagctgaagagtggcagaatgatgtgttcagactggagagggangggatttgggatgagttcctctctgcttttcatgttctggacaacgacacatgaagcaca

SEQ ID NO: 35064 - DNA, 121 bp, Artificial Sequence
  Synthesized
  misc_feature (61): n=t or c
tttagtcacaatgcttacgatgccatgctaggaagcgtcttaacacctctgagggaacggntgcggggttgtttctttcgtctattttttaaaatatatacgttgctcatgtcccaggcag

SEQ ID NO: 35065 - DNA, 121 bp, Artificial Sequence
  Synthesized
  misc_feature (61): n=t or c
atttcccttccccaacttggggtgaaaagaggccgcctcgcttctcaacgaagcagagcantgtaacttcattaagtggccaccaattaactttaaacaaatgagtcagacgttgtaccaa

SEQ ID NO: 35066 - DNA, 121 bp, Artificial Sequence
  Synthesized
  misc_feature (61): n=a or g
tcttaataatcgatttgtatttatagcagcattaaatcaacttaatgcaagctgttagttnaagaaatgtaaattaaatagaacagtttttaacataacagaagtttctgacacagatgta

SEQ ID NO: 35067 - DNA, 121 bp, Artificial Sequence
  Synthesized
  misc_feature (61): n=t or c
ataacctaattaaccacaaataaatctattcttcaacatattcgcctattcactgttctgnttatagagactatgagctgatagctgctggagttgtgtacatcatttcagatactcttca

SEQ ID NO: 35068 - DNA, 121 bp, Artificial Sequence
  Synthesized
  misc_feature (61): n=t or c
acaccccagtaagatcccagtggagaggatcagcaggtggcaaaccacccactccaacatntgttcccactgggagttatctggccaccagatatgcaactgtagggtggaaatgaatatt

SEQ ID NO: 35069 - DNA, 121 bp, Artificial Sequence
  Synthesized
  misc_feature (61): n=a or g
tgttttgtactatagaaaacattattataaagaaatttcaaaagataaagtttttctcttncttccttttcagtttccagaatactgagcttgaaaattcgttacaagaaggatcagagat

SEQ ID NO: 35070 - DNA, 121 bp, Artificial Sequence
  Synthesized
  misc_feature (61): n=t or c
tgcagcacaaggacccaaattgaaataaactctttctggtttgggcatggagactgctcangctgctccatgcaagggaatgggcactgcattccatcttctaacaaagagaaaggaaaca

SEQ ID NO: 35071 - DNA, 121 bp, Artificial Sequence
  Synthesized
  misc_feature (61): n=a or g
atagggcacgggagaacagctttaaactaaaaaagaggagtttatgttagatgttaaaaanaaacattttgctgagaaggctgtgagcctgtgtcataggttacccagaaaagctgtggct

SEQ ID NO: 35072 - DNA, 121 bp, Artificial Sequence
  Synthesized
  misc_feature (61): n=t or c
cttggaatgactccctcacaaatctgaacacagtacacttcacaatggattctggtaaggnagtgaaaacgttctacatagaagagcactacgacaaaataattcagaagtcaagtgaagg

SEQ ID NO: 35073 - DNA, 121 bp, Artificial Sequence
  Synthesized
  misc_feature (61): n=a or g
taactcacaagtgaaacgctttctgttagtgaaataaaaaagtaatatccatcagcacatngtatgaacataaacttgagcacagtcacagcatcacacaccagagctactgaatcactgc

SEQ ID NO: 35074 - DNA, 121 bp, Artificial Sequence
  Synthesized
  misc_feature (61): n=t or c
taccagccaacctgcaaagagagcatcagttgtcaatacctcttgcagtggaaaaaaaagngtcaggacagatacaaggccaggattagagagggaacccagaagaacagcatcaacggga

SEQ ID NO: 35075 - DNA, 121 bp, Artificial Sequence
  Synthesized
  misc_feature (61): n=a or t
ttgaacttgttaaagtttctgcctcggtgctggcagttgtgttcagtctgcacacaaaatnacctgatctctgcagcagacagatatggcactgaggtgtccagcactgctgtgtagctgc

SEQ ID NO: 35076 - DNA, 121 bp, Artificial Sequence
  Synthesized
  misc_feature (61): n=t or c
tcagcaggcagcacggcccagccaccggcgtgagctggcaatggagctcaatgtttgctgngagcattgtctgggctttcttatttctaagaaacagcctgctagggttccattttcaaat

SEQ ID NO: 35077 - DNA, 121 bp, Artificial Sequence
  Synthesized
  misc_feature (61): n=a or c
aaatcactgcttcacagctttataaagttacacagactcagatgcaaaccctctgctaggntgaggagcagggcctaagacagatcgatagctctttgaaaaggatcagctctactactaa

SEQ ID NO: 35078 - DNA, 121 bp, Artificial Sequence
  Synthesized
  misc_feature (61): n=a or g
cacagaggtagctgggcagacatgttcagggtgaggcaggacactctcccatacactgagntttccagatgatgctcatccctactcacagagctgggtatgctcctggagctggcaaagc

SEQ ID NO: 35079 - DNA, 121 bp, Artificial Sequence
  Synthesized
  misc_feature (61): n=t or c
tccttccatgaggaatatcattctgaggagccatcaccgtcaccagttaactctcagccancccctgcattggacaaaccacagtaggatgggtctggggaggattctcattgaataaccc

SEQ ID NO: 35080 - DNA, 121 bp, Artificial Sequence
  Synthesized
  misc_feature (61): n=a or g
agggagtaactgtcactacccacattagaaacaattacagaatataaatgtaaatctcatngaggtttgtacgcttctatgctgaactggagtttgcccccagccttgtggggatgccacc

SEQ ID NO: 35081 - DNA, 121 bp, Artificial Sequence
  Synthesized
  misc_feature (61): n=a or g
aacagcaaatggactacagcttccattttgaggagtggctgcaagagcaaacagcactgangttgtcagcagtaaggcaaggatgtgagaattaaggaaaataaagtggcatacttaaagg

SEQ ID NO: 35082 - DNA, 121 bp, Artificial Sequence
  Synthesized
  misc_feature (61): n=t or c
tcgttaaagcggagccaatggacagcagcagatcacaggtttgcagtttgggcactcgggnggagatggagaggtgcagcacagctgaaggcagcacagtgaaagcccctcccgcccaaat

SEQ ID NO: 35083 - DNA, 121 bp, Artificial Sequence
  Synthesized
  misc_feature (61): n=a or g
ctcctcagacacaaccctggcaaggtgtgccaggaattctggagaggaggaccaaaccccnctgtcctttagggcaggccaattgggtgctccttgtagtcaagaaactgaaaggtttttt

SEQ ID NO: 35084 - DNA, 121 bp, Artificial Sequence
  Synthesized
  misc_feature (61): n=a or g
cctttctgctgcaaatctcatgcagatcatatttacgtcgcttgcttgcaacacgccccantgctacagcactcacattctgccaacaccatcacaacgagcacttcttgcaagcaaactg

SEQ ID NO: 35085 - DNA, 121 bp, Artificial Sequence
  Synthesized
  misc_feature (61): n=t or c
actgttaacattttcctcttcactggagacagaggaagcataagcccacttgcaggattangcaagaatccattaatccactctgtaaacagaacttccctaactagttttgaattcaagg

SEQ ID NO: 35086 - DNA, 121 bp, Artificial Sequence
  Synthesized
  misc_feature (61): n=a or g
tctatcactgtacccatgcaagctttctcccatagtttttatcctcatacagccatctgtnactgctttccttcatcgagatgaattatttttaatgatgtacatacagaagaacaagata

SEQ ID NO: 35087 - DNA, 121 bp, Artificial Sequence
  Synthesized
  misc_feature (61): n=a or c
agttcagtcattctaaacatgtttgctaggaaatgagttctttattatcacatatactgcncactaggaaacacagtgtcctactagctaaattttagtacagcaatgtgaagtataaata

SEQ ID NO: 35088 - DNA, 121 bp, Artificial Sequence
  Synthesized
  misc_feature (61): n=t or c
cactgtccattccttttaaagggcattgtgttcttagaatttaactgcacctgatagttcngtgtatatatccaagttgtacacacacttttacacagtgataatagtgtacaggtggtaa

SEQ ID NO: 35089 - DNA, 121 bp, Artificial Sequence
  Synthesized
  misc_feature (61): n=t or c
ccctctgctctgtgtccccaggaaggacgcgcgtgtcctctggtaacagaactgagagtgncctccattaacgcgctccgggcgtacaggtgtcctcggggtggcccatatgccgggatgg

SEQ ID NO: 35090 - DNA, 121 bp, Artificial Sequence
  Synthesized
  misc_feature (61): n=t or g
tagacaagattgtataacagtggcattgttaagtactgcaaatatgcaatcagcaaagatnataagactcagataaaaagaatatccgtagttggaagacacatatgaggatcgtggctcc

SEQ ID NO: 35091 - DNA, 121 bp, Artificial Sequence
  Synthesized
  misc_feature (61): n=t or c
gagggttggcctaaagggtgggattggagctgctgatggtacacagagtcctccacaatcngaaggaaacggaatactaaggcttctgtggccttgtaggaacataactcttttcagctag

SEQ ID NO: 35092 - DNA, 121 bp, Artificial Sequence
  Synthesized
  misc_feature (61): n=c or g
cttcttggaggtgctgttcaatccaatggtgatatgtgggggacatcagtcagtctggtgnaacccttactatagtctaatgactggataacaggtccttggcgttgaaatccaatgtttt

SEQ ID NO: 35093 - DNA, 121 bp, Artificial Sequence
  Synthesized
  misc_feature (61): n=a or g
ccctgaacgtaagctttctgctgtgactcaggtgcacacactctgttggtatgcctcagtnacttggtggctggaatgcttaatgaactcagtgtgaagtatgtgtgcaaaactatggagg

SEQ ID NO: 35094 - DNA, 121 bp, Artificial Sequence
  Synthesized
  misc_feature (61): n=t or c
aaggtagcagtgattcgaggagacacagaaaatggcatttctgctttaacaccagatgcangctgcaggttcggaaatggctctgtcctctgtcctgggggatcacgagagacactgcaac

SEQ ID NO: 35095 - DNA, 121 bp, Artificial Sequence
  Synthesized
  misc_feature (61): n=a or g
gtgttcctggctgaatgcatctaggaaattggatagagcttgtgcctttagcgctctgcanaattccccgagatgggaatatgggagcaaaattctgatttcagggggaataactcaaggc

SEQ ID NO: 35096 - DNA, 121 bp, Artificial Sequence
  Synthesized
  misc_feature (61): n=a or c
gtactcattagggatttttgcgtcagctagatggattttaagcatttatcttctgtccagnatgtctgttggagtaccaaatgcagtatgcatgggcttctccagttctccctggtttcag

SEQ ID NO: 35097 - DNA, 121 bp, Artificial Sequence
  Synthesized
  misc_feature (61): n=t or c
ctacatgagctgtctcaggatctccttgttgcataacacctaacacagccaagttttctgngtcactcaaaagaagctcaacttcttactgattgagaccagctctggttgcatcacagca

SEQ ID NO: 35098 - DNA, 121 bp, Artificial Sequence
  Synthesized
  misc_feature (61): n=a or g
ctcactcatgtacccatagcatctcactcatgtacccctagcaactcattcatgtacccanaacatctccctcaatatccagacttgaatcttgagttcagccaggctgaactctgtatgt

SEQ ID NO: 35099 - DNA, 121 bp, Artificial Sequence
  Synthesized
  misc_feature (61): n=a or g
agtctcaaaaccacaaagctatttcacagaagttactgtttttttataaagttttctcttnctttacacaaggatattggatctttacattggttcattcctatggacactgtctacaaca

SEQ ID NO: 35100 - DNA, 121 bp, Artificial Sequence
  Synthesized
  misc_feature (61): n=a or g
gtttcttaaataatggccaagctttgccattatcaagagatggaaaagctttcagtgtatnctatagcttttgttttagacacgaacttagcagttggctttcttcttatatttgaactaa

SEQ ID NO: 35101 - DNA, 121 bp, Artificial Sequence
  Synthesized
  misc_feature (61): n=t or c
tactgctccccagctaatgaggctgaagcacagggagagcaagctctcctgtgggcctgangccaattgctctgttaagttttctttgcctgttctaatgagagttacacaacgtagaact

SEQ ID NO: 35102 - DNA, 121 bp, Artificial Sequence
  Synthesized
  misc_feature (61): n=t or c
tctgtggctgaactccagcgaaaaccatatgttagtcatattgccacctttttcttttccntattcttgctccattttaaaggacgacgccctgtgcagcaaaccaaagacagcctcaggg

SEQ ID NO: 35103 - DNA, 121 bp, Artificial Sequence
  Synthesized
  misc_feature (61): n=t or c
gcagtcatacagacataccctgaggtcacaacatgcctaagaggccttccctgtgcatggngatcctctccttcctgcacccagctgctgggaaagccccgggtgcatccctgggtcctcc

SEQ ID NO: 35104 - DNA, 121 bp, Artificial Sequence
  Synthesized
  misc_feature (61): n=t or c
gacagatcatttaatcttatttaagcctctgtttctccatcattgaaattggagtaagagnttctatcttacagaaggcacatggagatgccagttctgcattaaaccctttggtgacagt

SEQ ID NO: 35105 - DNA, 121 bp, Artificial Sequence
  Synthesized
  misc_feature (61): n=a or t
atggacatttgcagtagccttggaaactcgctgtctccaaggaatgagctgtgactcagcngttatttaataaccaagcagctctccttgggcctggctctattacccctcctgctaacca

SEQ ID NO: 35106 - DNA, 121 bp, Artificial Sequence
  Synthesized
  misc_feature (61): n=t or g
agtgaataccattcgaagccatcacatggctgcaacattggtattgaagttagaggagcanctcccttgcttctccaacaagaccagggactgccattacctagcaccacagcctcctcct

SEQ ID NO: 35107 - DNA, 121 bp, Artificial Sequence
  Synthesized
  misc_feature (61): n=a or g
gaggcacagtagatgtggctccctcaagcagaaaaaatatctgtgtttaatctcacagaanggcaaaccaagcaaacctcatccactagaaataatgataggttagatatatggttcctaa

SEQ ID NO: 35108 - DNA, 121 bp, Artificial Sequence
  Synthesized
  misc_feature (61): n=a or g
tctgaactcccagcacagccatctgcctcactgcttcgtgccctggctccaccttcctctnctcctttcttccttccaatatctcgtggatctctcaggcttgcagcccttaaatgacaga

SEQ ID NO: 35109 - DNA, 121 bp, Artificial Sequence
  Synthesized
  misc_feature (61): n=a or g
catgctgcctttgcctctgtagatggaataggaaggattcattctgtacacgatgctgggngcaagggtgaggtttgagtgcagcagagtgacaaaatctctgatttcagagtaacctgca

SEQ ID NO: 35110 - DNA, 121 bp, Artificial Sequence
  Synthesized
  misc_feature (61): n=a or g
tctgccttgcaaggacaccagatccttcctcacccttgtgcaatatttatcgtgaccccanatgacaaagagagtccttggctgtgctgcagggccgggtttctgaacaagcccagtttgt

SEQ ID NO: 35111 - DNA, 121 bp, Artificial Sequence
  Synthesized
  misc_feature (61): n=a or g
tataggaaacagcatgcaagaagactggcaacaagagtttctaattagcccaaaatgaggnattcagaaccaccgtggtacagtgaaaaatcaatgtttcctgtaatatttttttactaca

SEQ ID NO: 35112 - DNA, 121 bp, Artificial Sequence
  Synthesized
  misc_feature (61): n=a or g
actgggcaaaggaaagcctgaaataacccaacagaacagaactgcaacaacagagctctcnttcacgtgagggtatctaagagcataattcgacgtgagttacccaaacagctctgaatta

SEQ ID NO: 35113 - DNA, 121 bp, Artificial Sequence
  Synthesized
  misc_feature (61): n=t or c
ctgcagaaagttgtgttcgtgggatatatgcttggcactgtcaggttttactgtgtatagngctgtaggacatgaattcagttctgctgacctatgattcaaagtagtggtttcatgtaga

SEQ ID NO: 35114 - DNA, 121 bp, Artificial Sequence
  Synthesized
  misc_feature (61): n=a or t
ctttatttttttaatcaaatttttattttttacatcaatttccactttgtctggtgataantttttcccaggtttcttgggtttttaatggtatcttcagagtccctctggtatgagatac

SEQ ID NO: 35115 - DNA, 121 bp, Artificial Sequence
  Synthesized
  misc_feature (61): n=t or c
gcagcactagaaatgcctgcatttagatggggggaaatgtgcaggaaccaagaacaaagcnccaggaagcagcgccagagaataacctttcagctcaagctggtttccccaccagagagag

SEQ ID NO: 35116 - DNA, 121 bp, Artificial Sequence
  Synthesized
  misc_feature (61): n=t or c
gggaggcagcaacgaggagggacagcattacagatctccccaagcccatttattcacttanttctttccttaacttcacatcgggtgacaaaagaagggtgttgggatgcccatgggggat

SEQ ID NO: 35117 - DNA, 121 bp, Artificial Sequence
  Synthesized
  misc_feature (61): n=t or c
cgaagtgaaagttgtttgtgggaggtccagttccatgattatggtcctctactgtatatanctttttcatatcagtttccttatttccaccctgccttcatggcgttctctctttctgttc

SEQ ID NO: 35118 - DNA, 121 bp, Artificial Sequence
  Synthesized
  misc_feature (61): n=t or c
catgtcttcctgatttctccatttacatcccttctgcattcagggatgcctccctcagctnggaggctcaacctttgtctcagggactccctcctgtccatacatgagtgcaatctccagc

SEQ ID NO: 35119 - DNA, 121 bp, Artificial Sequence
  Synthesized
  misc_feature (61): n=a or g
tttctagtgggctgagcagcccttgcagtattctttcttaagggagaaggggagtgtcacngtggggtgatggttaaggttgctgaagaacacgtatcttaaggggaggcctaggtcctgt

SEQ ID NO: 35120 - DNA, 121 bp, Artificial Sequence
  Synthesized
  misc_feature (61): n=a or g
gctcccagctgtaatctgaaccactaaatttgattcctcaaacacctgttattcttggacnagctcctcttgcaccatacatcagaagaataaaatgaaacctatgcaacacagaaagaga

SEQ ID NO: 35121 - DNA, 121 bp, Artificial Sequence
  Synthesized
  misc_feature (61): n=a or g
ggatggctgtcctttttagaatttgccctttttttgtgatgctttttttattagattaggnaagtgtttgtatttgcatttgtagcataaccattttgaaagtatgtgatggtgtttaagg

SEQ ID NO: 35122 - DNA, 121 bp, Artificial Sequence
  Synthesized
  misc_feature (61): n=t or g
ggatggaagtccaaggaatctgtttgactttggtttagccatggagctattcagaagagangctttgaattgttcccaattgctaaagctggcatcagccttctctcagactggatttgag

SEQ ID NO: 35123 - DNA, 121 bp, Artificial Sequence
  Synthesized
  misc_feature (61): n=a or g
gattctcagtgcctcctggaggcactctgtaggcaaagtcagcacggatggagtcagctcnagatacttccacggtaagaaatggtagcaatctatacattggtcacagatttttacctgc

SEQ ID NO: 35124 - DNA, 121 bp, Artificial Sequence
  Synthesized
  misc_feature (61): n=t or c
aaccaaactttacctgcccagaacctccttcggctcatacttttcatagaactccttggangtgttccagtcggggaggtcctcctcctttgtcatggctgagtcctggcaggtggaacag

SEQ ID NO: 35125 - DNA, 121 bp, Artificial Sequence
  Synthesized
  misc_feature (61): n=t or c
acattctgattttttttccagggaaggcagcaccttgcagctacaagagcttgtctccctngtgtgatgtttactcacttattgaccagaggacaagtcatctcagtctccatagggctga

SEQ ID NO: 35126 - DNA, 121 bp, Artificial Sequence
  Synthesized
  misc_feature (61): n=t or g
agaatgaaatacatatgtcagatacaaaaacactagcactggaatagagagcctccttctncatttgtgtataacaactggatttggggggggagggatgagatttatgatgatgactgct

SEQ ID NO: 35127 - DNA, 121 bp, Artificial Sequence
  Synthesized
  misc_feature (61): n=t or c
cagaatatgtaactcattgtgttattgtgttttccatgagacccttcctcatcacaggtanttgctgctttaacaacacaccatcaagtgctactgaatactgcaaaaaaaaaaaagtgca

SEQ ID NO: 35128 - DNA, 121 bp, Artificial Sequence
  Synthesized
  misc_feature (61): n=t or c
ttgagccatggatgggtgccacagggctccagtcatgcagagctaataggtcagctgctcnctcgcttgtccacacgctcagctgaggttacagtttctcactaatttctttttttgtttg

SEQ ID NO: 35129 - DNA, 121 bp, Artificial Sequence
  Synthesized
  misc_feature (61): n=a or g
gcctaattctgggataataatttttcatttcaaacacttgaacacagaggcttaatccccncgctctcagacaacccaaccaagtcccacactgactgagcagatggacacagctggcact

SEQ ID NO: 35130 - DNA, 121 bp, Artificial Sequence
  Synthesized
  misc_feature (61): n=t or c
aaatccacattcatgtagatgcttaagcagagtttataagatattaaaaatctctcaaaangcttaatgaagtcagcaatatgaaataagcataaggaagcgtgccttcatggaagcatca

SEQ ID NO: 35131 - DNA, 121 bp, Artificial Sequence
  Synthesized
  misc_feature (61): n=t or g
tcctcctgctcttcctccttatcctctgatgtctggtcaaaggggtgcaaacctggagtgnagtgacatggcagctttacagccatggagaaaagaggaaaaaggaagagattccatctct

SEQ ID NO: 35132 - DNA, 121 bp, Artificial Sequence
  Synthesized
  misc_feature (61): n=t or c
acctggtgtgtcctacttgcagcatttggatggagccatgtacaagtttggccttgagttngagtgccgattgctgcctgaacctgatctcacagcagcactcctggctgcaggcagccac

SEQ ID NO: 35133 - DNA, 121 bp, Artificial Sequence
  Synthesized
  misc_feature (61): n=t or c
agcgaagatgtcgtattttgtttcttcgctgtctctactgagaatagaacgttattttccngaactttttccatgaaaagcaagaataaacacacacgcgtgtcttcctatttcctgtcaa

SEQ ID NO: 35134 - DNA, 121 bp, Artificial Sequence
  Synthesized
  misc_feature (61): n=t or g
ggagaagctaagaacaggaaggccaacccgaagcacctacgtctcatggtatcaggtttangaaataaagaaataggatggctgcaccaccactgccaaacaagaaagcacttgggctgac

SEQ ID NO: 35135 - DNA, 121 bp, Artificial Sequence
  Synthesized
  misc_feature (61): n=a or c
gaaatttccctgatctccttaagctgtataggagaaaagaaaactgggctgaagacatacntatctgctgcttaataacaaaattaaataactaatttggagtctgagggagagatggtgt

SEQ ID NO: 35136 - DNA, 121 bp, Artificial Sequence
  Synthesized
  misc_feature (61): n=a or g
atatgccacgtaactctcctttaaagctgatactgcagattgttctcaattgcgttcaacnttttaaacttgttgtaggacagaatccataccttggcaaatccatttagcctcgatttta

SEQ ID NO: 35137 - DNA, 121 bp, Artificial Sequence
  Synthesized
  misc_feature (61): n=a or g
tcaagggcattgcagtttcttcaatcagcagagccacccagaagtggtgctcaagacaaanctgcctccccttccattttgctaaagggaacatttgatccaaacgtccaaatgttcaaaa

SEQ ID NO: 35138 - DNA, 121 bp, Artificial Sequence
  Synthesized
  misc_feature (61): n=c or g
ccaaatggagtttggattaataattctgatagtatgtgtttttatcaatattaaagcattntagggcaaagtgttagcgtgaaaaattggaactggaggagctggaatgccttgagagaag

SEQ ID NO: 35139 - DNA, 121 bp, Artificial Sequence
  Synthesized
  misc_feature (61): n=t or c
catcccatgggaacaccctttcatttgagggggttctcatccaatggcagtaactctgccnggaaggatgtccccatcccacagcagcagcccagtcttcaaggggacccaaccaagagca

SEQ ID NO: 35140 - DNA, 121 bp, Artificial Sequence
  Synthesized
  misc_feature (61): n=c or g
aaagcaagcaaacccacagtgccatccagcacagccaccactcaccatgggatgctctganttacaacgatgctccaagcaataaatcacagacttttctctgctggaaggttgaaggtat

SEQ ID NO: 35141 - DNA, 121 bp, Artificial Sequence
  Synthesized
  misc_feature (61): n=c or g
ttactcttgctaatcaatgcaaaatcaaggaggttgcgttggttttaattggagctgcacncacctcactgcagggacctccaggactcttctctgaaggacaaagtgctgaacaccacct

SEQ ID NO: 35142 - DNA, 121 bp, Artificial Sequence
  Synthesized
  misc_feature (61): n=a or g
agaatgtatacattccatgttaaagggaccagacttggcacgaaggccaattgctgctctnacaagtcagaacatgcagtctggaagagactgagcagaacagtggctgccctgtgtaatc

SEQ ID NO: 35143 - DNA, 121 bp, Artificial Sequence
  Synthesized
  misc_feature (61): n=t or g
ggagaaaatcctgaaaaaggggatatggaacaaaaagacccttgaacactcctctgaaagnaactacattagaaagagatgtaattacttgtttactgtcttcgttagaagaaatttcatc

SEQ ID NO: 35144 - DNA, 121 bp, Artificial Sequence
  Synthesized
  misc_feature (61): n=t or g
atactatttagggaaaaaaatagtcactaaatgaccatatgtttctactgaatgatgaacntgacagtaaggcactggataaattaaaatagctaagatgttagttattttgtgttggtag

SEQ ID NO: 35145 - DNA, 121 bp, Artificial Sequence
  Synthesized
  misc_feature (61): n=a or t
aagtattatgcaacaacgaaggtctttctacccatcatttcttttcaaatggaaaatgacntgtgctttttaactttattagaaaaacctttcctgaattcaaaggggacacaactttgaa

SEQ ID NO: 35146 - DNA, 121 bp, Artificial Sequence
  Synthesized
  misc_feature (61): n=t or c
ggagctggagctcggtggagcgaggcacccagcaccacagccttcagtttccactctgcanctgagtgcatctaaatcattcccacggacagggctgcagggctgtgcctcacattgccag

SEQ ID NO: 35147 - DNA, 121 bp, Artificial Sequence
  Synthesized
  misc_feature (61): n=t or c
attattaattctgatgtggataattattcttaatccttctcgttgcacttggatttactancattgctattcacaccgaaggactccaagaaggaccaagatcacatcaggaaatgtataa

SEQ ID NO: 35148 - DNA, 121 bp, Artificial Sequence
  Synthesized
  misc_feature (61): n=a or g
tctgttctcgttctgctgtcagtaagaatgcctgctcagcactgctgcttctctgaaccantatgtacaagtgtgttctgagcagtactgaactgttgcacagactattggagatgcagtt

SEQ ID NO: 35149 - DNA, 121 bp, Artificial Sequence
  Synthesized
  misc_feature (61): n=t or c
agagatcagacatgcaagtaattataggtgtcccagttctaccctgacagcagacccttcngacctcctgctagctgccatggtgcaccaaaaccatcacttgctttcacagaaacaaagg

SEQ ID NO: 35150 - DNA, 121 bp, Artificial Sequence
  Synthesized
  misc_feature (61): n=t or g
cagagactgtggtattttcattcctggagaaactcaaaactcacctaggcaaggccttgancaacttggctaaagcctgagctaagatctgatgtgcttgtggaacttgatgaccactaga

SEQ ID NO: 35151 - DNA, 121 bp, Artificial Sequence
  Synthesized
  misc_feature (61): n=t or c
cctggtgtgcagagagcacatcccacacatcctgctggatggggttgtgaattgctgcttngggctatgctttgctttgggctggtgcaggggctgctgtgctccaatggcacagctctgg

SEQ ID NO: 35152 - DNA, 121 bp, Artificial Sequence
  Synthesized
  misc_feature (61): n=t or c
tattaattttctctgggcacggatattgtcctctttacctttgtgaaaaattttggtgttnggatgtttgtgtgaggtgtgcaggtggaacacagagaggtggtgcctttctgctggtgtc

SEQ ID NO: 35153 - DNA, 121 bp, Artificial Sequence
  Synthesized
  misc_feature (61): n=a or g
agctggcagacatgcatcaagctgctctcatctgctcacagagtgaaggagcgctccctcngatttgtgttgagtgaaaccccaacgagacctgagggtcactgttgttaagttccagggc

SEQ ID NO: 35154 - DNA, 121 bp, Artificial Sequence
  Synthesized
  misc_feature (61): n=t or c
gcctaaccagctcctctacatcacatcgagcacacaaatcttacaccacccaggtttatgntctcaggtctacagtcctggtctgtcagtacgtactgagtggctgagatggaatcagtaa

SEQ ID NO: 35155 - DNA, 121 bp, Artificial Sequence
  Synthesized
  misc_feature (61): n=a or g
tcctgtcttttaatcaccctgcttggaaacaatagcaaaatcacagagcaacggttgtagnttcctttcttgaaactttcctactccttttcagctccttttttttttttcccccctcagc

SEQ ID NO: 35156 - DNA, 121 bp, Artificial Sequence
  Synthesized
  misc_feature (61): n=a or c
gatgtggattttatcttcccttctgatactcaggttgtattgttggatcatgtcagttttnatttacctacatccatattaaaagttttcacaagaaaatatatgtttaaataacatcttt

SEQ ID NO: 35157 - DNA, 121 bp, Artificial Sequence
  Synthesized
  misc_feature (61): n=t or c
tggaagcatcacagtggtcaaatgcagctggtattggggactttagagctgtcaccctccngtctgcctctacagaagacgcaaacgtgagccggagtccttcatttaggattaacccaca

SEQ ID NO: 35158 - DNA, 121 bp, Artificial Sequence
  Synthesized
  misc_feature (61): n=a or c
agcctgattatcagctcaggcctctccctcctgggagcaatcccacaatgggcaacagctncctgcatcacatcgacagtacagacagtcctgctggggtctcattctagagcgcatcaga

SEQ ID NO: 35159 - DNA, 121 bp, Artificial Sequence
  Synthesized
  misc_feature (61): n=a or g
ggaaggatcagctcctgggagcagggatggatgaatcaggtcaccctcccgttcccatcantcatctcctgcattctaatgagcaaacattcctcccagttgtgacccttccattctgcta

SEQ ID NO: 35160 - DNA, 121 bp, Artificial Sequence
  Synthesized
  misc_feature (61): n=a or g
cctttcaggtacccttcaactacgtcaatgtcaatgacttacactaaaccaacctacactntagtgtacaatcctgcactaatgctatatgcccacatttcaaatgatccatttggcccaa

SEQ ID NO: 35161 - DNA, 121 bp, Artificial Sequence
  Synthesized
  misc_feature (61): n=t or c
ttagcattacctgggcagttaaaggacctgtccataagcaaggtagtaaatgaaggataangaaaattactgtgtattctactcatggcagtggttcataagagctattagtggctgataa

SEQ ID NO: 35162 - DNA, 121 bp, Artificial Sequence
  Synthesized
  misc_feature (61): n=a or g
catttacagccatagtgtcgggatttgcattttaaaagaatgcctcagatttcataactcncttccctcagaatgtttgcctgtggtgcaggttcactctaaaggcttgtcagttagcaga

SEQ ID NO: 35163 - DNA, 121 bp, Artificial Sequence
  Synthesized
  misc_feature (61): n=t or c
accagtggcaccaccagcagtgctttcgagtcattcacgttgctttttcagaacttcccangttgatgctacagtgatgcacgcacatctgtttatgtatttatgtatatgtgtgtatgca

SEQ ID NO: 35164 - DNA, 121 bp, Artificial Sequence
  Synthesized
  misc_feature (61): n=t or c
aaattcttaactgcactttgaaagcccacttggaaaaccttattccccctggcagcactgntgaacccagagccccctttggagcagcaccgtggtgctcagcacagcgcctttgcaggag

SEQ ID NO: 35165 - DNA, 121 bp, Artificial Sequence
  Synthesized
  misc_feature (61): n=t or c
ctgctgcccatgcccgtcttacaaaacatacaactggtacatgagaaacaatactgccctnaggaaaaattgccaagaattctgttctggggtacagagtaactccaggcctaactcaggc

SEQ ID NO: 35166 - DNA, 121 bp, Artificial Sequence
  Synthesized
  misc_feature (61): n=a or g
acaggcttagaagaactgatgatgcaggttacctgagttacagatcatacatgcaagcacngagttctacattacaaggcataacaaaccatttcactgtaacacagagcttgcagccatc

SEQ ID NO: 35167 - DNA, 121 bp, Artificial Sequence
  Synthesized
  misc_feature (61): n=a or g
ccattttagccttttcctctctctctgccccagcataataatgggaaccattgcattaagngtaacagcgttgggttacagaggggacgaagcagagtaaattgggcatattaagaacggc

SEQ ID NO: 35168 - DNA, 121 bp, Artificial Sequence
  Synthesized
  misc_feature (61): n=t or c
ttgtccaaaaatagctaaataggaggtaaagtggatatggaagcttttctttttgacttgnagggaagctgagacagcacagataactcaggtaccaaaacaaacagacgtctgccagcat

SEQ ID NO: 35169 - DNA, 121 bp, Artificial Sequence
  Synthesized
  misc_feature (61): n=a or g
atgaacatcccaggtttcagatatgtacagtagttggacaggaaactcctgggattttttnttaacaagtttatgattttcaaggtcctgtgttatgcaatcattgacagaaatgatgctt

SEQ ID NO: 35170 - DNA, 121 bp, Artificial Sequence
  Synthesized
  misc_feature (61): n=t or c
taccactagatagattgctggtatattgctacaacaaagaatagctaaacaccatctacangtgcaccaaagaacaggctaacatgggacaggacattaaattttaaacaattccttccca

SEQ ID NO: 35171 - DNA, 121 bp, Artificial Sequence
  Synthesized
  misc_feature (61): n=t or g
ttgcagaaactccagagccttttcaaacactgatttttgtgataccccaacgttgttctgntattctcaggcaggggactgatcatgtcctgcccgtaagggaagaaaagggatgatgaga

SEQ ID NO: 35172 - DNA, 121 bp, Artificial Sequence
  Synthesized
  misc_feature (61): n=t or c
ctgaaatcgtttattaattaaattggcattgcaggactggcatgtccccagctagagatanggagatgaatttaccttagctgtctgagttagggagaactaattgcttgacagtgatgta

SEQ ID NO: 35173 - DNA, 121 bp, Artificial Sequence
  Synthesized
  misc_feature (61): n=t or g
caacagctggaaataggcaatgggatgagcactactcctgaggtgccagcctctcatccancttcaggaaagcttgcagagccacagatcccaacaccagcccaaggtgggagcagctcct

SEQ ID NO: 35174 - DNA, 121 bp, Artificial Sequence
  Synthesized
  misc_feature (61): n=a or g
gcctcctctgataaatatttcactgacaagtacttctaagagaggttctgctttgtcaaancgtcttcattccgtttcctccccatgaaacttgcagtcttgtaactttctgctttgaaat

SEQ ID NO: 35175 - DNA, 121 bp, Artificial Sequence
  Synthesized
  misc_feature (61): n=a or g
actgacttatctaagcaattcctctaattttctaagcaaatcatctgatgtctaaatatanaaatagaaacaattgtccctctacctgattgtgctgatggactagaccctgttttataga

SEQ ID NO: 35176 - DNA, 121 bp, Artificial Sequence
  Synthesized
  misc_feature (61): n=t or c
cagtcaacaaatacaaggagggctaccaagatttgctgacagcactgagcaaacatctgangttacgatgctgctgcagtaaggcatgaggatcaaattcctcttgaaatatgaaaggata

SEQ ID NO: 35177 - DNA, 121 bp, Artificial Sequence
  Synthesized
  misc_feature (61): n=a or g
gcttaggtcaccgtgcgtcctgccaagcaatctgtgcggtgacaggctgctggcatggacncagaggggaatgcaatgtagaagaggtaaccgagagccttggagaaatcccaggccaaag

SEQ ID NO: 35178 - DNA, 121 bp, Artificial Sequence
  Synthesized
  misc_feature (61): n=c or g
aagttacatcaatggaaggacaggagcacatacgtcaatcatttggctggagatattgcgntacaaactgatttttatcacttacagctctctattcaaataattgtgtcctagatttctt

SEQ ID NO: 35179 - DNA, 121 bp, Artificial Sequence
  Synthesized
  misc_feature (61): n=t or c
tctcagggatcttagattttttttttttcaagttctctaggaagcaccagatctcttgaantcttgtgataactgagcacatgctagtgtgcttaagtcagcagaacaacagcctctgacc

SEQ ID NO: 35180 - DNA, 121 bp, Artificial Sequence
  Synthesized
  misc_feature (61): n=a or g
cctcttcatcccccccgctcatcaggatcccacgaggaccatcccatcccaccgctccacncttgctccattcccctatggaccgcactggggccaaattttacccctctctctgaccccc

SEQ ID NO: 35181 - DNA, 121 bp, Artificial Sequence
  Synthesized
  misc_feature (61): n=t or c
ttcaggtatgtatgtgggcttgaaacaaagactgcaggacttttaagaccgaaatcaaagntcagcttcataaccctgtgaaagttttccctggacgaaacacagagggaaccaatgagta

SEQ ID NO: 35182 - DNA, 121 bp, Artificial Sequence
  Synthesized
  misc_feature (61): n=t or c
cagattgtggaaactactgtcactgctctttatgacctaactgaaccgtgtgacttcaganaggggtttcatgatggagtgatagaagcttatatcatctatggcacaaaagatgacaggg

SEQ ID NO: 35183 - DNA, 121 bp, Artificial Sequence
  Synthesized
  misc_feature (61): n=t or c
gagatacatggcaaaacaaacatttgtacagcttccgagcagctcacacaaaggcaaagangctcacaattaaagcaagggccaggctgagcctccacggcacaccaagggacacggcatg

SEQ ID NO: 35184 - DNA, 121 bp, Artificial Sequence
  Synthesized
  misc_feature (61): n=a or g
cccatcacgattccggtttgagaagtgcacagaataatggccgaggttttcctggttcacnttgtccagtttaacacatcacactttcgtgttaacctttaatggggggagcctggaggag

SEQ ID NO: 35185 - DNA, 121 bp, Artificial Sequence
  Synthesized
  misc_feature (61): n=a or g
gaacaggtgcctccttttcccagagcagctcatgtcagtgggctgtggctgtgtctgcttngcagcatgctgagagctgtgctccttccttgccatccctgcatcactctggggtgagcct

SEQ ID NO: 35186 - DNA, 121 bp, Artificial Sequence
  Synthesized
  misc_feature (61): n=t or c
gagacaggtgcagcttcctcatctgtttgcattgcttttcctgagggtagaaaccagaccngacttggtgcaagggaagcacacagcgtttgagtgacagcctccatctggtgctttgcag

SEQ ID NO: 35187 - DNA, 121 bp, Artificial Sequence
  Synthesized
  misc_feature (61): n=t or c
cccttctcacctaggcaggtgcttcttcctggcagatgaagccctgctggcagtgatgagngcagtaaccaggaaggagatggccgcggtgggactgcagcaaaccaagtggtgctgccct

SEQ ID NO: 35188 - DNA, 121 bp, Artificial Sequence
  Synthesized
  misc_feature (61): n=a or g
caggactactcttaaacgccacaatctgaatgaccatttaaaacaaactgcttttagctcngtggtatactctacatgcttttactcatggctgtacgtcagtgatcaatgttctgttttt

SEQ ID NO: 35189 - DNA, 121 bp, Artificial Sequence
  Synthesized
  misc_feature (61): n=t or c
gcgttaagggaaaacctgggacaagacctgaggctgtgattcctatggggtccaggctttngagttctgttctctcccagcagctgatcaccagtttccaaaatcacagaaccattaaggt

SEQ ID NO: 35190 - DNA, 121 bp, Artificial Sequence
  Synthesized
  misc_feature (61): n=a or c
cacaactgtgccccagctgctggtagcagacatcgccctctcccttccctcagtgttccanaccaaatctttccatccactcaggtttgcactgctaggtccaagtctatggccaaaaggt

SEQ ID NO: 35191 - DNA, 121 bp, Artificial Sequence
  Synthesized
  misc_feature (61): n=t or c
agtgcagagaacactgttacaaacttcctgtaacagcactaactcacacatttagactggnggtataatccactacataaatgtacactcaaacacttgcacctaatatttcaatatcact

SEQ ID NO: 35192 - DNA, 121 bp, Artificial Sequence
  Synthesized
  misc_feature (61): n=c or g
tttaaagtgcagtaatctcttactaataactaatgaatggtttttaattttttaacaatgntgtgagaggatagaacgtgctagggtatcaggaaagtctacttctttttagcactgtttt

SEQ ID NO: 35193 - DNA, 121 bp, Artificial Sequence
  Synthesized
  misc_feature (61): n=a or g
agtggtaggaagtgttgttttcacgtgtcatgcctataaatcattgctctcccatcctagnggcatgacagcaatacctgtagcagaaccacagctacccttcctgcaaagggaaaggcat

SEQ ID NO: 35194 - DNA, 121 bp, Artificial Sequence
  Synthesized
  misc_feature (61): n=a or g
aggacaacacaacagagttcagaccaacattcttatctgatatatagcatgtttggcttantacagatatacagcttcctaatttgcttcttgatgtttctgtgagtacttccaaactcca

SEQ ID NO: 35195 - DNA, 121 bp, Artificial Sequence
  Synthesized
  misc_feature (61): n=t or c
atgctggtctctaactacgctcctgaacagcagctttagagggctttctgagactgacctngagatgtgcggttgggcagagctgggcagtcgaggctgtgggatgcagcgttccaggctg

SEQ ID NO: 35196 - DNA, 121 bp, Artificial Sequence
  Synthesized
  misc_feature (61): n=a or g
gctgcacatggaggaaagtttctagccagacacctccagcaagtatggggttggaagcatncaggctgtgtatgcctgacccccagcaatcccaccctgcagctcagataagtcagcacag

SEQ ID NO: 35197 - DNA, 121 bp, Artificial Sequence
  Synthesized
  misc_feature (61): n=a or g
caggtagggcctgtgatgtaacagacatttcatttctgccttagtacaggcaggaaaaagntttcatgtcttgaaaacatcaggcttgagcccattgctctccgtgtgctccttcccaaga

SEQ ID NO: 35198 - DNA, 121 bp, Artificial Sequence
  Synthesized
  misc_feature (61): n=a or g
gcctaaatctttttatgctgtgcataatacttgtggtagctagaccattctttacttggtntgtaaattttcctctgccttacactttgggtgaccaacccttacactacggcaacctaca

SEQ ID NO: 35199 - DNA, 121 bp, Artificial Sequence
  Synthesized
  misc_feature (61): n=t or c
ttggatagatagagccaggagcactgaagaggcaacattcagcctgctgccagccctttgnatagatagcccataatgatcattgaggataacaaatctgcctttgctagaggcagggcac

SEQ ID NO: 35200 - DNA, 121 bp, Artificial Sequence
  Synthesized
  misc_feature (61): n=a or g
cattttaaacggggaataaaaagtcgcacagattctttaaaaatcacaaatgaaacaaagnggttccgtgttgggcccacgtcggacatccgcggttctctgagtcgtgggctgccctgca

SEQ ID NO: 35201 - DNA, 121 bp, Artificial Sequence
  Synthesized
  misc_feature (61): n=a or g
acatttcacaagaccacatttaatcataacatagcaaaacatgaggtctgggatttttttngcagatgaaaagctgaaggaattcttcctatcttagaacaagggagctgactttctagga

SEQ ID NO: 35202 - DNA, 121 bp, Artificial Sequence
  Synthesized
  misc_feature (61): n=a or g
caaaaaggaaaaaagaaaacaaaactcggcactaacgcagaaggagctcacaacgccctcncaaagccgatctaaaatctcctccgcgtcgccaaacggccgcgcagaccgccgctatctc

SEQ ID NO: 35203 - DNA, 121 bp, Artificial Sequence
  Synthesized
  misc_feature (61): n=a or g
tgaattctgccctgctattaactgtgagatgctggccatcctacctctcgctgtttttagngtgctgctaatctgatatttgccagcagagaaattgcaagcttcttggagctgatacaga

SEQ ID NO: 35204 - DNA, 121 bp, Artificial Sequence
  Synthesized
  misc_feature (61): n=a or g
gcctgctcccaccactcccagctgtgatgtggaaatgtttgacatccctggggtgtggcanagcttgtccctttgctgctgcagggactgagtgcagcgggcatgtacgggcaaggagcat

SEQ ID NO: 35205 - DNA, 121 bp, Artificial Sequence
  Synthesized
  misc_feature (61): n=a or g
gtttgggtttttttggccattagcaggacatgtgtagctctgccctggtcacccacagctngtgttaccaaggggataaacgtgaggacaagtggaaactgggaaatgcaacctctgctcc

SEQ ID NO: 35206 - DNA, 121 bp, Artificial Sequence
  Synthesized
  misc_feature (61): n=t or c
tcgggatgcattcaacatcatctgcaagccaacgctcgagtttaaagcaactatacctaangtaagaaaaaagcccttaaataacagcccgcggagaaggttggagggaaaaaaaaagtca

SEQ ID NO: 35207 - DNA, 121 bp, Artificial Sequence
  Synthesized
  misc_feature (61): n=a or c
tgggacgtttatgttcaacacccactgaaactctttgacctcgtcactggtcaccatcagnagtgtttgtcacagctcattacgcagcaggcatgtggaagcccagtgacctttcccagga

SEQ ID NO: 35208 - DNA, 121 bp, Artificial Sequence
  Synthesized
  misc_feature (61): n=a or g
ggagaaaaaaatatgtaaaattatctagatccttcatataactttcaatattaatataaantcactttcttttaatcttagtatatgactctcaacccctcaaccaagaggaagagctctg

SEQ ID NO: 35209 - DNA, 121 bp, Artificial Sequence
  Synthesized
  misc_feature (61): n=t or c
gttctgcttttccagcactcctccaaaactgtgctttccagtttgaacaggtgagtctgtncagtgagctctgaagataactcccacgtgtcaggactgctgcaggtgggagatgctccca

SEQ ID NO: 35210 - DNA, 121 bp, Artificial Sequence
  Synthesized
  misc_feature (61): n=t or c
ctgggcatgggtgaaaaagcagattttagctgtgcccatccatgcacgtgtcatgcacttngtttcggtatcttccacacgtgcaaaaggtcagagagccctcttgaactttaaaagctcc

SEQ ID NO: 35211 - DNA, 121 bp, Artificial Sequence
  Synthesized
  misc_feature (61): n=a or g
ggtggaacgatacgtaggacttgttgctggatttgccaggtttagcaggcagagatagtgngaagaaatacttggttttaatgtgacagcgatggggactggcaggacccagcttggagcc

SEQ ID NO: 35212 - DNA, 121 bp, Artificial Sequence
  Synthesized
  misc_feature (61): n=a or c
tcagcaggctgggactgagctgtgtggccgtgctgggagccgtgtgctgacaccgaagttnatggacaactgcagctcatggtggttctgtgcacctgtgctggcgttgtgcatcgcctcc

SEQ ID NO: 35213 - DNA, 121 bp, Artificial Sequence
  Synthesized
  misc_feature (61): n=t or g
tttacatgctgaaggatttatattttaattcaatatggtcactttactacactgtctaaanatcaaactcaaccaccacttaagctacggcccaactcatctccaagcagcccaatattaa

SEQ ID NO: 35214 - DNA, 121 bp, Artificial Sequence
  Synthesized
  misc_feature (61): n=t or c
agtaatcaccatgaaaattagaagaaccgtttaggaaacagctttgttacggcctggcttnaactgaaccacctgcatcagtggagctgctgaaaacctgaaatgataacatttctgtgat

SEQ ID NO: 35215 - DNA, 121 bp, Artificial Sequence
  Synthesized
  misc_feature (61): n=a or g
tatcactcactgatacaccatcagtgataccacacaacagtctaagaagaaacacaaaccnaaacctattgcctaactacagttgttcaaaatggccaagctaaactgtgtcaagtgactt

SEQ ID NO: 35216 - DNA, 121 bp, Artificial Sequence
  Synthesized
  misc_feature (61): n=t or c
ttttataatgtcccttcatggcactgtgtgcattgttacctcaagtgggtccagcatgccntttcgagtcactatgatctgcttaggctgctcctccacaggaagcgagcggatcaaggca

SEQ ID NO: 35217 - DNA, 121 bp, Artificial Sequence
  Synthesized
  misc_feature (61): n=t or c
gctgaggctctccagggtgctgctggatgatgactgttgtcatcctgatgcacaagtacangaagggctctgaccccctgcagcctgtctgcacaccctggaaagagcagctccactccct

SEQ ID NO: 35218 - DNA, 121 bp, Artificial Sequence
  Synthesized
  misc_feature (61): n=t or c
ctttcccctgcattatgcattacattgcctacagtattttccttgcacaagtggaatttgngttgcacacaaaccaagaggcatataagatcactttcaccgtcactgttctccccacatc

SEQ ID NO: 35219 - DNA, 121 bp, Artificial Sequence
  Synthesized
  misc_feature (61): n=t or c
acaacagtgcctggcggaccgaattgatccattacagaatttcagataatcttgtgcatanagggagatgaagaataaatagcaaacccctttatccgccagtagttacctatacatctat

SEQ ID NO: 35220 - DNA, 121 bp, Artificial Sequence
  Synthesized
  misc_feature (61): n=t or c
ttcttatattaatgacaagtagcgatgagctgatcgtctcaaaagtcatcttctgaacggngcaggaatgttttactttctctgaagtctttttctagggtaaagaaaaacttgcaatcaa

SEQ ID NO: 35221 - DNA, 121 bp, Artificial Sequence
  Synthesized
  misc_feature (61): n=t or g
gaaaactattaacaagttgattttaattagcatggaaagttttgagagctaggaattcatnattttggaagaaggtctgcacgggcacctctagagtaagctggaacacgactcactcagg

SEQ ID NO: 35222 - DNA, 121 bp, Artificial Sequence
  Synthesized
  misc_feature (61): n=a or g
atatttcactgaagttgtcatcttggttggttgctcttccagtaatagcatttgcaggtangaaaaagcacagaaccttcctaccaagcaaaatgagttcagaactcactcttccacacaa

SEQ ID NO: 35223 - DNA, 121 bp, Artificial Sequence
  Synthesized
  misc_feature (61): n=a or g
gctgcagcagttggccctggctgtcttgatttcaaaccaagggatatcagttggctcctcntacgggcagctgttgcagtctgtctgtagtgcatgtgatcatattctgtgccatttctct

SEQ ID NO: 35224 - DNA, 121 bp, Artificial Sequence
  Synthesized
  misc_feature (61): n=t or c
gggcctgttgtacttgggacacacttttgagcatagtgcacacttcagcatatcaactcanaattgttcttcctgagaaaggaagaacatttcttcccattttgaattgaagtgtaagtgt

SEQ ID NO: 35225 - DNA, 121 bp, Artificial Sequence
  Synthesized
  misc_feature (61): n=a or g
acagatagccagagaaaaggtcttcctctgaatatctgcaggtctctagataaagctaccncgtcaaccttgtcagtaataaagcaggctgaactcccagatcatgcaatgtgcagagaat

SEQ ID NO: 35226 - DNA, 121 bp, Artificial Sequence
  Synthesized
  misc_feature (61): n=a or g
aaactgtctagggctcttccacaaactgtttgtcctgtgaagagatgaaagctggctcagnaatggctccatgtgttttggagcattcccatcgtagacatatctccagcaaagcgatgcc

SEQ ID NO: 35227 - DNA, 121 bp, Artificial Sequence
  Synthesized
  misc_feature (61): n=c or g
taaataaagaaaccctggaactaatgagagggcactggaagaggaagctacgccaagtggnaaagcaagctcctagcacagctctccccatggttctgctgtgcaactgccaggagctgcc

SEQ ID NO: 35228 - DNA, 121 bp, Artificial Sequence
  Synthesized
  misc_feature (61): n=a or g
gtaggatttagacatactacctagacttctttacagtgataaggaagatctttgcttcacngtgcctctgttttcaggatttgtctagtacctgtcctttatatgtatatatgtatatgta

SEQ ID NO: 35229 - DNA, 121 bp, Artificial Sequence
  Synthesized
  misc_feature (61): n=a or g
caaggaaagttatgttctatgatcctaaacaagaccagccatacaatcaccatcattttgngcagttctaactatccagaaatgagcaaggaattcatcttagaatagagtccattttata

SEQ ID NO: 35230 - DNA, 121 bp, Artificial Sequence
  Synthesized
  misc_feature (61): n=t or c
cacaatcaactgcattggcataatccttaaaaacattctgatgcaagaaataccattcttncaatgatttgttcatcttgcatgcagtgcttacaactgcacttgggagtacagccttgaa

SEQ ID NO: 35231 - DNA, 121 bp, Artificial Sequence
  Synthesized
  misc_feature (61): n=a or g
tgacaacagactgctcctcccctcgggctatcttcacaccaaccctccgtggtttgagacnttctctcctaaaaccaaacttgtaagtttaaacttcatgaaatctcagcctgttttacta

SEQ ID NO: 35232 - DNA, 121 bp, Artificial Sequence
  Synthesized
  misc_feature (61): n=a or g
tgcacaccgaggcccagagcccaaagcggggccctcacgcccgccaccatcttggccaggngagcgggctgcctggtgattaatatcaagtacaatgaccccatgttacaagcctgcgggg

SEQ ID NO: 35233 - DNA, 121 bp, Artificial Sequence
  Synthesized
  misc_feature (61): n=a or g
gagatgctgcatagaaaccaaatataacacaaccaacactgcctgttggaaaagatacccntgcaggtggactgctgccacagttcaggctgtagtgcctgtctggtccctttgctgcaac

SEQ ID NO: 35234 - DNA, 121 bp, Artificial Sequence
  Synthesized
  misc_feature (61): n=t or c
gctctgtgtggtggaaggcagcaggaatgctgcccatgaggtggtgtgggcccaggaactngggggttcattggcctgtgatttccaagggctgtgtgtgaaacagaaggaaatgatcctt

SEQ ID NO: 35235 - DNA, 121 bp, Artificial Sequence
  Synthesized
  misc_feature (61): n=a or g
tcctgagaaccatgttcctccatgggtctaacttaagactcaggcaatgcagcgcgtcccnttctgaaaccatccaaatgacatcaggaaaatgttttacaccaggggctaaccgttccaa

SEQ ID NO: 35236 - DNA, 121 bp, Artificial Sequence
  Synthesized
  misc_feature (61): n=c or g
cacagggagagagaagaaaatccccagaagtccccctctgttccatgattcgaaggcagantgaacacggacacttctgacccctcgttgcccttcagcagccccacagtcccacgaggtg

SEQ ID NO: 35237 - DNA, 121 bp, Artificial Sequence
  Synthesized
  misc_feature (61): n=a or g
tttacgattagggctgataggctataatatttgctgtaacaacccacactagttattttgnagtagcataaacttgaatgctgaagacgtgatgacatgggatttatttattacaaggagc

SEQ ID NO: 35238 - DNA, 121 bp, Artificial Sequence
  Synthesized
  misc_feature (61): n=t or g
gtctggagggacacagatgggttctgtttgaaacggttttgcagcagaaaagctctgcccnccaggtggttgcccacacaccgttgtgaatgcctgcagtgcaaagccctggcgtgagagg

SEQ ID NO: 35239 - DNA, 121 bp, Artificial Sequence
  Synthesized
  misc_feature (61): n=a or t
gtggagggattgcatatggagaagttaactaaaacatacacctaactactcagttcttgcnctgtgttcatcttccccatgtggggcaatttgggtcgggattgaaacaaacattatgcaa

SEQ ID NO: 35240 - DNA, 121 bp, Artificial Sequence
  Synthesized
  misc_feature (61): n=t or c
cacatctggagcgtacggagccaagaattttcttttgagagatggaacggagagcctgccntgtgttttttatgaaattgtaagtattcccacgtctatacataacaaagacaccactgca

SEQ ID NO: 35241 - DNA, 121 bp, Artificial Sequence
  Synthesized
  misc_feature (61): n=a or g
gtttggacggatctccagataagactgggatgcattgccatttgctgacctctcaaggccnttctctgcagagtccatggaggatgcacataattgcttacctgagcctgggagatttcct

SEQ ID NO: 35242 - DNA, 121 bp, Artificial Sequence
  Synthesized
  misc_feature (61): n=t or c
ggtttgatagaagccactaaaatgcatgtaaaaaaataagaattgcatacttgcatagatnttagaagttaaattttagtgccgtgttccaggggtgagacgtgtaagccctgttaacgct

SEQ ID NO: 35243 - DNA, 121 bp, Artificial Sequence
  Synthesized
  misc_feature (61): n=t or g
ctgtgctcacatcccaccgctgcagcaggaaagtgtcctttgtggctgcccagaaagcacnctgcttcacgttaagtcctcttataacacatgttgaaaattgttctattgttccgtagga

SEQ ID NO: 35244 - DNA, 121 bp, Artificial Sequence
  Synthesized
  misc_feature (61): n=t or c
gaagcaccagtgagtccagttaatcgtggccttatgtacagctgcagggctgtctttgctngtggtccagactggagccgctgcctgccacattgtgtgcatccatttagttctcctgctg

SEQ ID NO: 35245 - DNA, 121 bp, Artificial Sequence
  Synthesized
  misc_feature (61): n=a or g
ctgtagcacattcagtctgattttctcgtacagtaagtcaactgacaaaaagctgacaganaggaacaaaccttgaatttttttcatcttaccaaaattgaactctcttgtttttcttctc

SEQ ID NO: 35246 - DNA, 121 bp, Artificial Sequence
  Synthesized
  misc_feature (61): n=t or c
agtaacacacatctggcaaaaagagaatctttccaagttctaaaaatgctcccaaagaaangcattgcagagatccttccatccagccttctccagcctgcctagagtcccttgggaaccc

SEQ ID NO: 35247 - DNA, 121 bp, Artificial Sequence
  Synthesized
  misc_feature (61): n=a or t
acaaagattactgagatctgtggagcacctggtgttgggaaaacacagctatggtatttcntttttagattactcctgtgcgactgagagaatcgcttttctttgttgaatttaattatgg

SEQ ID NO: 35248 - DNA, 121 bp, Artificial Sequence
  Synthesized
  misc_feature (61): n=t or c
tggagcaaaggaaagatactttgaaatgctgatggatagttttgccttggtttctacccangtgcctgcttgagcaaccactttctgcttacctttctgctattctggtcttttgaaagct

SEQ ID NO: 35249 - DNA, 121 bp, Artificial Sequence
  Synthesized
  misc_feature (61): n=t or c
taaaagcagttccaaaatcatacagccagcaacctggccgctgcactgggccatcgtagcngaggcttttgttgcgccatgactggtttttaattggatggggattttgaagggtttcggt

SEQ ID NO: 35250 - DNA, 121 bp, Artificial Sequence
  Synthesized
  misc_feature (61): n=t or c
ggctgtgagcatctgcacccgagaggcctatcagtccatgaaggagagaaacatcgatganggtcatattattaacattaacaggtacacgaggtgggaacgcaggagctgccgtgtggga

SEQ ID NO: 35251 - DNA, 121 bp, Artificial Sequence
  Synthesized
  misc_feature (61): n=a or g
aaatggggtaaatgcaggtttttttttattgtaatctttattacaactcacatgaaatgcntttggaattctgtttttccagggtccacacatagcatcagttactcttgctgcctatgaa

SEQ ID NO: 35252 - DNA, 121 bp, Artificial Sequence
  Synthesized
  misc_feature (61): n=a or g
gatgttgcttagtgcaaacatctgattgtttgccatggcgtcctgcctggtgtcaggagtnatggggatctgctgctttggagaaaaaagcactgctggagcttcactgatctgtcagcat

SEQ ID NO: 35253 - DNA, 121 bp, Artificial Sequence
  Synthesized
  misc_feature (61): n=t or c
cccagctgacagttgttgaccgatgctcctaccacagcccatgggctgagctgcctgacanggctgggcagacagagccccattcactcagtggctcagcatttctaaggaaacctggatg

SEQ ID NO: 35254 - DNA, 121 bp, Artificial Sequence
  Synthesized
  misc_feature (61): n=t or c
tgtaaatgttcctgttactgcttctttccattttacttagggctggcagcatctttccagntcactgagtgattataaacaagcaactaaataggagtatctcagcatacctggaagcaat

SEQ ID NO: 35255 - DNA, 121 bp, Artificial Sequence
  Synthesized
  misc_feature (61): n=t or c
gctgcatccactgcagcccctcctgggaacagtgcatgaaaatggaagctgcacggaagangtatggcatatggaacacgcatgggagctgcgtggaaaatgaaacgtgggagatggatgg

SEQ ID NO: 35256 - DNA, 121 bp, Artificial Sequence
  Synthesized
  misc_feature (61): n=t or g
ggctttcatgattcaagaaaaagaaaaatgcagctttttagtggtggggactaatctctgnatagtaggcttaactttcagatattctgaatactcgcatatccaacgaagctcaaaaggg

SEQ ID NO: 35257 - DNA, 121 bp, Artificial Sequence
  Synthesized
  misc_feature (61): n=a or g
gggtgggtgatggaagaagacccaaagggttttgggtctgtggtggagctgcagggtccgncgccatgagcaaggagcagcgaggcgagtacagaacaaaggggacagacctgattttaat

SEQ ID NO: 35258 - DNA, 121 bp, Artificial Sequence
  Synthesized
  misc_feature (61): n=a or c
ggaaagaaactggaaaaatgaaatcccttatcctttctgtgcttcgttttcctcatatatncagtgtgtgtacacaactttgaaggtagcaccaaatcagctgcagcgtggttgtgctatg

SEQ ID NO: 35259 - DNA, 121 bp, Artificial Sequence
  Synthesized
  misc_feature (61): n=t or c
taacgtccttgtgtttgtgtgtctctttctctgctgccagtcgatgctccgaggcagaggnggctgctacaagcacacgttctatggaatcgagagccaccgctgcatggaggccacgccg

SEQ ID NO: 35260 - DNA, 121 bp, Artificial Sequence
  Synthesized
  misc_feature (61): n=t or c
gcccagcaggctcatgtgaaagcatgacaattagtggtagatgccagcaacaaccatgttnagaacagctattctgagacacaaaagagggggaaggaggaaaacaagccagacttctcag

SEQ ID NO: 35261 - DNA, 121 bp, Artificial Sequence
  Synthesized
  misc_feature (61): n=t or c
aactataaaaacagcatactcgttaaaatttgcttgcaaagagtttattccatagttctangcctactgtttcaatttagagcagactaacttgcatcgcaccaaccttcaagaagttgac

SEQ ID NO: 35262 - DNA, 121 bp, Artificial Sequence
  Synthesized
  misc_feature (61): n=a or g
ttctgaaacttgaatattttataatggataaaacgatcacagcgaattccaaggacagccnaggagctcaaagtgatccgatcatatttccagccatgagacctttggaaagagccccaga

SEQ ID NO: 35263 - DNA, 121 bp, Artificial Sequence
  Synthesized
  misc_feature (61): n=t or c
aacagtaaccacaaaactagctcacagagttcaagggatggaggtattgtttattttctgngctcttggatcagctgcaattccacatgtaagctaacttcttcagcccaaacttttagac

SEQ ID NO: 35264 - DNA, 121 bp, Artificial Sequence
  Synthesized
  misc_feature (61): n=a or g
tttgcatctgtgcagagtcccatgaagttcagatcctacttacagagcagacactgcacancctcgcctcctccagttcatttactgcagactgctaacctcctcttccctgctctgcaca

SEQ ID NO: 35265 - DNA, 121 bp, Artificial Sequence
  Synthesized
  misc_feature (61): n=t or g
cattaaggatgaagagcatccctagtttagggaacctggcagtatcgaaacttcatttctngattaataaataattgaagaaaaaagttaacatgaaattacttcctcatgtaaacattcg

SEQ ID NO: 35266 - DNA, 121 bp, Artificial Sequence
  Synthesized
  misc_feature (61): n=a or g
cagcgaggccggcagccgacgtggtggttccgagcagtgtggatgggatggcaatgtggcngatggcagcagcagtgcggtgggaaaagtggtggaataagcaacataatgctggagggct

SEQ ID NO: 35267 - DNA, 121 bp, Artificial Sequence
  Synthesized
  misc_feature (61): n=a or g
gggatttgttttgtcccttcagataaagtactcatcttcactattttttttaacagttttnagatgatactgtgtaataagctgagagatgaaagcttattaatgaagggagcttgtcgaa

SEQ ID NO: 35268 - DNA, 121 bp, Artificial Sequence
  Synthesized
  misc_feature (61): n=a or c
agggaacggactgtatatttcagagcagaaagagcttttgacttgacatgcgttgatggcncatggaaaccctggtttctatttacctgtagaacaacaacaatacaaacagtgaagcctc

SEQ ID NO: 35269 - DNA, 121 bp, Artificial Sequence
  Synthesized
  misc_feature (61): n=t or g
ggttttgaattcattacctttacagatcagtttcaatactgttagtaatcagttgtctgtnttcagttggactttgttcagttaataaatctatattcccttactcaaacaaaatacccat

SEQ ID NO: 35270 - DNA, 121 bp, Artificial Sequence
  Synthesized
  misc_feature (61): n=a or g
gaggccaaggagtatgtcctcaaggtgagatggggtatggatgcatgtgagacagagctangtttatagatgctagcagtcctgcagcatgctgaaggcagctgctgacaggccacgtaaa

SEQ ID NO: 35271 - DNA, 121 bp, Artificial Sequence
  Synthesized
  misc_feature (61): n=a or g
tgagcaggtatgaaaagacaaagacctttggtacaggtagtgctcctgagcaggcccaagngctgagcagagtacccttaagtagaatgtttagactttggctttggttcacaggatgctt

SEQ ID NO: 35272 - DNA, 121 bp, Artificial Sequence
  Synthesized
  misc_feature (61): n=a or g
caccagcactgctcgtgctgtgtttgctcctggtgctgtgctctgtgctctgcactctgtntgacagcaaatcgtaagcacagggcattaccagtgcttcctggttgggattttcaatggt

SEQ ID NO: 35273 - DNA, 121 bp, Artificial Sequence
  Synthesized
  misc_feature (61): n=t or c
tttatattttcttacagttaacgaagattaattatggtggaaatcaagcaatttccttttnggtttaatcgagtattctttataagattataattacaataatcttgtgtcctttgatctt

SEQ ID NO: 35274 - DNA, 121 bp, Artificial Sequence
  Synthesized
  misc_feature (61): n=a or g
cagagtttgcacatctacagattcccaccgccagttgttctggagatccaagtcagtgtcntcctaagaagttcaatgaaataccagaccttggtcccacaaagccataccctattgctac

SEQ ID NO: 35275 - DNA, 121 bp, Artificial Sequence
  Synthesized
  misc_feature (61): n=t or g
caggtggctcctctggagaacagcaagatctcctacttgctaactcatacttaaatgcctntaaacctgaaatacagatccaatcttgtcctctcttgaatgagcgtaattgctcctcagt

SEQ ID NO: 35276 - DNA, 121 bp, Artificial Sequence
  Synthesized
  misc_feature (61): n=t or c
tcatctcacctgaactcatctacttagaatgaatgaaggaagtgcagagctgtactgtcgngcgttccttggagtcgtgccaggttgggtttgggccagctcttcatttcatttgcagaat

SEQ ID NO: 35277 - DNA, 121 bp, Artificial Sequence
  Synthesized
  misc_feature (61): n=t or c
tgagctgttgtgaaatgacactggggacagacaggcctgtagttcaaatctacagggatgntcaaagtcccgtttctggagcaactgtgcaaaacttagtgaagcagcaagctgctgtcac

SEQ ID NO: 35278 - DNA, 121 bp, Artificial Sequence
  Synthesized
  misc_feature (61): n=c or g
gtgttgtgagagtggaaggatacatattaggtaaatgccctgtggcctggagaaaggtctnagtgcagtgctcgtggtggtgagatgtctcaaagctttaacataacagccataattatct

SEQ ID NO: 35279 - DNA, 121 bp, Artificial Sequence
  Synthesized
  misc_feature (61): n=a or g
agtcagaggataagatgaaagccaaagctgatgagcaggactattgcagctaaaccatgcntaatagagcaaagtaaaactatttggggacgtttaataactctttttagttgctgtgcaa

SEQ ID NO: 35280 - DNA, 121 bp, Artificial Sequence
  Synthesized
  misc_feature (61): n=a or g
aggagcaaaggtacaaagcttactgttccttgaactaagcaaatagatgctcctgtattcntttctccgccctttaaaatgaggttgctctctaatattttaatactataatattgcatta

SEQ ID NO: 35281 - DNA, 121 bp, Artificial Sequence
  Synthesized
  misc_feature (61): n=t or c
cattaagaattggcagtgagtttgttttgtactctgacttatgttcaacctgtgatgattnttaagtctccttccactagacaacagaaattttgctgacacaaaaatctgtcagcatgaa

SEQ ID NO: 35282 - DNA, 121 bp, Artificial Sequence
  Synthesized
  misc_feature (61): n=t or c
tgtggaaacaagtaagtaacctgcttttagttgttagtcttaaagcccaggcttagcaggnactgtcagactaattcagttcctcctattataatgcacttagaggtttaagtttccatcc

SEQ ID NO: 35283 - DNA, 121 bp, Artificial Sequence
  Synthesized
  misc_feature (61): n=t or g
ccccatatcaggccatgagagttttatctcatcgggggtctgcagaattagactgtggagntaaacagacttcttaaactttctgtaggagacatttgcatgtgtgcttgtttatgctaga

SEQ ID NO: 35284 - DNA, 121 bp, Artificial Sequence
  Synthesized
  misc_feature (61): n=c or g
atccttgttcgttttggaatgacagtgattctgtagaagggagtatccctctttcaacctncatggtttttaaacctcatttattctgtatctcaaatcaacaagaacttgactctaccta

SEQ ID NO: 35285 - DNA, 121 bp, Artificial Sequence
  Synthesized
  misc_feature (61): n=t or c
cccagagagtttcctgaggctatgggcaattagctgcaaaacttcactactgactgcagcnttccaacactggtttccctctgctactgagaggcccatgagcaatacagaagtgaccatt

SEQ ID NO: 35286 - DNA, 121 bp, Artificial Sequence
  Synthesized
  misc_feature (61): n=t or c
tcttttttccccttctgtttcctttcctgctttctgcatttcagggcatcctttctgtatntgcccttgatccattccttcagtgatgcagatcatttttttttaattattacgttcccag

SEQ ID NO: 35287 - DNA, 121 bp, Artificial Sequence
  Synthesized
  misc_feature (61): n=c or g
aggtctcctgggaggtggttgagttggtcatggttaaagcatggtgatggccttcaagganccctctcaccattcactcgccacattccttccagacatggtttgggtttcacgcagtgca

SEQ ID NO: 35288 - DNA, 121 bp, Artificial Sequence
  Synthesized
  misc_feature (61): n=a or g
gggttagattgaggagttaggggttaaggttaagggtcagtgttagggctttgtggttacngttaggggttaggcttagaattagggttattagggttaggagttagaggttaggtttagg

SEQ ID NO: 35289 - DNA, 121 bp, Artificial Sequence
  Synthesized
  misc_feature (61): n=c or g
ccgtgattcagcagttctgtctctgcagaacaactccagtcagttatctcttgatgcctgncatgctcagggtttcccagcatcgctggctgtgccgtgctggcttttggtgggtgctgtc

SEQ ID NO: 35290 - DNA, 121 bp, Artificial Sequence
  Synthesized
  misc_feature (61): n=t or c
cactcagtgtagcaaaagctacaggcatgaatcctttggcatcttccacttctgacacccncgaaacaacagcttcaagtaagaggtacaggaggccagccaggacggcaaacacaagggt

SEQ ID NO: 35291 - DNA, 121 bp, Artificial Sequence
  Synthesized
  misc_feature (61): n=t or g
aagttgtgaaggcactgtgctacaagatggcagtgcaaatcccttcacctgaatggtggtnctgtattagtgggttgaaacaaatgagaggagtgcattaagtagtttataattagttact

SEQ ID NO: 35292 - DNA, 121 bp, Artificial Sequence
  Synthesized
  misc_feature (61): n=a or g
caaaaaacaacacaaaacagttttatcctagttagcaaaaaaattctgaatccttgcaacnaagaaagttcttgccaactctgcatttgggattttctctgagtctgtgtgacttgcaaaa

SEQ ID NO: 35293 - DNA, 121 bp, Artificial Sequence
  Synthesized
  misc_feature (61): n=c or g
gggtgatcttcaaggcccttacacctaagccattcaatgattcattattataagcacacangatcttcaaagacagtaactttccagatgaccacagacgtacctacctattgacagagaa

SEQ ID NO: 35294 - DNA, 121 bp, Artificial Sequence
  Synthesized
  misc_feature (61): n=a or g
actctcaagcatcagactgccagcaggaaccaggctccttgtctctgcaggagtctcctcntctggagtggagaagtccatggtaattgcttgaaagaagaaggtgactcttgcctgtccc

SEQ ID NO: 35295 - DNA, 121 bp, Artificial Sequence
  Synthesized
  misc_feature (61): n=t or g
attatgggctgtctcttggggaccagtagggaaaagctggccatttcatggggaaaaaaancagtgtttaagacttctggcaccgatttattttagagctcagcggtttctgaacagaact

SEQ ID NO: 35296 - DNA, 121 bp, Artificial Sequence
  Synthesized
  misc_feature (61): n=t or c
aaccagagaaattttcaactgatacccttgaacatcagatctgtggtgaactgaagcacanagcaatgcatgcgtgctgccaggcaaatatcctgtaagtcatatttctttctgtggctat

SEQ ID NO: 35297 - DNA, 121 bp, Artificial Sequence
  Synthesized
  misc_feature (61): n=a or t
gagcagatgggggacgttttatgcacatacaaggagagatgcagaaactgtctctcatttngaggagttccaaagtatcttcacacagaagagcaaaagccctagcaatgttggctacccc

SEQ ID NO: 35298 - DNA, 121 bp, Artificial Sequence
  Synthesized
  misc_feature (61): n=t or c
ttgtaaaaatacctacacgtggaccgagaaaatgactttagtgcgacctttggttcacccngatggggtgagatccttcactgaggaaaccacgcgctggggaaagctttgctgctgtgca

SEQ ID NO: 35299 - DNA, 121 bp, Artificial Sequence
  Synthesized
  misc_feature (61): n=t or c
agggcttcctaatggcagctctgttttaagtctgttggtgacactgttctgctttgctctngctgttggaaaactgtctttgaagtgttgctgtgcgttggcagctccttgtgttggtgtc

SEQ ID NO: 35300 - DNA, 121 bp, Artificial Sequence
  Synthesized
  misc_feature (61): n=a or g
ctgcacagcacatctaccttaaaaagtttcttgtggagagaaggcagcgactgggtaaatncctcagctggaacaaagtgctggattatttgtcgctcagcacggctgtgccattttaaag

SEQ ID NO: 35301 - DNA, 121 bp, Artificial Sequence
  Synthesized
  misc_feature (61): n=a or g
tgggctggggccagccaattctcaggccaagcatgtccctggctgaggggacgtgttttcngtgtttttgaacaggacttgaggatcagtgggagtcatagaggcctttcaagattgttta

SEQ ID NO: 35302 - DNA, 121 bp, Artificial Sequence
  Synthesized
  misc_feature (61): n=a or g
gatgctgtgatcacatgcattttgaggtgtgttcagtacagggtttgtctcactaataacnttctcctgtttgtttgcaggattttgcttcccgggctaagctggctgtccagaacctggt

SEQ ID NO: 35303 - DNA, 121 bp, Artificial Sequence
  Synthesized
  misc_feature (61): n=t or c
cccagccgtggtcttcctacccctgtaaccattcaccttccttactttgggtgccgtattnataacaattttttatacttttcaaaggcataaaaacttcaaatcaatattgataagtgtg

SEQ ID NO: 35304 - DNA, 121 bp, Artificial Sequence
  Synthesized
  misc_feature (61): n=a or c
ctaacttcaacacttgcctgccttcctcagagctgaatagcagagtatttcgtttctgttnggctttggctgttacttaagtaaaagatcttggaccaagaagcatcatggtcctttaaaa

SEQ ID NO: 35305 - DNA, 121 bp, Artificial Sequence
  Synthesized
  misc_feature (61): n=a or g
tcctactcggtgtcgatcgctacctcttggtgtagtccagctaatagatcacagtgagccnagcagaacattttggttctgtgtgtttgtggattgctgttggaaaggtgagattaagtta

SEQ ID NO: 35306 - DNA, 121 bp, Artificial Sequence
  Synthesized
  misc_feature (61): n=t or c
aattgaagttggtaccaacagatgaccgaatttgtaaggacaaatgaaatattatattcangtagtcagattgaaactacagggagagaaaaaaggatcagtcacaacttcttcagtggta

SEQ ID NO: 35307 - DNA, 121 bp, Artificial Sequence
  Synthesized
  misc_feature (61): n=t or c
tgaacacagaacagaaacacttcgatgaggatggaggcaagatcacttgggatttccctangtgagaagcaagaccacagatggagctcaggtccatgccaagccttgtgccctcatccca

SEQ ID NO: 35308 - DNA, 121 bp, Artificial Sequence
  Synthesized
  misc_feature (61): n=a or g
gtgaggatgaaggccagtgttagtcatgttttcatggggctagagctggaggattgtgctntactcagtctgtgggcaaagggaaagtctgcctttgggattgctcatctgttaccaccac

SEQ ID NO: 35309 - DNA, 121 bp, Artificial Sequence
  Synthesized
  misc_feature (61): n=t or c
aaccataggcccatccagaagagactgactcctcccactatatttcatgtaaccacattcnagatagtgcattatttgtgaagacaaagaaatgaagggggaaaaaaagtagttatgaagc

SEQ ID NO: 35310 - DNA, 121 bp, Artificial Sequence
  Synthesized
  misc_feature (61): n=a or g
tttgccagctgtctgaaggcatcatccatagcaaactgctttcagctaaaggcaagaggcnaccatattaacaaccacgattttgtttatcagctatctgaagttgggtatataacaacag

SEQ ID NO: 35311 - DNA, 121 bp, Artificial Sequence
  Synthesized
  misc_feature (61): n=a or g
actaagctaaaaatctgattttaaaaaacagataacagtatttccagtagaaagaactcangctgtttaacctaccagaggttcacgagggccacatcctgaagcatgcagaggaaaaagt

SEQ ID NO: 35312 - DNA, 121 bp, Artificial Sequence
  Synthesized
  misc_feature (61): n=a or g
tccaatgcagaagaccacgttccactacataggattgccctctccaagctctcagatcacngcagcatctgccaggctccagctgttctttgctcctttccagcagtgctcaatagtttgt

SEQ ID NO: 35313 - DNA, 121 bp, Artificial Sequence
  Synthesized
  misc_feature (61): n=a or t
aaatttccatgcaacaactttattttacaagtcaatcaaaattctctacccagttctcccnctgggacattataccatttactgcgctctgcagaaattgaagtacaatcctggtacctgt

SEQ ID NO: 35314 - DNA, 121 bp, Artificial Sequence
  Synthesized
  misc_feature (61): n=a or g
atgcaaaacaaaaagaaactgctttaaccgtgcaatacagcagaacaacttgggctgagcnctttcccacctgccattacagaagagaggacctggatgccagttaaactgaaggtcttag

SEQ ID NO: 35315 - DNA, 121 bp, Artificial Sequence
  Synthesized
  misc_feature (61): n=a or g
cctgtcccaaaggctggatgagggccacccaaggacgtggagtgaggggctgcaggtaagncgctccctaagcagtcatggttttggtttagccctgctgtgcaaggggtaatagtaatgt

SEQ ID NO: 35316 - DNA, 121 bp, Artificial Sequence
  Synthesized
  misc_feature (61): n=a or g
atagacattgctgtgaactgcagatagaaaggaagatgattattgactgcatgaacctacnatttactcacactttcactgctgtgtgtctttttggactctccatctcaataagaaaata

SEQ ID NO: 35317 - DNA, 121 bp, Artificial Sequence
  Synthesized
  misc_feature (61): n=a or g
gttactgcttctgaacctggagcctgtgctccgagccccagcagctgcaagaacagagcangaaccttgcaaggacaggcacaaaaagaaaatccttccaggccacatctctagtcttgct

SEQ ID NO: 35318 - DNA, 121 bp, Artificial Sequence
  Synthesized
  misc_feature (61): n=a or g
tgtacagcacagtgcgaagggaagaactcacacacttccacagccaccttcaagactacancactaatgaaggagcaacccaccaagggttatagttgatccatatgtatagttgatccag

SEQ ID NO: 35319 - DNA, 121 bp, Artificial Sequence
  Synthesized
  misc_feature (61): n=a or c
acatctccctccaagctctacagcatcccagaactatgggggctccccaaagccctaacanccccccatagccatagagatccacgttgacttccccatcaccccacgcccatctctgcga

SEQ ID NO: 35320 - DNA, 121 bp, Artificial Sequence
  Synthesized
  misc_feature (61): n=c or g
aaatacactgcatcaaataaatctgactttcccatgaacgtggcccatcaatgctctttanattaagtgtgctttacctatagaaatattccaagagaaaaaagtgcatagctgcatatga

SEQ ID NO: 35321 - DNA, 121 bp, Artificial Sequence
  Synthesized
  misc_feature (61): n=t or c
tgggtactgaacaaggcagccaggagacagtgctgatgttccaggctctggggtggccaanaggggtgccattaacactttgtagctgttgtggatcctccttgctgaggacttccattca

SEQ ID NO: 35322 - DNA, 121 bp, Artificial Sequence
  Synthesized
  misc_feature (61): n=t or c
caccacggcatcactgctgcatccccactgcatctctgccacatctccaggttatctctgnttcactcctgctgcatctctactgcttctcagctgcgccttcactgcactccctctccat

SEQ ID NO: 35323 - DNA, 121 bp, Artificial Sequence
  Synthesized
  misc_feature (61): n=t or g
tggcagtggagagctccggatacctcctctttttaggcagcagattattgtcaacccttgnttgaagatctcagcttacaatgatggggactatcagcacctcctctttgcaaatgggggg

SEQ ID NO: 35324 - DNA, 121 bp, Artificial Sequence
  Synthesized
  misc_feature (61): n=a or g
ttaaagacactaatagtacagtctgtctgtcattaaagtgactccttcacttgcgctatcnctgtctggcaaacaaatccttcagcagtgatggacctaagcttcagggtttagcagtcag

SEQ ID NO: 35325 - DNA, 121 bp, Artificial Sequence
  Synthesized
  misc_feature (61): n=a or g
ccagcagctctggaggacaagctgcagcctggctcatatgacgtattgtggaacagacacngggcagaggatggtgtgaggctgtagtgaaaatgcccatatcccatgctcattgcagctt

SEQ ID NO: 35326 - DNA, 121 bp, Artificial Sequence
  Synthesized
  misc_feature (61): n=a or c
caatgttgaatccttgcattctgtccatgcatccatcttgtcaatacctaatagtccaggntccctaagttattaaccagtgagagttcatcaaatccaaatcccatagaaaacaaaaata

SEQ ID NO: 35327 - DNA, 121 bp, Artificial Sequence
  Synthesized
  misc_feature (61): n=a or g
cattttgtatcctaaggcacaaaaagcaaagcgcctcatcctggtgtgaagccaactcagngtgcagccactgactcctttaagaagggtccctggggcaggtcctctgggctggtgccat

SEQ ID NO: 35328 - DNA, 121 bp, Artificial Sequence
  Synthesized
  misc_feature (61): n=c or g
tagagcagaggaataacttgaattggtgaacggcgatgatgctagtgcagtcctgaagcangatctgccaagagcactagactagaaaaaccttcctcaaacaagaccagttcattgtaca

SEQ ID NO: 35329 - DNA, 121 bp, Artificial Sequence
  Synthesized
  misc_feature (61): n=a or g
cggttccacctctcccccccccagcccgcagtgattatgactccttcccaaactatttctnccaattctatttgccttcaaaacccccccagcgctatcagtgcacatctgggcagcaatc

SEQ ID NO: 35330 - DNA, 121 bp, Artificial Sequence
  Synthesized
  misc_feature (61): n=a or g
atcaggacataggtctgaatgacagcgtgtgggtgaaagaaagggaaagcaaagcccagcncactgcacacatcagtaccgaatgaaaccacttttcccagtggttttgtggctgcctgtc

SEQ ID NO: 35331 - DNA, 121 bp, Artificial Sequence
  Synthesized
  misc_feature (61): n=a or g
aggttttcttcgctttcatccgtcgtatcagacacaaaggtataaaagaaacccggatttntgtatttcaaagcagagtttcatcctgattgatctacagagaagagcctcaccaaggtac

SEQ ID NO: 35332 - DNA, 121 bp, Artificial Sequence
  Synthesized
  misc_feature (61): n=a or g
gtgtggtacccccaaacttctccttccagcgcctgtatcccaggtcaggttttgcagcccnggtattgatggcctcctgctgaggctgccagcaggaccagtggttgtgatttagacatct

SEQ ID NO: 35333 - DNA, 121 bp, Artificial Sequence
  Synthesized
  misc_feature (61): n=a or g
gctgtatttaaagatgttttcccagtaggtttctatggaagctgtagtcttataagatttncctatgtcaggttgttagcatcactgcaaacttaggattcacatccctgaaaagctctgt

SEQ ID NO: 35334 - DNA, 121 bp, Artificial Sequence
  Synthesized
  misc_feature (61): n=t or c
gctcagcctcttttgagacagattacgtcgagcacaggaattcactgctctctccagaggnggtttttgtgaatacagagtcccagaatttcacaagggactttttagagaggcagagact

SEQ ID NO: 35335 - DNA, 121 bp, Artificial Sequence
  Synthesized
  misc_feature (61): n=t or g
cgaaggagggtcagcaaagctgacctgcttagaatgttggctgggagaatcccatgggagncatgcatgaaaagcagaggggcctggcaaagccagacattgctcaaggaggaaatcctaa

SEQ ID NO: 35336 - DNA, 121 bp, Artificial Sequence
  Synthesized
  misc_feature (61): n=a or g
tctcctcgccaggccactctccctcactgctgcgtttctttacagcaaaacactggaacanaatgaaacctatctgccactaagtgtcctggttaggcaggaactgaagattgcatgcagg

SEQ ID NO: 35337 - DNA, 121 bp, Artificial Sequence
  Synthesized
  misc_feature (61): n=a or g
catcttggcacaaacacatctgtcaaaatactaaatttgccaatgttcacagatgttgacnttcaaaaggtatgaggacttcaaggggaacgtggaaaggaagagcactgtcctatttaaa

SEQ ID NO: 35338 - DNA, 121 bp, Artificial Sequence
  Synthesized
  misc_feature (61): n=t or c
gccatgtctgtagtattatgccttatgaagagggataggaaaagaggcagcagctatccangtctttcatgaagggaaaatcagaacaaagcatcagatatgcatcagacacaaaactatt

SEQ ID NO: 35339 - DNA, 121 bp, Artificial Sequence
  Synthesized
  misc_feature (61): n=a or t
gatgaaccagaggtgacaacgttctagcatggaggtttcctacaagaaaagcggttggatnttgatcagcttcctacaaaccaactcctgaatggaaaagttcccagtgtgtgcagtgttt

SEQ ID NO: 35340 - DNA, 121 bp, Artificial Sequence
  Synthesized
  misc_feature (61): n=a or g
ctcttgaccatctgctgctgctctaagaaacgagtgtttactaccagaaatatcggaggtntctgggatagatcacagcagagtgtaagggcagagtgcagccacttatgcaaagctgtgc

SEQ ID NO: 35341 - DNA, 121 bp, Artificial Sequence
  Synthesized
  misc_feature (61): n=a or g
ttgctgagcaacagcatctccctgaagggtgctgatgctcaaagtgttcctccagtaaagnagcagccagtctgtagttcttaaaagtatttctggaggtgtaaaacacgtgaattctcaa

SEQ ID NO: 35342 - DNA, 121 bp, Artificial Sequence
  Synthesized
  misc_feature (61): n=t or c
cgcctatttctgtagggtgaagaagtcaaacttactcaagaatgacaacatatctgcctcnagatacaaagcaagagtaaatttgttagaataaggaagtaccacttagtgcactgtgagt

SEQ ID NO: 35343 - DNA, 121 bp, Artificial Sequence
  Synthesized
  misc_feature (61): n=t or c
agcagtaaagcctagccatgaggattcctgggcacgctggtattgctccatcagtgcatangagaaagttagaaaggtcactttgttcacagaagcagctagggccacaagtacacgttta

SEQ ID NO: 35344 - DNA, 121 bp, Artificial Sequence
  Synthesized
  misc_feature (61): n=a or g
ttacacttcctggaacaagaaaaagattaatttcaggagatggatatttcccaacaaatcnaaatagaaatcacagcaggtcccaaatacaattttattctgcaatcgaagtcaccatggc

SEQ ID NO: 35345 - DNA, 121 bp, Artificial Sequence
  Synthesized
  misc_feature (61): n=t or c
aaggactcattctttggaataacttttcactgtaagatgagttcagttattccacctttgntttcaatctcctttattttattatttagcaatggttggaaaagatcagtgcatgctttac

SEQ ID NO: 35346 - DNA, 121 bp, Artificial Sequence
  Synthesized
  misc_feature (61): n=t or g
ctcagactagcagttgagtgccgttttctcagtgtcactgaaacacgatatacccatattngatctatttccaggcctcgagtttagaagggagctgacagtgttgttaatgacatgtagg

SEQ ID NO: 35347 - DNA, 121 bp, Artificial Sequence
  Synthesized
  misc_feature (61): n=t or g
cttatgagccaaggctgtagatcccatccgttacagagagtaggaaggaagcaccagctcngttcagccatatccattgatctggagaccgaaacggggccccccggccacgctgctctca

SEQ ID NO: 35348 - DNA, 121 bp, Artificial Sequence
  Synthesized
  misc_feature (61): n=a or g
gcagaggctgctctcctgtgcctgcttcttcaggctgagggaaggtgagcaaaccatcttngctgtcaccctgggattgcactgtgacctgggggctctgcctccagctcttccccagctg

SEQ ID NO: 35349 - DNA, 121 bp, Artificial Sequence
  Synthesized
  misc_feature (61): n=a or g
ggagaacttcatgacatcaccttctccgagtcctcagattccgtgtgaatgtgttagcacngcaatagacaaaagcttagaagtatgataggtgtggccaaaagggttcaaaacccaaatg

SEQ ID NO: 35350 - DNA, 121 bp, Artificial Sequence
  Synthesized
  misc_feature (61): n=a or g
tgcaaatatggaaaaaggtgttagctgcatttcatatactttttgcttttggatttgaacnttattaagattttcctaaagactttgtgtgtaaaacctccaaatctgtaaagcagaaagg

SEQ ID NO: 35351 - DNA, 121 bp, Artificial Sequence
  Synthesized
  misc_feature (61): n=a or c
gccacacagtgtggatctgatgtgttgaggagtggcactgggataacacacacagggcagnagcaccacgctggttttgtatcccattcccagccctggccaggtttggtcactgggccta

SEQ ID NO: 35352 - DNA, 121 bp, Artificial Sequence
  Synthesized
  misc_feature (61): n=a or t
tactttgctcatgctctgtaactgatccagtctgaatactcattccactatacaaactgtnatattaagtttaaaatctgaaagcgcagttcaggtgcaaacattgccactagaacagcaa

SEQ ID NO: 35353 - DNA, 121 bp, Artificial Sequence
  Synthesized
  misc_feature (61): n=a or g
tgagaacaagaagataatgtgaaaatacaattgcattttgacgtctttaaaaagagacacntacggaaaagcaataaaggcatgccaaaggatagcaaatgttttaagagaggaaatgcat

SEQ ID NO: 35354 - DNA, 121 bp, Artificial Sequence
  Synthesized
  misc_feature (61): n=t or c
tgcagctattaccatatgtcatcaaataaccagcataagcagatgtgctgctcctcctcantgacaccacacagaagtttagagaacaggagcagggggctatgcctcttcctagccccac

SEQ ID NO: 35355 - DNA, 121 bp, Artificial Sequence
  Synthesized
  misc_feature (61): n=a or c
gtatctgccttttggtccctggagtgactctcagacaccaaaatgaaaatgtttgaatttnagaggtaaatttgcctctggacaaatggtctctgatttctgaacacattaactcatgttc

SEQ ID NO: 35356 - DNA, 121 bp, Artificial Sequence
  Synthesized
  misc_feature (61): n=t or g
taggattttttgtgtgtctttcttcagtttaaatcaaactacttgcacgtttttcttggantcttatttgagctttagcagcttcagtagagaacatttttttttctactaaatgtacatt

SEQ ID NO: 35357 - DNA, 121 bp, Artificial Sequence
  Synthesized
  misc_feature (61): n=a or c
ccctaatagatatatatatatatattgttattatttaatgcacaagatacacatgcatttnagctcattgagcagctggctaacgtgaactagagtgcttcagatagatagtggtctgagc

SEQ ID NO: 35358 - DNA, 121 bp, Artificial Sequence
  Synthesized
  misc_feature (61): n=a or g
ttccccattgtggcaaataaatgacacttgggaaatgaatcaaagttgtttgtgaaaatgngttgacttcatcacaagtgccagggcaatgaaaccctcccacatcttcttcctagtgctg

SEQ ID NO: 35359 - DNA, 121 bp, Artificial Sequence
  Synthesized
  misc_feature (61): n=t or c
gccagctatgaatgttcgtttcccttttccgcatatatttgcgtaagtgagataataaaanattatttccatctagactgaaactgctaaaaaaaagtggagtagcagctgatgtctcagc

SEQ ID NO: 35360 - DNA, 121 bp, Artificial Sequence
  Synthesized
  misc_feature (61): n=a or g
aaaaactattcctgtgacaagcacacacttctgtgacaaaattatgtgatgtggggacagngagaggaagacaagtgaggaacagcaagtgcatgcagccaaattcctggaacacaataaa

SEQ ID NO: 35361 - DNA, 121 bp, Artificial Sequence
  Synthesized
  misc_feature (61): n=a or g
tcagagcaacactgcaagcagctccgaggaggaattacagtcctgttcctcagcagcttcnctccacttcaacgcgattccctataaaggcgctgagcaacagcctgcaaagattcctccc

SEQ ID NO: 35362 - DNA, 121 bp, Artificial Sequence
  Synthesized
  misc_feature (61): n=a or g
ccagcctgacccacttacccacttccagcaatagctcagctgtctcttggtgccaaaatcncccagcccagcccatgttgtgatgctggtgcccaaaggggagcgcccacacctgccctta

SEQ ID NO: 35363 - DNA, 121 bp, Artificial Sequence
  Synthesized
  misc_feature (61): n=t or c
aataacaactcctccagtgtggagccacaaataaaaattcagaagataatacattttctantactgtcaagaaatcaaacccaggaattatagaaattattgtagtttaccttgaaaactg

SEQ ID NO: 35364 - DNA, 121 bp, Artificial Sequence
  Synthesized
  misc_feature (61): n=a or g
gtcttttggaaaggcaaagatttagagcaaaactccctctttgagcaagatgtagagaagngagcttctgcactaacatcagacctgagaaatgagacaaagcaaccagaaatgaaggagg

SEQ ID NO: 35365 - DNA, 121 bp, Artificial Sequence
  Synthesized
  misc_feature (61): n=a or c
ttcactttttttttttaaccatctgtatgcattttacagttattctattgctgcttcaaangttgcaaaatgcaccagtttggttgagtgctgcctcagacgccatgaagacagacacaaa

SEQ ID NO: 35366 - DNA, 121 bp, Artificial Sequence
  Synthesized
  misc_feature (61): n=a or g
ccctctttacctttgatgtggtatacttttgaaaaaagttgcatttgttaataagtcactnaacacataattgcatgtcagaactggatgaagagcaccaagtatcctcctccaaataact

SEQ ID NO: 35367 - DNA, 121 bp, Artificial Sequence
  Synthesized
  misc_feature (61): n=a or g
caaatgctagcaaacaaaatgagccatcctgatcccactgtagtggatatggaaagagagncatctacaagaggtgcttcattagacatttactgaagaagaaatgaactgccatgtagat

SEQ ID NO: 35368 - DNA, 121 bp, Artificial Sequence
  Synthesized
  misc_feature (61): n=a or g
tggctactcggaaggaaaaatgctttgcaagggaggaaggaacaaacagccttggaaaganttagggaaggagatcaacgctgtgaccggcgggtattgagctgttctaccaataattcat

SEQ ID NO: 35369 - DNA, 121 bp, Artificial Sequence
  Synthesized
  misc_feature (61): n=a or g
tgttaatatatgtattatatagcactgcttctttacattatcacttggcgttgtagtgggnctgtttaaatgcacagtgcagctagagcctttgccttgccatggagcctacaaaagagac

SEQ ID NO: 35370 - DNA, 121 bp, Artificial Sequence
  Synthesized
  misc_feature (61): n=a or c
tacaaaattcctttgtgtatgcattttcttacacgaactctgaaacataatgaatcttgcnaatgtgttgtgttggaaaataatacattgacagcactaaaaatccaaaagatttgtttta

SEQ ID NO: 35371 - DNA, 121 bp, Artificial Sequence
  Synthesized
  misc_feature (61): n=t or c
atgtttggtgctagcattgcagagaaatgcaggatttcagctgtttgctagaaatttttgntcaatgatgttgcttgtaagcatgcacattaagtgaatcttgactctctgcaggcaagaa

SEQ ID NO: 35372 - DNA, 121 bp, Artificial Sequence
  Synthesized
  misc_feature (61): n=t or c
tgtagtgcaggagaatgagacctgctcccctgcacctatgcgtatgacacatgcaggggcnctcagggtatgggctgttcaacattccacttctccctcctctcagaaaaagaaaacaaaa

SEQ ID NO: 35373 - DNA, 121 bp, Artificial Sequence
  Synthesized
  misc_feature (61): n=a or g
aatccgaagttgaatgtcagtgttctttgcagtttgcagcccataccctgcacatgctttngttttcatttgaactaaagttatgtgaatagttcaattaaaactgggaatgatttagatg

SEQ ID NO: 35374 - DNA, 121 bp, Artificial Sequence
  Synthesized
  misc_feature (61): n=a or g
agcaacagtagggaaatggtggggaatcgagctgacttcctctatggcacagatctcagtntgtgcagcatctctttacctccatcagcctttctcctcccccagcgaaggagccaaagca

SEQ ID NO: 35375 - DNA, 121 bp, Artificial Sequence
  Synthesized
  misc_feature (61): n=a or c
tgactatgaggcattggctctgttttgtggagtaatgtagtgcggaaagagtggccactgntgagcaggaagctcccaggtcagttactctcaaaagctgtcctgtgaccttccctctgta

SEQ ID NO: 35376 - DNA, 121 bp, Artificial Sequence
  Synthesized
  misc_feature (61): n=a or g
gaattttttgaaactgttgctacacctgtgagagaggggcagcaaagtaagaaccagccanctgcccatttattcttttattagaaggcacagatggagccatgatcacggtgacagtgag

SEQ ID NO: 35377 - DNA, 121 bp, Artificial Sequence
  Synthesized
  misc_feature (61): n=t or c
actgtggagatctttcggtcaagaagctggaaaaaatcagaggaaggtttgtgagaacacncaggacctgaagctgctatatgtaatttctatttgctatccagcagagtggagtgaggag

SEQ ID NO: 35378 - DNA, 121 bp, Artificial Sequence
  Synthesized
  misc_feature (61): n=a or c
ttagttttcttgacctacataatcattaaggctgctaaatgtaaatgaatattaaattaangagagtaaggcatgtcctgaaaattgaggtctagtagaatctgttaggtaaatatatgac

SEQ ID NO: 35379 - DNA, 121 bp, Artificial Sequence
  Synthesized
  misc_feature (61): n=a or t
gggctcttggaggaaaggacttagttctaagattcagagaaaagtcaataaggattctttntaaaggccaagtgctgttaattgagctgaagctatgtagaaatcaccccttcttagaata

SEQ ID NO: 35380 - DNA, 121 bp, Artificial Sequence
  Synthesized
  misc_feature (61): n=t or c
acagtcagtggagacttgacagcagttgttcttcccagcttttcacagaatattttccagnactcccagaggcctctggtatattggccattctgaacagatacattaagaatcatgcttt

SEQ ID NO: 35381 - DNA, 121 bp, Artificial Sequence
  Synthesized
  misc_feature (61): n=a or g
agtggatgcatcttccagtactgatgaattactttgtgttgttattcaccttagaacaatnagtgaagatttatgtagacgtgaccatcttgtacaatgtttttactgtgacaaggtaaaa

SEQ ID NO: 35382 - DNA, 121 bp, Artificial Sequence
  Synthesized
  misc_feature (61): n=t or c
agtttatattgtatttttgttgatctgaaaatctatttttcctcctactttctcttcctgnataagaacataggttgttctctgcaatgtctcctcaaacaaacacaactgttaactatgt

SEQ ID NO: 35383 - DNA, 121 bp, Artificial Sequence
  Synthesized
  misc_feature (61): n=t or c
actcactgctgtaatagatgcttcccaataatctgtacatcggttcaagcagcagagctgnggcagttttccccctctccctttctggatgctcatttccagaggttaacgaccagagagg

SEQ ID NO: 35384 - DNA, 121 bp, Artificial Sequence
  Synthesized
  misc_feature (61): n=t or c
cctgcagtgatgctgactcatgaatgaaagggaggtaaattactgtacatatactaagatnctgcatgccagctgttctgcagcctccccgcaaagctttgcaacctcccttctcagcatg

SEQ ID NO: 35385 - DNA, 121 bp, Artificial Sequence
  Synthesized
  misc_feature (61): n=a or g
aatttggctcatcagccatcacagcatgagtctcttctgtgtatgacacaaaagagaatanttctgtccgtctgcaaatgggttcatcattattttcattctaataacaaatgatccttat

SEQ ID NO: 35386 - DNA, 121 bp, Artificial Sequence
  Synthesized
  misc_feature (61): n=a or g
gccttcgggcactgctgtgaccccaacaaaaccctatgcttaaccttggattaacagcacngcgctcagcagcatcctgtgggaagatgggcagaacctctccccatactgagcgctgggt

SEQ ID NO: 35387 - DNA, 121 bp, Artificial Sequence
  Synthesized
  misc_feature (61): n=a or g
cagatagcagcccttcagctatcaactcttcactccttaggtactctctaccctccaaccntgcctgggatcagtactgatgtcaccagctttcatccacactttcaatgtgcagagtgta

SEQ ID NO: 35388 - DNA, 121 bp, Artificial Sequence
  Synthesized
  misc_feature (61): n=t or c
aagaaaaaagttgtgtttgtttccctgctaatattccctaaggttactcagccctttgcantcagctggtcacagaatgaatatccaaaaccttttgaaaacgtcacatattcagccaagg

SEQ ID NO: 35389 - DNA, 121 bp, Artificial Sequence
  Synthesized
  misc_feature (61): n=a or c
cttacttctgggcattgggaatgtggcaatgcaggggtcttgctatatgatgagttacacnttttctttcctctatgtgtagttattttggattgtctcactaggaggtaaaccaagcact

SEQ ID NO: 35390 - DNA, 121 bp, Artificial Sequence
  Synthesized
  misc_feature (61): n=t or c
ggtttgtaacagacagagcttaacagcggagcacatttggttttatgggcgccataaagangagcggcctcacacctgggagagagcaaaacaaactgggcagaagcagcaggagggcatt

SEQ ID NO: 35391 - DNA, 121 bp, Artificial Sequence
  Synthesized
  misc_feature (61): n=t or c
aaacctggtttccagctgttacagtttgcaagtaagtgtctttaatgaagcatcaaaactnggcgcacaacaatcacttaagaatagaatttatctgcaactggtttgttcagctaattga

SEQ ID NO: 35392 - DNA, 121 bp, Artificial Sequence
  Synthesized
  misc_feature (61): n=t or c
tagtcccactgtacactacttatttctctattgaaaaatgaggacagtacctgattttaangataataacacttcttcatatggtgtaaatctattattaagtctgaatattgaaaccaga

SEQ ID NO: 35393 - DNA, 121 bp, Artificial Sequence
  Synthesized
  misc_feature (61): n=t or g
accaccttctttctaaagaaagtatatgaaaggctaccaaaatatccccgcagatgccacntctggagacacgacccagggcatcctgacctccaagtgaagccgctcacgggcagcacca

SEQ ID NO: 35394 - DNA, 121 bp, Artificial Sequence
  Synthesized
  misc_feature (61): n=c or g
catctacaagtacccagggtagacctggcatcactcttctcttttctactgataccccttngggatggcatggcatggaggatctctgtgtgctctcctctacccatcctatacacacaaa

SEQ ID NO: 35395 - DNA, 121 bp, Artificial Sequence
  Synthesized
  misc_feature (61): n=a or c
gtgatttgtgaatctgattgaaaatggttttagatctttatctaacagactgtagccttantctttgagagctttcttctaccagcctgatttgacttttttcaagaaatgaatatgtata

SEQ ID NO: 35396 - DNA, 121 bp, Artificial Sequence
  Synthesized
  misc_feature (61): n=t or g
ccatcctccaggtccttccaaacgcattgaccagagcctgactgctcaccaggggctgcanttgggcactgacctccaacacgagttctcaccatcctctcgtgcaacttctgttgatgga

SEQ ID NO: 35397 - DNA, 121 bp, Artificial Sequence
  Synthesized
  misc_feature (61): n=a or c
taaggtcccacatttcaaactggtgtaattttaacagagatgtaaactgtaaagacagacncttttttttcactgttcagtgaaatatatgtcctttatgacatatctgtacgtcataaag

SEQ ID NO: 35398 - DNA, 121 bp, Artificial Sequence
  Synthesized
  misc_feature (61): n=a or g
tgttttaagaggcaacaagtgaaagccctcatgctaaagctcatgtactgttccttaatcngggtcaaaaccactatataaaagaacaaacgtaacactgaaaagcatttttctagcatgc

SEQ ID NO: 35399 - DNA, 121 bp, Artificial Sequence
  Synthesized
  misc_feature (61): n=t or c
gtgaactgcacctcacgtcaagttttgctgagtttggcttttggtggtaaaaggctgtaanagagccttcggaagtcgtgtcagagccgtgactgaaagcagcaagctgcctccagccctg

SEQ ID NO: 35400 - DNA, 121 bp, Artificial Sequence
  Synthesized
  misc_feature (61): n=a or g
aaagaaactcctccgcctatgaactcagtgtaccgtgctaaaaggagccgctctgagcccnaaacaagagctgtaaggagctcttcaggaagcactgccgacactggctttcattcctgct

SEQ ID NO: 35401 - DNA, 121 bp, Artificial Sequence
  Synthesized
  misc_feature (61): n=t or c
tcctttcgtagtcctggttgcacatataggtcactgtatcatcagcttgatcctgtcagcnggaaactggcgagactctttccagtgcagcccgagttgtgtaattcgagtaactttccca

SEQ ID NO: 35402 - DNA, 121 bp, Artificial Sequence
  Synthesized
  misc_feature (61): n=a or g
ttgtaattctaagaccagaacctgacaatcagaagacgaagtgtttgaaggcaggcaaaanaagtctgacttcaggctaatttaaatgttttattaaaggttttcatctctatcaccgatt

SEQ ID NO: 35403 - DNA, 121 bp, Artificial Sequence
  Synthesized
  misc_feature (61): n=a or g
atctcattgaatgggggcatcttttgtcagaaggatgccttgcatagcccactgagatacnttaattcaaagcacttagctggggcttggttcgtcttattgagtagtctttcagctccat

SEQ ID NO: 35404 - DNA, 121 bp, Artificial Sequence
  Synthesized
  misc_feature (61): n=a or g
taaataatctccattaataggatttatcagtgcgaatcctttcctgtccacatgagaaganttcttggcaatgttatgcttatggtttacctttccaaagagttgcacgtctctacggttt

SEQ ID NO: 35405 - DNA, 121 bp, Artificial Sequence
  Synthesized
  misc_feature (61): n=a or g
attacaatgaagcattcgctaaacagaaacacaggttgctgtttaagttgtatccatactnaaataaattttgctttattaactatttgtggaagatgataatttataactgctgagcttc

SEQ ID NO: 35406 - DNA, 121 bp, Artificial Sequence
  Synthesized
  misc_feature (61): n=a or g
ctcggtctttccttgccatgagtgccatccttcaactgacatgacctgagagatgacaganctgcatcacagcgtcattaccaaaagaaatgccattggattcatcacatgtcatctggag

SEQ ID NO: 35407 - DNA, 121 bp, Artificial Sequence
  Synthesized
  misc_feature (61): n=a or g
aaggtgctcaaatgccttctcctttgcagtgctgtttacaggtctgctttgctgaaagccnaatgggaaattcctgagtatttctgaattaagttgtgcattccaagatattacgtaaatg

SEQ ID NO: 35408 - DNA, 121 bp, Artificial Sequence
  Synthesized
  misc_feature (61): n=t or c
cattctgtgctcctgtatgcagagctcattgccctgggagagcccacagaagagcactccngtttgtaaacaggaggatcactgctcgccagaagatggattatttgtgctggtttggagc

SEQ ID NO: 35409 - DNA, 121 bp, Artificial Sequence
  Synthesized
  misc_feature (61): n=a or g
catggagggccattgtgtgagggcggtgtgtagagcagaatccatctctgctcacacgaanggaagaagacgacaaccccatcgggtggtgagcagcaaagccgttcctttcccaaaagca

SEQ ID NO: 35410 - DNA, 121 bp, Artificial Sequence
  Synthesized
  misc_feature (61): n=t or c
ttggttgtcagcccttcattaggaatggcatgaaccaaactcacccccacagaaaccagcnggagtcaggaccagggcagaactgatataagcaatgcagaaactgctgtagcaaaagaaa

SEQ ID NO: 35411 - DNA, 121 bp, Artificial Sequence
  Synthesized
  misc_feature (61): n=t or c
ggactggatgatcccagaggtcttttccagccataggaatggattcttagggatcccagcnatagggttgccacatttcacatggggacgtgccccatccaggcatcaaaaggagaggaat

SEQ ID NO: 35412 - DNA, 121 bp, Artificial Sequence
  Synthesized
  misc_feature (61): n=c or g
gagtaaagtgtacaaaaaaaaaaaatgttgtggatattcagcacaggacagaacacttcanaaactcagctttttaattatcttgtctgatttattatttgataaaatctcaaacattaac

SEQ ID NO: 35413 - DNA, 121 bp, Artificial Sequence
  Synthesized
  misc_feature (61): n=a or c
tctgcagagacactgagatacaattttcagctctgggttcagtgatgtcagagacatttanggatgtccaccatttatgaaaattagattgcattggaaaatttttgcctttggctctaca

SEQ ID NO: 35414 - DNA, 121 bp, Artificial Sequence
  Synthesized
  misc_feature (61): n=a or g
cacacttgggccaggcttccctgtcattcagtgttggagagcacagctttgctgaaaacanaaatgaatagcagaggtgactctcattcaggtgctgccattcacacagtgagctcctctg

SEQ ID NO: 35415 - DNA, 121 bp, Artificial Sequence
  Synthesized
  misc_feature (61): n=t or c
cactcatgtttaagaaaacagtgaattttaggcacttagcttcatctacactgagcaacantgaatagatcttcaattcttctctcattttgagttagtctaaattacagcactcaggcaa

SEQ ID NO: 35416 - DNA, 121 bp, Artificial Sequence
  Synthesized
  misc_feature (61): n=t or c
tgttactgtttgaccatacatatgacattctgtaagaataaatgcatatttgactaatatntccattagaacatatgtcagaaacatgtttacagggtctatagagaaatatttgtgaacc

SEQ ID NO: 35417 - DNA, 121 bp, Artificial Sequence
  Synthesized
  misc_feature (61): n=a or g
gctttgtattgccttttgagagacttgaaagaatgttccttttttaaactatcagagctancacaaaagtattggactgagtgaagaagtatctagctaggccagaggcacgttgtaggaa

SEQ ID NO: 35418 - DNA, 121 bp, Artificial Sequence
  Synthesized
  misc_feature (61): n=t or c
aacagcctcagcctatcaggacaagccatgcaccatgcagctgccagccagcaagaataantctaagtaggtcaggcctgcatttctaaaaatgccacggtctagtaaccccactgtcccg

SEQ ID NO: 35419 - DNA, 121 bp, Artificial Sequence
  Synthesized
  misc_feature (61): n=a or g
ggtctctcttcatattactttttgcttattgaaaaagggcaaaataaagaaaacgaggtgnagtcaggctccattgtgcctgctgccagctcactcccttggaaaaaaaacacatgactaa

SEQ ID NO: 35420 - DNA, 121 bp, Artificial Sequence
  Synthesized
  misc_feature (61): n=a or g
ctgttgtgtttccttcctgaatgcacagagttgtccgcattcctaccattccccaggttcngaagtagtgccctggaggtgaaactgaagagccaccggtccttccaggtcatttctgaac

SEQ ID NO: 35421 - DNA, 121 bp, Artificial Sequence
  Synthesized
  misc_feature (61): n=t or c
ctgcaaaaatcctccatgaattcggtcctattgcacatgatgctatcaaagtaccaccaanaccgccactttgaaagaagaggagatgcatacagagtgccctttccagaattacaagact

SEQ ID NO: 35422 - DNA, 121 bp, Artificial Sequence
  Synthesized
  misc_feature (61): n=t or g
aaatgcctgtagctggcgtatgcagcagatttccttgtgcttcattttggttgaatattgnctgatttccattcagataaagatttattccttttgttgtttcttcgtcaggatcctgaaa

SEQ ID NO: 35423 - DNA, 121 bp, Artificial Sequence
  Synthesized
  misc_feature (61): n=t or c
ttgcagtaggtggggagggtggataaagcatcgttctactggttaaaaacagcagttttgngcgcttctctgcttatttcagtttgagatctcctctgaaccaagatgataaaaatgggga

SEQ ID NO: 35424 - DNA, 121 bp, Artificial Sequence
  Synthesized
  misc_feature (61): n=t or c
acctgctgggctggatggagctttgagctgacccgctattggctttgatgttttaatgatnattttaacatagtcagcctcttaattttacttcccaaccctagaacagccagcttttaaa

SEQ ID NO: 35425 - DNA, 121 bp, Artificial Sequence
  Synthesized
  misc_feature (61): n=c or g
ttttgtacagtggaaaatatactgcagagcacttctcatctccattgtttcttgcagtaanctggggaatttttgccctttcagtatctgatggcttagtaaggaaagtatatggagtaaa

SEQ ID NO: 35426 - DNA, 121 bp, Artificial Sequence
  Synthesized
  misc_feature (61): n=a or g
cttctcccctgataagaggtgaagagtatggcttcattagaggagccgaggagggatgggnaggggacatgattgccttggagaaacacaccggggtaaaaccctggggaggaaaaggcaa

SEQ ID NO: 35427 - DNA, 121 bp, Artificial Sequence
  Synthesized
  misc_feature (61): n=a or g
gggtattctttactcggtcttttatgttgtttggacaggaggttgtgaaaaaaatgaaaantttgtaagccctaaaagctgaataataatcgattctgttttctcccatgaaagtgttttt

SEQ ID NO: 35428 - DNA, 121 bp, Artificial Sequence
  Synthesized
  misc_feature (61): n=a or c
tgctgcatcccaatggcaccttaaattcttaaattacagttgagattcatctgcttcaagngtttgatccagaaatcactgggcatgtgctctgcagagcatcagacctgataattggaat

SEQ ID NO: 35429 - DNA, 121 bp, Artificial Sequence
  Synthesized
  misc_feature (61): n=t or c
tgggagtgaatgcttatgaaacaaatagttcagtactgtgcagctatccaaaatgcaacantaattctggcactatgcgatggcctcagcaactgatgcaattctgcaatattaacaggcc

SEQ ID NO: 35430 - DNA, 121 bp, Artificial Sequence
  Synthesized
  misc_feature (61): n=a or g
tttcctgaattatatgaggacacagcaaagaggggatagaataaattcactggtctcctgngagggacacagagatgatttcgctgaccacagtcttgacaggtgtgcacaggccttttat

SEQ ID NO: 35431 - DNA, 121 bp, Artificial Sequence
  Synthesized
  misc_feature (61): n=a or g
ttgaaaacgatcaaaatacctatggacattgcaagacatgaagttgccaacagctgaatcnagcactgacagtaaagcagaagtccaaaagccctctctcagacacaccagtttcctgagg

SEQ ID NO: 35432 - DNA, 121 bp, Artificial Sequence
  Synthesized
  misc_feature (61): n=c or g
ttttaatatactttcctggcacagagtggtatactaatctgtcaaaattctgtatacacantatttataattctactgtcttactttttcctttgtacttacaagtgctttttcctttttc

SEQ ID NO: 35433 - DNA, 121 bp, Artificial Sequence
  Synthesized
  misc_feature (61): n=a or g
gcttttctaccagttcaattctaaattaacttcatgaggaacaaaaaggacaatggccaanggactgatgcatgtctttttcagaagctccatgtcagaccttgtagagatgtaaatccag

SEQ ID NO: 35434 - DNA, 121 bp, Artificial Sequence
  Synthesized
  misc_feature (61): n=a or g
tttgctgaaatcattatcttttttctttttttttaaaccacgatgggagggaataacatgnaaatattgccatgcctcagcactgcaatgggatctccaaaagatgcccaattttagaagg

SEQ ID NO: 35435 - DNA, 121 bp, Artificial Sequence
  Synthesized
  misc_feature (61): n=a or t
cctgaccaatgtgcagccacgtgtgcttttgcaagaatgactggcttaatttttttatgtnctttcccctgaggcacttgagttgattctggaagttccacccattccatccccatctgca

SEQ ID NO: 35436 - DNA, 121 bp, Artificial Sequence
  Synthesized
  misc_feature (61): n=a or c
ctttaatcattcttcaaggttaagaggttcatattttactcccatgtgccatgaccttccntaattagcatgctgttggtatttcacatatgaaatatgaataagctattcattatcacca

SEQ ID NO: 35437 - DNA, 121 bp, Artificial Sequence
  Synthesized
  misc_feature (61): n=a or g
acctccccaccctgccagcttggagaacctcacccaagcggtgccaggatgtgttgtatcncgttgccacggcaactgacatcttacgatgctgaagcaggcggatgcggagtcatgccac

SEQ ID NO: 35438 - DNA, 121 bp, Artificial Sequence
  Synthesized
  misc_feature (61): n=a or g
cctgagggtcaaatccttgcagtaaatctcccttggtcctccatccttggctttgcgcctngctcctttcaaccacaaactccatccctgctctgtgctttcggttcccttccccccagcc

SEQ ID NO: 35439 - DNA, 121 bp, Artificial Sequence
  Synthesized
  misc_feature (61): n=t or c
tgatttaaataaaggatttacctccagcttactgaataacaagcgctgatacaatctgaanggtgtaaggagaaaatggaaggtatccagaaatacagacagccctgaggggtttaaacag

SEQ ID NO: 35440 - DNA, 121 bp, Artificial Sequence
  Synthesized
  misc_feature (61): n=a or c
tttcctatttattatagtactattgtatgaacatatgcaaatgaatgattttcctcatgantgattttcctctgacctttcagctatttgaaaactctaatgaacatattatattcatctt

SEQ ID NO: 35441 - DNA, 121 bp, Artificial Sequence
  Synthesized
  misc_feature (61): n=a or g
acaacagaggcgcgaaaagaattgcatgtgccatccagagcagctcccaggagaaatccangcatggagagctatctcaaaagcagcactgaagcacagagcaggagagcaaggcccagcc

SEQ ID NO: 35442 - DNA, 121 bp, Artificial Sequence
  Synthesized
  misc_feature (61): n=a or c
ttgaataatgctgttaagtttttaaggttctgtttgtgttcataacagtgatcacatttangtagcacagacaaagattaaagccatccaaaaccactaacctgcaaatcactgctctgtg

SEQ ID NO: 35443 - DNA, 121 bp, Artificial Sequence
  Synthesized
  misc_feature (61): n=t or c
atttcctactgtccagtaatatgagctacagatgctgaaagtttttacccgttggatcccngaagctgaaggatttgctctaagcgtggagcagatgtgggctgccaggccagagcagcca

SEQ ID NO: 35444 - DNA, 121 bp, Artificial Sequence
  Synthesized
  misc_feature (61): n=a or c
ttcctaatggatgtcaatattgctttctctcctggtattgaaatgagtaagtttagatatnagttctagtgactactgattttcaatactaaaatcctaagggcttcctaaattttacatc

SEQ ID NO: 35445 - DNA, 121 bp, Artificial Sequence
  Synthesized
  misc_feature (61): n=a or g
ttatacccatgtagtcaggattataacagagacaaccaaaagttcctatgctaaatcctcntgttctcttcccttgtataggcttcttcctatatatactatgtatttgtctcttccagaa

SEQ ID NO: 35446 - DNA, 121 bp, Artificial Sequence
  Synthesized
  misc_feature (61): n=a or g
ggtgaaggctttttttttttttttttccccacaatacctgtatgttattgattcagttgtnctttgatgctgatccttagcttctgtctgcctatgagagcttggccagtaattcctgctt

SEQ ID NO: 35447 - DNA, 121 bp, Artificial Sequence
  Synthesized
  misc_feature (61): n=a or g
ctagcatggccatttgtccacagtgggacaaggcctgatggtggcacagggatggtcctcngtcctcagcaggatgatgccggcaggagaaggggagcaaggaactgctgctgtggggctg

SEQ ID NO: 35448 - DNA, 121 bp, Artificial Sequence
  Synthesized
  misc_feature (61): n=a or g
ggtctctagctttcaccagccagggacgtatacttacaacctccacaatccaactgtcctntccgttttcataaaacttaagggagtatggtatctctggggctggtagctctccatcagg

SEQ ID NO: 35449 - DNA, 121 bp, Artificial Sequence
  Synthesized
  misc_feature (61): n=a or c
aagcacggtgctggggcactgctagcagagaagggaagaggtttacattggcaatttgggntttcatggaccttttgttcttttgaggagatgggaaaccttaaccaatctcttccttgct

SEQ ID NO: 35450 - DNA, 121 bp, Artificial Sequence
  Synthesized
  misc_feature (61): n=a or g
gccagaaatgttactgcttaagttatgagtcatagacttaaaagtaaagaaaaacccagantagctcccatccggaaaaagtatttagtaaagaaataatacatactttcttaaagatttt

SEQ ID NO: 35451 - DNA, 121 bp, Artificial Sequence
  Synthesized
  misc_feature (61): n=t or c
ctagccctggcttcccagtattttgtcaaagtgtttctggctgccaggtgaagtctgactnggaccagaaatgtttgcatctagtgatttttctctttactttgttgccgccttgactgtc

SEQ ID NO: 35452 - DNA, 121 bp, Artificial Sequence
  Synthesized
  misc_feature (61): n=a or g
attttttacatactcacattttccagtgactattccacatttatatcaaactgatttatcntttatgagtcaatatctattagttacattaaactcattctagattttaagaatatcttcc

SEQ ID NO: 35453 - DNA, 121 bp, Artificial Sequence
  Synthesized
  misc_feature (61): n=t or c
ctgtttaatagaatttttgcctgcacaggcccaggcccttacgtttcagtctgtccatacncatatggaggactgccagaatagggaaagaaccttttttttctctctctctttttgatta

SEQ ID NO: 35454 - DNA, 121 bp, Artificial Sequence
  Synthesized
  misc_feature (61): n=a or t
aagagtttctcaagcttccttttaattattcttatttgattgacattcaacaatctaattnacaccgtttgccagtgaaaatcccatttgttccttttcttgtaatacacttttcttctta

SEQ ID NO: 35455 - DNA, 121 bp, Artificial Sequence
  Synthesized
  misc_feature (61): n=a or g
aggagaaatgtgttaattgcccctgcagctcaaggagagcctctccagcccgtggcaggtnctggtctgtgcagagatgaaggtttcatcagatgcagcagctcagttccaggaacctaca

SEQ ID NO: 35456 - DNA, 121 bp, Artificial Sequence
  Synthesized
  misc_feature (61): n=t or c
ctgctcattaaagatcacacggtgttttcagccgaattagctgtgaatctcagtgccagantcactctaggtcagctccgttgctgccgcagcagcttccccaggcaaggaaaagtcttct

SEQ ID NO: 35457 - DNA, 121 bp, Artificial Sequence
  Synthesized
  misc_feature (61): n=a or g
taaggagacggtgattaatttgtagtttttgataaagaaaacttctatgggtgaaattacntgggctgcaaattggaaacatttatttgttgtttataggtctggtactttaatgtggatg

SEQ ID NO: 35458 - DNA, 121 bp, Artificial Sequence
  Synthesized
  misc_feature (61): n=a or g
catgacaatttttgttcgacttatgattcatttgtaagtaacatcaacagtactgcaaccnttgccttagcacgtggctatccagtgtggccttttgaagttctacaaagagcatgagaga

SEQ ID NO: 35459 - DNA, 121 bp, Artificial Sequence
  Synthesized
  misc_feature (61): n=a or g
gatttatttttctttttcttcttttttgctgcattaaatgtctgtgtctgagcattacacntttgctttcagtttgcatatgtgtatgtaagcaaagatgcatacaaatatgcatatctct

SEQ ID NO: 35460 - DNA, 121 bp, Artificial Sequence
  Synthesized
  misc_feature (61): n=a or g
gtctctctttcctctgctaaagcagctgtgctgttcctctgggggcttccctactctgaanccaccactgaagaccctgaagcctcacccacatcactttgtttcacagctctgcccacag

SEQ ID NO: 35461 - DNA, 121 bp, Artificial Sequence
  Synthesized
  misc_feature (61): n=a or g
ataaacactgtgttggagctgaaggacagcgagtgcacgtgggagaggtgtcacctccacngatttatttaccagctgatggggcagggctgactggtgaaggttttcattttatttgctt

SEQ ID NO: 35462 - DNA, 121 bp, Artificial Sequence
  Synthesized
  misc_feature (61): n=t or c
ctgttctaaactcatttagtagagacagtggttaacatacatatgagacaaatttgccctngcttttattaaacttgaatatatgacaaaacaaaccgcaatactacttcccagatgtgtg

SEQ ID NO: 35463 - DNA, 121 bp, Artificial Sequence
  Synthesized
  misc_feature (61): n=a or g
ctagtaagacctttcatttcaaacagctgaagaggcaacaccactacagacagcatgcccntatttaccaaagcattggggacatgttgatggaacaaagcactaaataagtacaaaatgc

SEQ ID NO: 35464 - DNA, 121 bp, Artificial Sequence
  Synthesized
  misc_feature (61): n=t or c
taaacatgcaggtaagttaagctatgctccattctggtccatgcagttctttcagttggangagtgtctaagcacctctagattaaaatctcttgaatgcaaaaactttctgtgctgtcca

SEQ ID NO: 35465 - DNA, 121 bp, Artificial Sequence
  Synthesized
  misc_feature (61): n=t or c
acgatttttagtagcagtcgtatggctaatatactagtagaacctatggggaaaagggcanacttctctctcaaagatgtaattcacatttcaaactttaagatgtcaatttataatttaa

SEQ ID NO: 35466 - DNA, 121 bp, Artificial Sequence
  Synthesized
  misc_feature (61): n=t or c
tggaaaataaaacagtagcattgatgaaatgatgaagagctgttcatttgtgcctgggctngtagcccaagagctgttgtacttgcatacaggttgatgcacaggtaccccgaccattatt

SEQ ID NO: 35467 - DNA, 121 bp, Artificial Sequence
  Synthesized
  misc_feature (61): n=a or g
agtgggatggctcagggatcacagacaacagaagggtttctgtactgagtgttttgtctcngaacacatctgggatttaaactctcgcttgtttagaaggtgtggagcagaggaggaattt

SEQ ID NO: 35468 - DNA, 121 bp, Artificial Sequence
  Synthesized
  misc_feature (61): n=a or g
tagctgtgtcagtgtgacctgttgttctgctggaagtgtgaagcacacgttatagaactcntgtggtttttactgaaaaagcagccagctttggcatttatttctgggttagtgaacagga

SEQ ID NO: 35469 - DNA, 121 bp, Artificial Sequence
  Synthesized
  misc_feature (61): n=a or g
atgttaaggctgcccatctgtccattccccatatattttatctgtactctacttgggctcntctgaattactgaatttataaatttgcttttatttcaattgtagaacagcctcagaggca

SEQ ID NO: 35470 - DNA, 121 bp, Artificial Sequence
  Synthesized
  misc_feature (61): n=t or c
tgaagcactcaagtttcaaatctttggtgtcgggtgacagtgagaatttgaccccagatanggggagatttggtatatatacactcagtaaaacaattaataaaatgcactttgactgtga

SEQ ID NO: 35471 - DNA, 121 bp, Artificial Sequence
  Synthesized
  misc_feature (61): n=a or c
caggtgataactgcaggagggaagactgaactagttcctgcacatctttgatgtcggatgnctaagacggtggaacttcagcaagggagaagctatggaaagtctgtctgccagcataatt

SEQ ID NO: 35472 - DNA, 121 bp, Artificial Sequence
  Synthesized
  misc_feature (61): n=a or g
catacataagtatgtaagactacaaactaaatatataacatactaggaattcacgttctcntttacagataactaaaaaaaaaccagtcaaatgtctgttttggagaggactcgtgacttc

SEQ ID NO: 35473 - DNA, 121 bp, Artificial Sequence
  Synthesized
  misc_feature (61): n=t or c
tatttgcatgtcagggtgagctatttcctcattcctaaagaattgacttgcattataccangaaatataaggaaaacacacagtaaagtttcggctgttgcttatattacaatatgtttgg

SEQ ID NO: 35474 - DNA, 121 bp, Artificial Sequence
  Synthesized
  misc_feature (61): n=a or t
acatgatttcatagagacattatacagaagcttacagctccttcggataattctagcaaanaggaggacatatacaagaacaaagatcttcaaaactacatggaaatctgtagaataaaat

SEQ ID NO: 35475 - DNA, 121 bp, Artificial Sequence
  Synthesized
  misc_feature (61): n=t or c
gcctactggggaagtgtcctgtgagacctgctgtttacatatagagaaggaccagtgggangtgtggtcagaagctgtcctgggcacaatgagcacaatataattgagttctcttcttgat

SEQ ID NO: 35476 - DNA, 121 bp, Artificial Sequence
  Synthesized
  misc_feature (61): n=t or c
acctcgacacatctgctctgagacacgggcatttgtgagtcctctatggactgcgtgcagnccggagacaaagaaatctggcacctggcactggccacggatgcatggggctagcatgggg

SEQ ID NO: 35477 - DNA, 121 bp, Artificial Sequence
  Synthesized
  misc_feature (61): n=t or c
agattcctcttttctttttcatccaagagtggactcctgaggctgcagagctgatacattngatctggtgaagtctaacaaggaagtaaaatatgatacaagcaggcttggagtttgtgct

SEQ ID NO: 35478 - DNA, 121 bp, Artificial Sequence
  Synthesized
  misc_feature (61): n=a or g
gagtgatgctgaagcatcatttccagcccacacggatgggttacccaatgcttgacttccnatggctactcaagcagaagttctgccagccccacagcccaagcaattggatgtcccccat

SEQ ID NO: 35479 - DNA, 121 bp, Artificial Sequence
  Synthesized
  misc_feature (61): n=a or g
ccgaagtattgcactacatttttagagtgcctctgatgtcctgaaaagggcctgagacacnaagagtctgttggtatcccttgatctgcctcgtaagaagggtctaggtcctatttagtta

SEQ ID NO: 35480 - DNA, 121 bp, Artificial Sequence
  Synthesized
  misc_feature (61): n=t or g
gaaagtcctctgaaatggctgtaggcaagttgctcaaagagaagcaagacttggcaacctncatgaagtctcagagtaacaggacagagttccagaagtaagcatcttttcctcacactgc

SEQ ID NO: 35481 - DNA, 121 bp, Artificial Sequence
  Synthesized
  misc_feature (61): n=a or g
agctgacaagtaaaattgagattcaagcctgtacctgttgttgtgcacaatattacctatnctataagcatttttttcctcaaaaaatgttctatttacatatatcttaacgccaggagct

SEQ ID NO: 35482 - DNA, 121 bp, Artificial Sequence
  Synthesized
  misc_feature (61): n=t or c
gcctttatgaaattattattctgcgtaatacaatttcaggcttgaataaatgaatgccatngtgataagcaggctgctgctttgctcaaagatgcaccttaaaaacaatctgctgaaagaa

SEQ ID NO: 35483 - DNA, 121 bp, Artificial Sequence
  Synthesized
  misc_feature (61): n=a or g
caaaacaaaacaaagcagaacaaaacgcaaaccaaacaaaacctaggaaaaataattatcnggactccctgtgggtctggagtcctacttgttcaatacactgacaaatagctgtgttgaa

SEQ ID NO: 35484 - DNA, 121 bp, Artificial Sequence
  Synthesized
  misc_feature (61): n=a or g
tcaaaagaggaaattcagcaggctccatggaagtggaaaaacactgaaagttgacagtcancgttgtcagtacagagaaagaaggtgatattaaatgttacgtttaaattaaagaattatt

SEQ ID NO: 35485 - DNA, 121 bp, Artificial Sequence
  Synthesized
  misc_feature (61): n=t or c
caagaggcgctgcagcaggaagtgacacctgcctgtccaccaccaaaacaatgtgcagctngtctcaggtgcccgccttctctctgcagcaacagcatcatacccttaagaacagttgtct

SEQ ID NO: 35486 - DNA, 121 bp, Artificial Sequence
  Synthesized
  misc_feature (61): n=a or g
gcgcattttactctctttcctctgacagcgtgtgacctgcatggcttccagcgatccgtcnctgggacagagcggctctcctgcagccttaccgatcgccgtacgcctcttgggcagctcc

SEQ ID NO: 35487 - DNA, 121 bp, Artificial Sequence
  Synthesized
  misc_feature (61): n=t or c
atacaatacacacgactcatctctcttcctgtctgcatatttcaaatacacagaaagaagntgtacatctgagtggtacacaccagcaaaatagcaggttttacagtttcttggccttctg

SEQ ID NO: 35488 - DNA, 121 bp, Artificial Sequence
  Synthesized
  misc_feature (61): n=a or g
tctctaggttttactgaaagtaaatgcacagtcctttgagaagtatcccagctctgcagtngcaaaacgccttcatttttgccttggagcagcacgtgaagaatctgaagtgaagagagct

SEQ ID NO: 35489 - DNA, 121 bp, Artificial Sequence
  Synthesized
  misc_feature (61): n=a or g
cccattatcagccacagtttccatctaaatgtttacatatgtatgcatccataaatgtgtntacacaaccatctgagccttgccatggaagaaatgagaatgtttcctgtttctgtatatt

SEQ ID NO: 35490 - DNA, 121 bp, Artificial Sequence
  Synthesized
  misc_feature (61): n=a or g
ggatcctctgatcagccttaagcaaattcattctgatgccaagaagtcctcctctagcagntcctgctttacttttctctgaaagatggatgtgccccatctaccttctttgaaaactacc

SEQ ID NO: 35491 - DNA, 121 bp, Artificial Sequence
  Synthesized
  misc_feature (61): n=a or g
tccccacgttttactttgggtcttgacaacactgtgagactgagacctattggcaagcagncccaaggagcctgtgagtaccactaaggctctgggtcaaaagacaattcaggcagtggag

SEQ ID NO: 35492 - DNA, 121 bp, Artificial Sequence
  Synthesized
  misc_feature (61): n=t or c
ggaaaggttaaggttagctgtaatgctaagctggctctgcactgcgggaggatatggagangtgggtgtcaggagagattcttcactggtttcctcatcaattccaggcaaatacgtgtca

SEQ ID NO: 35493 - DNA, 121 bp, Artificial Sequence
  Synthesized
  misc_feature (61): n=t or c
tgttttacagtcgagtctattcagggcaatcttggtgaggaaaggaatgaattgccccttngctcgctccaaaatccagtgggattattaattccaccagcaaaggggcaaaaggaaccca

SEQ ID NO: 35494 - DNA, 121 bp, Artificial Sequence
  Synthesized
  misc_feature (61): n=a or g
gccaaacagcaaagtgataacaaagaaatgcagttctttgtcctctacaggggtactcatngagtttagcttatgctcctttccttttatgaaatgtctgctgtctttgaattctctctgg

SEQ ID NO: 35495 - DNA, 121 bp, Artificial Sequence
  Synthesized
  misc_feature (61): n=t or c
caactctaaacaacatttctcagaatattcgttagctctgggtttctgatgggaagctccnattaatgccattttgagagcactttaaccccttgtttggaatgtctgaattacgagtgtg

SEQ ID NO: 35496 - DNA, 121 bp, Artificial Sequence
  Synthesized
  misc_feature (61): n=c or g
actggagttagtttgaagggaaaggcagaatatggccgtattctgtgttgccctggaaaanagtggcaggtgtcaagcacttcctgttgcatctggaggatgccaaaagtgtttggcattt

SEQ ID NO: 35497 - DNA, 121 bp, Artificial Sequence
  Synthesized
  misc_feature (61): n=t or g
ggccacccttctccagaaagtctggctcaaatgcgttcggctcacaggcagcttccctcangggcacagctccatattggtaagctattgcacaaattggtttatatttattgcagctaca

SEQ ID NO: 35498 - DNA, 121 bp, Artificial Sequence
  Synthesized
  misc_feature (61): n=t or c
gtaagtccctgtgaagcagtctttggaaacaatactgcagttttttgttcatctataaagngtgtgtgatatacagtgcgtagcagggagattggtgtcctataaagaacggcagtatgta

SEQ ID NO: 35499 - DNA, 121 bp, Artificial Sequence
  Synthesized
  misc_feature (61): n=t or c
aaataaagatggctcttttttatttttattaatgaagtcaggagctagtgctcaggaatantgagctgcaggcgaaatctgggaaggcagaaaatagttcagaggatagagctgcagggta

SEQ ID NO: 35500 - DNA, 121 bp, Artificial Sequence
  Synthesized
  misc_feature (61): n=t or c
ttgacatttctttcatattttcttctgctgtgcttttgtgtgcctgccatgcacacactgngcaatggtgccctacctgactttctttggtagtcccttccagagacagtcgtagcagaac

SEQ ID NO: 35501 - DNA, 121 bp, Artificial Sequence
  Synthesized
  misc_feature (61): n=t or g
ctttgtttccaccttgggcttcttcaatttgattttcatctctgttaccccaatcatactntattttacaaaggtggagtactggtcacccttctctgctgtgccatggggttacctgtgt

SEQ ID NO: 35502 - DNA, 121 bp, Artificial Sequence
  Synthesized
  misc_feature (61): n=t or c
tttttttttttttttcccctcaatggagaagttctgattggttctatcagaaggagatctnttcagagatgccattgattatagtactagtggtctggacacagtatatttactgctttac

SEQ ID NO: 35503 - DNA, 121 bp, Artificial Sequence
  Synthesized
  misc_feature (61): n=a or g
tcaagcttaaatttaatttcagatttgtctctggcagttaaaacagagggacaaactgaanataaagcactaaaacgtgcattaaattaattttctattaatgaatttaaaagatattttc

SEQ ID NO: 35504 - DNA, 121 bp, Artificial Sequence
  Synthesized
  misc_feature (61): n=a or t
aatgtgcttgtatcccataatgctgtatactgcatgtttagtgttctcttgtaatgttganttttttttgaattctgctaaaaagaggaatgcatttaaccctgagatacctgaaaatgaa

SEQ ID NO: 35505 - DNA, 121 bp, Artificial Sequence
  Synthesized
  misc_feature (61): n=a or g
gtataatcccaacagctcacagaaacatttctcctcttcctgtgttgctctgcaacctccncactctccgcacatactgcacaggagcgctccatgttggtacagtgctgatatgcagaag

SEQ ID NO: 35506 - DNA, 121 bp, Artificial Sequence
  Synthesized
  misc_feature (61): n=a or g
aaagaaaatactgagtacatctgattccttcaatcaagtgaaagctgtcacttggctaaanccaagcattgacactaggggaaacgatacaatttgtaacagcaagaaacctaagtcatca

SEQ ID NO: 35507 - DNA, 121 bp, Artificial Sequence
  Synthesized
  misc_feature (61): n=t or c
tggtgaaagcaatatgtcttattgtttgtcactcatctttatgtaacacctcccctgctgnagacaaatggatttgtgtaaactggacgacatcatttttgtgcagtagtagttgtcctct

SEQ ID NO: 35508 - DNA, 121 bp, Artificial Sequence
  Synthesized
  misc_feature (61): n=t or c
ggcacatcagctcaaacagacatgtaaaacaaggaacctctgtagacagaggtacagacanagatgccatttgtgatgttggttctgaagttctctaaaaaccaacggaattgtaagcatt

SEQ ID NO: 35509 - DNA, 121 bp, Artificial Sequence
  Synthesized
  misc_feature (61): n=a or c
agatgaacaaagcaaatgaaaatattgtgatttcttctagctcagactgctctgactgctntttatgaaatagaaacacaaataactcagtgttataagtagcaaatccatcttactttga

SEQ ID NO: 35510 - DNA, 121 bp, Artificial Sequence
  Synthesized
  misc_feature (61): n=a or g
gtctagccctcttcgaaaccactcatctactggtaagaaaggccagggtgtcagagcccanaacacactcaggcaccctctgggacctcccaagccttgtgctcttttcagcacttagtaa

SEQ ID NO: 35511 - DNA, 121 bp, Artificial Sequence
  Synthesized
  misc_feature (61): n=t or c
aggagggacacatccagtatttctcacattcaacagagctctctattttacagcactgccnagactcttttaggtgagccactgcacaaataataagaaggagttctcaagaatttgtttt

SEQ ID NO: 35512 - DNA, 121 bp, Artificial Sequence
  Synthesized
  misc_feature (61): n=a or g
cagcacaaagccgaggggagttctgtgcagtgatggttggtgcagccttcccctgtgtgcntagaggtgatccgtgcacttctgggtctgcatccgctgtcctgaatgggaaaaccccgga

SEQ ID NO: 35513 - DNA, 121 bp, Artificial Sequence
  Synthesized
  misc_feature (61): n=a or t
tatatgtgaaataacaccagttcacatcgtgaaatctatttgtgtgcatgtttctttgaanattctacatcactatttcttactttcctttcacacaggagatttcacaagtacatctctc

SEQ ID NO: 35514 - DNA, 121 bp, Artificial Sequence
  Synthesized
  misc_feature (61): n=a or c
atgctgattttctcggctctttacagacaccctgggccactgcaaaagtctgcttagtagntcacttgtcataaaggattcattgtgtttgtttttaagctaaagtgttataaagggagta

SEQ ID NO: 35515 - DNA, 121 bp, Artificial Sequence
  Synthesized
  misc_feature (61): n=t or g
agtccctctcagcatccttgctttgaggtatgcaatagctgtggtctcacagcttccctgngctttcccctgtgctgagctctcatctgtctccccagcagcttccagcctgggtaattac

SEQ ID NO: 35516 - DNA, 121 bp, Artificial Sequence
  Synthesized
  misc_feature (61): n=a or c
ctgggagctggaatgcagccagggggaaggggtagtcctggtgcggatgtgtgcagggganccaggagcagaggaatggctgggtgtcctcaagtagtgtcaggattgctcagtggtgtgc

SEQ ID NO: 35517 - DNA, 121 bp, Artificial Sequence
  Synthesized
  misc_feature (61): n=t or c
gtatgcaagactacattcagcaagcttactgtgagttaaaaggatgagttggaacaccaanactgtgatctcaatttctatgaaattattggtatactaggaactgattaaggcactgatt

SEQ ID NO: 35518 - DNA, 121 bp, Artificial Sequence
  Synthesized
  misc_feature (61): n=c or g
acacccattgtgactctcatatccttttctgcaaaaagaagcagcacagaactcaggtacntgacttcacattcaccagcaattaatttcaacctaatttaccatccactcacttgtgcaa

SEQ ID NO: 35519 - DNA, 121 bp, Artificial Sequence
  Synthesized
  misc_feature (61): n=t or c
agtatttagtttacaaggatggtgcaagcctgaaagcaccactgtgtgctgagcagttccntgtctttggacgggaagaatcacagatgtgcaaagcattattcttttcatcttcaaagtg

SEQ ID NO: 35520 - DNA, 121 bp, Artificial Sequence
  Synthesized
  misc_feature (61): n=t or c
accagggctgagcaaaatgggaggattatctttcccaactggatgttaacactcctaatanaactcaggatacccactggtcatttctgtggtaagactacattgctagcttacattcaac

SEQ ID NO: 35521 - DNA, 121 bp, Artificial Sequence
  Synthesized
  misc_feature (61): n=t or g
gttggttactggttttatttgcacaacagaagtgaacagaaccgagcatcccttcccaacnctccttccatacgctgagctggaacataaatctgctgcagggagtggaagaggggaaggt

SEQ ID NO: 35522 - DNA, 121 bp, Artificial Sequence
  Synthesized
  misc_feature (61): n=t or c
ttgcagctgaagaggggctcactgattttttctgtgtcaccaaggagagcttaagtaccantagtgaaacgttcccagtgtctcatgtggtttgctcagaccgcaggaggaaccctctgca

SEQ ID NO: 35523 - DNA, 121 bp, Artificial Sequence
  Synthesized
  misc_feature (61): n=a or t
aaataagacaaaactggcctgaagtgtctgacaggtaactttacctgaaattgtgtatttntgtagctctaagattcagagtgtggaaaaagtgctcattcacttgtttgtcactgtctgc

SEQ ID NO: 35524 - DNA, 121 bp, Artificial Sequence
  Synthesized
  misc_feature (61): n=a or g
tgcagggcagcagtgggcaagtactggtctgttgaggtagcgtggcagtgctttcctcatntgaggaataaaactgataaatgagggctgagcgatggcacgagtggatcacaatactgca

SEQ ID NO: 35525 - DNA, 121 bp, Artificial Sequence
  Synthesized
  misc_feature (61): n=t or c
tagttaatcaacttctaagttaattgtcaagtttgctatatcattaagccctcgcagcttnccaatagatcagcacatttcttccagttctacctttctatctctttattttcttacatag

SEQ ID NO: 35526 - DNA, 121 bp, Artificial Sequence
  Synthesized
  misc_feature (61): n=a or g
cactttcctaattgccagctaatgaaatcctttcagcagcacactggtttcacaccatgcntgctagcttatttcacagcaagtctgtcatctcatcacagttttgggaagttgattagga

SEQ ID NO: 35527 - DNA, 121 bp, Artificial Sequence
  Synthesized
  misc_feature (61): n=t or g
tgaagtcgtgacagcatgaactagtctaatgaagaatactatggaatttttagtttcctanttctccattctgtgtgcacatgcaaacagtggcacaaaaattgtacattaccaacaaggt

SEQ ID NO: 35528 - DNA, 121 bp, Artificial Sequence
  Synthesized
  misc_feature (61): n=a or t
gaatacctctgcaaatttcattttatctaaatattttgctccatcacacttagtctctccngagctgatgagcaggtgtctccactgtctacgcatacagttgtgatggatctgttatttt

SEQ ID NO: 35529 - DNA, 121 bp, Artificial Sequence
  Synthesized
  misc_feature (61): n=t or g
ttggaccactcaatgctgtacatgaaacaattcttcttgccttaaaacagtctggattttntttctgatatctggttgttcattccaatgggtaatatggggatacagaggaaagactgac

SEQ ID NO: 35530 - DNA, 121 bp, Artificial Sequence
  Synthesized
  misc_feature (61): n=a or g
gatacaaacacctatcatctccctacacacactgagccaaatcccatcactttttcactcngtaatagcatcgctcaggagctctgcagccaaccatgagaagggagaagcatggagatac

SEQ ID NO: 35531 - DNA, 121 bp, Artificial Sequence
  Synthesized
  misc_feature (61): n=t or g
cagtatttatggcagcacctggagccataattgagtgtgcgctatagatgcgaagatgtgncagctcagcttgaaactcagcttggccattagctccatgtagaggtgagcagggagaagg

SEQ ID NO: 35532 - DNA, 121 bp, Artificial Sequence
  Synthesized
  misc_feature (61): n=a or g
atttgtctgcttgcaagtagactcggtgtacgttcaatttaaaaacctagaatggcttttnttctgtgaaagatgtgtctgtaccttgtgattgtttcatggatccactaccaatagtgaa

SEQ ID NO: 35533 - DNA, 121 bp, Artificial Sequence
  Synthesized
  misc_feature (61): n=a or c
agacacatttcctgtggctgcttcctctgctttttctgaacagtaccttatactgccccanaatcacatcagctggaaagcatcacagaatttattgcctggacagctggcagggagcagg

SEQ ID NO: 35534 - DNA, 121 bp, Artificial Sequence
  Synthesized
  misc_feature (61): n=a or g
aagacacagcttctcaaccatagccttatcttaaaagattcccgtgcaagaattttccccntaatctggagggcattgattggtaatgttcaacccagcagaccttagaagcaaggaggca

SEQ ID NO: 35535 - DNA, 121 bp, Artificial Sequence
  Synthesized
  misc_feature (61): n=t or c
agacaagcagcaaaccctttgatcccaagttgggctctaaagtaatattctgaaagtatangtgagcatactttattcaccagccaattgtgtgacaacctgacagattacaaaagcagaa

SEQ ID NO: 35536 - DNA, 121 bp, Artificial Sequence
  Synthesized
  misc_feature (61): n=a or g
tgccaaccaaaacatactcatgtctccattgctgtaacttgcactacaagtctctatttgntttactgtaatataagagttgtgttcttctctgacagaagtgaaatctgcagttcttttc

SEQ ID NO: 35537 - DNA, 121 bp, Artificial Sequence
  Synthesized
  misc_feature (61): n=t or g
gattaggtattcggtaccgtagtcatgactcaagacttgtcctagttagggctttaacagntatagtataaacaatgggagttttgtccagttgcattttcttcttgatacttagaaaaat

SEQ ID NO: 35538 - DNA, 121 bp, Artificial Sequence
  Synthesized
  misc_feature (61): n=t or g
aatttttaacactactttcttcgatctgttattttatcctctctgtacttcaggaaaattncagtcagatatcacaatattagaccctccttaagaacatcaaaatgttgaattgaaaggg

SEQ ID NO: 35539 - DNA, 121 bp, Artificial Sequence
  Synthesized
  misc_feature (61): n=t or c
catactctgacaaattaattgaaatgaagcttgttaacaagttaattttctgaattcatancattgaaaatgtatcaactatgtacagagttataaagttttgctggtttggcatgaggaa

SEQ ID NO: 35540 - DNA, 121 bp, Artificial Sequence
  Synthesized
  misc_feature (61): n=a or g
ccatttcgtctcaggagagggaaatgcagcagttctggcaggatagaccatgtctacaaanagactgaaaggccatttactgtggggaacagactggatccagtaagctgttagagaaggt

SEQ ID NO: 35541 - DNA, 121 bp, Artificial Sequence
  Synthesized
  misc_feature (61): n=t or g
tcatggacatcaagggttgcattatgatacctttagttacaatttatatacaatagagcanaaatattctgttaaatgaaaccgagagttcagaatctggtaatgttatggtgatgcctgt

SEQ ID NO: 35542 - DNA, 121 bp, Artificial Sequence
  Synthesized
  misc_feature (61): n=t or c
tgtggataattatttaggattttattattgttatttcattcacaaggaagtctcagctcantttaactgtacacacatcaggtatgtagattaatgtagttgcttttttctctctgtaact

SEQ ID NO: 35543 - DNA, 121 bp, Artificial Sequence
  Synthesized
  misc_feature (61): n=t or c
ctgctctgcttgtaccagattcctgaccccatctcagtctctataaatgcaaactgggtantgggaccaagaaattccccccagcagccccagcaccccaacgtatcacttccatatcatc

SEQ ID NO: 35544 - DNA, 121 bp, Artificial Sequence
  Synthesized
  misc_feature (61): n=a or c
cccaagtacagtgatgaaaggctttatttcaaggctttcgcatgaatgagtattcagctgngcccaatatgactggaatttcagcacccataatagaaataattagctctcccagttagtt

SEQ ID NO: 35545 - DNA, 121 bp, Artificial Sequence
  Synthesized
  misc_feature (61): n=t or c
gagcaccgtctggacctgaatatgaagcaggtcaatgaaaacccactgctgagccacagangaaggctcaggtgtgaagacaccagcaaataaattctttccatgcgcatcccatcacacc

SEQ ID NO: 35546 - DNA, 121 bp, Artificial Sequence
  Synthesized
  misc_feature (61): n=t or c
gtggctaacacttcaaggttttaactgttcattgctcctgttgtagttgcttgtaatatangttgccagtgattcatattaatatatagatgaaatatgctgcaaatgaataaatgtgata

SEQ ID NO: 35547 - DNA, 121 bp, Artificial Sequence
  Synthesized
  misc_feature (61): n=a or c
taggaaaagctagtggaaaaatctaagataatcctctcatgagtcttacctaatatctgtnagtatctggtcagttactgataccacacaacaattttcaaatcaacaagaaaaaaaggca

SEQ ID NO: 35548 - DNA, 121 bp, Artificial Sequence
  Synthesized
  misc_feature (61): n=a or t
tcacggcctgaaggagctcacgcaccaggctctgtataccaacaccttccatcagtcaganacctctgtaccaaatataggctttgtacacctcctagagtttctgctgttccaggaagaa

SEQ ID NO: 35549 - DNA, 121 bp, Artificial Sequence
  Synthesized
  misc_feature (61): n=a or g
gctaacaccttgtgcggtcctcttggattaggcaagtattgtgtttgtgcatcagtttacncttaaacaaacaccagtaggatgtttaaatcagtggcattaactgtctggaggatgtggt

SEQ ID NO: 35550 - DNA, 121 bp, Artificial Sequence
  Synthesized
  misc_feature (61): n=a or g
agacgttatattcttgaattgttgcaaggcatttgatttagtactgtacagtactctgcantagcaacctttatgttgagaaatggcacaataagtgggttaagaaccactgttgatggtt

SEQ ID NO: 35551 - DNA, 121 bp, Artificial Sequence
  Synthesized
  misc_feature (61): n=a or g
tttcagaatgttctatccagtgttagcctatttttaaaatgtcatgtagtgagacttaatnttaaagccctctatcgtttatggtcttttaagtctcagctgtttaatgataagaatgttg

SEQ ID NO: 35552 - DNA, 121 bp, Artificial Sequence
  Synthesized
  misc_feature (61): n=a or g
tgcatgtcttccacttcaaatacctccagaggccataataatgtttattttccagtggaancactatcaaaatctctgttgtagctgtgcaaagcaaagtaaaaataacccaagcctaaat

SEQ ID NO: 35553 - DNA, 121 bp, Artificial Sequence
  Synthesized
  misc_feature (61): n=t or c
ttcacagactcaaatctagtaagacaacacaagtcacaagatagacaaacaaaagagtttnatagggggtgccctatttgcagtacaagacattgacatttccctgagcataaccctcttc

SEQ ID NO: 35554 - DNA, 121 bp, Artificial Sequence
  Synthesized
  misc_feature (61): n=a or g
atggcacagctactttgggagaacaaataataaggaaaccactagcctatccttaaaaggnagctaaagaaaacattcagaatcaatcaaattttagggcttgcacacagaaattatggca

SEQ ID NO: 35555 - DNA, 121 bp, Artificial Sequence
  Synthesized
  misc_feature (61): n=t or c
agatattggtattgttcttcagttggtgttgcatcaatgtgctgcaaagttggaggtgcanacagttaaatgaaagatttccagtacttcccagctatgttttttcaataaccacatatgg

SEQ ID NO: 35556 - DNA, 121 bp, Artificial Sequence
  Synthesized
  misc_feature (61): n=t or g
gttattcatattgctacaaaatgttatttttaatccaaacactgctgggtgcatctccttntgccccaggggtagtacaaagtatggtattggcctctatttctgtaccccatttacttca

SEQ ID NO: 35557 - DNA, 121 bp, Artificial Sequence
  Synthesized
  misc_feature (61): n=a or g
taagaggaagactgtggctacatccagaaaaatccactccaaagccatttgctgagaggcnaagttccaggaatagcctaagtacatttttgaaaatgtatttagaaagcaaaaataatct

SEQ ID NO: 35558 - DNA, 121 bp, Artificial Sequence
  Synthesized
  misc_feature (61): n=a or g
aagttgcagtaactctgggtggaaagatgcttcctggggaaagacccatatgggtagatantattgcccaggtgggttaggtgtgtcttggatgtgcttactggggatgctggctgattgc

SEQ ID NO: 35559 - DNA, 121 bp, Artificial Sequence
  Synthesized
  misc_feature (61): n=a or g
cagcaactagtagtacagtaagaaaatacattaatccttaaatacacagttgtctgttacngcatgatgtgatgtgtccctttgaatactgaatgtctgcacattctgatacccgtaatgt

SEQ ID NO: 35560 - DNA, 121 bp, Artificial Sequence
  Synthesized
  misc_feature (61): n=t or g
ctattgtaaatcagaaaatcggccacttctgatgaaaatctgctttgtacccacctccagnctccagccaactctcttgaggctatatatgatacgccattgtcaaccctggtgtcagctt

SEQ ID NO: 35561 - DNA, 121 bp, Artificial Sequence
  Synthesized
  misc_feature (61): n=a or g
ctgaaataacagagctcaatgtccacacgctaaataatcttcctctttcctgccactcccnccccatcactattcctctaattaatgcagacacctttgggagtgagaatcagatgagcct

SEQ ID NO: 35562 - DNA, 121 bp, Artificial Sequence
  Synthesized
  misc_feature (61): n=t or g
tgctgcttaatttctgcttctgggcgttacgtcagtttaatccctcccagtctgagcagtncctcctgccccgacgttacccatgtgtgtttcaggaatgcggcctgagctggctcataga

SEQ ID NO: 35563 - DNA, 121 bp, Artificial Sequence
  Synthesized
  misc_feature (61): n=t or c
acggagaggtcgctgcatctggtctttcccttgttctcctttgggcagccagatcttagcngtttctttttagctattcctgtacttttgagcagcatgagacagtttcttccagttcctg

SEQ ID NO: 35564 - DNA, 121 bp, Artificial Sequence
  Synthesized
  misc_feature (61): n=t or c
ctaatttggtaattaaaggattagaggggtctaaaatggtaataaaaaatgaaatctaaanagtatattggagaaggaaaacaatcataaccatcctaaagccaggatgaattttgatcct

SEQ ID NO: 35565 - DNA, 121 bp, Artificial Sequence
  Synthesized
  misc_feature (61): n=a or g
ctttaaggaatctcttttattttcccacccattccccctgggaaggtatactttggcactnaagaaccatgtttataagatacaaaacaagcactgagcttggatcactctcataaacaaa

SEQ ID NO: 35566 - DNA, 121 bp, Artificial Sequence
  Synthesized
  misc_feature (61): n=a or c
cctatgctttcagaagactgcgaatttgagttttaagcatgggaaatcatccctgattacntctaactaatgaaaatgtcatcagcagaagttaagaactgaaccataaaaaaaaaatctt

SEQ ID NO: 35567 - DNA, 121 bp, Artificial Sequence
  Synthesized
  misc_feature (61): n=a or g
gcaaaagctggctgttgttaagtatgcagatctgcatcactattattagaaaacagttgcnttgcatgaactagtgccaaggtttgccttttggaagaagtcttcccacatacctcatgaa

SEQ ID NO: 35568 - DNA, 121 bp, Artificial Sequence
  Synthesized
  misc_feature (61): n=a or g
gtgcccagcacaccttgtcctgcagacccaagttaacacatctcagggccacgctgtgctntatttaaagccggatccctacagcaggagggttaaaaatagcaaaggcagcaccgaggtt

SEQ ID NO: 35569 - DNA, 121 bp, Artificial Sequence
  Synthesized
  misc_feature (61): n=a or g
tcatattcaattcatgccataatcttcaggagtgcttattgcagatcaggaaaattgtatnctttaaagccaatctaacctcaataactaagaaaactatcagtctccaggggagaaaatg

SEQ ID NO: 35570 - DNA, 121 bp, Artificial Sequence
  Synthesized
  misc_feature (61): n=c or g
cgagtgggatggaaaaccacctcctgtagtcccagccacgtttgtgctgtttgaggcacantccagatcttgttgaggaatcttgagtttatccagttgtgctgatgcttatccttttctt

SEQ ID NO: 35571 - DNA, 121 bp, Artificial Sequence
  Synthesized
  misc_feature (61): n=a or g
tgatgcatttgtttacagctactgccagctttgcaggctgtgggcacaggtttgctcccanttaatacgctgtcaaaatcttgatgtatttaaattcaagaatagatacaattgtacatta

SEQ ID NO: 35572 - DNA, 121 bp, Artificial Sequence
  Synthesized
  misc_feature (61): n=a or g
caacttctgttttttttgtgcactgatactagagtgctctttcaagcagttcccttggcantaaggagcttgttactgtaagtgaatggaaagctctgtcttctggtcatttgctgctggt

SEQ ID NO: 35573 - DNA, 121 bp, Artificial Sequence
  Synthesized
  misc_feature (61): n=a or g
cagaaaaggaagcaagcaacatgttggtccctaatatgaattctggttttactcactttcntgtacatatgttgttcctgtcaattgaaaagtttagctagtcatgggggaaatatgtttg

SEQ ID NO: 35574 - DNA, 121 bp, Artificial Sequence
  Synthesized
  misc_feature (61): n=a or g
tctcctgattaatgttgcaatgtttggaacagcacagggattttaccttgttgaaatagcnccatgttgtaatatagacagagatggtcagactgccatatggaggtagctctgggcccaa

SEQ ID NO: 35575 - DNA, 121 bp, Artificial Sequence
  Synthesized
  misc_feature (61): n=a or c
cacagagctcttttcttccttcttttctcatgttatggttgatatcagcaggctgaggganggacagacagcaaaacactacaatataccatagaagaacgtctggtttccagagagcaga

SEQ ID NO: 35576 - DNA, 121 bp, Artificial Sequence
  Synthesized
  misc_feature (61): n=a or g
cactacataagaatcatatatagtatgattatttaataggagtcatatgattgcaatggtnatgtgaagttctctattgtctgagaagtattttattggaaggctgtacattggaagacaa

SEQ ID NO: 35577 - DNA, 121 bp, Artificial Sequence
  Synthesized
  misc_feature (61): n=t or c
agccacggctgtgaagcaaaagtctcggccaaccgtgactgaatgcacaccgaaaacgagngactcgccttcgcgcacgttaagctgccgctatcgggctctaaggacgccaagaagccaa

SEQ ID NO: 35578 - DNA, 121 bp, Artificial Sequence
  Synthesized
  misc_feature (61): n=a or g
gcctcaagtgttttgaagcgtaggagcactactgatgtgctctgagtggttttctgctttnaaagatgatgttgagcacccagcactgggtggaccccaacatacgccttactgtaacttt

SEQ ID NO: 35579 - DNA, 121 bp, Artificial Sequence
  Synthesized
  misc_feature (61): n=t or c
ctccatcattaatattaagcaatccctgacaataccactctgcgctttcctaaagagccancagcctggtaaacaaacctgcagatgcacagaattcagcggaatgtctcatccagagagg

SEQ ID NO: 35580 - DNA, 121 bp, Artificial Sequence
  Synthesized
  misc_feature (61): n=t or c
tgggcacttttctttgttagttttggaagtgaagtgagagagtgctttcctgcctgcctcnaccgtgcgttaaggagtgcggtgttgccattcttgctagatgaagtcttttattcctgca

SEQ ID NO: 35581 - DNA, 121 bp, Artificial Sequence
  Synthesized
  misc_feature (61): n=t or c
tcttcatctttctttcctctgcagggtttgtactgtgtgtttttgtggctgcttacagatngtacaacttctaaaccttcattcaggtataataatgaaggcaactgcagcatatactggt

SEQ ID NO: 35582 - DNA, 121 bp, Artificial Sequence
  Synthesized
  misc_feature (61): n=t or c
gtggtcacagcagcctgcaaggctcagactaagctcagacacgagcactagggggaaaatntggggaggttttgcccctggaccaaaggattgatcccaatctccttagaggttaaactca

SEQ ID NO: 35583 - DNA, 121 bp, Artificial Sequence
  Synthesized
  misc_feature (61): n=t or c
gctttgctgctgaaattgatctcagcaacttctgctctgcaagggatgcatgggatggctngcaggcatcaacctgcctgctctgaggagctgtatgaaaacgtgcctccgggctactgct

SEQ ID NO: 35584 - DNA, 121 bp, Artificial Sequence
  Synthesized
  misc_feature (61): n=t or c
tgacccactgcattcttctgagtagatcagtaactgaacctgattttagatcctctttcanccttcttttaaattatataaatttaaaagaaaatcaaaagaaaattttaaataaaatttt

SEQ ID NO: 35585 - DNA, 121 bp, Artificial Sequence
  Synthesized
  misc_feature (61): n=a or g
tttcctactcttctttgctgtcttttgagccacctgttcttttcagtatatttatcagagnttggagccttcacattcccatgttggctgaacttcaaaacaaataccatcctattccatc

SEQ ID NO: 35586 - DNA, 121 bp, Artificial Sequence
  Synthesized
  misc_feature (61): n=t or c
ctcacagtaactctccagccgctcttcagcaaaatgctgtactgactcagtcagtaccaanaaaaggattgccagctgctttataagaaacaagtcctaaacacgacaacagctaaggcag

SEQ ID NO: 35587 - DNA, 121 bp, Artificial Sequence
  Synthesized
  misc_feature (61): n=a or t
agggtgtgtatgtttagataagaccaccaattgtttattcctatgtggaaagtgggagggncagaagaaataatggaaaacatccaatctcgcttaggagtgaaggggttaatggtaactc

SEQ ID NO: 35588 - DNA, 121 bp, Artificial Sequence
  Synthesized
  misc_feature (61): n=t or c
agcagcaaagagaccccgagccattctgtggggccgggatcgaggcccctggctgaaattngggcacactttgccttcagttggcaaacctcccctctcccataagcatgcacctcctgcc

SEQ ID NO: 35589 - DNA, 121 bp, Artificial Sequence
  Synthesized
  misc_feature (61): n=a or g
gggcgacaaatgactgctggaggcatatggcttaattacaaacggcagcaggccagagccntcaaatgccaacactgctcccaggtttggaggacaccagcatgggctcgttgtaccaaca

SEQ ID NO: 35590 - DNA, 121 bp, Artificial Sequence
  Synthesized
  misc_feature (61): n=a or t
ggaccgaagtgcccttctgagcaccaaagtgcaaaaagtcaatattgactgaaatgccaanttgatgaaaattagttgtttctttttccttcacagatatacgtgtccagcagcaaacact

SEQ ID NO: 35591 - DNA, 121 bp, Artificial Sequence
  Synthesized
  misc_feature (61): n=t or c
caaaaaaacacgatattttcttctgagaatcaaattaatggacctacaactacccagcccngtaacttaattcctctgttataacaagagagacaaaggaattaaatgttcctgatgattg

SEQ ID NO: 35592 - DNA, 121 bp, Artificial Sequence
  Synthesized
  misc_feature (61): n=a or g
ctggataccaaatgacacaaacccgaggtgtgctgtgagttactgagttgcaccggtgacngcagtggaagtgcccacacgaggtacaacacagggctgcttgccctgcagtgcgtacgtt

SEQ ID NO: 35593 - DNA, 121 bp, Artificial Sequence
  Synthesized
  misc_feature (61): n=t or g
gcactgccgtgggatgggagcaggtcagccctgtactcctgaggcagcggcatacgctcanacagtacaaaggttgtgtgccttaattctgcaaaaatttggggtactttgaatggatctc

SEQ ID NO: 35594 - DNA, 121 bp, Artificial Sequence
  Synthesized
  misc_feature (61): n=a or g
gggggaactcttcagcaatagctacttggcaaaacaaaggactgatacagagctctggcantgagttccaaagccactgctgctaaagggctgcatccatgccctgtttgcctgctttggt

SEQ ID NO: 35595 - DNA, 121 bp, Artificial Sequence
  Synthesized
  misc_feature (61): n=t or c
tccttcctctcccggttttcattagtttgtcaagttctggcaaaccccctgattgggagangaagcagaacgctgcaaacgccccacaccttatgggcggaaagcagcgagctcagcagcc

SEQ ID NO: 35596 - DNA, 121 bp, Artificial Sequence
  Synthesized
  misc_feature (61): n=a or c
gtcatcgtggtgccaccatattgaggtggtcttggtgtcccctcacctaacattgggttcntcatggtgccaccagattggattagtcatggtgtccctccacctgatgttgggttggtca

SEQ ID NO: 35597 - DNA, 121 bp, Artificial Sequence
  Synthesized
  misc_feature (61): n=t or c
cgtgattttacagcacgtgttgttgctttgccacaggtcaaagttgggaataggaggaagnttcctttgctgagggaggtgctggacgcagcctctgacgtagtctggcagagctctgggg

SEQ ID NO: 35598 - DNA, 121 bp, Artificial Sequence
  Synthesized
  misc_feature (61): n=t or g
atgttacagttgtgacaagtatagcactttagagatataacacttggaagaaatccagtantataattgaatatgctgcaaatgaaaatagttgttcataatgtgaccaagtacctttgca

SEQ ID NO: 35599 - DNA, 121 bp, Artificial Sequence
  Synthesized
  misc_feature (61): n=t or c
ctgcagcgaatctccccgtgttaacattcattgtattagaattgcatctaatattgggtgngcagtctgctgcaaccacagcttccctgctcatatgctgcaatatttcacaaatagcagg

SEQ ID NO: 35600 - DNA, 121 bp, Artificial Sequence
  Synthesized
  misc_feature (61): n=a or g
actcataaggtttgggccactaatccagagaaagctcatccaaggcacatctctagaaggncctgagaagaggactcctgtgcttgcatggaacagttttcttcatgactgatgctcttcc

SEQ ID NO: 35601 - DNA, 121 bp, Artificial Sequence
  Synthesized
  misc_feature (61): n=a or g
tgaggggcccggtcagtgggcgtggtggggatgggctggtggttgcacggggtggtcttangggtcttttcttcccacgtaactagcgatgggagtcaggggaacagcctcaagttgcacc

SEQ ID NO: 35602 - DNA, 121 bp, Artificial Sequence
  Synthesized
  misc_feature (61): n=t or c
aaaaatgtgcctgacgaagagacagatcctggatacccagttctcctggggggactgactngaagcaagtgggtgttctccatcatttagaaaccaaagttcattctagtgatagctgtca

SEQ ID NO: 35603 - DNA, 121 bp, Artificial Sequence
  Synthesized
  misc_feature (61): n=c or g
gactcagagtaaataaaagaagtgcatgctacacctcttttggagatgagtggaagaatanataaaaattaatttttcaatattagccagtgcatcagtgacaattgagtactcaagagct

SEQ ID NO: 35604 - DNA, 121 bp, Artificial Sequence
  Synthesized
  misc_feature (61): n=t or c
ccagcagccaggccagcacctggttgcagcagggctctgctgtgccagcctcaaggcagtnctaagtcatgctggaaactctttcagcccagcttctgttcagtttcagggaaacagaagc

SEQ ID NO: 35605 - DNA, 121 bp, Artificial Sequence
  Synthesized
  misc_feature (61): n=a or t
ttctgcataggtctgaagagtttggctatttttctcctctaaactttcattgggttacatngctgttgcttttaatgcttcttaaggtttattttaactgcaagcagcctctgtgacaatg

SEQ ID NO: 35606 - DNA, 121 bp, Artificial Sequence
  Synthesized
  misc_feature (61): n=a or g
aggccaaacagccagtatgagggccctttttaacactgccttaaactatactcaattttantcacaggctttaagactgtggtggcgctttgcaaatcatcactaaataccttttcttcat

SEQ ID NO: 35607 - DNA, 121 bp, Artificial Sequence
  Synthesized
  misc_feature (61): n=a or g
attttaggctgcttcctcagtgggctgatcctgcgcccttaccagctcccacatgaaggcngcagtgaaacagaacatctggacatgaggctagttacttatatggctaaaatcagattta

SEQ ID NO: 35608 - DNA, 121 bp, Artificial Sequence
  Synthesized
  misc_feature (61): n=t or c
gtctgcagtttcttctgcacttggctactttctgcccctgggaattcagccttgcagcatncccacatttttcaggtcatttacacgtctggacctacagcacactttttttaatcttttt

SEQ ID NO: 35609 - DNA, 121 bp, Artificial Sequence
  Synthesized
  misc_feature (61): n=a or g
gagcacttgggctgcagatctcccacaaaacacaatggttcctgaaggcccagcctcaggnagggatgatgctgggaggtgaggatttcttttccttcctctgaacgggaaggggatctgt

SEQ ID NO: 35610 - DNA, 121 bp, Artificial Sequence
  Synthesized
  misc_feature (61): n=t or c
caaaggaaaccagatgtcaggaattgtgctcggtgtgttggattacatccttatcttgcangtccaggttatggcttacaggatataatacacagagagtgtactctagaatatataaaac

SEQ ID NO: 35611 - DNA, 121 bp, Artificial Sequence
  Synthesized
  misc_feature (61): n=t or c
tatgcttcatagtgtttgcttcactttcataggatatattgctacttaaggagacaaattnctcagctctctaacaatgcctttctgaataaggcacctgcagcctttttccacctgcttg

SEQ ID NO: 35612 - DNA, 121 bp, Artificial Sequence
  Synthesized
  misc_feature (61): n=a or g
gtaggagaaaatatctttgttcagcagccggaatatctcaatctgagtgagatgagttacntgctgctcccagaataggctgttgttggcactcagcgtggctggcagtgagggctgactg

SEQ ID NO: 35613 - DNA, 121 bp, Artificial Sequence
  Synthesized
  misc_feature (61): n=a or t
aaaataatgcctggaaactatgtttggatgcctacacctcagggaaaaggaaaatgattcngctgagagtccaccgtagatatctttgcataattatttcctcatgttttataagggactg

SEQ ID NO: 35614 - DNA, 121 bp, Artificial Sequence
  Synthesized
  misc_feature (61): n=a or g
ggtttcacgtttgcgactttgtccctattagcattagcaaatcacaaggcaaacactgaanaagtgtagcatcctgccttaaaaatcacaagattttcagttaagtattaggggttttttt

SEQ ID NO: 35615 - DNA, 121 bp, Artificial Sequence
  Synthesized
  misc_feature (61): n=t or c
tttctattcactcagcaagagaagggtttaaaacgacaaacttttctcacagcaatgccanaaccagtttgtactgtgttcagagtccagggatgatctttttcactttgttccaatatat

SEQ ID NO: 35616 - DNA, 121 bp, Artificial Sequence
  Synthesized
  misc_feature (61): n=t or c
gtgcccagctcaaaacatgatgccactccagcatctgcagtggtctgaatgttaagctganggtcagctatgtaatgtaattacacgtttccagacacaactgctcctgacctggcaacta

SEQ ID NO: 35617 - DNA, 121 bp, Artificial Sequence
  Synthesized
  misc_feature (61): n=t or c
ctgatcattattatcaaaaccctgaggcactgtgggtttgacatggttaatgtcataatgngggcttacataaatgctgcataaatctatactgttttatttatttgattttgaaaactgg

SEQ ID NO: 35618 - DNA, 121 bp, Artificial Sequence
  Synthesized
  misc_feature (61): n=a or g
gtggatgctgcatccccgctggttactcatgattgatgtctgtgaatttaggacttggccntgacttggtgcattctcccctggacaaggacaacaccatctgttccatactatctctata

SEQ ID NO: 35619 - DNA, 121 bp, Artificial Sequence
  Synthesized
  misc_feature (61): n=a or g
aagagctttctgtgtctttcctacacagaaaaggaaagcacactgtgacattgaaccaatnatacaaaatttgtaagacagctataagcacaattctaatttcttttcagcagttttgatg

SEQ ID NO: 35620 - DNA, 121 bp, Artificial Sequence
  Synthesized
  misc_feature (61): n=a or g
tttgtaatgatgcttttcacaagagatatgcaagtatttacatcaaacgctgcacttatcnaactaatatttctatcaattacaagagcccacattactgtctttggattcacaattttaa

SEQ ID NO: 35621 - DNA, 121 bp, Artificial Sequence
  Synthesized
  misc_feature (61): n=a or c
ttgcttcctgaagatcactgctttgcatcatgcaccatcacaactacctaggaaaaaaaancagtcattttaagctccagttacctggacaacaggatatattactgcttccagttcagat

SEQ ID NO: 35622 - DNA, 121 bp, Artificial Sequence
  Synthesized
  misc_feature (61): n=a or g
cagacatagcattggaccctcggtatgggctgacagcttggaaggataagcctgatacacngatgaaatctgtgccttgtgaaaatttattgctgttcttgttgatgacagaactgtgcac

SEQ ID NO: 35623 - DNA, 121 bp, Artificial Sequence
  Synthesized
  misc_feature (61): n=t or c
cttgctgtctggaaacggttttgttttggaagggttaatcctgggagcccccaggatctgncgcctgcccagcatgactcattgctgagctcccagcctcccccaggctctccgggggagc

SEQ ID NO: 35624 - DNA, 121 bp, Artificial Sequence
  Synthesized
  misc_feature (61): n=t or c
tcttgcccctgtatcctttaagttatgcaaaataaaataccccccttataaaagtgcaatngcatctgttgtatttaaagcacaaattttaattgcgttctggaaagtagcatgcaacaaa

SEQ ID NO: 35625 - DNA, 121 bp, Artificial Sequence
  Synthesized
  misc_feature (61): n=t or g
agacttaggtattctttggtagttatttgccctaatagtagaataggaaggaatcagaagncaaaaaacatcagtatcaagtttgtccctattctcttgagtgtcatttaaagaggaacat

SEQ ID NO: 35626 - DNA, 121 bp, Artificial Sequence
  Synthesized
  misc_feature (61): n=t or c
ttgagaactaaaaatattcttggttggttggattttaaggataggctgtgctgtgggaaanactgtagttttcaaagtggggattgattttgctccctctgaaatcaattcagggactcct

SEQ ID NO: 35627 - DNA, 121 bp, Artificial Sequence
  Synthesized
  misc_feature (61): n=a or g
ctccatagctttcctctacagctcctgggaaaggttgtttaaacagtggttttcttgtctngctgtttttttggtggttggatggttgtgggattttttgggggaagaggaggagatggcg

SEQ ID NO: 35628 - DNA, 121 bp, Artificial Sequence
  Synthesized
  misc_feature (61): n=a or c
gtgctgaaggagcaaagagagcttgtgaagcacaactgcgtgctgagatctgctgtcaccnacagctgggacccagggacagatcctccacctggccacaccgggcactgcagccatgaaa

SEQ ID NO: 35629 - DNA, 121 bp, Artificial Sequence
  Synthesized
  misc_feature (61): n=t or c
tcatccatgtttaaatgaatttgggtccttggattaataattgtaaacatggtggaataangaccagtgacttgatgggtgtccagggtgaacagatgatgagatctgtgctcagcctgtg

SEQ ID NO: 35630 - DNA, 121 bp, Artificial Sequence
  Synthesized
  misc_feature (61): n=a or g
ataaagtttacttgaacacatatgaacctatcctaaatctactagataagcaagcaggaancaaaattctcaattcaccccaaaagtttctagaaatttcctttttatctgctggcaccat

SEQ ID NO: 35631 - DNA, 121 bp, Artificial Sequence
  Synthesized
  misc_feature (61): n=t or c
tctcctcgtctgtcatcagtgcagatatttaaatgcatttattgctaggaggacaattttngtaatatttagaacaaattgttcccatttaacatcagcactgggctttgagcctgagcat

SEQ ID NO: 35632 - DNA, 121 bp, Artificial Sequence
  Synthesized
  misc_feature (61): n=t or c
agactctgattttaaactcatgctcaagctgcagaagcttaattcacagaacttagaaatngctaaacacactagtgaaactgcagtgttctgatacagagctgtttcctttgtggaatgt

SEQ ID NO: 35633 - DNA, 121 bp, Artificial Sequence
  Synthesized
  misc_feature (61): n=t or c
gtctcccatgatgtgagtgccaactgagcaatcaaaagtctgtcgtctatgcagtagatanctttgagaacaaaacacttattatttcacagctcaggaaataaatattctttctattttg

SEQ ID NO: 35634 - DNA, 121 bp, Artificial Sequence
  Synthesized
  misc_feature (61): n=c or g
atgcttgcctttttaaatatatatattttaaaatagttacttgtctctgttaaacgcacanaatgtgtttattgtagagagtcacaggaaacatgagttcagtttcaggggctgttacgat

SEQ ID NO: 35635 - DNA, 121 bp, Artificial Sequence
  Synthesized
  misc_feature (61): n=t or c
catagcaagtgctgagcccagcctccgaagacactctgacggggttagttggcccccttantgggatttcagtgaaagaaaaaagtttggcaacttgggaaggagggagtggaactattat

SEQ ID NO: 35636 - DNA, 121 bp, Artificial Sequence
  Synthesized
  misc_feature (61): n=a or t
caaggagatccaagtgctatattcatacaatagacaagaacaagttgttccagtgacaaanacaaaagacgaacgataggataacctttgcgataaagactgtgaatttcaataagaacta

SEQ ID NO: 35637 - DNA, 121 bp, Artificial Sequence
  Synthesized
  misc_feature (61): n=a or t
tttgtgcttgaatttgactttctgtccagacactgacagatgcctttaacaccacttgttnggacttataaatctatctcagcagctagctgtaattggtttaaaagtcagggacttagct

SEQ ID NO: 35638 - DNA, 121 bp, Artificial Sequence
  Synthesized
  misc_feature (61): n=a or g
ccttgtttttgtttacttttcctctctgctctaaaaagggcagcgagcaccttcacagacngggctgtgaatcactcccagggacctctctgcctgtgccctgtcaagcagttatgctcag

SEQ ID NO: 35639 - DNA, 121 bp, Artificial Sequence
  Synthesized
  misc_feature (61): n=a or g
agcaagaatcgttgaggtgaatgtgtaggttttaattctgcattaaagcacagggcctgtnctaactgaaccctgctgtgctttgcatctacccggttacattactggtgtaccttctgtg

SEQ ID NO: 35640 - DNA, 121 bp, Artificial Sequence
  Synthesized
  misc_feature (61): n=a or g
caaggtggagtggctctgcttcctggtgcgagtctgtctatggaggtggctcttctgctgntgggtatcaatctgtgaacacagaaccctgccctgtccttcataggcaggtgtacaaatc

SEQ ID NO: 35641 - DNA, 121 bp, Artificial Sequence
  Synthesized
  misc_feature (61): n=a or t
tgaaatcagggagattatacacagtggttgtcaaaggatggccatctcatacatccacagngtgtaatcatactactcctttacctacccagtgcaacatttgttattgtcgatgtttttc

SEQ ID NO: 35642 - DNA, 121 bp, Artificial Sequence
  Synthesized
  misc_feature (61): n=a or g
gtgccatctgtgtatctaaatgcctgaatttactcctcttaatgtcaatatgcatcgcacngcccaggagttctcttcctgctcatgcaatagataaacagttgtataacagctacacaca

SEQ ID NO: 35643 - DNA, 121 bp, Artificial Sequence
  Synthesized
  misc_feature (61): n=a or g
agaactgaaaccaaagcagaagaaaaactgcatgctttctttctcaaatctggagcatacntggtgacaacagtctgctgtggagatagcatgacaagatgacaacacaagactgtggaga

SEQ ID NO: 35644 - DNA, 121 bp, Artificial Sequence
  Synthesized
  misc_feature (61): n=t or c
tcttagagcaactcgcccaaatgtaatttcaaacctctaaggaagtgatagagttggcacngcagctctataaaacttgtctcattgaatcaagcctctttgtgataagctttcaaggttt

SEQ ID NO: 35645 - DNA, 121 bp, Artificial Sequence
  Synthesized
  misc_feature (61): n=a or g
tttaaaatatgccctcgctttatgctgtacagcgatattttaatttacagtatgaaagtangtctcttccagaaccttttacttgtttattaacacaagaaaagagaagctgctcaaaaat

SEQ ID NO: 35646 - DNA, 121 bp, Artificial Sequence
  Synthesized
  misc_feature (61): n=t or c
ctgtggaaacttaacattcttccagctcccagcaagcatgcagttacagtgctgcaggctnccagtatgcttttagtgcctgtcctgtcctggtggtgccctgtagctgcacaaaagggag

SEQ ID NO: 35647 - DNA, 121 bp, Artificial Sequence
  Synthesized
  misc_feature (61): n=a or g
gttcaagcattatcaagtaaattaatttttttttttccctactcagagtttttgtttgaanctactcttcaaaaatgagtataattggagttttctctctaaacagtacattttaatattg

SEQ ID NO: 35648 - DNA, 121 bp, Artificial Sequence
  Synthesized
  misc_feature (61): n=a or g
aactgattcatgagtattcattcatgagctcattttaagctaaaacatgctgatgatcacnaagtatgagtagttcaaagtaaagtcatgtttacaagaaacaaagctcaggttctaatat

SEQ ID NO: 35649 - DNA, 121 bp, Artificial Sequence
  Synthesized
  misc_feature (61): n=a or g
tgagactgctaaccattgtgttcaacttgtcttattcccttgcttttcttttaatacatgncccattattcttagccacatctgttctgggaaatattaacacagtagctatctggcttta

SEQ ID NO: 35650 - DNA, 121 bp, Artificial Sequence
  Synthesized
  misc_feature (61): n=t or c
aagagctacattttgaggtgctgcaagggtgaattaaaattctagactttccagaacaaantggaaaaaaactaatttcaaggggtctggaaatttactctcaattgtcacagttacttca

SEQ ID NO: 35651 - DNA, 121 bp, Artificial Sequence
  Synthesized
  misc_feature (61): n=a or g
ttattcagtgaaattccagagtatcttaagctgctcatagttcaaatgaaaactcctgcantttgtaaactgtcaaatttaatacaagatcttagtgctaataggatttgattgacttcta

SEQ ID NO: 35652 - DNA, 121 bp, Artificial Sequence
  Synthesized
  misc_feature (61): n=t or c
tctttttatacctctaatataaggtaataacaagccatcgtgaaataatcttgaatagatnctagtgaggggttttcctaatgcagagtccatgctccgtgcacacacctctttggtgcaa

SEQ ID NO: 35653 - DNA, 121 bp, Artificial Sequence
  Synthesized
  misc_feature (61): n=t or c
aaaatagcttttgtacgttcaaaacttctcaataagcacattgtatagttggggtgaactntgtgttacttatcaacaagcaactcctacacatccaaactatcactgagcacgatgcaag

SEQ ID NO: 35654 - DNA, 121 bp, Artificial Sequence
  Synthesized
  misc_feature (61): n=t or c
gcatggctcatttcctaaaggttggaggagggactatgactgagcaaaaaggtcagtaaanagtgaatagtccttgcaccttcatggaatgttatactgatgctcttttctgactgaccat

SEQ ID NO: 35655 - DNA, 121 bp, Artificial Sequence
  Synthesized
  misc_feature (61): n=a or g
atggcacagcagtggggatggcggccatggcgtgaggacaagactgaggcctgctgctacncgcagcttgagttgctccaagcacaaggtgactggtaccagaggaacaccgaccccgtgc

SEQ ID NO: 35656 - DNA, 121 bp, Artificial Sequence
  Synthesized
  misc_feature (61): n=a or g
acaggcaggagttgctaaatgcaggcagaccccactgctttcacaccttcacctgggagcnttcatctggcaggcaagagggtttgctccccatttaaacgcagtgcgttctgcagtgcct

SEQ ID NO: 35657 - DNA, 121 bp, Artificial Sequence
  Synthesized
  misc_feature (61): n=a or t
gcgctatgcaggagttctgcagctttctttttgtcctgtgtttttgagataacacatgacncataaaggagtcctggcatccttgcaggaccagcttgtacagtagttgacctgtgctctc

SEQ ID NO: 35658 - DNA, 121 bp, Artificial Sequence
  Synthesized
  misc_feature (61): n=a or g
acctctccagctagcagggactttatggaaaccaaataaggtgacaggttctactgaatanggcccattctccaaaataaaaccaattaacccagagtaaatcttggaaatcgatgactcc

SEQ ID NO: 35659 - DNA, 121 bp, Artificial Sequence
  Synthesized
  misc_feature (61): n=a or g
gtaatccacagtacatgacattttaactggtatttgctgaggcactcataaaattctaaantactctagtttttgaaacgcatctgtataaattaactaaaacgtattaaaagtaccataa

SEQ ID NO: 35660 - DNA, 121 bp, Artificial Sequence
  Synthesized
  misc_feature (61): n=a or g
ttcagttttttgcatttcttctctttaaatcatacagttatgtttattctggtacctgcangaaatgtccattcttaatatgtttgtacaggacatggttttcaattttcagacttatttt

SEQ ID NO: 35661 - DNA, 121 bp, Artificial Sequence
  Synthesized
  misc_feature (61): n=a or g
cttgttccaagacccaaacttgatgagcatttattgatggaattcagagggactaaactgncctttctatgctcagtacttttaaaggtcattggtagattaggacagagagtattgactt

SEQ ID NO: 35662 - DNA, 121 bp, Artificial Sequence
  Synthesized
  misc_feature (61): n=t or c
ttcaaaaaaaactccccttttctacccgttcatacaaagcaaacaaactctaaataattcnccccctcccccacctcaaaactccaagttagtgtttgtaatgtcaggtcactgacgagta

SEQ ID NO: 35663 - DNA, 121 bp, Artificial Sequence
  Synthesized
  misc_feature (61): n=t or c
catagcgcaaatacttttacttcctttcagctttatattacagcttccagtctgtggaaanatttgcccaagcttgatccaaatattcctttcagaagtttttagcagtctaatcatatct

SEQ ID NO: 35664 - DNA, 121 bp, Artificial Sequence
  Synthesized
  misc_feature (61): n=a or g
gctgtggagctgcaggaggagcgctgcaggcaatgagaaggaaggggggtgtgaggacacnctacctggccgtgcacagagatgtcaaagcggatgccatagagcttcagcaggctccggt

SEQ ID NO: 35665 - DNA, 121 bp, Artificial Sequence
  Synthesized
  misc_feature (61): n=a or g
tgggcatttcacctgtgcgtaatccctgcttaagttttgtgtgtgagtattccagtgacancattagccactgtgcttttaatcactaaattgctttgtagattttgaataactgtacatt

SEQ ID NO: 35666 - DNA, 121 bp, Artificial Sequence
  Synthesized
  misc_feature (61): n=a or c
gatttctgaactgtcctcttaatcagactgagtctatttaacgcagttgactcctgctagnttttggtgctaggtgaagttgcatattttgctgttgtttttatatgtaatttgcatctta

SEQ ID NO: 35667 - DNA, 121 bp, Artificial Sequence
  Synthesized
  misc_feature (61): n=t or c
aaatacagaaggcccttcagaagcaggttgtgctggcatcaaacgggcacagagccacgcnagataaacaaatgtcagccaacaagagccagagggaggacggtgtttatgctgcagagca

SEQ ID NO: 35668 - DNA, 121 bp, Artificial Sequence
  Synthesized
  misc_feature (61): n=a or c
ctcccaaggctgtgtccagatgactttctgagtcttgccttggctactgtccatcactggncagtgtgtggaaccaggtctggaagggagtgggaaaaatagagagagaggtaagtcagtc

SEQ ID NO: 35669 - DNA, 121 bp, Artificial Sequence
  Synthesized
  misc_feature (61): n=a or g
gatccccaaaaccccataccacactgtaaaattgcaccgaaaatgaaaaaaaactcttccnaaatgtaataaaggcatccccacccaaataccaacaaaatacaccataaatttaataact

SEQ ID NO: 35670 - DNA, 121 bp, Artificial Sequence
  Synthesized
  misc_feature (61): n=t or c
catgtttccagttcccctccactcacgaatcatctgagaaatgggtgatattttggtctcngatcatcctgccagcacaaaaggaacaaattttgttctaccatctcctatattcactcat

SEQ ID NO: 35671 - DNA, 121 bp, Artificial Sequence
  Synthesized
  misc_feature (61): n=t or c
taactgcaggctttagctgtctctgaggaaaaactccctgcctgcaagcttcttacactcnttgcagccagcttctgtgacatggaaagacgatgagctaaaacagcataactctggtctt

SEQ ID NO: 35672 - DNA, 121 bp, Artificial Sequence
  Synthesized
  misc_feature (61): n=a or c
ttttatttagattttaagtacttctttttagaaaggccttttctatagaaaatgttctganagggtttactggggaaagggaaatattgcagaggaagggcagcattcattttatgtgcat

SEQ ID NO: 35673 - DNA, 121 bp, Artificial Sequence
  Synthesized
  misc_feature (61): n=t or c
agccaatgcagagagtgaaaaggtggctcttttgggtgaatgggtaatagtaagggcaaanaagagcactcacatctagaagaagtctgttgatcactgcttacaaagtgcgaagcgtctg

SEQ ID NO: 35674 - DNA, 121 bp, Artificial Sequence
  Synthesized
  misc_feature (61): n=c or g
ttttttaaataaatatttgtaccttcttagtagtatttatgtacttaggaacaaaaatatntcagaatgagttacaaaaaggaagatctccaaccatggtcagtgctttccccaaatccta

SEQ ID NO: 35675 - DNA, 121 bp, Artificial Sequence
  Synthesized
  misc_feature (61): n=t or c
taactgccagcaacgtgttcttgtgaggttacatgccagaacctagaggaggaaatgcttngttgttctaacatacacagagtgaaaccagggcatggaagtatgtatgttcaatattcta

SEQ ID NO: 35676 - DNA, 121 bp, Artificial Sequence
  Synthesized
  misc_feature (61): n=t or c
tgctatgcaatgctttgtttcactgcttttggtgctatcagcctcatggccctacagtcangacttctactgccgattaggatgcttactttggtttactttgctcccacgtacaacacgt

SEQ ID NO: 35677 - DNA, 121 bp, Artificial Sequence
  Synthesized
  misc_feature (61): n=t or c
tttcagcaatgagcgcccctggtccagatgcagagcagagcagacactctcccttctgccncaatgattctcacatccccattttgaggctgcagacatctggggaggctccggaccgcac

SEQ ID NO: 35678 - DNA, 121 bp, Artificial Sequence
  Synthesized
  misc_feature (61): n=a or g
ctcaggttcccctgagctctgaaattcgatggcacgtggatcgtgtgatctggatgagccntggacaggcagaccactgctttgtccatggacacttggctgccagtggtgatagaagaac

SEQ ID NO: 35679 - DNA, 121 bp, Artificial Sequence
  Synthesized
  misc_feature (61): n=a or g
cttagcagaaatacaaactattggtccactcatgttctccagaaatgataaattcatacancttaaatagcaaaaaatcaaactaaaagaaacagcattcaatccctgtgtgcaatccata

SEQ ID NO: 35680 - DNA, 121 bp, Artificial Sequence
  Synthesized
  misc_feature (61): n=a or g
atgtgagccacctctgtccattactgctgcctcccagccaggtctgctttccatctgggcntcagtcagccctgaaaacatgacctgcttccaacgtgtggcttcacaagtggtacgtaag

SEQ ID NO: 35681 - DNA, 121 bp, Artificial Sequence
  Synthesized
  misc_feature (61): n=a or g
ccagactgaaaacatatctaagcaggagtggactgaatccaagcagcccacagtgagcacnctgaggccgagcatcctcctgttaaaaaagacaatggaggcaccagaggcttttaacttt

SEQ ID NO: 35682 - DNA, 121 bp, Artificial Sequence
  Synthesized
  misc_feature (61): n=t or g
taaaaatgacattatagaaattacagaagttatgataaattttgctttcccatgggaactncaagggcaccaagtgttccgctaaagtattctacttacaggctgcatttatttagtctgt

SEQ ID NO: 35683 - DNA, 121 bp, Artificial Sequence
  Synthesized
  misc_feature (61): n=a or t
ctgcagaaattcctggttgtttacatgggaattacaccagagactgctggcaagaaaggancttacaacaacagcatctccagccccagaaatctcccagcatacctggagcaggcctggc

SEQ ID NO: 35684 - DNA, 121 bp, Artificial Sequence
  Synthesized
  misc_feature (61): n=t or c
acagctggggatggggatgctggggacagcagtggatgtttcatggcatggactagctgantgtgtgtttccacttcctctggaaagggtttttccatctccaaaggctggagaaaagcca

SEQ ID NO: 35685 - DNA, 121 bp, Artificial Sequence
  Synthesized
  misc_feature (61): n=t or c
aaatcactccagatgttgcttaactttatgctagaacagtatccaaagatggaaatgaganagcaatcaggcacaagcccttctcccaaatcttctatcctctatttctaatagcaagtct

SEQ ID NO: 35686 - DNA, 121 bp, Artificial Sequence
  Synthesized
  misc_feature (61): n=t or c
acacaaaaacaagtaagtagaagtacaatttctaatctttgcagcaatcagatttctatcngactgcagagccagaatacttttaagagaatactaaataattttgttcaattaatccaac

SEQ ID NO: 35687 - DNA, 121 bp, Artificial Sequence
  Synthesized
  misc_feature (61): n=a or g
ggcgctcacgatctacaggaataccttactatttagatatggtaaaatgcttcagaatccnaataagttaccaatcaaaaagatttttaccgtttaaggttttcagaaattctacttgcct

SEQ ID NO: 35688 - DNA, 121 bp, Artificial Sequence
  Synthesized
  misc_feature (61): n=a or c
gagcgtgaataaggtcactgcaccagtgtggatatgatggaggttctgaagtttatagccnaacagttgggtttgaggtgcatgcacttggataaaaagaattactctatttccttttgct

SEQ ID NO: 35689 - DNA, 121 bp, Artificial Sequence
  Synthesized
  misc_feature (61): n=a or g
attgactatttctctgtgtttttcacgtcaaaagtgtgataaattgtcaatgtagtatacnggtagtcctaattttataataatcattgtaacagcagaaggaggcaagaaaaggctctgg

SEQ ID NO: 35690 - DNA, 121 bp, Artificial Sequence
  Synthesized
  misc_feature (61): n=a or g
ttgaaaaatttaccaccctgaaatacagtttgttgttttgtgggtccagaccttcttgggntcctctttaaaatcctattcctactgaatttgcaagagaatacatatgcccaacattgtt

SEQ ID NO: 35691 - DNA, 121 bp, Artificial Sequence
  Synthesized
  misc_feature (61): n=t or c
attaccagctgttagaacttgggagggtaaattttactggaggaacatgggaggaatggcnctgtcctgatctgcttgctatgcaactgcctctggctgctgtttgatactattttctgtg

SEQ ID NO: 35692 - DNA, 121 bp, Artificial Sequence
  Synthesized
  misc_feature (61): n=t or c
tgctacagtcagtgtttaacatgtctgtgcttcggttggcctgcatgcctcaaggtcctcntccccaaacccaatggagtgtgagcatccacgtgtgttgaactagatgatctccagaggt

SEQ ID NO: 35693 - DNA, 121 bp, Artificial Sequence
  Synthesized
  misc_feature (61): n=a or g
ctgactcttgtgggtgaggctgctttccagctctgctggggacatttggtgacaccaatcnacaaataaccactgggctgtccaacaacacgtatcacattgccatcccctccctgggctg

SEQ ID NO: 35694 - DNA, 121 bp, Artificial Sequence
  Synthesized
  misc_feature (61): n=a or g
tgcttggtgccttctcagtgctgacatccaaacagttacactgaggctgagtttccctccntggtaaagagagagtgggcagccaacaatttaaattgtattgtgatgatttaataaagtg

SEQ ID NO: 35695 - DNA, 121 bp, Artificial Sequence
  Synthesized
  misc_feature (61): n=c or g
cctgcatggatgctctgaatgccttgtcaagcaggaacctaacaattaacttaaagctgcntaaactgccaacaaccaggctgaccacaaggaactgaagacaaccagagcctacgccttc

SEQ ID NO: 35696 - DNA, 121 bp, Artificial Sequence
  Synthesized
  misc_feature (61): n=t or c
acatcccattgccttgggaaaagtcctaatcttgcaattctctgttctctttgctatcacncagctttccactgcgctccaacacgggaacggttaagcagcataaacagcaaacaggttc

SEQ ID NO: 35697 - DNA, 121 bp, Artificial Sequence
  Synthesized
  misc_feature (61): n=a or g
atattcttaacaaaaggcaacccgtagtttattaatgtgtaaatataatgtaattacttcntaattccttatgttaaataaaaaggggggtttctcagcagataagccctgacactttttt

SEQ ID NO: 35698 - DNA, 121 bp, Artificial Sequence
  Synthesized
  misc_feature (61): n=t or c
gcagtgtcgacctctacagtattcagaccagagaaaccttattcataagattgttcataangttccctttgttatgctgtatcagttgttattaagtgctgaaatgagccaagtaatccta

SEQ ID NO: 35699 - DNA, 121 bp, Artificial Sequence
  Synthesized
  misc_feature (61): n=t or c
taagttatttaaagcaaaaggagaaaagcatgaatggcatcagccaaactattcttagttnggttaaggaagggaaagccacaaagggttcagctagagagaactcagtgaaacacaccct

SEQ ID NO: 35700 - DNA, 121 bp, Artificial Sequence
  Synthesized
  misc_feature (61): n=t or c
ttttctttccactgtgttaatatcatatgggtaaaactgcctgataaatacctgagttctnacgtttcaataaacgtaatactggagtggtttagtcaaatgatgtcaggggtattaaatc

SEQ ID NO: 35701 - DNA, 121 bp, Artificial Sequence
  Synthesized
  misc_feature (61): n=t or c
tgccattcactaattttgaactcataaaggatcaggcctgacaaattagacatatgtacantgtcatcagccccataaagtgagaaaacagcactacatgcaagctttgctcctttgccac

SEQ ID NO: 35702 - DNA, 121 bp, Artificial Sequence
  Synthesized
  misc_feature (61): n=t or g
ttctccctcccagtaattaccagggtcattatgcaactgtagatacaattgaaatggtttncctgtctttgaagcatgccaaagacagttacacattagtaataaaaacattttcatagcc

SEQ ID NO: 35703 - DNA, 121 bp, Artificial Sequence
  Synthesized
  misc_feature (61): n=a or c
attttagaaaaggaaatacaatccaacaactaactctataacaacatctaatagaacatcnttcttgtggttttaagaggtctccaccacatatcttagttcacatggaacaagcaagcat

SEQ ID NO: 35704 - DNA, 121 bp, Artificial Sequence
  Synthesized
  misc_feature (61): n=t or c
cctatctcccagtttctccttcaaccaaacagctgaagtctgaaagattttctttcacttncatcataccctcagtgagagatcttgactatctgcttcttgcctttaagatatcagatgc

SEQ ID NO: 35705 - DNA, 121 bp, Artificial Sequence
  Synthesized
  misc_feature (61): n=a or g
agaaataataacctacgttatatatatatatattctcacttcagtgagcacagcagaaacntaaatccagaagtgagaacacatctgcactacaaaacaagcattaaaaaccacgtcctag

SEQ ID NO: 35706 - DNA, 121 bp, Artificial Sequence
  Synthesized
  misc_feature (61): n=a or g
aaattgggaagaaaagaagagtggcatgaataattccatgaagtgcaaacctagaggtgangtaaaattggccccttattacaaaacataactagactacagatttccttacacctggcaa

SEQ ID NO: 35707 - DNA, 121 bp, Artificial Sequence
  Synthesized
  misc_feature (61): n=a or g
tatgctaccctggtaaatttgttacatctactttaaagctattttgaagaaaataaaaccnttgctctccccttgcatcaggagtacctttaggtgtgctgtggagagggccacgctcatt

SEQ ID NO: 35708 - DNA, 121 bp, Artificial Sequence
  Synthesized
  misc_feature (61): n=t or g
agtcattcagcagaactgtagttcttgctgttgataccggccaaagaattggcaggaaagnttagaagaggaataatacagtgccgttctttaaagcaataatcagtgttttagcaattag

SEQ ID NO: 35709 - DNA, 121 bp, Artificial Sequence
  Synthesized
  misc_feature (61): n=t or c
ttgggtaccccgagtaacacaagtgattggtgccaaatgacacaatcatttaataaaagtnactgattttcactgagataacaaaatacctcctgccctccactttgcactatctgtgcct

SEQ ID NO: 35710 - DNA, 121 bp, Artificial Sequence
  Synthesized
  misc_feature (61): n=a or g
actcctcccagcctatacctcaatttcaaccccaatacatcctaagagtactgcttgagantatgggatgcattttgaaaaccctttcctatatcagaaaatatttcacttaaacacttgg

SEQ ID NO: 35711 - DNA, 121 bp, Artificial Sequence
  Synthesized
  misc_feature (61): n=t or c
atcctataggagtttgggtatagggcattatgtggttatgaagagcaacctatgcatcttnacctttcagccatgcagatttaaagcctatgtgctgttttttacaatgttttcttctggc

SEQ ID NO: 35712 - DNA, 121 bp, Artificial Sequence
  Synthesized
  misc_feature (61): n=t or c
cactgagatgcatgaaaggctgttaatgggcactatgaccatagtttgtcccaaagacaanagaagacccttcctagtcattggagcaatgagaacagcgttctagttggaataaaaatgc

SEQ ID NO: 35713 - DNA, 121 bp, Artificial Sequence
  Synthesized
  misc_feature (61): n=t or c
aagactgcacaaagcaatttgatacaaacctatcaagttcttatcaatctagctccccctnctataacaggccttcttatagtttagattcaaataattcaggaagttttactttaaataa

SEQ ID NO: 35714 - DNA, 121 bp, Artificial Sequence
  Synthesized
  misc_feature (61): n=t or c
gccacttgacctaatgggagcaactgcctcccaaaaggctttgaaactttgtatttcagantgaaaattcagttaagttccttcagagtcattttatatcgttcaactcaacagatttaga

SEQ ID NO: 35715 - DNA, 121 bp, Artificial Sequence
  Synthesized
  misc_feature (61): n=t or g
agagctctgtttaaggcaaagcttacgcttgttgagcagttaggccaggttgtgtcctcangttgaaaagcagctcagttctgatggtagtgtcttaggagctctctgtgatctgtttcca

SEQ ID NO: 35716 - DNA, 121 bp, Artificial Sequence
  Synthesized
  misc_feature (61): n=a or g
aacagatgatccactgacttgtatgggtagtcaattaatgtcttgcatttcttatagaaangctctgagcttttacactgtgtatttgttttgtgggcaatatcactttttttaagtagtt

SEQ ID NO: 35717 - DNA, 121 bp, Artificial Sequence
  Synthesized
  misc_feature (61): n=c or g
acgcacagcactgcaaggtgttaccatcaggtattcctcagggtagaaaaacgtggacttnaataagagacagcagtgattctgcacagtctgcctcattagttgattgacaggtggaata

SEQ ID NO: 35718 - DNA, 121 bp, Artificial Sequence
  Synthesized
  misc_feature (61): n=t or c
ttccagtatattattttaagatctagcaaaacaatcggtatatactcctcagattatgggnggtcataagactaattcatatcattgtgattacaaggagaaactgagaatgcttggcata

SEQ ID NO: 35719 - DNA, 121 bp, Artificial Sequence
  Synthesized
  misc_feature (61): n=a or g
gagtagaaagtagagaaatagcaaatccaaaaagtaaaaaactgttttttaggctcatgantccaatgctgacccaaattttctgttttgttttagactaaaatatggtgtaatactgttc

SEQ ID NO: 35720 - DNA, 121 bp, Artificial Sequence
  Synthesized
  misc_feature (61): n=a or g
agtgcaagtcattatatacatcagactacaccctggtgtgtcatcttggggagcttttccngactgtcagagaaactcttaaaagcccaaagagtcaatctgcacagcacctacatgcata

SEQ ID NO: 35721 - DNA, 121 bp, Artificial Sequence
  Synthesized
  misc_feature (61): n=a or g
cattgttaaatgtgtacatattagctgccactgaagcaagtacttgaagctaaaccaactngatgtgacaaatctgtctttggtaaataattcaggtcatttatgcttatctgaactaaga

SEQ ID NO: 35722 - DNA, 121 bp, Artificial Sequence
  Synthesized
  misc_feature (61): n=a or c
cccattatgaatgctcacacggttgccccgcggtcactgttttgatacttctcttcctccnttagtgacaaaactacagcccagaaagttcacaccttgcaagcaggccaatggacagcac

SEQ ID NO: 35723 - DNA, 121 bp, Artificial Sequence
  Synthesized
  misc_feature (61): n=t or c
tgttcgtgttacagctgaactgagaggagagtgattcagttttgggaaggatgagtcctgngttgctttattgtccagctgctgagctgcgaggctcgagtgggtgtgtgtgatgtgaagg

SEQ ID NO: 35724 - DNA, 121 bp, Artificial Sequence
  Synthesized
  misc_feature (61): n=a or g
ttgacaccagctagcacaaatcacttcttggcctcaccaacaatctttttatacaagccgnagtaagcctaaaaacacgcaactgccaccgccacgcacacactcacaccccgcacacaag

SEQ ID NO: 35725 - DNA, 121 bp, Artificial Sequence
  Synthesized
  misc_feature (61): n=a or g
tttttttttttgttttttttttgtttttttttttcagaatttgcttgatgtttaacttcangatgagcagaacagctgaggcaaaggacatgttcttggctccctactgaagggcacctac

SEQ ID NO: 35726 - DNA, 121 bp, Artificial Sequence
  Synthesized
  misc_feature (61): n=a or g
cagaaatatttgaaagttgctcactttccctagaagagggtcacaatagtccctatcaaantactgtggtcagcttccttatcctaaatgagaaagaccattactaaacactaatgtttgc

SEQ ID NO: 35727 - DNA, 121 bp, Artificial Sequence
  Synthesized
  misc_feature (61): n=a or g
ctgctacaatccaggaactgagtcagaacaaagaatcattttgccagtactcatctgtgcntttcccagctcagttccccactccacaaaggacagagaatggggacgagggaaatcagct

SEQ ID NO: 35728 - DNA, 121 bp, Artificial Sequence
  Synthesized
  misc_feature (61): n=t or c
tgccctaccccggagctgtgtcattcccccagtccttcccaaaacgtctgacttctgctangggacgcggtcctgcccacagtctgggcatgagaaaggagtgatgccagtgccgagtggc

SEQ ID NO: 35729 - DNA, 121 bp, Artificial Sequence
  Synthesized
  misc_feature (61): n=t or c
tgaaaagcacaaataaacattaaaaggccattgacagtacaggcatcactgataactgtantgttagatgaagtgagtatcaaaaatacaatagacaagttttatttacaatttttttcaa

SEQ ID NO: 35730 - DNA, 121 bp, Artificial Sequence
  Synthesized
  misc_feature (61): n=t or c
gttgagcaggtattaaatagatcctatttggttatgaataacctgttattcaatttaaaantaaatagtaaagcctatggggaaaaaaggcctgaagacatctgaagagttattcagtgct

SEQ ID NO: 35731 - DNA, 121 bp, Artificial Sequence
  Synthesized
  misc_feature (61): n=t or c
ttgtacactgacttttcagtgtatgcaccaaatggaacacaacattggaggctgctgagtngctggcgttgtacctctctaccactgcgtgaatgtcaaaaaaagatttctagcattttca

SEQ ID NO: 35732 - DNA, 121 bp, Artificial Sequence
  Synthesized
  misc_feature (61): n=a or g
ggacgtggcggtggttcagagcgctcagcctcctgcgggagggctgtgaagggagcgtgancaccgcctggggataaaatgtcaggactaaagtttaaacgctgaaaaataagattggaac

SEQ ID NO: 35733 - DNA, 121 bp, Artificial Sequence
  Synthesized
  misc_feature (61): n=t or c
ccagtcttctgtctccatcgtggtcttcatcccctgggtcatctgcgtgcttgttggaacngggctcgtttcaagcctgtcttgcccaagtgctgggaaacctcagcaagtcaaagcttcc

SEQ ID NO: 35734 - DNA, 121 bp, Artificial Sequence
  Synthesized
  misc_feature (61): n=t or c
aacattaattccaggtctggctatagatatttgcctctcaaggcaaaatgtagacaaaagnccccggtacaaagtgtcccaaagcagaaaagcttttacaattccagaagttacttacttc

SEQ ID NO: 35735 - DNA, 121 bp, Artificial Sequence
  Synthesized
  misc_feature (61): n=c or g
gctgtttttgagcgctcatttgctccctgtccttgctggatgttcacagtctttgctgcgntgctgagtatcatgtcagctggcttcaaatcaagggcacttctttttttttaattgtgtt

SEQ ID NO: 35736 - DNA, 121 bp, Artificial Sequence
  Synthesized
  misc_feature (61): n=a or t
aaatggcgtaatcagatcagtcattgtctgtgagcaaaattatagacaacttatatgagtnctgttggcttgatcccctctgcagtgaattcaaacataaaatttccattggctgtacctc

SEQ ID NO: 35737 - DNA, 121 bp, Artificial Sequence
  Synthesized
  misc_feature (61): n=a or g
tcaaatagtttcatgtccttcttatgtgtggcacccaaaaacacacccagtgctcgaggtnagcattgcatcactgcagagtatagtgggacaaacactgctgtctctgaaaaacctccag

SEQ ID NO: 35738 - DNA, 121 bp, Artificial Sequence
  Synthesized
  misc_feature (61): n=a or g
tggcctatagagttgctagtttagtattcacataataaagcatctccctgaaacactgaanacacctgagagtttcacatgctttcattaattaagcacctctacagtgaggtacaccaac

SEQ ID NO: 35739 - DNA, 121 bp, Artificial Sequence
  Synthesized
  misc_feature (61): n=t or c
gcacctccaacaagcagatggagcctaatttctaaaaagttcctctgaaaagaagagcccngaaagctacctgtaaacttattagctgttgagacaccccctcctattatttcactccaga

SEQ ID NO: 35740 - DNA, 121 bp, Artificial Sequence
  Synthesized
  misc_feature (61): n=t or c
caaaaaaagggctagctgcaaaaattgatggacttccactgctatccatcacggggctgcngcatcaaagctgttcactgcaagcgcactgatggagatcccagcagagatggacatctca

SEQ ID NO: 35741 - DNA, 121 bp, Artificial Sequence
  Synthesized
  misc_feature (61): n=a or g
aaattacaatcccaagcagggggctgaaaacaaacaaacccaccgtctccaatggccagcncgccgttaatgtccctcagatgggtcattaggtcttttatgggttgtcagcatggagaac

SEQ ID NO: 35742 - DNA, 121 bp, Artificial Sequence
  Synthesized
  misc_feature (61): n=t or g
aaccaaactcaagctatggggtcaaaaatactgcaggcaatgattagaccctcagtagatntacttgtcaggagattatgaaagccttggtatgaattaatggtacaaagcctaacaagct

SEQ ID NO: 35743 - DNA, 121 bp, Artificial Sequence
  Synthesized
  misc_feature (61): n=t or c
actacaagagctcgcctgcatagagccactttcaggatctgatgcttagtaatgttattantcaatcacagtaacaagggatatccaaaatcttaaatacagctaccaattcctcaccctt

SEQ ID NO: 35744 - DNA, 121 bp, Artificial Sequence
  Synthesized
  misc_feature (61): n=a or g
ctccaatcatgagtagaaggaattgtgtgcggttaaaaggaactgatccatgaagggagancaaggaagtcagagttaaagaacacttcaggtagaaaagggaagagaagagtcttaatca

SEQ ID NO: 35745 - DNA, 121 bp, Artificial Sequence
  Synthesized
  misc_feature (61): n=t or c
tgcgtaacagagctgtatttgttagtgaagaatgtgtattttgtgcaacttcagcttgaangtctgcattgttaatttgctttttaagccaaacagccacagcctgtaagatttgtgcctt

SEQ ID NO: 35746 - DNA, 121 bp, Artificial Sequence
  Synthesized
  misc_feature (61): n=a or g
aagctcctgcataaggcagccgcagtcatgtaaaggggtgtatctgacatcagtcagatgntaacacgaggcaggctggtgttccctccatccctggtgttcagtcagttccgcttgtgag

SEQ ID NO: 35747 - DNA, 121 bp, Artificial Sequence
  Synthesized
  misc_feature (61): n=t or c
ataacaagaaacaatttctataaagaatcttattccccaacaaaggggttatctagagaanaagcagcctatatgcctttttcacccattttgtatcttaatgtatttcaagcacatccat

SEQ ID NO: 35748 - DNA, 121 bp, Artificial Sequence
  Synthesized
  misc_feature (61): n=a or g
aaatagcaaatgcaacaactccaactcctcatttttgagcccttcatttggttgtggcagncagctcaagagctgcacccacatttctttcctccgaggatattaagtgaaggcagctagt

SEQ ID NO: 35749 - DNA, 121 bp, Artificial Sequence
  Synthesized
  misc_feature (61): n=t or c
caaagaatatcatcctcatttaacatttttcactgagcttttcttctgaaagtttttttcntaaggtttgtcttcacctgctcagtttgatcaaatggttaggaggtttagatttttcaat

SEQ ID NO: 35750 - DNA, 121 bp, Artificial Sequence
  Synthesized
  misc_feature (61): n=a or t
gtgctgctcctggtaagtaggttaacaaaggatagcaacctttcaggtatcaacctggccngtagccagcactccaggagttaaaaagtggacctttccacccagaaggccgcactgactc

SEQ ID NO: 35751 - DNA, 121 bp, Artificial Sequence
  Synthesized
  misc_feature (61): n=a or c
aacagcccattgaatgactgaagagctgatacctaagaaagcagacagcagtagagaacanagagagttattctgatctctagttcaagtaatacttgagtcatgcttgccaagtggttgg

SEQ ID NO: 35752 - DNA, 121 bp, Artificial Sequence
  Synthesized
  misc_feature (61): n=a or g
caatcagtgttctaactagaagatatttggtaagtgcagagaccccacatttagctatgcncattttttatttatttgggcctttgccaaaggaaggcagctatttttccatatagtatgt

SEQ ID NO: 35753 - DNA, 121 bp, Artificial Sequence
  Synthesized
  misc_feature (61): n=t or c
tttactcattgcttcacatggagcactgagcagtcaacactacctattccaaccaacatcnaaacagtaaaaaaactacttgaaattcagacatgggtttatagactgaccacaattaaca

SEQ ID NO: 35754 - DNA, 121 bp, Artificial Sequence
  Synthesized
  misc_feature (61): n=a or t
tgtctagtaaaatattttagggaaatgaataaaatttgctttaaaagcttttgaccagatnatttcaggcatgtgtaaggatgtcacctgtctctggtccactctgcaggctatgcaaatg

SEQ ID NO: 35755 - DNA, 121 bp, Artificial Sequence
  Synthesized
  misc_feature (61): n=t or c
gtagtgatgtgtactacagttacgtttcattacttttcatcaaactgaaatttcccacttnttgttgcacctggaatatcggatcttttacctgcataagctattccagttgcttcaaaat

SEQ ID NO: 35756 - DNA, 121 bp, Artificial Sequence
  Synthesized
  misc_feature (61): n=t or c
tgatctttttgtagtgttcttctcttagaaagataacttatggacagaaagtggaaggttnactgaaaggaacctgaattgtccccacaaagaaaaaggatgaggtagtaaaaaagcatag

SEQ ID NO: 35757 - DNA, 121 bp, Artificial Sequence
  Synthesized
  misc_feature (61): n=t or c
aagttacaccattctgttaagggcgttatccaaatgcctttgaacaacgacaggcaggcanggggcatcaaccactatgaagaagatattactcatgtcttcttctgtgggtaacacagct

SEQ ID NO: 35758 - DNA, 121 bp, Artificial Sequence
  Synthesized
  misc_feature (61): n=a or g
ccggtacttttatcacagttggcacgagcaaacggccctcccgctatcagcacagcacacngcaatggcacaccctctgcttagcgcctcggtggcccttttggggatgcgcccccccatc

SEQ ID NO: 35759 - DNA, 121 bp, Artificial Sequence
  Synthesized
  misc_feature (61): n=a or g
gatcagattgtgaggactggggcaaggggaagcagcagcttggcaggccctgagcttgcantgctttctgcagctctccccaaatctacttcttgccataaactgcaaggctgcagatagt

SEQ ID NO: 35760 - DNA, 121 bp, Artificial Sequence
  Synthesized
  misc_feature (61): n=a or c
ctttgttccttgcttttaaagcacctgggcatgcctcccactgaactaaccccaaacacgnctatggaacaccggaagtacagaaggacagctccaacacccaaatgcccattggcaccaa

SEQ ID NO: 35761 - DNA, 121 bp, Artificial Sequence
  Synthesized
  misc_feature (61): n=t or g
tatacctgggcagttttggagtttggggtactggattactccttgacaccctctttcacanactaaattgtctttatcaaacacaatacaagaaaaagagaaaagagaaaataaagcaaaa

SEQ ID NO: 35762 - DNA, 121 bp, Artificial Sequence
  Synthesized
  misc_feature (61): n=a or g
gctgcgcagtgcactgctagaccagcttgtaaggtaagctgcagcatgcaaaagggtcctnagcacagcaatgcgagaggcccagtgcagaactgtggcagtacagcggtggtgaatgtta

SEQ ID NO: 35763 - DNA, 121 bp, Artificial Sequence
  Synthesized
  misc_feature (61): n=t or c
acaacaacatggaaaataggctttcatctttcaagaccatattaacataaggaacagtttngctagggcaaaagcatttattattaagtatttcaagggatgtgacagaagtaataaaata

SEQ ID NO: 35764 - DNA, 121 bp, Artificial Sequence
  Synthesized
  misc_feature (61): n=a or g
cctgaggtaggaaatgaagacaacatgcaacatccttctgggaaaggagatggggtcttanagataaccaagaacatgttataaatgacctaaagcctccccacatcctcttttattgggg

SEQ ID NO: 35765 - DNA, 121 bp, Artificial Sequence
  Synthesized
  misc_feature (61): n=a or g
actttcttgtcgtctttggtggtggtaggtagatggttggattgcaaaaaatttttatatntgtatttgccaaatggcaacaaggaatttagaggaaggataagtactgttctactaatca

SEQ ID NO: 35766 - DNA, 121 bp, Artificial Sequence
  Synthesized
  misc_feature (61): n=a or g
ccctgcaaacatgtaactccaattcaccaatcctattacatatgctcccagcatttgtacnggggagatttagctctgagctctccattgctttatctctttgcgtgtttgccagtgcaga

SEQ ID NO: 35767 - DNA, 121 bp, Artificial Sequence
  Synthesized
  misc_feature (61): n=a or g
agctgctacccaaagacgataggatcatatacacaaatgatgaaccaaaagacactatgantacttcatgaatacctagccagtacaggcacatcagcactgctgtccataaataaataag

SEQ ID NO: 35768 - DNA, 121 bp, Artificial Sequence
  Synthesized
  misc_feature (61): n=t or c
gaagtttggctagcctagggaagcacagacaggcaaccagtgctgtaagaaactcaaggcnaagtgctacaacagggaagcctgcggttgttcagttctggagagcagaacattataaaac

SEQ ID NO: 35769 - DNA, 121 bp, Artificial Sequence
  Synthesized
  misc_feature (61): n=a or g
aagacctgccacataaatttaagaagcaaataaacatgagctgtcattcccacagaaaagngaaaataagacagtttgatttctgagttcaggctgtgatataaaataaaagatgaccaaa

SEQ ID NO: 35770 - DNA, 121 bp, Artificial Sequence
  Synthesized
  misc_feature (61): n=a or g
caaacacagcacagcctcacatctgggagcctctgggcaacagggacccttataacaaccntggttactgcaagatgaaaggttgtgtagctaatatcacaggtctgcttctactcctgca

SEQ ID NO: 35771 - DNA, 121 bp, Artificial Sequence
  Synthesized
  misc_feature (61): n=a or t
tgggctcatcatgcattggactgagtgacatagtggtcttcctagtagcaggatgttcccnaagccacatgtctgcaccaaaacacttgacttactttcccttgagtgtgttggccatgag

SEQ ID NO: 35772 - DNA, 121 bp, Artificial Sequence
  Synthesized
  misc_feature (61): n=t or c
ccaaacctcttctgttctaacttatctacagtcattttctgttccatttccttttttcatntgatgatttttactcccataagtttgtcatatgactgttaacaaactctgaagtctgagt

SEQ ID NO: 35773 - DNA, 121 bp, Artificial Sequence
  Synthesized
  misc_feature (61): n=a or t
gagagatattatcagtcaggacagcaaaatgcctggctagattaaattaacacaaggatanttttttttcgccatttattttaggaaagcaagtgagaatgctgcaacaaaatctggctgc

SEQ ID NO: 35774 - DNA, 121 bp, Artificial Sequence
  Synthesized
  misc_feature (61): n=t or c
actatggatttaaaatttcttctaggttttggagaagtattttattgacagtaccaccccncactcttatcttttccctcagccctgaaacatcgcatttcttgcacttggttatgcataa

SEQ ID NO: 35775 - DNA, 121 bp, Artificial Sequence
  Synthesized
  misc_feature (61): n=c or g
cacagaaatcagcctaatactttatttttgactcaagataatggcaggaaacagcaagagntgatagctattgccttacgctcatgcaccagagcttagtccaaatgaattcagagactgt

SEQ ID NO: 35776 - DNA, 121 bp, Artificial Sequence
  Synthesized
  misc_feature (61): n=t or c
tgtggcagcagtccctggccaggaaaatttaaagatgcagtgttcaagaacaaagcttttngtgggagagaggcagtgccactactgccatccagggccttgtgtaaagagcaggtggtcc

SEQ ID NO: 35777 - DNA, 121 bp, Artificial Sequence
  Synthesized
  misc_feature (61): n=t or g
tggactgtgccgtgtgtgtacagctgtctttagagcacagctcacaggtaggtttttgccngtaatatcttcttacaagtcatctgatgttaggcactgcttgaacaatgaacatattcaa

SEQ ID NO: 35778 - DNA, 121 bp, Artificial Sequence
  Synthesized
  misc_feature (61): n=a or g
gagactgcaaatgttcagcttgtaacatgtgagcctcacgtgggtgcctgcccgctgtacntgtgaaaaaatctcattggtgctaggatatgacttctcatgatctgtgtttatcttttat

SEQ ID NO: 35779 - DNA, 121 bp, Artificial Sequence
  Synthesized
  misc_feature (61): n=a or g
gtccatcaggtcagggttgtagggggctggagcctgactctgctgtccttgcagcagctgnagctggtgtgggacacagggtccagacagaaatagatcgggctctcaaggccttcatgac

SEQ ID NO: 35780 - DNA, 121 bp, Artificial Sequence
  Synthesized
  misc_feature (61): n=t or c
gctgtgtggatatctcacatacctatgcatgagggaaacctaattgcccttccattcagtngaacaattttattacacaaccaaccatgaagttctgcaagtcatttaaaatgccatacaa

SEQ ID NO: 35781 - DNA, 121 bp, Artificial Sequence
  Synthesized
  misc_feature (61): n=t or c
tccaacactcttcttttggcaattatcactgtgccatggagcttccaaagaagctcaaagngcccaatcagcagaagccataacgtctggataagggcacagattaaaaacacacagcctg

SEQ ID NO: 35782 - DNA, 121 bp, Artificial Sequence
  Synthesized
  misc_feature (61): n=t or g
tttggaatagaaggtaggcaatattataaaatgccttaaaaatctgtcctgtcgttcttanatgttatagctgtattagaaagcaaaagtgtttatctattttcatattatttcatatata

SEQ ID NO: 35783 - DNA, 121 bp, Artificial Sequence
  Synthesized
  misc_feature (61): n=a or g
acactgagccacagcagcaggtagtagaacatagcactcaacatgaccctagcactgaagncgatggctctaacctgcctggtgctactcctgctccagaatgccccaggtgagtgtgtgg

SEQ ID NO: 35784 - DNA, 121 bp, Artificial Sequence
  Synthesized
  misc_feature (61): n=t or c
ccgaagccctgcaatgaagcattaagaacagcctttttgaacttctcaacagggacagtcnttatggattatttaagcataaaaatacacggctttctggaagagaaccgttttagccttc

SEQ ID NO: 35785 - DNA, 121 bp, Artificial Sequence
  Synthesized
  misc_feature (61): n=t or c
tgagaactcctcttactgccccaaacatctctggcttgcatttggcatgcttgcttcctantgtccttcacagacggcatgctggaggcacaactggtgcctgcccaagacagggcctctg

SEQ ID NO: 35786 - DNA, 121 bp, Artificial Sequence
  Synthesized
  misc_feature (61): n=c or g
tcatacaatacatgttcattagtcctatgaaaaaaataattgttgcagaaagggaattcanaagtcttactcatttccatgtattctggagtcagtccagtgaaaggttccaagctgtagt

SEQ ID NO: 35787 - DNA, 121 bp, Artificial Sequence
  Synthesized
  misc_feature (61): n=t or c
gttttaactggggaataagtgatgctccatgttctttcacaactttttcacaagtttaaanagtgattctatgaagatattgtataacaagtcccctgggagtgaaacaatgtgcaaggga

SEQ ID NO: 35788 - DNA, 121 bp, Artificial Sequence
  Synthesized
  misc_feature (61): n=a or g
gttgccaaaggaaggagatggcttgtctgaaaagccatctgcaaagtgatctttcctaggnggcctgaaggagcgttttctaagccttctggcctcaatggcggggagtagcatgcctgcc

SEQ ID NO: 35789 - DNA, 121 bp, Artificial Sequence
  Synthesized
  misc_feature (61): n=t or c
ctgttagaaaagtgtctgctgttaggttttctttagaatctgatagatgcagtactcaaanatttactttcaaagtccagcaatatgttctgcaaaaagggagacttctgtatagagattt

SEQ ID NO: 35790 - DNA, 121 bp, Artificial Sequence
  Synthesized
  misc_feature (61): n=t or c
gacataagctggaagttgtgaagaaggcaaaatcacttttcttgcagcttaagtgcacttntaaaatttgtttgcactcaggaggtagtctcaatgaaaatttctgaagctgcttgtgtaa

SEQ ID NO: 35791 - DNA, 121 bp, Artificial Sequence
  Synthesized
  misc_feature (61): n=t or c
taaacatgagaaatcagaagacagcaaaagcctatagcactcacaaaacttctaaagggcntgtgctctatctcccctaaagagtgataaagtcacacacctcaactgaattattcttaca

SEQ ID NO: 35792 - DNA, 121 bp, Artificial Sequence
  Synthesized
  misc_feature (61): n=t or c
cagagaaagaggaaattcttaattgacgtcattttagctgagcattgtcctgtggtgtttntatcttatttgtttacagaacaaggaaaaaaaaaatcaaaacagcataaaaaaacatttt

SEQ ID NO: 35793 - DNA, 121 bp, Artificial Sequence
  Synthesized
  misc_feature (61): n=t or c
acacccaaccctcacccaacatgcagacatggcacaagggtggctttagatgaaggacaangtaggttgcttctgtaccatcactgagccccagattcacatgagaggatacattagatca

SEQ ID NO: 35794 - DNA, 121 bp, Artificial Sequence
  Synthesized
  misc_feature (61): n=a or g
ttctggaacaaatattagcctattgattttagcatataatctataatgtcattaagtattnttgtccctcctaaccagactgctggataccagccacgacctacttagttgttggcgataa

SEQ ID NO: 35795 - DNA, 121 bp, Artificial Sequence
  Synthesized
  misc_feature (61): n=t or c
agcagcatcagaggaaggggacggcgggatctccgctcggcagagcgctttccggctcagntttctccccccttccgtaggtctctttgagcagagggttgaacagtatttggaagagctt

SEQ ID NO: 35796 - DNA, 121 bp, Artificial Sequence
  Synthesized
  misc_feature (61): n=a or g
cacgcccactgatgtggaaaaaagctttcttccaccttatttaagctaccccagccaatanttttgcacatcccttttcctattagtgtacagaagtgttatataatgagctttctctacc

SEQ ID NO: 35797 - DNA, 121 bp, Artificial Sequence
  Synthesized
  misc_feature (61): n=c or g
gtggtgaaacagagcagggcgtagatttgtctccaaactaagccaccacaaaagcagtganttgttaggtatgctgctttttttccagtacggtttgcttacagaggccaggggcagggct

SEQ ID NO: 35798 - DNA, 121 bp, Artificial Sequence
  Synthesized
  misc_feature (61): n=a or g
ccacctatatacgttctcaggtttattaattatgaaactagtaaaatggtgttgtcggctnccttttgcaaagcgtacttacgctgtgttagaagactgaacagagttttaagcgctttgc

SEQ ID NO: 35799 - DNA, 121 bp, Artificial Sequence
  Synthesized
  misc_feature (61): n=t or c
cctcgacatgctgattcttaaccacgtcggcaagtcgtacttcaattacttcgatggggangttgggcacgtccagaagctcctgaacatcaacttcctgagctacgtggccatgacagtc

SEQ ID NO: 35800 - DNA, 121 bp, Artificial Sequence
  Synthesized
  misc_feature (61): n=c or g
ccagatatctactccctgttgtggtcttattttcagatgggtgtcccactgatgtccaggntgctctgtacagggattcagtacgaggtcagtgtgctccagataccctcagtgcagtttg

SEQ ID NO: 35801 - DNA, 121 bp, Artificial Sequence
  Synthesized
  misc_feature (61): n=a or g
agagagagagagaaaaaaaaaagttgtgaacagccctcatgcccaacatctaaatcatgcnctgtcaaccacttccccttcctgtcacacagcctgagaaaatccctcatgtttgttttga

SEQ ID NO: 35802 - DNA, 121 bp, Artificial Sequence
  Synthesized
  misc_feature (61): n=a or g
tgctattaaatggcaatgggggaaagctgaacaggtccatcctttgggtaagggctgagcngaaagatgacagcatgctgagtttgttatgagcaaagaaccgagtaccaacaggagagac

SEQ ID NO: 35803 - DNA, 121 bp, Artificial Sequence
  Synthesized
  misc_feature (61): n=a or g
gtcagtagctttcttattgagttgctggttggtttggacctacagctaatcttctaagaangtcatttcagttgctcatggtcaatactctgtcctacgctgagagatcagaatggagttg

SEQ ID NO: 35804 - DNA, 121 bp, Artificial Sequence
  Synthesized
  misc_feature (61): n=a or g
gctcctgccaatagtttgtgatgacccctgaatgtcagtgctgtctggggagcgagcctcngctaggagaaacggctgcgcctgtcttctgctgtgactgcagcatctgagtgcctagcat

SEQ ID NO: 35805 - DNA, 121 bp, Artificial Sequence
  Synthesized
  misc_feature (61): n=t or c
ttgcacacgttcacacatacattccctccccccaacacatacacaaatacaaatagaacanaaaaaccaactttctttctctctgcccttcagaaaggcaacactgttttggcagatcagc

SEQ ID NO: 35806 - DNA, 121 bp, Artificial Sequence
  Synthesized
  misc_feature (61): n=a or g
ggaaaataggcttagtgccagagtggtcaaacactggatcaagctgcctagaaaggctatngaatgtccatcttcagagatatccaagagtggacaggatatggcccaacacagctttgaa

SEQ ID NO: 35807 - DNA, 121 bp, Artificial Sequence
  Synthesized
  misc_feature (61): n=t or c
ctgggtggaaggggcgatcacagtgaaatctggcatcacaactattcctaatggctcactngtgggcaagaggagcagtgtgatgatggtggcacagaggttggccaccagggcttcagtg

SEQ ID NO: 35808 - DNA, 121 bp, Artificial Sequence
  Synthesized
  misc_feature (61): n=c or g
tgtgaagcaatagaaaacattcaaaagctccagaatgtgtgcttatattgagtatgttctnatttgtcagtaaaagacatattttgtggctctggagaacttaaagacaaagattgtctac

SEQ ID NO: 35809 - DNA, 121 bp, Artificial Sequence
  Synthesized
  misc_feature (61): n=t or c
agcaggagggggggcagcgggggctgcatccgtgtgctggctgtgaggtatggggggagcngtactgatgcaaatgggacagaaaatcaccactgagccctgggatgtcagccctggcctg

SEQ ID NO: 35810 - DNA, 121 bp, Artificial Sequence
  Synthesized
  misc_feature (61): n=a or g
ggagggtaacatttcaccatatccagagtggtgctttcagtccttcaaataaattttttcnttcatatcagtgctaaacatgtcagtggttctgcctcaggcctctgaggatgtgtgatct

SEQ ID NO: 35811 - DNA, 121 bp, Artificial Sequence
  Synthesized
  misc_feature (61): n=t or c
aagtatcgccttacttaggttttatcatgtgcatgattgccttgggcagcttttattgtcnctttatctcagtccattgaagtattcagctggtgctttcttgtgacctgaatgaaggctc

SEQ ID NO: 35812 - DNA, 121 bp, Artificial Sequence
  Synthesized
  misc_feature (61): n=a or t
ctgttggcttccttaagctgtaaaataaatacaagctctaagttcaaactctcaattaaangagcttggttactggcaattgtattgcagactatctcacagtgtttattgtttccctagg

SEQ ID NO: 35813 - DNA, 121 bp, Artificial Sequence
  Synthesized
  misc_feature (61): n=t or c
gaaactaaaacacccatctactggatgtccttcagggacagcacaaggcatttatgttctnctagtgtgcatgtgaattcactgaatggcattatggtattctatacttaatattttatat

SEQ ID NO: 35814 - DNA, 121 bp, Artificial Sequence
  Synthesized
  misc_feature (61): n=t or c
gttccattctattgactatattatttaccaaaagtatctcagtgatgaatttagtcttttnagttgcttgtaaatgttagtggttttgtaatactaaatggtacatggtttattgatggga

SEQ ID NO: 35815 - DNA, 121 bp, Artificial Sequence
  Synthesized
  misc_feature (61): n=a or g
gtcctgctgtcagacagtaggttctcactggactcttttgggggatgctctgcccattgcngggagctgcctgcttatgtccagctgcactcctagagtctcatgtgtgtcagtgagcgtc

SEQ ID NO: 35816 - DNA, 121 bp, Artificial Sequence
  Synthesized
  misc_feature (61): n=t or c
cgctatcatcggagcccgtggaacatttctaatcaacttaagtcagcccaccattatgttnctggccttgctccagcaagacacttaagcaggtgtctgggtttgagcatgtgaacagccc

SEQ ID NO: 35817 - DNA, 121 bp, Artificial Sequence
  Synthesized
  misc_feature (61): n=t or c
aactcattctaccaaaacttagacagttaatatctgaattaagatatgaagggggctaccnttcgttactgaccttagagagatttagatctttttggtctaaatgccaaggacaaagata

SEQ ID NO: 35818 - DNA, 121 bp, Artificial Sequence
  Synthesized
  misc_feature (61): n=a or g
atgtaaatagcaagaagactattgcccagcctcttgctaaaataataagctttaaaaattnagattgccacccaaagagtgctcatttatatcagttttaaagattttagattgttttaaa

SEQ ID NO: 35819 - DNA, 121 bp, Artificial Sequence
  Synthesized
  misc_feature (61): n=a or t
agtgccacagccatgcctgaaaagcaaaagcagacgcactttaagaggagacccagtgcancgctctgcaggaaaatcaacaggagagctacattcatacctctgagcagcaaagcaaagg

SEQ ID NO: 35820 - DNA, 121 bp, Artificial Sequence
  Synthesized
  misc_feature (61): n=a or g
aggttggggtccaagcaagccatcctcctgctgtgttctgctttgttctcttggcaggacngctctgcccctatccaagcacccaacagccctggggcactctgcacctatcgagcagaat

SEQ ID NO: 35821 - DNA, 121 bp, Artificial Sequence
  Synthesized
  misc_feature (61): n=a or t
atatgatgtcttttcattttttttcttttttttttaatccacgggaccccagctttattcnttgcacagtgttcagtgaatacaccagctgctcaatatttctctttatcctcatgcttta

SEQ ID NO: 35822 - DNA, 121 bp, Artificial Sequence
  Synthesized
  misc_feature (61): n=t or g
tttgagctgttttgccacatttttcttctctcccagctgaataccaagctaacatcctcanctgaccactggccacagaagctgtttatgtgggaggtaactggaacatgctaaggaattg

SEQ ID NO: 35823 - DNA, 121 bp, Artificial Sequence
  Synthesized
  misc_feature (61): n=a or g
cacctgggtttccacaggtggaagcaagagctggcccttggttcatttttgtccttgcacnctgtcagtacacaggcagcatccccagctgggtgtgggagcttggcagctgtctgggctc

SEQ ID NO: 35824 - DNA, 121 bp, Artificial Sequence
  Synthesized
  misc_feature (61): n=t or c
agataagcagtcaacaccgtatctttgtgcttgaactcctgcctgctccttctgtacagcngcctgagttacgataggatattggttaagcacttccctgtaggtgggatacaaaacatcg

SEQ ID NO: 35825 - DNA, 121 bp, Artificial Sequence
  Synthesized
  misc_feature (61): n=a or t
tgttgtttgcacatataaatgcatgaatcacagcttgtgcaaatagttgccggcatgattnaaaggcgtttcttttaccttcaagctccaaaagaaaaataggaaaaacaattcctatcac

SEQ ID NO: 35826 - DNA, 121 bp, Artificial Sequence
  Synthesized
  misc_feature (61): n=a or g
acccaagagagcgatgctcaatatactcctttctacagaagctgaagacacacctatgacntcccaaagcaatatatacattatctgtaaaagaaaggcttgaactgtaatgctcctgctg

SEQ ID NO: 35827 - DNA, 121 bp, Artificial Sequence
  Synthesized
  misc_feature (61): n=a or g
aactgggctactaattgtagcaccttttaaagtgaagagcttttaaaatgcaaaatgcaanaagttgacatacaagagaggcttgaagaagtagtttcacttaaagctgaaaaagcttttg

SEQ ID NO: 35828 - DNA, 121 bp, Artificial Sequence
  Synthesized
  misc_feature (61): n=t or c
attggaccaccttttctatttagaacaaagacactgtcgtataaacactctagtacctagncaggttccagttgagaaagtaactttctgtacagtgcacatacttcaatggcccgaagtg

SEQ ID NO: 35829 - DNA, 121 bp, Artificial Sequence
  Synthesized
  misc_feature (61): n=a or g
aaaccactgctgagaatcagttcagatcctgaaaatttccatctcattaaacttctatgtntggaaagcaatttcttcacagtagataataatattattaacaaacctattagcagtacag

SEQ ID NO: 35830 - DNA, 121 bp, Artificial Sequence
  Synthesized
  misc_feature (61): n=t or c
tccttatttttctatatgctcatatagcactgtagcattacagcccctattacacaattcnttctgtaattggaaaagttgcacatctgtttctaatcagaacttcacaccattccaacaa

SEQ ID NO: 35831 - DNA, 121 bp, Artificial Sequence
  Synthesized
  misc_feature (61): n=a or c
tatacatacgtaggtgttcattcactatttacaggtattctccacacagtattattcatanttcagcactataatatgcattagtatacatatctatacatctatgcagtcactgcagtca

SEQ ID NO: 35832 - DNA, 121 bp, Artificial Sequence
  Synthesized
  misc_feature (61): n=a or g
ccaagcaaccacattaaaaatagcttgctacatactttgttatttggaaaatctgcagagngagttgttattattttgtgtattgttctcaaaaggaaactttctagctactcacaaaaca

SEQ ID NO: 35833 - DNA, 121 bp, Artificial Sequence
  Synthesized
  misc_feature (61): n=t or c
gctcaccccgttcccattgcaggagctgtcccagatgcagacccagatctccgacacctcngtagtgctgaccatggacaacaaccgcaacctggacctggacagcatcatcgccgaggtg

SEQ ID NO: 35834 - DNA, 121 bp, Artificial Sequence
  Synthesized
  misc_feature (61): n=a or g
cagttgagaaatcagtgaaaaaaataattgcaataatgaaaaagtatttccgttgtgctcntcgaatcaaaaacatgaaaatattcactgcaccaactgcttctcagcaacactgaaaaaa

SEQ ID NO: 35835 - DNA, 121 bp, Artificial Sequence
  Synthesized
  misc_feature (61): n=t or c
ttgtgttatttcctagtaagagatatgtggtaagggaattgccttttatatgtgctgcccntcttatttctgatattatttacgtatttaaggaaatcaatgctttaaaagagcaacagca

SEQ ID NO: 35836 - DNA, 121 bp, Artificial Sequence
  Synthesized
  misc_feature (61): n=a or g
taattccatgcacatgaaagtcatgaactaaatatatgtagaatgccttcttcatggagtnaaaagtagcttgtttcagtattcttttctcacctgattcaccattttaaaactggaaggc

SEQ ID NO: 35837 - DNA, 121 bp, Artificial Sequence
  Synthesized
  misc_feature (61): n=a or g
ataaataatcctgcagcacaacacctgtgattcatggataaggacaggaaaagattcagantaagccaaaaaaacaggtatgaaaagctctgaattctatctgtaaatgtatttctaaagt

SEQ ID NO: 35838 - DNA, 121 bp, Artificial Sequence
  Synthesized
  misc_feature (61): n=a or g
gcaattaaagcacaaaggaagaaaacagcaagtatcatattttcatgatacgggataaatnagcagataatagaacaactttattagtccatgcataagctagtgtttctgttgtcagtag

SEQ ID NO: 35839 - DNA, 121 bp, Artificial Sequence
  Synthesized
  misc_feature (61): n=t or c
tctgtatgggcagaaggacagttggttctgctgcctgtgctgtgagtgggcctcagggaangttcacctgcaggtgacctcagtcgtgtcccctcttcctattcagatggagctgatggag

SEQ ID NO: 35840 - DNA, 121 bp, Artificial Sequence
  Synthesized
  misc_feature (61): n=c or g
tgccaccacctccagtctccagatgctgttaggacaaaaccagcctggctctcctgcagcncagaatgaaggggatggcaacaccccatataaaactaaggattcttcactactgagctcc

SEQ ID NO: 35841 - DNA, 121 bp, Artificial Sequence
  Synthesized
  misc_feature (61): n=a or c
tctagtatttcttacacaagtgaaaagaaagtgattaatgattgtgggtgcctccattttnaaatgcctcatttgcctttattttaaaatgtttctacttttcaagtggttgagtgctgtt

SEQ ID NO: 35842 - DNA, 121 bp, Artificial Sequence
  Synthesized
  misc_feature (61): n=a or g
tgacttagtatcttaaacatgccaagggcatgacgcttaaccatgccaagaggcttaagtnatgaatgtctttgatagagtgtttggatacccgaagttacatttatgaccctagagtttt

SEQ ID NO: 35843 - DNA, 121 bp, Artificial Sequence
  Synthesized
  misc_feature (61): n=a or g
ctctctgcaacatctgctggggctcaggccgagaagggtgcagagtagacccctgcattangagggcatcaaataaaggaaaatacctcctgtcgccctgtggcagctccaaggcatgcag

SEQ ID NO: 35844 - DNA, 121 bp, Artificial Sequence
  Synthesized
  misc_feature (61): n=t or c
gcagtcctgggatgtcagggagggtgagagcacatcaacgggagtatttctcccaaacccnctgcagttttgttgcatgcattgcttctcgagtcacagtgatttgtccagcagtgctcgg

SEQ ID NO: 35845 - DNA, 121 bp, Artificial Sequence
  Synthesized
  misc_feature (61): n=t or c
gggaaaatactaccttgatgtctgtgaactaaataagccatggtaagaaaatgcatttggncagtcagctataatccttagcacttctattcccaaatgtagagctcatcctttgcctagg

SEQ ID NO: 35846 - DNA, 121 bp, Artificial Sequence
  Synthesized
  misc_feature (61): n=t or c
ccatcccacttggggacagtaagcattctgtaatttcattttgagttccttcaggacttgnctgtgacaccacgtaattccggtaactaactgatatcttatttctcccagtccattccca

SEQ ID NO: 35847 - DNA, 121 bp, Artificial Sequence
  Synthesized
  misc_feature (61): n=c or g
tgcaacgatgggctctgcctgggtgccgtctgtgctgctgtgaatatgatgctctgtgtancttcactggggatgtaattctaaagtgaaagaggggagatttaagtttgatgttaggaat

SEQ ID NO: 35848 - DNA, 121 bp, Artificial Sequence
  Synthesized
  misc_feature (61): n=t or c
agcccctctaccttcgacaatccctcctaattttgccatcagcaatttcaacgtcagactncttcttcctgtgcttaagtcataaacaaaaccagtaagaccattctaatacactctaaga

SEQ ID NO: 35849 - DNA, 121 bp, Artificial Sequence
  Synthesized
  misc_feature (61): n=a or t
tgctattttgcctgttgcagttttggaaagaagtaattccatcaatttctgatgacacttnctgtcattaaagtcattgtttagtcattacagaagttgagcagaatcatgaatacattgt

SEQ ID NO: 35850 - DNA, 121 bp, Artificial Sequence
  Synthesized
  misc_feature (61): n=c or g
taggcattcctacttgcatggataggacaattagtaagaatttagttgctccacccctctnctaggaatccctgaggcagaatcatataatcatagcttttatgcatcacagaaaaatcag

SEQ ID NO: 35851 - DNA, 121 bp, Artificial Sequence
  Synthesized
  misc_feature (61): n=a or t
gtaaattcctgtagttttacaagataaaagcaagcagcattaaacaagaaatacgtgccanacaatatgcctttttcctcctcgttccttaaagtctacagcaaaactcactacaggacat

SEQ ID NO: 35852 - DNA, 121 bp, Artificial Sequence
  Synthesized
  misc_feature (61): n=t or c
actctaatgtgctccttaaggtttttccttaatggataggtataagtaagtcacctgcatngctgttacccttgtgaaaggaatttgtgtccttgaagcttgaaactgagggtgaggaaga

SEQ ID NO: 35853 - DNA, 121 bp, Artificial Sequence
  Synthesized
  misc_feature (61): n=t or c
cagacttcacacacagcactgcagtatgccatgtaggtactcctctatcttctgtgatgtnggtacttagctgcattaataaaagctctgaaattttttaaaaggtagtactaaaaggaaa

SEQ ID NO: 35854 - DNA, 121 bp, Artificial Sequence
  Synthesized
  misc_feature (61): n=t or c
gatatgtgcaaccttagccaccttgatgctgaacacagacatcaaaatagcctgcttcagnactatctgggggcagtctgacatcctttcgcacaggcacatgtcagaggggcagctctag

SEQ ID NO: 35855 - DNA, 121 bp, Artificial Sequence
  Synthesized
  misc_feature (61): n=t or c
attcagttttccaggtggtgacttgcatatttatgagaattagagcattcattacaaacanaagtttggtatgaaatacataggaacgggaaaaatagaccgaattttgggaaatagttta

SEQ ID NO: 35856 - DNA, 121 bp, Artificial Sequence
  Synthesized
  misc_feature (61): n=a or g
ggcattagaagaatattttttttgtcttgtcttcccttgacagtgcactattacagccctntgatggatgctgttgaagatagatactttctcaaaccatgtgtgggcagtggtctccctt

SEQ ID NO: 35857 - DNA, 121 bp, Artificial Sequence
  Synthesized
  misc_feature (61): n=a or g
gggtaacagtcaggcaaagtcccctccaccccaccccaaagcttgggaatattgttctggngacaaatatatactggaaataactgaggccttactcagacctttgtcactgtgctccact

SEQ ID NO: 35858 - DNA, 121 bp, Artificial Sequence
  Synthesized
  misc_feature (61): n=t or c
agattaaatgaaatgttttatgtctatggcaagtgtggtcaaagagcacctaaacccaacngacgccttttctttttgttgccaccgctgtctgatcttaaaatgttctagcagcaactac

SEQ ID NO: 35859 - DNA, 121 bp, Artificial Sequence
  Synthesized
  misc_feature (61): n=a or g
ttgggccttgtatgcctgccatcaggtgctctccactttggcttggttggattgcctccanatttggagtagtgtatgtgaaagcagagctagctcttctcttccagggtcgtacattgaa

SEQ ID NO: 35860 - DNA, 121 bp, Artificial Sequence
  Synthesized
  misc_feature (61): n=a or g
ctgagttttatttttacttattggcttctttaggttttattttgtttccatgagtacaatngctgggtttaattgccttgctgaacttcagtagttttaattataaaagaattacagtgtg

SEQ ID NO: 35861 - DNA, 121 bp, Artificial Sequence
  Synthesized
  misc_feature (61): n=t or c
tgcaatttgaatatttagcaacaagtgactaactagctgcacatttggtgctcattatttnaaaaaggaggaatttgctagcaattaccacacagcagtatctggcattaccacttttaac

SEQ ID NO: 35862 - DNA, 121 bp, Artificial Sequence
  Synthesized
  misc_feature (61): n=t or c
tggaggtgtaggagaaagatgaataagaaaaagcatttttatacctcatggaaacttggangcaaaaaatatagtagagagtgtaaagtggtgcagctgaggagtgatcatcaaagttctc

SEQ ID NO: 35863 - DNA, 121 bp, Artificial Sequence
  Synthesized
  misc_feature (61): n=a or g
aggctgcctcagctctgagccaggtgctcttgtatttctgcagccttccaaggtatccttnggaagtgcacaaaataccctgttggcacctgtacttctcccccatcaagtatcacgtcca

SEQ ID NO: 35864 - DNA, 121 bp, Artificial Sequence
  Synthesized
  misc_feature (61): n=t or c
ttatctgccctcccagaggttaactcctgcccatgatcagcttactgtccttctctttttnttgctttagttttaacatcccttaaaaaagaagaggaaaaaaaaaacaccacaaaaccca

SEQ ID NO: 35865 - DNA, 121 bp, Artificial Sequence
  Synthesized
  misc_feature (61): n=a or g
tgttcccggttatttccaactcaggaagagaaaccttttctttttgccttatactgtgacnagtggatttcctcacttctgtctgcctggctctgcacagggagcccatgggggcaacacc

SEQ ID NO: 35866 - DNA, 121 bp, Artificial Sequence
  Synthesized
  misc_feature (61): n=a or g
tgctctgcagatactccagacactaaaaaagtctgctgataacacgcctggttcagatccnccctccatctttttagcaggtcctcctggtagcagttggagattaattattcccctcttt

SEQ ID NO: 35867 - DNA, 121 bp, Artificial Sequence
  Synthesized
  misc_feature (61): n=a or g
cccacctcctcttaactcagcatccaaatttggatctgaaactcaagaagagtgatcaagncacagtctggatgggataaagaatacattatttttcacatataaagtgtgacatgtctct

SEQ ID NO: 35868 - DNA, 121 bp, Artificial Sequence
  Synthesized
  misc_feature (61): n=t or c
tatcttcaagggctacttgcaaaaccaaagttactttcctgagaacctgctggggttcatnattcctatttgtaggtggtagcataagtcagactgccaaacacatccaataccaagcttt

SEQ ID NO: 35869 - DNA, 121 bp, Artificial Sequence
  Synthesized
  misc_feature (61): n=t or g
taattaaaatgcaaaaccaaagaacaaaaaaccccaaaccctaactcactgtttaggattntgtcactcaataattgcagagctttgaatttaatattaatgcagtgcaaaacctttattc

SEQ ID NO: 35870 - DNA, 121 bp, Artificial Sequence
  Synthesized
  misc_feature (61): n=a or g
tacaagcacatcaaccgttgttatcaccaactccatcaccgaggggagcacagcagtcgcnggattcaggctctgcaggcagctcatgggaatctgggagcagtgcagagcattgccagga

SEQ ID NO: 35871 - DNA, 121 bp, Artificial Sequence
  Synthesized
  misc_feature (61): n=a or g
atcccaaacaccaccaactttccaatatttggtgactacaagacaccagtaattggagganttcccagtttcagaggtaatgtggctgatccatatctcccgccgggctgaagcacccaca

SEQ ID NO: 35872 - DNA, 121 bp, Artificial Sequence
  Synthesized
  misc_feature (61): n=c or g
ctccgagaatgaatgtttcttaatatccaacctgaacaagggacgaaagtctctgcccaantgacaagaacatccaaagatgaaatccacacagcgcagtgaggctgccaacagtgaaccc

SEQ ID NO: 35873 - DNA, 121 bp, Artificial Sequence
  Synthesized
  misc_feature (61): n=a or g
aaagtttttacccgcagttagttctcttacgttgtacctgtcaaaaatagtattttaaagnaagtttaaacattagaataaacatttagagagatcatttcatcctcaaagatcctctatg

SEQ ID NO: 35874 - DNA, 121 bp, Artificial Sequence
  Synthesized
  misc_feature (61): n=t or c
gtgctgccccacactgccgagtggtgcctggcgttgacccacattgactgttgtttacccngtgttggtgcgtggtgacacgcgatgacccacgttgactggtgttgacccacacattgag

SEQ ID NO: 35875 - DNA, 121 bp, Artificial Sequence
  Synthesized
  misc_feature (61): n=t or c
aaagtgtgttcatcttgttatttctttcgagaggcattacagacacatacatttagacttnttttagcttgttaatttatgccagctagtgtaaaattacagggttgagaagaaagttgca

SEQ ID NO: 35876 - DNA, 121 bp, Artificial Sequence
  Synthesized
  misc_feature (61): n=t or c
caaatgagtgcttttttttttttttaagaacctgaagtgaccagcctgtccctattgaaanaggtgcactgtggcctcataggttgcatcagctgattgtccctcctgttcatctcatgtc

SEQ ID NO: 35877 - DNA, 121 bp, Artificial Sequence
  Synthesized
  misc_feature (61): n=t or c
gcacgttgcagggctctgcacctaattctagcagttggatactgctgtaataaaaagttanaggaaacctaaggaagaaatcattggaaataattcagtttcctttcctttcctcttttct

SEQ ID NO: 35878 - DNA, 121 bp, Artificial Sequence
  Synthesized
  misc_feature (61): n=a or g
tcatctttctatgaaccaaaacgacatggatatgcttgtataatatcctgaatttttgccnaattcttaagttggaatgtgttcagatgacaggctctgagcaacctgatcggactgtaga

SEQ ID NO: 35879 - DNA, 121 bp, Artificial Sequence
  Synthesized
  misc_feature (61): n=a or g
ccatctacaacttttatacaagtgcacacttgaccatctgcttatttattatgcttaggantgagaaagaaggtctgaagagtttgtatgtgtataagtgtacagataaaacattcagatg

SEQ ID NO: 35880 - DNA, 121 bp, Artificial Sequence
  Synthesized
  misc_feature (61): n=t or c
cacacgtacaatgtgattggaaaaaatctcatcttgcctgcccgcctttcctttgtctcangaagaaaagaaagtggagtcattcagacctccttctgcagtctcctgcgttgtattcaaa

SEQ ID NO: 35881 - DNA, 121 bp, Artificial Sequence
  Synthesized
  misc_feature (61): n=a or g
gtatacaaaaccccaaactaacaacaacagagcttttggcaggtagttatgaagaacaggnaggatcagaaattctacagtggaaagtcaacatgcacacccactgggcaaaattcacctg

SEQ ID NO: 35882 - DNA, 121 bp, Artificial Sequence
  Synthesized
  misc_feature (61): n=t or c
tgaacaattctatgattccatgaactgaagagaaaggaattactcctttcaggtgacaganggaaaaatgcatttaaaataccaattaggattattaaaaactaaatcaaactatacatgc

SEQ ID NO: 35883 - DNA, 121 bp, Artificial Sequence
  Synthesized
  misc_feature (61): n=a or g
aggcaaagccctgcgattccagggagctctgctgatgtccgatgctatttgacctgctgcncaggattgttcaaatatcacctgggtgaatagtttggtaatgaatggaaggacttctgat

SEQ ID NO: 35884 - DNA, 121 bp, Artificial Sequence
  Synthesized
  misc_feature (61): n=a or g
aggatgctgtgattgtagatgtataaactggggaagctgaagctcaggtatgtgttccccntacaatgttttgggctctaccatctcaagcatttaccaaacactccatatactttgacct

SEQ ID NO: 35885 - DNA, 121 bp, Artificial Sequence
  Synthesized
  misc_feature (61): n=a or c
ttaagctattaaaacttctgaattgcatgggcagtcactggaattaactaggaaaaaaaanccctgccttcccacaaatcccacatctacattttaaacaagagagagacagagagagaga

SEQ ID NO: 35886 - DNA, 121 bp, Artificial Sequence
  Synthesized
  misc_feature (61): n=a or g
tgttgtcagctgaggtaaaagagctcttctacaagagcataataagctgtgaaggcctttngttttgtaattcatgtcttgttctgttggtcttctgggttttgatggttttcatgcagaa

SEQ ID NO: 35887 - DNA, 121 bp, Artificial Sequence
  Synthesized
  misc_feature (61): n=a or g
cttttcagcttttgttcacgtcttcctttttcttttttcgtaaatggcagcacctacatgnccagacattaggattctacagaaaatgctaaaaatcacaaataatccgcacttcaagtag

SEQ ID NO: 35888 - DNA, 121 bp, Artificial Sequence
  Synthesized
  misc_feature (61): n=a or t
aaaggagttgtcatctgccagaggaaaaggaagtgaaaagacaaggacgtttaggaagtantttctccctctcagttgagtgtttcaaacaggatgggaggaaataaaaacactcaactcc

SEQ ID NO: 35889 - DNA, 121 bp, Artificial Sequence
  Synthesized
  misc_feature (61): n=t or c
aggtgctgtagggaaaggaagaagtccctctcctggtagaatcaagtcacaaagtaccaantgcagccagcctcaagcaaactcatattgttgaagttgcaggctaacacagaaaacagag

SEQ ID NO: 35890 - DNA, 121 bp, Artificial Sequence
  Synthesized
  misc_feature (61): n=t or c
ccaacatcagcctcgggatgggcacggctggccagaaatgaaagccttggtaatagccaangctcactgtatgtgcagtccttgatttatacacctcagccacaggtgggtcttcgatata

SEQ ID NO: 35891 - DNA, 121 bp, Artificial Sequence
  Synthesized
  misc_feature (61): n=a or c
ttaggtacagagcagggatgatgtctatttaaaggctggaaactatggatttttttcctanaacttttgggatacctgtcacaaaacataacttggaatagccaaataatgtgttccaaaa

SEQ ID NO: 35892 - DNA, 121 bp, Artificial Sequence
  Synthesized
  misc_feature (61): n=a or g
ttcatttccttcatggagtaaaatacatgcttatgctcacaaaaggcactacaggaaacantaagaaagcattaatgttatctactgaaactgagttttatggacattcctgtcaagtgtt

SEQ ID NO: 35893 - DNA, 121 bp, Artificial Sequence
  Synthesized
  misc_feature (61): n=t or c
ccacatagttagataccaatgatacagatgggaaggggaatggatatataccactgttttntttcagtccaggtaagtttaattctgggtagttttaaaccttgcattaaagtatattggc

SEQ ID NO: 35894 - DNA, 121 bp, Artificial Sequence
  Synthesized
  misc_feature (61): n=a or g
agcatagctccaatcacagtgacactgccattattttaactcttgtggttaatgtggcaantcaaatctggctcagtaaacagccctggtcgtgctgtctcgcctccttaagattcctcct

SEQ ID NO: 35895 - DNA, 121 bp, Artificial Sequence
  Synthesized
  misc_feature (61): n=a or t
gactgggttgcaggttatgggggctgcggctgcctctgaattccgtccttcccatttggcntcttagtacttacaaactaacgcaccatggaaaggaaataattgttaaaaatacgtccat

SEQ ID NO: 35896 - DNA, 121 bp, Artificial Sequence
  Synthesized
  misc_feature (61): n=t or c
tcatatcttccctttgaatagaatataaagaatgaattttttgtcattctcacagtgccangctgatcttcagctagcagactctacattgcaaatcacagaaggcttgctttgtgaacag

SEQ ID NO: 35897 - DNA, 121 bp, Artificial Sequence
  Synthesized
  misc_feature (61): n=t or c
tcagcaagcaatgcttgtggccgcctcctgctgcgttcctgtgcagaggaagaggagggangggtgctgctgaagtctgctaggaatgggatgggtgtaggaccctatgtggctgctcaga

SEQ ID NO: 35898 - DNA, 121 bp, Artificial Sequence
  Synthesized
  misc_feature (61): n=a or c
gtttcaccatgcagggtgagcacggggctccaggcaagaggtcggtgcagggtgcttggcncctggggagagtgctctctcgttgagtttcctgactcctcatcccatctcactgcctccc

SEQ ID NO: 35899 - DNA, 121 bp, Artificial Sequence
  Synthesized
  misc_feature (61): n=t or g
gagaaggctgccataacatgcatgtacatagactgtgttggagctgtaggcacagactctnctgcagtactgctttgtacttgttttcagtgtactgctgtagtttccctgagaatagtgc

SEQ ID NO: 35900 - DNA, 121 bp, Artificial Sequence
  Synthesized
  misc_feature (61): n=t or c
ctgaaacttgattgaaattatatcacaagaaataagaaaccccaagagagaccgcaatganagtgagtgtgaggcggagtaatactgctacagaggggacaaaacacttcatcttggcctt

SEQ ID NO: 35901 - DNA, 121 bp, Artificial Sequence
  Synthesized
  misc_feature (61): n=t or c
tgtgttcggttcgggtttcttggaggatgttttttgccctgggattgcgctgtgtgcctcngacgggcgaatttcagcgagaaaatgcatggttgaggaacgattccgcatatatttccat

SEQ ID NO: 35902 - DNA, 121 bp, Artificial Sequence
  Synthesized
  misc_feature (61): n=a or g
tgaggaagggacaaagtggcacatggacactcagtgccaatggaggaactgccatcctgcnttgtggcactgcattgtgaagcttagcatgaagctaacagcctgataaggcaaaaaaaat

SEQ ID NO: 35903 - DNA, 121 bp, Artificial Sequence
  Synthesized
  misc_feature (61): n=a or c
ctttggtatgtgcagaagctcttcagtcattctggagctttgttgcagtgggcacctgtgncctgctctgcatacctgggcactcagtttggaagcagagagaatgctcatcctgtgggcc

SEQ ID NO: 35904 - DNA, 121 bp, Artificial Sequence
  Synthesized
  misc_feature (61): n=t or c
tagtggaccaaaagtagttacctgcttcaggtcctctgctttcagcatactctgttgtagntacactcccatgtgtacctcacatgcagtcctgtaggatacttttgagttcctcagttgt

SEQ ID NO: 35905 - DNA, 121 bp, Artificial Sequence
  Synthesized
  misc_feature (61): n=a or g
catttctaagacaaatcactgaaggaacatccatccctgtctctttttaataatagctganacaaacttctgttagagatggggaaaatgtgcttgagatcttgcttcagggagggggttt

SEQ ID NO: 35906 - DNA, 121 bp, Artificial Sequence
  Synthesized
  misc_feature (61): n=t or c
gcgttgcacaatgcctacaggatgcagtccacacacaacggtcagcgtgagaattaacagngcttgtgtgatgctatccaaacacaagataaatatatacacacacacacatacataaata

SEQ ID NO: 35907 - DNA, 121 bp, Artificial Sequence
  Synthesized
  misc_feature (61): n=t or c
agataaagcagtgtttgatacagcttgttctaattacctcagtgaagcctaaaattatttnctcttgacaggagtgaataccatggggcatgtcaagaaatgacttttttttctaacagtg

SEQ ID NO: 35908 - DNA, 121 bp, Artificial Sequence
  Synthesized
  misc_feature (61): n=a or g
ttccctttctataaataagggtgagtcaccattaccctgctgcagtgcggccttggcagcncccggctgaacaggcacaacaaacagcacaagttctgagtgcggggatgtgcccacccca

SEQ ID NO: 35909 - DNA, 121 bp, Artificial Sequence
  Synthesized
  misc_feature (61): n=a or c
tgcatgttgtatttattgcttactgaagttaattaattcagttctaaaacaagtggcttcnagatttaaagctttagaaggaccagacttgtctctgtttgcatttagcacttatttgtaa

SEQ ID NO: 35910 - DNA, 121 bp, Artificial Sequence
  Synthesized
  misc_feature (61): n=t or c
aatattcttatgacagggcaaaacagggatttggttttttaagttggaacattcacatctntgtaaggcactgaaatctgtcaagtacaatcagaatatttcaaaattgactcagaacagg

SEQ ID NO: 35911 - DNA, 121 bp, Artificial Sequence
  Synthesized
  misc_feature (61): n=a or g
ataaaacattgccacctatagaggtttcggcatccatctacattaatttaaatttaatgcncttgattgattttcagactaaatcaaatgcaattctgtggagtaatgcatggtacaaaag

SEQ ID NO: 35912 - DNA, 121 bp, Artificial Sequence
  Synthesized
  misc_feature (61): n=a or g
tgccacgcagatgaaaagactggaactaaatgaaggtgtgttgctgactcctcacacactnaacctttccctaaaacaaaggagcagatcaaagaaaggacaagcttctgcatcgcctgga

SEQ ID NO: 35913 - DNA, 121 bp, Artificial Sequence
  Synthesized
  misc_feature (61): n=a or g
acaattaattcagcccacagcctcttccctgctgacccctttcctaaggatccctcaggtncaagcagcatgaatgcagccatggtgacggtattatggtataggctgcagctccttccaa

SEQ ID NO: 35914 - DNA, 121 bp, Artificial Sequence
  Synthesized
  misc_feature (61): n=t or c
ccctgtgaagtaacacaagccttcagtgggctcagtggttttagtctctttccactgacantggaggaaaagtcaatttgttctgaatttcagcacagggctgtgtttgaacacaagcagg

SEQ ID NO: 35915 - DNA, 121 bp, Artificial Sequence
  Synthesized
  misc_feature (61): n=a or c
gtaatgagtaagtatctagtctctctgtcataaagaaatgataccgttgggtttagcactntaattggatgtttcattttccatcatcaataaccacattcatattagttatgcttatcat

SEQ ID NO: 35916 - DNA, 121 bp, Artificial Sequence
  Synthesized
  misc_feature (61): n=a or g
accgtcatcctgcggtactccttaaaatcacaagttgtacccaagctttgggcaccgggcntccccccgcaatgagccgatcagatttaagtgctaaatcccagagcaacaaggtttttga

SEQ ID NO: 35917 - DNA, 121 bp, Artificial Sequence
  Synthesized
  misc_feature (61): n=a or g
attctctcagctttgcgttctgcactctgtggggttttagctttttgctcacaccataacngcatcttctgctaacaaacattctgggacctcacacaaacatgccctgagccacagcttt

SEQ ID NO: 35918 - DNA, 121 bp, Artificial Sequence
  Synthesized
  misc_feature (61): n=a or g
ataatgcattcttgagaaggaaaaagaaacagcaaagcattacatatttctgccttccatntgtgtgctctgggcatctttcatccaaatctacctactgctgaatgctatgaaaatcaga

SEQ ID NO: 35919 - DNA, 121 bp, Artificial Sequence
  Synthesized
  misc_feature (61): n=a or c
aggccttatgcacatacaggcagtagaggatgttatattcacagacactccatcctttgtngatgcaggccgccctgatggcccactgcaggtataagatagttttctgaaataatcatcc

SEQ ID NO: 35920 - DNA, 121 bp, Artificial Sequence
  Synthesized
  misc_feature (61): n=a or g
atgggctcagccaagtaacgtatttctggtacgttaacacaaagtcaaaaaatcccttaanaagaaagtaggaataaatacataaagatatcatacaaagtattttgtcagtggtaagtta

SEQ ID NO: 35921 - DNA, 121 bp, Artificial Sequence
  Synthesized
  misc_feature (61): n=a or t
gctcccagctttcggtgtggatgcaactaacacatggcctgctctccgtgggatgcttaanaggagagtgaggagaggtggagcaaatgctggccttttttagcgctcttttacagctctt

SEQ ID NO: 35922 - DNA, 121 bp, Artificial Sequence
  Synthesized
  misc_feature (61): n=a or g
tgtgaaaagctaagagaattcaaacccctgtgactgtcagtcctcatccactgccacaacnctccttccaactccccatcaaaggggttaggaatgccttttccaaacacctcaagaaggc

SEQ ID NO: 35923 - DNA, 121 bp, Artificial Sequence
  Synthesized
  misc_feature (61): n=t or c
tgttgtgtacatatttgaagagattggctccatccccttcatgttttccttttatgtcttnatgtctctttaagataaagaagatccaataatactgctatgcattaaacattttttcttc

SEQ ID NO: 35924 - DNA, 121 bp, Artificial Sequence
  Synthesized
  misc_feature (61): n=a or g
gagcagtagggaggcagaagaggaaaaatatgtgcctctgacccatatgcagaagtcccanaacattttgcttatggcttgtgtaacagtgaatctcatgcaattgagtgggtacagttga

SEQ ID NO: 35925 - DNA, 121 bp, Artificial Sequence
  Synthesized
  misc_feature (61): n=a or g
aagatggaaggtttaaggaagaaatccagccctgcggggagagccaaggcaatgcccagtnctgccaggcatccctcatcagtacaggctggagcaggttctggggagggaccctgggagg

SEQ ID NO: 35926 - DNA, 121 bp, Artificial Sequence
  Synthesized
  misc_feature (61): n=t or c
gagctggggtgatggaatggagaaggattcggagctggcagaaggatgcattagaatcttntaatgcatgcactgatttcaggcaggcctcctttgtgcgccggcacctcactctgcttac

SEQ ID NO: 35927 - DNA, 121 bp, Artificial Sequence
  Synthesized
  misc_feature (61): n=t or c
cagaaccaccatcctgccagctaagtctggagttagctcagaaagaactggttcatataangagctcaccaatgttacctgctgcaccaagaaaggtggaaatggcattgaacacagtcag

SEQ ID NO: 35928 - DNA, 121 bp, Artificial Sequence
  Synthesized
  misc_feature (61): n=t or c
tgatacagctgcgtttttgacttgaaagatgactatcacaataaaacaggttgttcctccngcagagctgattgctccaggagtgccccatagagagctgaatgccgggactcctccgggt

SEQ ID NO: 35929 - DNA, 121 bp, Artificial Sequence
  Synthesized
  misc_feature (61): n=a or g
aaagaatgaagaagtttggatggaagaacaccacgagcttccaaaaaaagcagagcatggntgcagattaatttgttgtcacatcctgtgcttcttggttctgttctagtctgaagtacta

SEQ ID NO: 35930 - DNA, 121 bp, Artificial Sequence
  Synthesized
  misc_feature (61): n=t or c
actgacttctcccagttcctttcccttctagctgctacatacacatttgtttatcctgcanttggaataagctctgccttatttcttattatttctccatctcctggaaataaaaagtttc

SEQ ID NO: 35931 - DNA, 121 bp, Artificial Sequence
  Synthesized
  misc_feature (61): n=t or c
caacccaagccattctatgatcctatgatctacaggtagacatcagaagggctgacctacngaacacaaagtactacctgctgtggtgtagtaggaatggacacctctagcacaaagccgt

SEQ ID NO: 35932 - DNA, 121 bp, Artificial Sequence
  Synthesized
  misc_feature (61): n=t or g
gagcctggggaagacagcctgacctgtgggagggccctttcccacagcaatcagtttacgntcagacagcggccacgcaccatggctgcaggaaaaggtagttatccttcaaagctcagca

SEQ ID NO: 35933 - DNA, 121 bp, Artificial Sequence
  Synthesized
  misc_feature (61): n=a or g
ttcctttccagctgatggttcagatcctgcaggcaagtgcctgtctccaccttcacaaagntggcaagctctctagaattgagccaaaaagccatgaggaagtccccagaggagagggatg

SEQ ID NO: 35934 - DNA, 121 bp, Artificial Sequence
  Synthesized
  misc_feature (61): n=t or g
gatgctagcagcctgctctgaaaatagcagcgatgatcttttgactctcagctatcagaantgttcttaatactgttctatacaagaatatatcctaaagcttgcggagttatgatctttg

SEQ ID NO: 35935 - DNA, 121 bp, Artificial Sequence
  Synthesized
  misc_feature (61): n=t or c
atataatgcttaactatcaaatggaaagactgtggaatagctttggatatgacatgcctcncatttcttaagttcattacagtttcagagccctgtgactcggaataagaaagaaacaagc

SEQ ID NO: 35936 - DNA, 121 bp, Artificial Sequence
  Synthesized
  misc_feature (61): n=t or c
taatgcatacatttaaatgtctcattttcttacagcttaagccaaaaaacacttaaaaaanattattgaattgagtaacattcacaagtcttgtcatggctattgtaatcctatattgtat

SEQ ID NO: 35937 - DNA, 121 bp, Artificial Sequence
  Synthesized
  misc_feature (61): n=a or g
cagtccctgcagagcgactctcggacagagcacgcttttagaggaggcccttaacgccaanaatgcctgctatgaaactgttatttacacggagccccgcgcagtggggctgcaaagagcc

SEQ ID NO: 35938 - DNA, 121 bp, Artificial Sequence
  Synthesized
  misc_feature (61): n=a or g
tccagctgtcagcagcaaaacaaacccatgcacacttgcagcaaggaaaaagcaatttgcncactgtgcccaaagccaacttgggctaatgagagtcacaaaaaagaaagaaagaaagaaa

SEQ ID NO: 35939 - DNA, 121 bp, Artificial Sequence
  Synthesized
  misc_feature (61): n=a or g
ggacgtaggaaatcgagggaccttgccctttgtggtatctcatgctttcagcaagctccangttggtcaaagagagagcaacgctggtgagaaatgcaagacgtggtgctgcagggagcgt

SEQ ID NO: 35940 - DNA, 121 bp, Artificial Sequence
  Synthesized
  misc_feature (61): n=a or t
attttaggagactacatttacattatattctctcttccatgagtagaagaggggaaaaaantattctgagtaatattgcttgcaaactaagttttcatgcactgcattaagtggcccttac

SEQ ID NO: 35941 - DNA, 121 bp, Artificial Sequence
  Synthesized
  misc_feature (61): n=a or c
cctgagtgatgacaacaagaagaaaaaaagagtcagttttcctcatttagtgcaacgaaanagtatttttgaaattttggttgcttgagaatttccttaggaattttgagactggaaaata

SEQ ID NO: 35942 - DNA, 121 bp, Artificial Sequence
  Synthesized
  misc_feature (61): n=a or g
gaggcaggattcctgtatcgtgtttaggagagccacatatgtgcccagaactgcggttgcncctacccaagctctacctttgtaagaagctcattcatttgtctgctcccttggcactgcc

SEQ ID NO: 35943 - DNA, 121 bp, Artificial Sequence
  Synthesized
  misc_feature (61): n=c or g
caccagcatctgttcatgcagatgcctgttttttccccttccactcatgtattgaccaganctgacctacttagctgtgagcagctggcaactgcttagcctaaatatgtagctccagact

SEQ ID NO: 35944 - DNA, 121 bp, Artificial Sequence
  Synthesized
  misc_feature (61): n=t or c
tattctgcaatcacaattcattagaaaaacaatgaatgttctgttcaaaataattgtgcantggggagaggtttcaattactttgattaccagatctgtgaacttatcccacatagataac

SEQ ID NO: 35945 - DNA, 121 bp, Artificial Sequence
  Synthesized
  misc_feature (61): n=t or c
atatttcagcatagggtaaagtcaggaaatataagaaaaaacactgggatattttggtcangcagctgtttctatgaagggaaagaagaaattgcacacaggtagcagagatacagttttt

SEQ ID NO: 35946 - DNA, 121 bp, Artificial Sequence
  Synthesized
  misc_feature (61): n=t or c
gtcaaagttggagttgaagaggtcatgcaactgactgaaaaaataacagcaagtgacccantggtgaacttttaaggaaaggttagagagcgcaggatttttttctagtttattgttgtaa

SEQ ID NO: 35947 - DNA, 121 bp, Artificial Sequence
  Synthesized
  misc_feature (61): n=t or g
gataaagcataggtcaaataccgaactagcaatagctcctgatgagccttgcccaaaacanctagctgcccctctcccctctctggcaagggctgccaggtcacaggtgttcctcctgttt

SEQ ID NO: 35948 - DNA, 121 bp, Artificial Sequence
  Synthesized
  misc_feature (61): n=a or g
ttctgatggtgaagaagcaagttcaccactaggtaagttactccagtgctaaaaccttatnttttctcctattctggatttgtttagcttcagcttccagccatgggatcacgttgtgctg

SEQ ID NO: 35949 - DNA, 121 bp, Artificial Sequence
  Synthesized
  misc_feature (61): n=t or c
cacatcaatttctgcccacaattaactggggtgaaagaacaaaatgaaatctcagagcaancctcattcgctatcgactacaatttgttctttgcttttagataaaggccaccgtcaatct

SEQ ID NO: 35950 - DNA, 121 bp, Artificial Sequence
  Synthesized
  misc_feature (61): n=a or g
tcaggtggtctattggaagttcagaactggaggtggaacctacgcacaaagccaactctantagctgtcttcatgtcaaccactgacttgaaggcctcctgccactatttccatttctttg

SEQ ID NO: 35951 - DNA, 121 bp, Artificial Sequence
  Synthesized
  misc_feature (61): n=a or g
agctcccctacacagtcagagaaagagccatgagctcccgagatcagcatcaagagcaggntcacttctccggtccttctagagatctctaggcttcccaaacagggcagggaactacggg

SEQ ID NO: 35952 - DNA, 121 bp, Artificial Sequence
  Synthesized
  misc_feature (61): n=a or t
agctcttccaaccaagtgcaagtagcctcccagaaatttccactttttacacattcttganggcatcaagcaggtgcttgtactaccagtttctatcccctcccatttacatcctcatttt

SEQ ID NO: 35953 - DNA, 121 bp, Artificial Sequence
  Synthesized
  misc_feature (61): n=a or g
gaaaaccagcttattctcttcttccaccctctcctcagggagggagatctagtatacacantttctcctagaggcatagggctcactgatacacaccttacttctgcaaggtagaaggata

SEQ ID NO: 35954 - DNA, 121 bp, Artificial Sequence
  Synthesized
  misc_feature (61): n=a or g
aaacacttcactgttaattcaacagagaacatgacttctccttcaggtgaaatctgtggangttagtgctggatctaacatggacagaaactatggctgaaatatcctggctgaatcccac

SEQ ID NO: 35955 - DNA, 121 bp, Artificial Sequence
  Synthesized
  misc_feature (61): n=a or c
cattgcgcagtcttcaatcctgtcctgctactctgaagccatagtttaaactgagcccagntataatcccaaagcacagcggaaaggctagctctgcagacaactcctgcatcttctttta

SEQ ID NO: 35956 - DNA, 121 bp, Artificial Sequence
  Synthesized
  misc_feature (61): n=t or c
aggtattactataaaataaatgttcatggggcttacccattgcccatcttggaactatctnttgcatcaatttcaagccactaatgactacaagggaaaagcctggtgttaaggacacaac

SEQ ID NO: 35957 - DNA, 121 bp, Artificial Sequence
  Synthesized
  misc_feature (61): n=a or g
cagttttccttttcttatagaaatgcttttactgtgaaatccatgtaaaagtaatttgctntggatagggaatgtaggctttcacatatttaaagttccaattttgtgtcaggcatctgta

SEQ ID NO: 35958 - DNA, 121 bp, Artificial Sequence
  Synthesized
  misc_feature (61): n=a or c
tgccaaaaaaacccatccaagcagcacaggaaggatgggagagaaaagagcaggaggtgtngatggggagaggaattctgtccccgctccgtctcgcgcacgagtgcgtattatatacatg

SEQ ID NO: 35959 - DNA, 121 bp, Artificial Sequence
  Synthesized
  misc_feature (61): n=a or g
atcacgtgtggcacacagaaaacattccccgacttcaggacttccctgaaagctggggaantcatgctggacagcattttctggtccttctctgggaagaggcagtccctcttggtaacaa

SEQ ID NO: 35960 - DNA, 121 bp, Artificial Sequence
  Synthesized
  misc_feature (61): n=t or c
gcttatgggcatggtgaggatcacggagggcacagcccagcctcaggaacatgaaacgtgngccaaacatggcacagcccaaccacaggcagatctcccagtgatgcttaaatcaaagagc

SEQ ID NO: 35961 - DNA, 121 bp, Artificial Sequence
  Synthesized
  misc_feature (61): n=t or g
ggacatgtaagaaaacccagccctacactttccactcgaaactgcttttagcttgaactanaaggtgcaaagaagagagctgaactggttgcgggggggaggggggggctcgagtggcagg

SEQ ID NO: 35962 - DNA, 121 bp, Artificial Sequence
  Synthesized
  misc_feature (61): n=t or c
accctaccagtaagagcagcctggatttgggaggtgagccaaaaagtgcagttcgtcccgnggggagcgtgtcaggaaggaagtagggaaaatgccagcaaagccagagacaaattcatct

SEQ ID NO: 35963 - DNA, 121 bp, Artificial Sequence
  Synthesized
  misc_feature (61): n=a or g
gtgcaagaagtctttgggctcaaagcagatggccatgccctgcacaggcacatcatcattngcagacgggttgtagccgacatttgtccggacagcaaatgcaactggcttcgtctgcagg

SEQ ID NO: 35964 - DNA, 121 bp, Artificial Sequence
  Synthesized
  misc_feature (61): n=t or c
tgacatcttaacagcttagttgagtttaggaggcagttctacttaaatgaggcttttatcnttacctgtgcagctatttcttatgggaatataagtatttttaacagattcttatctaatt

SEQ ID NO: 35965 - DNA, 121 bp, Artificial Sequence
  Synthesized
  misc_feature (61): n=a or c
atgtagtttaggggaagcatggagattcactaaactgcccaaagacaggaagtacgtctgnttgtttctgctggggaagaaactcagaagtgaacccacttctttgttgtccctctctcat

SEQ ID NO: 35966 - DNA, 121 bp, Artificial Sequence
  Synthesized
  misc_feature (61): n=t or c
tgcagaaccacggcttggctgggctgcaaggggagcaagagcctggaccttgggggattgntttctctgccctacatggagcttgaaaaactggaagccttgaggttcccaataggagaaa

SEQ ID NO: 35967 - DNA, 121 bp, Artificial Sequence
  Synthesized
  misc_feature (61): n=t or c
aggagcagcataggaagggctgcagctgaggatgcactcttgcagacaaaggcccagctgntcaggactgtcagtctgttgttaagaagtgctggatgacattcatcactcagtatgcaag

SEQ ID NO: 35968 - DNA, 121 bp, Artificial Sequence
  Synthesized
  misc_feature (61): n=a or g
cctctttttatttccctttattaatgatctggaaagctttcagagcaataatgcaattagnatgcttacttagatatggtcctcttgcttcccatcctcggagaaagggcttggagtttgg

SEQ ID NO: 35969 - DNA, 121 bp, Artificial Sequence
  Synthesized
  misc_feature (61): n=a or g
cgaaggccgtagaaccaagggaagaagacaccttaatgaggtcagcaccacattaaggtgnttacatgactacacatcaattaaagactgcttaccagcagaaatcaagaaggcatacgtg

SEQ ID NO: 35970 - DNA, 121 bp, Artificial Sequence
  Synthesized
  misc_feature (61): n=a or g
tccaccctgccggggagaaaagagaatgcaggttagtggcatgcaaaggatccctgctacnacagcaagagcagagcacaagctggcatcaccagagctgctcaaagatacatctggccct

SEQ ID NO: 35971 - DNA, 121 bp, Artificial Sequence
  Synthesized
  misc_feature (61): n=a or g
tgttccagtgtatcccaaaagggataaggaaataaataaacattagctaatctaatctgcngcttcctcagctgggaagcagagaactgagatgaatcttcaacaacaacaacaacaacga

SEQ ID NO: 35972 - DNA, 121 bp, Artificial Sequence
  Synthesized
  misc_feature (61): n=t or c
atgttgattcctctggatcaacactggctgctgatatttctaggcttttactccttacatngctctgtaaacagagcctaactgctgtttgtttgtttgtttaaatcttgattgtttcccc

SEQ ID NO: 35973 - DNA, 121 bp, Artificial Sequence
  Synthesized
  misc_feature (61): n=t or c
gagaacggcggctccaagcttagaaaatggaaactccaaacatcccaaactgagtcaaagngaaggagggggaaaataaactcacgctgtggtttacagttcggggtgcccggatcctccc

SEQ ID NO: 35974 - DNA, 121 bp, Artificial Sequence
  Synthesized
  misc_feature (61): n=t or c
tctagcaaaattctgttcatactgaaatgagctgcaaatctccagatatcttcataggagngaaagttttaccagattatagaaaactgggttggaagttggaggaaagtgcattccaact

SEQ ID NO: 35975 - DNA, 121 bp, Artificial Sequence
  Synthesized
  misc_feature (61): n=t or c
cagggtgctcagcttgggcaactggagcagctgtgctgactgcagaccagctcatatcccncaccttccctcatggtctattgtgacaggactgcgctcatcagcctacttgtgttccact

SEQ ID NO: 35976 - DNA, 121 bp, Artificial Sequence
  Synthesized
  misc_feature (61): n=t or c
ggtaagctatcattttaagacaaatagtatgtggttcctctatacagtcatgtaataaagnaatccaagacccaaaaagctaaacaggctacagactgcaacacagaatttcacattgata

SEQ ID NO: 35977 - DNA, 121 bp, Artificial Sequence
  Synthesized
  misc_feature (61): n=t or c
gcctgggaagcaggagggcagggagcgctgacctcagcttgtaaaactgaggcgggagttnagaaatgagacctggcagcaatctggaaattagtcctgggatgtgaccgactgctgctgg

SEQ ID NO: 35978 - DNA, 121 bp, Artificial Sequence
  Synthesized
  misc_feature (61): n=a or g
gcacgacgcacccagccctcagacaggcatcagttggttcctgcctcttggcagcgcaccnaccggcagtacggcttcacaggcacaaaatgctctctctcaaactgtcccagtgagaaac

SEQ ID NO: 35979 - DNA, 121 bp, Artificial Sequence
  Synthesized
  misc_feature (61): n=t or c
accctacgtctcatttcagtgggacgctcagcatttcagtgaccagcagctcctcctaccnagggatttggctatacccaacccaaggggccatctccaaaggggctgatggcaaacgcca

SEQ ID NO: 35980 - DNA, 121 bp, Artificial Sequence
  Synthesized
  misc_feature (61): n=t or c
gcctggtagcttcatgagcctgcaaatgaattcccagggcatgtgcttggcagtccttgangccaaaggggaagctgactgccatccttctctgtagatcctcatcctttagcattaactc

SEQ ID NO: 35981 - DNA, 121 bp, Artificial Sequence
  Synthesized
  misc_feature (61): n=a or g
agtacaacagatcactgtatgcacaggagtgaggatatagaagaaaaggtgaaatctacanccttctgattttttctatataagtaatgagaaaatcttttcataaaaaaaaaaggggggg

SEQ ID NO: 35982 - DNA, 121 bp, Artificial Sequence
  Synthesized
  misc_feature (61): n=a or g
tggctgagtaacttattttggctacttattgtagcaatttgttcttccccagatccacctntaatacaacacgctgctgcttatttatctacctctaccataaatatttacaaataatctt

SEQ ID NO: 35983 - DNA, 121 bp, Artificial Sequence
  Synthesized
  misc_feature (61): n=a or g
tccctggaaaagcacagagaaaacagtggcccatgtaaagggcttggacctgctgcatggntctcactgtgtaacaaagatatttctctgtccccgaagcagatgttttggatggaaaatg

SEQ ID NO: 35984 - DNA, 121 bp, Artificial Sequence
  Synthesized
  misc_feature (61): n=t or g
tacccactcatcagtgtccagggaacatgtagtactcccatgctgattggtatcagatganaaaggcagcacgtttgaaatctctccatgtaggaaattatcaggtgaaacagtgctggag

SEQ ID NO: 35985 - DNA, 121 bp, Artificial Sequence
  Synthesized
  misc_feature (61): n=a or t
cttcccaagatgtccccatgtgtagggagtgagcacacttagggacatggtaatttatggnatcatttaccatgaggactgtgaatcgtcactcagaaagcagggaaataaatgaatgagc

SEQ ID NO: 35986 - DNA, 121 bp, Artificial Sequence
  Synthesized
  misc_feature (61): n=t or c
ctcaggtttatcagtctgtgctcaagtatttaccagtggaacagacagcaccctctgaggntggggaccttctactgaaaatccaccttgcagaggactttccacacagctaggaaatgga

SEQ ID NO: 35987 - DNA, 121 bp, Artificial Sequence
  Synthesized
  misc_feature (61): n=t or c
gtgtagacaaatgtggaagatgcactggggacagcatcacattaggaagttagacctgttncttaaactcctggcagaaactgtggaaaaataaatgcagtagtagtgtacttagccttat

SEQ ID NO: 35988 - DNA, 121 bp, Artificial Sequence
  Synthesized
  misc_feature (61): n=a or g
gaaacttgatggtatggaacctgcacagacattagctctgccatctttctgtctgcctcantggctacaggagtcctctgcagagcaagagcacgcacagccccttgcaaagagtaaagca

SEQ ID NO: 35989 - DNA, 121 bp, Artificial Sequence
  Synthesized
  misc_feature (61): n=a or t
tagccagcaggaagaggaacagaactcacaggctgctgtgaatacacagcagccctccaancatttttccttgtaattagagcaaagtttagcgtgaactagaaaaaaactgcatccttga

SEQ ID NO: 35990 - DNA, 121 bp, Artificial Sequence
  Synthesized
  misc_feature (61): n=t or c
cattatatgtgttaattacactggttcctgctgctagccctgccacttcacagtgtcaaangtaaagaagcagcagtgccagtagcccaggtaacacttgtgaaatcccttcttaacggga

SEQ ID NO: 35991 - DNA, 121 bp, Artificial Sequence
  Synthesized
  misc_feature (61): n=a or t
ggacattttgaaactagtgaagtgaaacggacctttcctcaccctataatgccaaaacatntggaaaaggaagtgggagagggtgaggattggagaattaaaatcatccacatttagcact

SEQ ID NO: 35992 - DNA, 121 bp, Artificial Sequence
  Synthesized
  misc_feature (61): n=t or c
ctacaagcttcatattgcaagagttatgaattataataaacgcctctaaattataataaangcctataaattcctatcccccaagacatcttacaactaatgctgtaaagtcaacaaacca

SEQ ID NO: 35993 - DNA, 121 bp, Artificial Sequence
  Synthesized
  misc_feature (61): n=a or g
ttagaaaaacactaggaaaatatatccaacaacctattagtaaaaacttgaaaaaagtagnaaaagaagaagaaatcaacagatctgccaaagatatggtgctgcgttacaccaaattaat

SEQ ID NO: 35994 - DNA, 121 bp, Artificial Sequence
  Synthesized
  misc_feature (61): n=t or c
atatggcagagtgttctcatcttgcctatatgatcacatccaggggctcttgacacgctcntgtagagagcaaaatgattcagcccaggtattccaatgacgacaagaccagctgatgggc

SEQ ID NO: 35995 - DNA, 121 bp, Artificial Sequence
  Synthesized
  misc_feature (61): n=a or c
agcctgcctaatgctttagaaactttagtccccttacagctttgcctgctgacatagcttntgagctttattactgttaacaggttttagatctctgagtcctttcatgtccaagaagtga

SEQ ID NO: 35996 - DNA, 121 bp, Artificial Sequence
  Synthesized
  misc_feature (61): n=c or g
caaacttcttttccactttactgtgaaattctagaaggctaacattgagccaagatgagantcattagagttcagaattctaattccaaacaatgaattaattagattgctgacagtggaa

SEQ ID NO: 35997 - DNA, 121 bp, Artificial Sequence
  Synthesized
  misc_feature (61): n=t or c
gactgctttcagtgtcctatcgtgtctttttccatcttctgccttataacattttctatgncttgtaaactgataggaattcattcctcaatggtcatacacaggggttaataagcttcca

SEQ ID NO: 35998 - DNA, 121 bp, Artificial Sequence
  Synthesized
  misc_feature (61): n=t or c
gaatggcctgtgtgggatataaagaagagaaatacatggaggaggggattgaacaaacagnagtcagagtgttctaggctgacaaggaaaagcaattggaatcagtagaatatctttgtat

SEQ ID NO: 35999 - DNA, 121 bp, Artificial Sequence
  Synthesized
  misc_feature (61): n=t or c
tggagcagcagaggggctgctgcaagactgggattggctgtggatggcactgaggaagagncctcttctcacaccctcacctacaactgggaaccactctgcttcacagctggtcaggcat

SEQ ID NO: 36000 - DNA, 121 bp, Artificial Sequence
  Synthesized
  misc_feature (61): n=t or c
ctggttagaagagacggagacaataaatgcaaagggtaaatgaagtaacccaagaaaaaantgtatgagatacaatatagaaaattaaaagcgaggcataagagaacagtctctaaggaag

SEQ ID NO: 36001 - DNA, 121 bp, Artificial Sequence
  Synthesized
  misc_feature (61): n=a or c
tgatgagcattttgaagctctgtataacatacatgtgcttacagcataccgtagatgctgnagcttatagcagcaacaaaaagatatggcaaaatttcaacaaacattacagtagtaccca

SEQ ID NO: 36002 - DNA, 121 bp, Artificial Sequence
  Synthesized
  misc_feature (61): n=t or c
gctcagttctgtgtctgcctcttcctgcactgctgcctgagctctgcccacacctctgtcnttcatcctcctcgaagggaacattgtggtgaaatcaatgagagcgactcacacggcccca

SEQ ID NO: 36003 - DNA, 121 bp, Artificial Sequence
  Synthesized
  misc_feature (61): n=c or g
attgtgacctgcactgaggaaagaaaggaggacccctgggttcgagtcgtgctaatgaatntgaaaggaatggaggagaaatgggtctggcacagtttctgctcctgctcccacagaccta

SEQ ID NO: 36004 - DNA, 121 bp, Artificial Sequence
  Synthesized
  misc_feature (61): n=t or c
aagcataatttcaagagggtgcaaagggtcctcatttcaatcaattaatgttactgtgcanaaagctaactcagaaaatagcagctatgcttcagtgtaccacagcttacgactgcatgtg

SEQ ID NO: 36005 - DNA, 121 bp, Artificial Sequence
  Synthesized
  misc_feature (61): n=a or t
ataccaaacaactacaagtttacaagcttagattttgtttcctttctgtggataaccatgntccaaaattagcaacaaaataaagaattgctctttcaaagtaattaaaaaattaatttat

SEQ ID NO: 36006 - DNA, 121 bp, Artificial Sequence
  Synthesized
  misc_feature (61): n=t or c
ttttagaaagacaaaaccttgtttccaaaaatctccaaatctttctttcaaaatagatacntcttgcatgaattgaatgtttagcatatgcagacactcagaaataatgccactctgcact

SEQ ID NO: 36007 - DNA, 121 bp, Artificial Sequence
  Synthesized
  misc_feature (61): n=t or g
cttactgggaactgtttctgctgctttccactgctttctattgagtgatacatgaaaatcncatgcagcaagtgctacctaacagtgaatacgtttacatttaattagtacttattttagg

SEQ ID NO: 36008 - DNA, 121 bp, Artificial Sequence
  Synthesized
  misc_feature (61): n=t or c
aagccctggaacactcaatgcccaaggtcaatgtcagtgtgctgctatgaaaagcagctanggaaccctcaggagaatcaattatgagcatatgagaaatagtcttctcccctctgtgaga

SEQ ID NO: 36009 - DNA, 121 bp, Artificial Sequence
  Synthesized
  misc_feature (61): n=a or g
ttttgtatagtcagctacactttaatgcatttttaatggagtaaaagcctataatggctcntttaaatttacaaataaacaagatttaattcctttttatttccaattacagatgctctga

SEQ ID NO: 36010 - DNA, 121 bp, Artificial Sequence
  Synthesized
  misc_feature (61): n=a or g
ggtgacatcaggaaggcagattccttttgacagaattcttttaacaataaactacacttcntatcgttacgtgcctctacgttgccatttctctggagatcacaaagtcctttttgaatat

SEQ ID NO: 36011 - DNA, 121 bp, Artificial Sequence
  Synthesized
  misc_feature (61): n=a or c
tatatgtatgtgctaacaaaaatgaaggcttgtctggagtaaatatctactttaatctagntaaaaaatatattgactacatacagaatcaagcagcagtttgatcttgcactatataatt

SEQ ID NO: 36012 - DNA, 121 bp, Artificial Sequence
  Synthesized
  misc_feature (61): n=t or c
ccgggaagatgtcggataattcctgtgcagtgtatctgttcttacctgtgctcacctgtgntctgatgcgcagcatctgcctagtaacgctttcccccgccggacgctccgcttccacggc

SEQ ID NO: 36013 - DNA, 121 bp, Artificial Sequence
  Synthesized
  misc_feature (61): n=t or c
actaatcctgcaatataatagactttcatagagatatggaaaatggctgcttttttatctnggttgccatgggaaccatcagagagaaggcctagctgagatgcaatagaaggttattaaa

SEQ ID NO: 36014 - DNA, 121 bp, Artificial Sequence
  Synthesized
  misc_feature (61): n=a or g
aattaaatttcaaaaaatactttatttttatgtctagttaatattggctgtgtgctttgcncaactcaagattgcaatttatttcctaagtgtgacagaattcatcacactggagatgcat

SEQ ID NO: 36015 - DNA, 121 bp, Artificial Sequence
  Synthesized
  misc_feature (61): n=a or g
gtttcctccatattttatagaaggcaaatgcgattcattgcaatgcttttggagagggcanaggtggagcttctgtatagcctcctccaaagaggatacaagcctgtgtctgcgtgaaagt

SEQ ID NO: 36016 - DNA, 121 bp, Artificial Sequence
  Synthesized
  misc_feature (61): n=a or t
taataagctactagtttttttaaaggtttttaaggcagttgcattgtcatggagacttagnactgtgcagttgcaattgttaccagagttcagtctctgacacaagaagaagcttataggc

SEQ ID NO: 36017 - DNA, 121 bp, Artificial Sequence
  Synthesized
  misc_feature (61): n=t or g
ctttagatagttaaagagaaccatcagcttctgccatggaacttaaaattctgagaccctnttctggatgttttcattgttcaagcagtagcagagactgcttctgcctctctcccagtaa

SEQ ID NO: 36018 - DNA, 121 bp, Artificial Sequence
  Synthesized
  misc_feature (61): n=t or c
atcttcaaagctccacctgtctgaaaatcctaaacagatttaaaggaaagtataaaattcnacccctaaaattgccgaagtattcataaatggcatcttattcgtgattaaatctgttgga

SEQ ID NO: 36019 - DNA, 121 bp, Artificial Sequence
  Synthesized
  misc_feature (61): n=a or g
acatgtgaagttttaagcatattttgggaaactctagtaatactgcctaaatcaatcctcnttttcctatggatttatgaaatggttcatcttccccgtcagccatgtgtgttgcagtaaa

SEQ ID NO: 36020 - DNA, 121 bp, Artificial Sequence
  Synthesized
  misc_feature (61): n=a or g
caccctctgaggcactactatagtccaatggtaacatttcaaatcaacttaaattaagccntaccacattccattgcatgatatcatgcaacagatgttacactccgaacacacaggacaa

SEQ ID NO: 36021 - DNA, 121 bp, Artificial Sequence
  Synthesized
  misc_feature (61): n=a or g
gttgtgaagtacctcagccacgtgctccggtcccccaaagtgattgattagttcatccaangtattgagaggtagctctttgcccagtgcttttacttttgctagtaggtcctgcttcatc

SEQ ID NO: 36022 - DNA, 121 bp, Artificial Sequence
  Synthesized
  misc_feature (61): n=t or c
cctggcactgagagctgatgattcacagagcacggaatggaggtctcggcctggcctgtgngcacttcgggtggttacagcgggttggctgtgtttctttgcaatgggccgggctggttgt

SEQ ID NO: 36023 - DNA, 121 bp, Artificial Sequence
  Synthesized
  misc_feature (61): n=c or g
tcatggatgctaaacatgagaacatattttcctgtcttccctagtggcaacaatatttcanctttgacccaacaagtatttatgcattgtgcattcttgtcatatatacatgaatgcacaa

SEQ ID NO: 36024 - DNA, 121 bp, Artificial Sequence
  Synthesized
  misc_feature (61): n=t or c
aatatatttaaaatggctctgatatttagaaaagcagatagtcttccatgattaccagcantctgacagaaaattcaaaaaaaaggaggagctacatgcacaatgaagggaattagcataa

SEQ ID NO: 36025 - DNA, 121 bp, Artificial Sequence
  Synthesized
  misc_feature (61): n=a or c
aatcatgaggtagggataaatttttgtgaacacactaactggaatttctttcttgcagaanttaggtacactgcaaaaaaatcaggacgacttttaaatttgcttaacctttgtgtacaat

SEQ ID NO: 36026 - DNA, 121 bp, Artificial Sequence
  Synthesized
  misc_feature (61): n=a or g
ccgaatgcagcaggccactcatggcctcagcctggagtcaagatgctgctgctgtaggaanagcacaatctgtgggagcgctgctggaccagtaattgaccactgctggcatgatacaaaa

SEQ ID NO: 36027 - DNA, 121 bp, Artificial Sequence
  Synthesized
  misc_feature (61): n=a or g
taggtaaaccagagtatttccaaactgcaagttaaggtagccttagaaacacagacatacncacatggctttagcaaaataggtgcatggtcacagccatgaaggtgaggactaaatattt

SEQ ID NO: 36028 - DNA, 121 bp, Artificial Sequence
  Synthesized
  misc_feature (61): n=c or g
acccccgtgctgtgaaaaacgtgtacagtgaaggcttgcccaaagcatcgctgaagctttnctcagagatgtggaatgcagacaggtttggatctaatacacagggggccgcagctccctt

SEQ ID NO: 36029 - DNA, 121 bp, Artificial Sequence
  Synthesized
  misc_feature (61): n=a or g
tgtaccctagggcttgtggtttatatgggaagttcttagcttttcttggcctctgggcaangtctagctgagtgagttgcatgcttcagtaaagagcacggactcctctccctggcagcct

SEQ ID NO: 36030 - DNA, 121 bp, Artificial Sequence
  Synthesized
  misc_feature (61): n=a or g
agaggcgctagttctaagcggggctgaacagttaggtttcaccggcgtttccacagcattnctgatgtcagcagggaggttcccctagggctagcaatggtggaggggttggaaaggctgg

SEQ ID NO: 36031 - DNA, 121 bp, Artificial Sequence
  Synthesized
  misc_feature (61): n=a or g
ataataacaaaacagcaaaaaagagcatggtttctatgctatacataaatcagtcattttngttgtcaaagaggcccaaatctctgtttcacttgagaatgcttttgctctctatttgttg

SEQ ID NO: 36032 - DNA, 121 bp, Artificial Sequence
  Synthesized
  misc_feature (61): n=a or g
tggcactccactgcactccttctaggagatctctgtcttttttggactgaggagcccacanctggggccagaattctaaacatggtctcaccatgtcagtgcaggggggaaggatcacctc

SEQ ID NO: 36033 - DNA, 121 bp, Artificial Sequence
  Synthesized
  misc_feature (61): n=a or t
tgtgctccagaacaggccagggaggtaaggggataggcgcagccactctcccagctgatgnctctgggccttgacttcctctacctgattgcctgtggggactgaactttctgcaagcatc

SEQ ID NO: 36034 - DNA, 121 bp, Artificial Sequence
  Synthesized
  misc_feature (61): n=t or c
ctattcaattcagcgtacatttcatctgggagcagcacttaccagcaagtaattattcttncaaagatgtgcatcagaatggattgtgcttcccaagaacaaaggcttaaatgagacctcc

SEQ ID NO: 36035 - DNA, 121 bp, Artificial Sequence
  Synthesized
  misc_feature (61): n=t or c
ttataaaaagtgattcaattttacactaaagttagtgtgccttcaccccaaacacctccanactgtggttactgcccaggtacctgtgggcaaagctacaaaaacactaaggtgaccagca

SEQ ID NO: 36036 - DNA, 121 bp, Artificial Sequence
  Synthesized
  misc_feature (61): n=c or g
ccagtacgtttcagatactgattaataataaggcaatgacaactcctcagtattctttttntaagtaaccatccaccagactcaacctgtgcctttaagagtgctgctgcaggctcctctc

SEQ ID NO: 36037 - DNA, 121 bp, Artificial Sequence
  Synthesized
  misc_feature (61): n=t or c
agatttagatctctctaggtgaattcttgtactcagtaagacctaatcaggtcttagtggnggaggctaaggtttgagggcttgacctctttggctgagatgagggcaaaactggagctga

SEQ ID NO: 36038 - DNA, 121 bp, Artificial Sequence
  Synthesized
  misc_feature (61): n=t or c
gtatctgctactggccagagcagaggagaagtgaatgctagagggaactgcattcagctcntcttgtaaagaaaggctgaaatggagttgaactcaatgagcctcagagatgctttccaat

SEQ ID NO: 36039 - DNA, 121 bp, Artificial Sequence
  Synthesized
  misc_feature (61): n=a or g
tcaagactcaatccatttccaaagggcacagcacaaatggcaaaccattttgtgcttgctntttggatactttcctctgaaccctggtcataggaaccggagacaacctgctgcaacagca

SEQ ID NO: 36040 - DNA, 121 bp, Artificial Sequence
  Synthesized
  misc_feature (61): n=a or g
cgcagcctggagtgcagcgtcccgtgccctccccgtgccgtcatggtgaatgtgcacaacngaacccgcccgacctttggccatctgtaaatagaagggctggatcaggtgagcgtgggca

SEQ ID NO: 36041 - DNA, 121 bp, Artificial Sequence
  Synthesized
  misc_feature (61): n=a or c
tttaatcttcatgacgcaaataaattagagcaggttttgtgtttccatagtaccacctagnattgtttctagaacaagtaaaggaatcaccagtttgttgtatttgttttggttcaaataa

SEQ ID NO: 36042 - DNA, 121 bp, Artificial Sequence
  Synthesized
  misc_feature (61): n=t or g
cagcccaagctgcagcaggacctcaatgctgcatccagcaaggggagatgggacctccttnaccatgggctgtgctgaagcaggattttccctcccaagctgcacagcctctccctgctcg

SEQ ID NO: 36043 - DNA, 121 bp, Artificial Sequence
  Synthesized
  misc_feature (61): n=a or g
ggagaaatgatttccagatttatttgaaggaagtttgtcacgttttttttgattctgtacnacagcttccaatcatgagtgcagcccatcaaccagcaaagttacaaagcaacaggggaca

SEQ ID NO: 36044 - DNA, 121 bp, Artificial Sequence
  Synthesized
  misc_feature (61): n=t or c
tccccctgcatcatcagtaccccaaaatcatacatgtttatccctacacacacagctgtcntccatatgtgcccatctcccataccaccacatcccactgaaccatatatatgtacaacca

SEQ ID NO: 36045 - DNA, 121 bp, Artificial Sequence
  Synthesized
  misc_feature (61): n=c or g
aaaaaaaggtcatttcattacattggctttctgaaacagttcagatttattgtttgtcctnagggcacaaaaaatacaaaatctgcttatgaagagtctaagccattttcccttgattaga

SEQ ID NO: 36046 - DNA, 121 bp, Artificial Sequence
  Synthesized
  misc_feature (61): n=a or c
caggacatggacttggtgatctccatgagcttgggacattctatgatttgctgcttcctanatcagcaagtttcaccgaagctcatctccccacatccaaaaaaccactgtctctattgag

SEQ ID NO: 36047 - DNA, 121 bp, Artificial Sequence
  Synthesized
  misc_feature (61): n=t or c
aactctgatcttgacagatttccacaagctaggtaggatccagatacactcaactgagtantctcagcagaaaaaccttgctaattttgtttttgtggtctgtgacccaggagcccacgaa

SEQ ID NO: 36048 - DNA, 121 bp, Artificial Sequence
  Synthesized
  misc_feature (61): n=t or c
tgaggtgctgagcccattcataaggcccccacgtgctgtggcaatgaaggctgcagcgaanacttgagcaatgctttgctgctggctgggatccctcggctgactcagtgtgcagcgggtc

SEQ ID NO: 36049 - DNA, 121 bp, Artificial Sequence
  Synthesized
  misc_feature (61): n=t or c
ttgaaaatgcaatctaagctctcttttttttatatataaaagcagtccaaggtatacgaangtgtcactggaagacgtgcagtcatttttccatgctactgaatggcagcaaagcctgaag

SEQ ID NO: 36050 - DNA, 121 bp, Artificial Sequence
  Synthesized
  misc_feature (61): n=t or c
atttttcccaagaacatggcaaggttggactatgcagtgcttatggacttgtcccagttcncctctctccctccaacccctaatttaaattctatataggcataaaactttcagtctatgt

SEQ ID NO: 36051 - DNA, 121 bp, Artificial Sequence
  Synthesized
  misc_feature (61): n=a or g
atatattgagcccttgctttatatccagttctgctttctcgttctctttagtacccaaacnctgtcttgtgtgaggctctggcatatggacatgcttaaattagcctttattctgacctgg

SEQ ID NO: 36052 - DNA, 121 bp, Artificial Sequence
  Synthesized
  misc_feature (61): n=a or g
aaattatctgacgtgtgaaggttatcagtgtgatacatgatgggagttatctgctaaaaantgctgttactcgtagcttttatatatgacacagactggtgagacagaaatgaaatattac

SEQ ID NO: 36053 - DNA, 121 bp, Artificial Sequence
  Synthesized
  misc_feature (61): n=a or c
taatagctcaagtgaaatataaagagcttcttgaaggtctatcagattgtggcagtatcanctgaagacttttctagtcttatggtattatgtattttaaaatatttacagctgttagagt

SEQ ID NO: 36054 - DNA, 121 bp, Artificial Sequence
  Synthesized
  misc_feature (61): n=a or g
gttgtatgctattattccaatagatgcattttcaagataaatccatctgtaaccagctatnctattagcctaaaatgcaacaaaaaatgggcgaatgaatcagaactacatgaacaaagca

SEQ ID NO: 36055 - DNA, 121 bp, Artificial Sequence
  Synthesized
  misc_feature (61): n=a or g
cacagttctcttcaatttcaattaaagatttaccaggcaggcattggcatccatggggcanccttagtccagcacggagcatctgtgtcactgcgctgggatgaggcggctcatggcaaag

SEQ ID NO: 36056 - DNA, 121 bp, Artificial Sequence
  Synthesized
  misc_feature (61): n=t or c
aaaaatttgcttttaaaaacatcggtccctcgttgccctgtttggaaaagaaagctgtaangtgaggagcactgcacacctaaggagggatcccttagtgttgtccctatgggataaaaga

SEQ ID NO: 36057 - DNA, 121 bp, Artificial Sequence
  Synthesized
  misc_feature (61): n=a or g
agaataggtttcccagtgactgacttggcacagacacaatgtaggaaatgcttctgcccantatcaaacattcaccttctgacagttccaggggacatctatccttcacagcagtgctgag

SEQ ID NO: 36058 - DNA, 121 bp, Artificial Sequence
  Synthesized
  misc_feature (61): n=t or g
tttctttgcctgttttcctttcattactttccttactttttggaggaagagaggacaaaanaaataaacagcagcattttttggcatttttgaaagcagcaaacctgagcattgccagaaa

SEQ ID NO: 36059 - DNA, 121 bp, Artificial Sequence
  Synthesized
  misc_feature (61): n=a or t
aacaaaagttcaattattttcagtgaggtttgctttggaatttaaagagagaaaaggagcngctctgaatgcagataaaactgttaacaatttccaagggtactctagttgtgttcttcat

SEQ ID NO: 36060 - DNA, 121 bp, Artificial Sequence
  Synthesized
  misc_feature (61): n=t or c
gttgttatcacatctcaaaattttctcatacaaacagaaatgttttaacagctgtactgtngctgtgttttgcctcattgtccatttttttatcttcaggttgaatgcccattttgaggtg

SEQ ID NO: 36061 - DNA, 121 bp, Artificial Sequence
  Synthesized
  misc_feature (61): n=a or g
cacctccctcttaccttggagcattcacaatgaaatatctcattccaaataacattaaaanggatctaaatcaagagaagaaaccacctcactggggttccaactgagggcaccaccttcc

SEQ ID NO: 36062 - DNA, 121 bp, Artificial Sequence
  Synthesized
  misc_feature (61): n=a or g
aggttgcaaggttgcatgctttgactgttattattagtactattactatttggagagcagngttttaaatacctacttaagtaattcagagcgtctgaagcagtgaggggttgcttttcct

SEQ ID NO: 36063 - DNA, 121 bp, Artificial Sequence
  Synthesized
  misc_feature (61): n=a or t
gctcttccctgcccctcaggggaacacatacacttccacagccgtccagccataaatctgncttcatcccaaatcccaagggacagggaggacttcaggagatggctcatgaaattagcat

SEQ ID NO: 36064 - DNA, 121 bp, Artificial Sequence
  Synthesized
  misc_feature (61): n=a or g
acagccatagtctgctttctaaaattgctttgttttaatttaaacaatttaattaattacnataacaatctagtttaagccagtctcttggctttttttcaccttttttccttaatttctg

SEQ ID NO: 36065 - DNA, 121 bp, Artificial Sequence
  Synthesized
  misc_feature (61): n=a or g
atcgtggccctccacaatgattctgtgtagaaagccttatgtctggataaaatagctacantttcactaccatgtttgtgttcaaaacgagcctcagttccagcatcctgctgtctgctgc

SEQ ID NO: 36066 - DNA, 121 bp, Artificial Sequence
  Synthesized
  misc_feature (61): n=t or c
gttcaatccaaacatatgcactgagtaccaccataccacgcactgaattaggcaaggaaangtatgtgattgctgactgtaaaagcctgccctctggtccttctgagaaaataatgcatgt

SEQ ID NO: 36067 - DNA, 121 bp, Artificial Sequence
  Synthesized
  misc_feature (61): n=a or g
aaatattttgaggtcttaagaaaatgcagtatcaatatccacaaaacagacattacttaanagtaatgtcagtaaaatatggtatatgctaagcagacaaatcacgtgagaacataaaaac

SEQ ID NO: 36068 - DNA, 121 bp, Artificial Sequence
  Synthesized
  misc_feature (61): n=t or g
aacaaagatctgagcctctttgcatccagtggtacagcactggtgagacagatgttggcanctgttctaagcagcacaggttgaagacatgacatctgtgatatgagggagaaacagcatc

SEQ ID NO: 36069 - DNA, 121 bp, Artificial Sequence
  Synthesized
  misc_feature (61): n=t or c
ctgccctgcttctgctgagatcatctccttggggaagcattgctgtaggcagatgggagcnctgggctccccttgtccatctgcactccctcctgcttctgctctcttcttctgcctgcag

SEQ ID NO: 36070 - DNA, 121 bp, Artificial Sequence
  Synthesized
  misc_feature (61): n=a or g
agaatgttgctgttgggcaactcaccaaatcattctctcacgcaagtaacagattgaaggnttacaatctggcctcagcaggttacgtataaagcaattcagtctgaaactgcattttaga

SEQ ID NO: 36071 - DNA, 121 bp, Artificial Sequence
  Synthesized
  misc_feature (61): n=a or g
gattatacagggctttgttggcatttgaaatacggcaaagagttagtcagtgttttttcanagggcatcctgtatgaagatattattaatctaaggaacaatagcatcatttattgatttt

SEQ ID NO: 36072 - DNA, 121 bp, Artificial Sequence
  Synthesized
  misc_feature (61): n=a or g
agatgctcctgtatagtacctgctgcttcccatggctctcacagagctcttccagcccgtnagagaatgctgctggccaagctcttcctgggaagccgcctctgggggcagtaagggacat

SEQ ID NO: 36073 - DNA, 121 bp, Artificial Sequence
  Synthesized
  misc_feature (61): n=t or c
cccccagtattaataataaataaaggaaaaatatttcagaaagagacagaacttgctgtanagcagcaatgtgatgacaatacagtggctttctttttagcagggctgtattgttttaaga

SEQ ID NO: 36074 - DNA, 121 bp, Artificial Sequence
  Synthesized
  misc_feature (61): n=a or g
tgcagcatcttcctgaggactgtgagtaccggggatttcgctttcaacccaaactaccacngtggctttgatgcaagcccaaagagcacaaagcagcagcactactttgtttcagggcaat

SEQ ID NO: 36075 - DNA, 121 bp, Artificial Sequence
  Synthesized
  misc_feature (61): n=t or c
gcttggcagcatctgtggcaagctctttcagattgattcaaaacattagcccccaaaaagncatactcatatacttggtgagggggcaacatgatatattaatggcttgaatcattacagc

SEQ ID NO: 36076 - DNA, 121 bp, Artificial Sequence
  Synthesized
  misc_feature (61): n=t or g
accattctttctgggaagaaattgttcctaatattcagtccaaacttccccgggcacaacntgaagccagtacttcttatcctatttctgtgatctggaagaagattccaaccctcacctc

SEQ ID NO: 36077 - DNA, 121 bp, Artificial Sequence
  Synthesized
  misc_feature (61): n=t or c
ttcatttatgaagtttccagtcttctgacatttccaaaataaaggatgaaatttaaatgancaacagcgatcatttccttttgtaaatgtgtgggaggaaagctgagaaaaacacacaggg

SEQ ID NO: 36078 - DNA, 121 bp, Artificial Sequence
  Synthesized
  misc_feature (61): n=a or g
attctgggctgtttctctggagcaagagaagagaaacagaagtttctggtctggcatggcntgcagagcaaagacttgcaatgtggtcccagccacgtgcaccagcaatgctccaagtggt

SEQ ID NO: 36079 - DNA, 121 bp, Artificial Sequence
  Synthesized
  misc_feature (61): n=a or t
acagcagctagttggagtgcaggtgagacagcacaaccctgaacgtgattcccattgcctnacagccatgacgttgctcatctcatgttggctcagtccagtggacaggaccttcttttcc

SEQ ID NO: 36080 - DNA, 121 bp, Artificial Sequence
  Synthesized
  misc_feature (61): n=a or g
catacttaccctgctcagtgaaggacctctgactctgatatgggcctgtggagcagcaaangccccatcccacaattgtggattaccaaagaaaagtgtgtcttgcagagcctgaacatca

SEQ ID NO: 36081 - DNA, 121 bp, Artificial Sequence
  Synthesized
  misc_feature (61): n=a or g
tggccaatgcctctctcactgtccccaggtagtggaaaagtgcctggatctgggtgctgcntctgcccgctatgtgagcggctccatggagagcacagcctttgctgaggaggtggtgaaa

SEQ ID NO: 36082 - DNA, 121 bp, Artificial Sequence
  Synthesized
  misc_feature (61): n=a or g
cctgttcatgtattcctaaatgtacttctgcttgcctctttctctgactgcagtacttccnctgtcagtggggggttggcttatattaggttggaaatccattgcatgtaattgctgattt

SEQ ID NO: 36083 - DNA, 121 bp, Artificial Sequence
  Synthesized
  misc_feature (61): n=a or g
ataatgagagtgaaatattctgaaagtagagtgaggcatctctaatgtaaacagaaacacncagcagttagtgaaatgtgtcctgcagaatcaatttgacgcgcactctactacctctcct

SEQ ID NO: 36084 - DNA, 121 bp, Artificial Sequence
  Synthesized
  misc_feature (61): n=a or t
actatgtgaaaatcgaagtgggaaaaatatgactgtgtcagtagaacttgtcatagagagnttagggcacatcatataatagcaaatctttgatattttgaagtcagaaataacccacgaa

SEQ ID NO: 36085 - DNA, 121 bp, Artificial Sequence
  Synthesized
  misc_feature (61): n=a or c
ggccatgtggacactgcaggcgttcgggaagcctgtcctgctctgtgctctgtgcacatgntctggcatttgtcacagctgatctgctcatctgcagggagcagtgcccgtcctggtgcta

SEQ ID NO: 36086 - DNA, 121 bp, Artificial Sequence
  Synthesized
  misc_feature (61): n=a or c
tggggatatggtcttgctccacgccaacgtctggctgtaaatgcagggaagtttgcccttntccttagcagggccaccaactccagctgcacatgcaaagcatgcacacgggctgcaagcc

SEQ ID NO: 36087 - DNA, 121 bp, Artificial Sequence
  Synthesized
  misc_feature (61): n=t or c
ctgcaacctcactgttcaatttctgatgatttcagccatgctcctggccaatatgtcaggngctcaatcaggcccctgaagtcacgcatgttaaaaaaataacaaaacaacagtaaagaac

SEQ ID NO: 36088 - DNA, 121 bp, Artificial Sequence
  Synthesized
  misc_feature (61): n=a or g
cagtttacatgctgatacatgagacaagatgaagcaattgttattttaattcacatagctnctaccacactgttaaagctgtcactaaaattaagctgcatttccagcatgattcctgatg

SEQ ID NO: 36089 - DNA, 121 bp, Artificial Sequence
  Synthesized
  misc_feature (61): n=a or c
tgcaaaagcttaatgccacgtgtaattgttgcttttattaaaaggaacatatatgatttcncttcagcttactacctatactctccaatagcttggacaaataacttgctgctcaacaaca

SEQ ID NO: 36090 - DNA, 121 bp, Artificial Sequence
  Synthesized
  misc_feature (61): n=t or g
aaaaacatttcagctctctccctctaaaagtgtttggcaatcttaataagtggcaattaanggagctgtttcagcatctctactaggtagcttctattcgttggttttggtttttgtttat

SEQ ID NO: 36091 - DNA, 121 bp, Artificial Sequence
  Synthesized
  misc_feature (61): n=a or t
ccttttttagtttgactgcgtaagcgcagctcacgtggcttcagcatgctgaattattcancccaaaggaagaagtcagccccactgccaccccacagcccagggatgggtcactgagggg

SEQ ID NO: 36092 - DNA, 121 bp, Artificial Sequence
  Synthesized
  misc_feature (61): n=a or g
tattgtgtttactaatgaaattatgtcaaaggcaagcctaaatttgggatccagtgactcnagtctcctccttagtcccctctgctcgcccaggcgttccccagaatcccctctgcctgtg

SEQ ID NO: 36093 - DNA, 121 bp, Artificial Sequence
  Synthesized
  misc_feature (61): n=t or c
aatccacaagaaaagttcatgaagttaagtaacccatagtaagtattcttaaatcccaggnagtcatttgtgttagctgtcccaaaatatgtctcttcctagtatggtggtgaggggtaga

SEQ ID NO: 36094 - DNA, 121 bp, Artificial Sequence
  Synthesized
  misc_feature (61): n=a or c
cattaatactcaagggcacaaattacaacacaagaatttccatatgagcatgagaaaaaancttctttattttgaggttgacggaactggagcaggctggccagagacattatagaacctc

SEQ ID NO: 36095 - DNA, 121 bp, Artificial Sequence
  Synthesized
  misc_feature (61): n=c or g
tgattgatttaataactcagtactcctttataatttactggagttttagggggtagtgttntattttacctgttaactaatattaaaacaaatgtgaccacttttgcatctggtttttttc

SEQ ID NO: 36096 - DNA, 121 bp, Artificial Sequence
  Synthesized
  misc_feature (61): n=t or c
gctattcttaagcctaggtgaggcacccagttagctgcgagcagggcttctagcttttttntttattgggttggagaacatgaaggacaggcatgtcaccacggctgatgtatatccatgt

SEQ ID NO: 36097 - DNA, 121 bp, Artificial Sequence
  Synthesized
  misc_feature (61): n=t or c
tagttatgaacttaatatctttaacaagggatgatgcatactttttaatctactttgagtnacactgattccaaatttttataactgatgtgtacgggcatttgattcatgttcaacaggg

SEQ ID NO: 36098 - DNA, 121 bp, Artificial Sequence
  Synthesized
  misc_feature (61): n=t or c
caggcaagctttctgaatttcccatgtgaaacaattggtgtttggccactgtgcccacagngggccctgtttgtacagaattagtggtctgtttctgtggggcactcagggccacttcaga

SEQ ID NO: 36099 - DNA, 121 bp, Artificial Sequence
  Synthesized
  misc_feature (61): n=a or g
aggagccttcctcaactatcccaacccaataaagaagatgaagactgaagacatacctccnttatctctctctgagtcagcagcactattttgctactgtgctgactgatcacgacagcct

SEQ ID NO: 36100 - DNA, 121 bp, Artificial Sequence
  Synthesized
  misc_feature (61): n=a or t
tttgtagctctctgtgtaatggctctataggatatttggtccttactatattcaccagaanttttttttccattgtatttcagtagtgctttagtgttctaacagtatagtaagggccgat

SEQ ID NO: 36101 - DNA, 121 bp, Artificial Sequence
  Synthesized
  misc_feature (61): n=a or c
cgtagatcaatttaaaagtgactgatgaaagtgttgccaaatccaactttaatgtagaaanatacctggagagtgtgaaggtcaagaaattttggcagaacatctgtcctgtctgtacaga

SEQ ID NO: 36102 - DNA, 121 bp, Artificial Sequence
  Synthesized
  misc_feature (61): n=a or g
tcccctcctggcagtattcagaattaaacatttagggcatcacacagcgataccaaaagtngggctgcaagcagacccctcttgtcaaacacttgttggagaacacgagtgatggaggcat

SEQ ID NO: 36103 - DNA, 121 bp, Artificial Sequence
  Synthesized
  misc_feature (61): n=t or c
ggaagagaaggaaaggaaaagaaaataaatgatatttaaattccttatactcctactgtgngcccttcagatcacacagaggcctgcagctgcttctaatccctctctcccagaattgttc

SEQ ID NO: 36104 - DNA, 121 bp, Artificial Sequence
  Synthesized
  misc_feature (61): n=a or c
atttttatatttatctgtaagaaggaggcatggctatattgctcatataatcccatactgntataatataatagttatgacagctgttagcatgagaaaagacaatgtgtagaaaaaagat

SEQ ID NO: 36105 - DNA, 121 bp, Artificial Sequence
  Synthesized
  misc_feature (61): n=a or c
aaagttcacaaccgcaggacagaactcagtaaagcagcctcattcgtctatgctttcctcncattccaagtgtttagatctgatgacaaatcagatgagcagactctggacctcacctcca

SEQ ID NO: 36106 - DNA, 121 bp, Artificial Sequence
  Synthesized
  misc_feature (61): n=t or c
aattcataggactgtagaaaaagattgtacatattttgaagattttgcataattttttacngtcaaagacagtatgtattccaaacagctgaaactgtaacttaaaaacagatatgttttg

SEQ ID NO: 36107 - DNA, 121 bp, Artificial Sequence
  Synthesized
  misc_feature (61): n=a or g
gcttctaaaacttttagtaattaaattgaatagattggtgaacaaattacttaggtttgcngttgctgttatcatacttcattagggagaatgatgctgtttttgcagagaaaacagtgac

SEQ ID NO: 36108 - DNA, 121 bp, Artificial Sequence
  Synthesized
  misc_feature (61): n=t or c
gacatccttggaacaatgaaagtgttaaactaaataagaaattctgcctgaattttttaangaggcaattgctatcaggatttgaatttgagagatatatcttattactgctgtgtgctgg

SEQ ID NO: 36109 - DNA, 121 bp, Artificial Sequence
  Synthesized
  misc_feature (61): n=t or c
agcacaggtctgaggctgccagagaataacggggcaattatttcttcgctgttttgtgtgntagcggtacaggtgctctgccaaagaggaagccaggcacgcagctatgggggggtgcaat

SEQ ID NO: 36110 - DNA, 121 bp, Artificial Sequence
  Synthesized
  misc_feature (61): n=a or g
cacccactagaaaattcagggtaatatcttggtgaacagtcttcttcaaatatcagttaantgtaactctaactatattacataaaatccttgtttcattccccaccgcaccccccccccc

SEQ ID NO: 36111 - DNA, 121 bp, Artificial Sequence
  Synthesized
  misc_feature (61): n=c or g
tataacactgatctcagggacgccttaaaaagaggctgtaaagttttctgcactgatagantagtaaggagtctgaattaatgtttttaactctgatgagagtttcatatgacaacaggca

SEQ ID NO: 36112 - DNA, 121 bp, Artificial Sequence
  Synthesized
  misc_feature (61): n=t or c
tcaaaaaactttttctctgcagacatataaaaagaaaattatatccatattttattcccangaggttttaatcgtaccaaaatccttcaagaattgttctaaaacttactattttattttt

SEQ ID NO: 36113 - DNA, 121 bp, Artificial Sequence
  Synthesized
  misc_feature (61): n=a or g
acctacttatccttagcacacaatcgatacaccgagctcagaacagttgacttcttataangttgtgcttcaatgagacaattgcactctattacttagttatgatttacaaagcttgtct

SEQ ID NO: 36114 - DNA, 121 bp, Artificial Sequence
  Synthesized
  misc_feature (61): n=t or g
attaaagtacatttcaactgaaaaaataaacaaggttacttctaataactctaggacgttntccatacatacaccttgcacaccccagaagtttaactatgtcacacttgaaacacaaagg

SEQ ID NO: 36115 - DNA, 121 bp, Artificial Sequence
  Synthesized
  misc_feature (61): n=a or t
caaggtacttgaaaataggtagtctgtgtagagaaacacctgaactcgtctacttgcatantgagaacagttagagcttgacccctgcatttttgtaaccctagtcctgccatttatattt

SEQ ID NO: 36116 - DNA, 121 bp, Artificial Sequence
  Synthesized
  misc_feature (61): n=a or g
actcaagcaatagtatgtttttagcaacctgaaatttgctagtagcaagatcacaagagtntataaaacacaggaaactaaaccttgtattcagatatattggtacaaagtaatgcatttt

SEQ ID NO: 36117 - DNA, 121 bp, Artificial Sequence
  Synthesized
  misc_feature (61): n=t or c
tattattaagacaaagcatctaatccaaccataatatagtgaggttttcttggttgttgcngcttgcccacctacaacactagatttattgcagggaattccctcaaacttttaagtaatg

SEQ ID NO: 36118 - DNA, 121 bp, Artificial Sequence
  Synthesized
  misc_feature (61): n=a or t
ttaaaaataaggctgagaaaacgaagctgtctgtatagctaagcagtagtacatttgccantgtatgataatgtggattacagcagctcagtctaactgcactgatgtcgtatgaacatgt

SEQ ID NO: 36119 - DNA, 121 bp, Artificial Sequence
  Synthesized
  misc_feature (61): n=t or c
ccaaaaaaaaaaaaaaaaaaaaaagatcatcaaccaaacaaactcctttgatttaataggnccatcatgataatttttgatcacattaaataatgacacagtgcttatgaggtaatgttca

SEQ ID NO: 36120 - DNA, 121 bp, Artificial Sequence
  Synthesized
  misc_feature (61): n=t or c
cttggctactacttccatcctgggaagcagacgttaggataaacaatttgtcagaaaggtnggttgaaatttcctttagcttggctaaaatttctgagaaagtagaaagttctcatgtgac

SEQ ID NO: 36121 - DNA, 121 bp, Artificial Sequence
  Synthesized
  misc_feature (61): n=t or g
gaaaggcttccaaaaggtgatggagaatttctcttgcaggttgcacagacagaaaaggaanctgcagttagaaatgttagaaagcctatctgcaggagcagcgcctctctgcgctgttcag

SEQ ID NO: 36122 - DNA, 121 bp, Artificial Sequence
  Synthesized
  misc_feature (61): n=a or t
gtttttgcatagcttagcacacagtgctccagactcgagcatgatttccttacaacaacgntcatataccttgggatgtgtcagtaaaacaaaagtgctagctcatttttacatctcatgg

SEQ ID NO: 36123 - DNA, 121 bp, Artificial Sequence
  Synthesized
  misc_feature (61): n=a or g
tgatatgtttgttcatgttcaactgattattgtgccttcaaaatatttcccattgtaagcngtgtcaaaacacccagaaccactcaatttcctacgctatttcgtatgttacaaaaatagt

SEQ ID NO: 36124 - DNA, 121 bp, Artificial Sequence
  Synthesized
  misc_feature (61): n=t or c
tgcccaatgaaccttaaaaaatgaggtgaatcattcactcatagctactactgtttcttcnccaaagctttgattttttttgctagagaaacatacaagggaattgtgtgcaagtcagttg

SEQ ID NO: 36125 - DNA, 121 bp, Artificial Sequence
  Synthesized
  misc_feature (61): n=t or c
aaaaatggaagaaatcaggggagaaggtagattctggcagccatttatttgattgcaatcnggcaaaaaaaggggaaatgaacttctgaaaattgggaatcgaaaataccagagctttgaa

SEQ ID NO: 36126 - DNA, 121 bp, Artificial Sequence
  Synthesized
  misc_feature (61): n=t or g
tcaagaaaaggttgtttctttctagaaaaagaatgcaaaggttgcctgctggatattctgnatacaaaacatcactaataagttgattggacagaattatggtagaggttgttgatggtgg

SEQ ID NO: 36127 - DNA, 121 bp, Artificial Sequence
  Synthesized
  misc_feature (61): n=a or c
ggctccacagtgattgaattgggtacaccaaaatctgtaaacagggatgaaaaagaccacnttacactattcagacgagcctggcagtattctgccagattcagaacaagccccacgagct

SEQ ID NO: 36128 - DNA, 121 bp, Artificial Sequence
  Synthesized
  misc_feature (61): n=c or g
ctgggtgcttcagcaaaggctactgtaggatggcgagactcatgtctcagatgctcttaancatattgtctagaccttattataggaatgtcctacacctggttcaaaagatgattattgt

SEQ ID NO: 36129 - DNA, 121 bp, Artificial Sequence
  Synthesized
  misc_feature (61): n=a or g
aggtgaagtttgtccccttagcaaggagctgcttaaaatcagcttaactgctgtggaagcncagcctagggtcagctctgccccaggagtgaggtgcagtcagcaggcaccaccaggaact

SEQ ID NO: 36130 - DNA, 121 bp, Artificial Sequence
  Synthesized
  misc_feature (61): n=t or c
tttttaatatcctattttgtgtgatatttacaaagtcacagtcctcacacctcgtggaagngacacagtgtgaaggagatgaaaccaaactcactgcaacctgaaatattatgtgcaacta

SEQ ID NO: 36131 - DNA, 121 bp, Artificial Sequence
  Synthesized
  misc_feature (61): n=c or g
acctcctagcattatatttagtctctcatggtcacaatagactggcaactcagagatactntttgattaatgacagcaactatctttcactatagatgggctctatgtttataacctagtt

SEQ ID NO: 36132 - DNA, 121 bp, Artificial Sequence
  Synthesized
  misc_feature (61): n=t or c
agggaagctgcaaggtgccaagtgtgagactgaagctgcaaagctggctgggctgtattcntgtgaagcttcaaaccaaaaccccatgggagtggatccttcctgccattgtaaggagaag

SEQ ID NO: 36133 - DNA, 121 bp, Artificial Sequence
  Synthesized
  misc_feature (61): n=a or g
tctcactctctttcttcttttcatcctctcttccttttggccttcccatgctgaccagctnggagttgctcattcagattctccagttttgtgtgagccaggaaatctctgcacaaaaata

SEQ ID NO: 36134 - DNA, 121 bp, Artificial Sequence
  Synthesized
  misc_feature (61): n=t or c
gcacagagtgggcaattagcagaagggcagcagctgtatttcaagtagaactgttccagcnttccgcccttgtgaggatacaggcagaaaattgcctctgtattgacccactgctgctttc

SEQ ID NO: 36135 - DNA, 121 bp, Artificial Sequence
  Synthesized
  misc_feature (61): n=t or c
tctgaagtatgggcctgtgtgttttcctttttgctggttgctgagtatggattgtttgctntgtaaagatatctttgctcacaaattgggcttgatgtgggcatgcattgtttgcaaattg

SEQ ID NO: 36136 - DNA, 121 bp, Artificial Sequence
  Synthesized
  misc_feature (61): n=a or g
tctaaggggagaaagaacttaaagcaggagtgtccagcccgtggccctggacagcaagcantgtggccccacacgatcacagacttttaacactgtattgtgatttttaacaatatttttc

SEQ ID NO: 36137 - DNA, 121 bp, Artificial Sequence
  Synthesized
  misc_feature (61): n=a or g
tttttcccaaataagttatgatctcagtgatccacgttatcaaaatctgatcaaaccacanatctgtcactggtatttcttgagcatgatttcttaccttttttttttttcatatagtctc

SEQ ID NO: 36138 - DNA, 121 bp, Artificial Sequence
  Synthesized
  misc_feature (61): n=a or t
acaaaacgttgtgtttttggtatgcacacacagctatcagatatcactgggaaataaacgncgccatcagaggatgtgtgacgtgtgaggagcgccgcgtgccgcctgctgaacactgcaa

SEQ ID NO: 36139 - DNA, 121 bp, Artificial Sequence
  Synthesized
  misc_feature (61): n=a or g
aaagcttcctgtcagcctccgcttctgctcgcttactttgcttgaactgctgttgtgctcngttttctttttctcatcttgaagtgaagcagtttggttctcatttgtgccactaacagag

SEQ ID NO: 36140 - DNA, 121 bp, Artificial Sequence
  Synthesized
  misc_feature (61): n=t or c
tattacaattctttccgcagataattagcattaatggcattcttagttgtaattacaaaanagcactttgctcgtacgatggctgtaggtacagtagtagcaagaatcctctaatctggct

SEQ ID NO: 36141 - DNA, 121 bp, Artificial Sequence
  Synthesized
  misc_feature (61): n=t or c
ggcatggacttcacttcgggtaggacaatatgtgaagagatagttactccccatgttcccnaacccagtcaaataaggaaagtttaagttctcttgggacattagacacaaaataaaaaaa

SEQ ID NO: 36142 - DNA, 121 bp, Artificial Sequence
  Synthesized
  misc_feature (61): n=t or c
tctcactgacactttggtttggtttggttatttaaattctgcatttaatcccattgtttangcattcttttacatgtggtttcgcagggcattaaagactattctgtttggaaatattttt

SEQ ID NO: 36143 - DNA, 121 bp, Artificial Sequence
  Synthesized
  misc_feature (61): n=a or g
cagaagctgctgcaaaaagcaatgggaacatgtccttctcctaggcctgggagcttcttcncaacctgaatattgcaacctaatttgaaaaggctaagaatgtcagagcaagggaggaaat

SEQ ID NO: 36144 - DNA, 121 bp, Artificial Sequence
  Synthesized
  misc_feature (61): n=t or c
tgaaatggactaaaccatccatcccttgctagtcaccatgcaagctacaaaggaaaacgtnttaagatatttgttttgctcaagtcattacagtaccataatactcctattgtgaacattc

SEQ ID NO: 36145 - DNA, 121 bp, Artificial Sequence
  Synthesized
  misc_feature (61): n=a or c
gccacattgtgatgggacagtgtagggtttctctgccaggactttcaggtgtcaattccancgggtgacttggaagagaattacgttgaacattttaaggtgaagatgcctgcatctggga

SEQ ID NO: 36146 - DNA, 121 bp, Artificial Sequence
  Synthesized
  misc_feature (61): n=a or g
cacctggccccacgcagcccttaccggcttgtactcaggcagccactcggggatgttgagnttattgatctcagaggcgatcttcttcctgtgccctggcttggtgacaccaatggccgtg

SEQ ID NO: 36147 - DNA, 121 bp, Artificial Sequence
  Synthesized
  misc_feature (61): n=a or c
gccttgagagcactgtttttacttgaactggctgtatcgcaatcagctcctctcacatctnaaaaattccagcagcagatttcacaacttcatagaatcatagaacggcctggattgaaaa

SEQ ID NO: 36148 - DNA, 121 bp, Artificial Sequence
  Synthesized
  misc_feature (61): n=c or g
gaatcaccggcctccctcaaagactgaagcttcaaccattagagctggcaaaaatatgcantgtaattccaactttctgagcatttttaatgggaatgtctaatttcaatcagaaagcttc

SEQ ID NO: 36149 - DNA, 121 bp, Artificial Sequence
  Synthesized
  misc_feature (61): n=t or c
gcctcacacagcagcccaaaagcagcaactcatgcagctgcaataaagacagatgtgtttnctagctttctcccagatgcaggctgcttctcaggtgaccacccattccccggggaaggat

SEQ ID NO: 36150 - DNA, 121 bp, Artificial Sequence
  Synthesized
  misc_feature (61): n=a or g
gcagaaataacagattaccaaaatagcccattataacacattaagtgcacgttgttcaccnaatttttcacttttcctgcgccaggcatttacttcaatgtgctgaagtcttacaagatgc

SEQ ID NO: 36151 - DNA, 121 bp, Artificial Sequence
  Synthesized
  misc_feature (61): n=t or c
acctgggcagcagaaataacccggtgcaaagcagggacaatgtgggaccttcacatttccnctcccgggaacagaactcgtgccactgactgaggacagcaggactggctataagaatgct

SEQ ID NO: 36152 - DNA, 121 bp, Artificial Sequence
  Synthesized
  misc_feature (61): n=t or c
tctttgagatacgtggtaatagcccttggtatgcaaaataggatgggcagttcctttttcntagacctctgcttttctagagaagtgtatgtagaataaaaagtgtaagaaaggcctgaaa

SEQ ID NO: 36153 - DNA, 121 bp, Artificial Sequence
  Synthesized
  misc_feature (61): n=a or g
aggaacacatggaaggaaatgagaactgagtttgtggggttgatctctcaaagtggcagcncaagaaaagcagatggatggaaccactgggccacgtcgccccacagagagtggccacagc

SEQ ID NO: 36154 - DNA, 121 bp, Artificial Sequence
  Synthesized
  misc_feature (61): n=a or t
ttctggtagtcacagtttctaattactttaccagtcctgctgtgattaccagctctgcaantaagagctatttaaagcacttcccatctttagatctctaaaatactgcggtaagattatc

SEQ ID NO: 36155 - DNA, 121 bp, Artificial Sequence
  Synthesized
  misc_feature (61): n=a or g
gcagatcaaaacagacaatggacctgcttacaggtcattatctgttcaaaggttttgccancagtggggcatacagcatgtcttgggtatactccactctccaacagggcaggctgtcata

SEQ ID NO: 36156 - DNA, 121 bp, Artificial Sequence
  Synthesized
  misc_feature (61): n=t or c
agacctcctcctccatgcagcataaaagtgaggttcaagccctacagaacaggagctggtnttgggtggaaggaaagtttattaggacaccatcatattgcagatctcctgaggacaatga

SEQ ID NO: 36157 - DNA, 121 bp, Artificial Sequence
  Synthesized
  misc_feature (61): n=a or t
caactgtgacatactggccagaggggagaaaagctgccaagtgccagcttttcagtctttngtgttccttgaacccatgtagtctgagatttctgatgtctgctgatgcatatgtgtgttt

SEQ ID NO: 36158 - DNA, 121 bp, Artificial Sequence
  Synthesized
  misc_feature (61): n=t or c
aaacaggctcaaaaaaaataaattcagtgtattgcagtctggtctaactactgaaagttangcagagaaagcaagatataatttacccatttaacttttgtttcactactgtcatagttaa

SEQ ID NO: 36159 - DNA, 121 bp, Artificial Sequence
  Synthesized
  misc_feature (61): n=a or g
attatttttagtaggcatattttattgttattaatctgagtcaaaatctatgcatccatancctaataactccatctgaattgtctaatcttaccttgcctacttttgtcttcagatgaaa

SEQ ID NO: 36160 - DNA, 121 bp, Artificial Sequence
  Synthesized
  misc_feature (61): n=t or c
tggtgattgttacaagcttttcaaaccagtgtttactgcaaacttccaggcaatctgtcanggcttttgtattcccagggactttttaagtccttgaaaaggaaccaaaattataaatagt

SEQ ID NO: 36161 - DNA, 121 bp, Artificial Sequence
  Synthesized
  misc_feature (61): n=t or c
ccacagtggcactgctgcagctaggcctgtgcaccgctgcttggcctgccaggagcccagngcgtgctggtggctgaatatgtctcactgccatgatgatagcagaagttcttgctgaacc

SEQ ID NO: 36162 - DNA, 121 bp, Artificial Sequence
  Synthesized
  misc_feature (61): n=t or c
attaggttggttctctgtaggaatcacaagtgagacatcagtgacatcagtaagagtcagnaggaataagagagtacaaggtatctttctcagtcctaaaaatgctattcaaaacactcta

SEQ ID NO: 36163 - DNA, 121 bp, Artificial Sequence
  Synthesized
  misc_feature (61): n=t or c
cgcagtagtgtgtgtgcactggaccattttcacaggctatggcacgacattctccaaaacnttcttactcccatgcagctcacagctgcatctggcattagttacatggagattggcctct

SEQ ID NO: 36164 - DNA, 121 bp, Artificial Sequence
  Synthesized
  misc_feature (61): n=a or g
tgcatctcagataaattcctgctaaattcaggatgggaacacacgctggtaaacaatgcanattctttatgccgttttcctttcctgcctgcacaggaggatgacctttctttcttgttct

SEQ ID NO: 36165 - DNA, 121 bp, Artificial Sequence
  Synthesized
  misc_feature (61): n=a or t
aaaatactactgagttacttaaggataatttagaagaaatccttagcgtatctgatatacnttgtgttcgaaaccaaggatagtatgtcttacacatttttaggcaaatcatctgagcccc

SEQ ID NO: 36166 - DNA, 121 bp, Artificial Sequence
  Synthesized
  misc_feature (61): n=t or c
gtatctcatgcagcaacagcagtggtacaaggagcagcatctgtgatgctcagagtgcatntgtttctatctgatgccctattgggaagaaatgtgttggacgagaaggatgccttacctt

SEQ ID NO: 36167 - DNA, 121 bp, Artificial Sequence
  Synthesized
  misc_feature (61): n=t or c
agcagtaaaaatacagaatataaaaaagtgttggtaactttgatatctagctgtaaagttngaaagcgttttgtaataaacataaatcccaatttagatatctcctgagatttcttgggtg

SEQ ID NO: 36168 - DNA, 121 bp, Artificial Sequence
  Synthesized
  misc_feature (61): n=a or g
cgggggaaaggacttgggttgctgctgctgctgctatgggagggagaacagcaaatcgccnatggagccacacagaggagagtgcacagcttgggccatatgttaatgagactcagccagg

SEQ ID NO: 36169 - DNA, 121 bp, Artificial Sequence
  Synthesized
  misc_feature (61): n=t or c
aggctgtcactcgggttactgaggacctgctgggatcctgggggagagaatcacactttcnaatagagtatgtgtaaggactggacagcttggagcatgcagagaaggcctagaagagatg

SEQ ID NO: 36170 - DNA, 121 bp, Artificial Sequence
  Synthesized
  misc_feature (61): n=t or g
tcccacatggctgaggatctgcaaagctctcattgtcttttttgtctattttcctcttatnttttggcttgcattgcaaggcaatggccgtgccaagcctctgcaatgggaactttgggtg

SEQ ID NO: 36171 - DNA, 121 bp, Artificial Sequence
  Synthesized
  misc_feature (61): n=a or g
cagggacacacgggcacagtgtggccgtgctgtggcatccggctcatacaggacactgtcncacaaagggaaactgaaatccagagctgaaatccccagaaggagtcagagatggggtcag

SEQ ID NO: 36172 - DNA, 121 bp, Artificial Sequence
  Synthesized
  misc_feature (61): n=a or g
gccgtgcactgtggagtaccctatgcaatgtccaaagtaaatatacagtatggaagttcanatttaaaactcgaaattttgttaaaaagaggcaaggagatcaatatgtacagcctttttt

SEQ ID NO: 36173 - DNA, 121 bp, Artificial Sequence
  Synthesized
  misc_feature (61): n=t or c
gcgtgggtggttgttcaaattgtatatggtacgctgttctgtgattcacgttcatgtttantgcaataattattgcagtaagcttaatatagtgatacatctatatgaagacttttaaatc

SEQ ID NO: 36174 - DNA, 121 bp, Artificial Sequence
  Synthesized
  misc_feature (61): n=a or g
aggttatgtactgcagctttcacagggcactttcaaaacacaccaattaaggccagaaatncagtgacttggttttaaaaatagtctttgtgcttatgagaggtatagaaaagtgtgtttt

SEQ ID NO: 36175 - DNA, 121 bp, Artificial Sequence
  Synthesized
  misc_feature (61): n=c or g
tggaaggtgtttagcagactttccctggcaggcttaactccttatgagcagcggactgagnctctggtgctctcatacctgctgccaaagcttacagcaagctactagcttttgtaaaata

SEQ ID NO: 36176 - DNA, 121 bp, Artificial Sequence
  Synthesized
  misc_feature (61): n=t or c
ctctgtaacgacaatcgcatccccccctgcacacactggtttgcattacagaaaacatggnccaacagaaagccaatttctctgcgctgcaattgggtttggactaattccaagcagtcac

SEQ ID NO: 36177 - DNA, 121 bp, Artificial Sequence
  Synthesized
  misc_feature (61): n=a or g
agtcatatgctgaggataaactggaggattctgcttttgctagagagaaatacctattatnctgcagagggcgagtttagtactcacaggttttctttattcatgatgtgtggctgctcca

SEQ ID NO: 36178 - DNA, 121 bp, Artificial Sequence
  Synthesized
  misc_feature (61): n=t or c
ctctaataaactgtgttactgccgacgctccaaacgatgctcgtcgctttaggattgcagngtgaggcgctcagcgcgggctgagcagttgcatgttgccttctgtgaggaaaacgtgatc

SEQ ID NO: 36179 - DNA, 121 bp, Artificial Sequence
  Synthesized
  misc_feature (61): n=t or c
tactcaaaagttattaactctgcaatagcattagtcccatgcaattacacctttttcaganggcaaaaagattaagttcattttgagtttgcagaatgcagtttgtgaaaaatgttattat

SEQ ID NO: 36180 - DNA, 121 bp, Artificial Sequence
  Synthesized
  misc_feature (61): n=a or g
tatattgatttacgatttcaaagtgctgaacaaacaactcattcttccaagcagaccacanataatgactcattagctccaatttaatatgcaggaaaagtgggaggacaatggttgcaca

SEQ ID NO: 36181 - DNA, 121 bp, Artificial Sequence
  Synthesized
  misc_feature (61): n=a or g
acacactgacttcagaaccattctgcagctgtgttaattatatagaaaaagctaagatacntttttacgtccttgaaaggtgaaaaatgaacaacgaggacagtgaacagcagggagaact

SEQ ID NO: 36182 - DNA, 121 bp, Artificial Sequence
  Synthesized
  misc_feature (61): n=t or c
cacctgctccagcaggaatctgcacgggtgtttcttcttggagtaaaccaattcattttcngtgtcacaaataaccttccctacgccggcaggaccactactagcagctcccttatctgcc

SEQ ID NO: 36183 - DNA, 121 bp, Artificial Sequence
  Synthesized
  misc_feature (61): n=a or g
taatattgtcaaagttaagatctttactgtatgttctgtttcccattaatcagtaacctcntcaatatacagtgtttcttccacatctgcttttttttcccaagaagtagatttcacatgt

SEQ ID NO: 36184 - DNA, 121 bp, Artificial Sequence
  Synthesized
  misc_feature (61): n=c or g
attcaaaaggaaattttaactttactttaagaaactctctctcctttttgggtaaaagttngtcaacttcaatataccttttaactatagaaatgcatgaagtatcctctgtgacttgaaa

SEQ ID NO: 36185 - DNA, 121 bp, Artificial Sequence
  Synthesized
  misc_feature (61): n=t or c
cttcttttctcagagtaaaaggtaatggagtggtcttcattagcataattttagtaaatanatatatatatgacaataaatgccaacaaaaaagttttagcttgttatatctgttaagagc

SEQ ID NO: 36186 - DNA, 121 bp, Artificial Sequence
  Synthesized
  misc_feature (61): n=a or g
catataactttttttttaggatgtagaagaattcagaatattctcctcttcagtatctaanatagatccatcatttggctcgtgtattggggtcaattagtcctgaattacttcagacatt

SEQ ID NO: 36187 - DNA, 121 bp, Artificial Sequence
  Synthesized
  misc_feature (61): n=t or c
gagtgggaaactgactgcactggtgtggggtgaacctgggctgtaggtaggactgctgcangtctggggaaagaatagttaaaaaactggactttttgttgaaaacttgaaagctttctat

SEQ ID NO: 36188 - DNA, 121 bp, Artificial Sequence
  Synthesized
  misc_feature (61): n=a or g
gtgatggctgtaatggctctggttctatgatagagttttttcgtatgtgctttgaaaatgngtgcatctctgcgtggaagaggctcagatgtacttccttaagattcatgaggctttgctg

SEQ ID NO: 36189 - DNA, 121 bp, Artificial Sequence
  Synthesized
  misc_feature (61): n=a or g
gtaggtcctggtaatgtatattttcatagcagtttccttttcaggacagggaattctaacntccatgctgattcaagttcgttcacagcttcaggactattataaataatataggggacga

SEQ ID NO: 36190 - DNA, 121 bp, Artificial Sequence
  Synthesized
  misc_feature (61): n=t or c
cccttcttatcagaggataaggagtaatagcatacagcctatagatcatgtgtgtagaatnattacaactagaaaagaccattacagttatttagttgaaccaacaacctatcactgccat

SEQ ID NO: 36191 - DNA, 121 bp, Artificial Sequence
  Synthesized
  misc_feature (61): n=t or c
tcagcagttgcaaaaggtcttgcatatgtatcaggagaactgcctatggaacaatgtacangtggcccgatgcagctgcacatttgatgctgcgtatggaaggagcacgtgcctgtagctg

SEQ ID NO: 36192 - DNA, 121 bp, Artificial Sequence
  Synthesized
  misc_feature (61): n=t or c
gtgtctttaacagatcacatcatagtagttcctaatcataagagctgctcagaaagcagtntgtcaaccccaatccagaggaatccaagcctgcctaggtaatccgtgatttcactacttt

SEQ ID NO: 36193 - DNA, 121 bp, Artificial Sequence
  Synthesized
  misc_feature (61): n=a or g
acacaaacttcaggtttggttctttctcttcagaagtctgactacttataattcatgacantgctgtaagatggtacaatagggcacgggatatatttaagcataaagacatctgctctgg

SEQ ID NO: 36194 - DNA, 121 bp, Artificial Sequence
  Synthesized
  misc_feature (61): n=a or t
tcattaccgagctaattacctgcccgcacaactttacacagcaatcaaaaaagcttcctgnaatgtagctgtaagcaggatggttcagtatttcaaaagttagtaaaatacgcctcaagaa

SEQ ID NO: 36195 - DNA, 121 bp, Artificial Sequence
  Synthesized
  misc_feature (61): n=t or c
gttcatgcagcaccgtatctctagcaacctccttgcactataaacaaataaatgcatcttnatccagatcatttttgcacttgcagagatgaaaataaatgcataacaacacgtgcagaga

SEQ ID NO: 36196 - DNA, 121 bp, Artificial Sequence
  Synthesized
  misc_feature (61): n=t or c
tggctgctgtagatagtcgactactaacagtaataagtgctagctcaagatactctaaatnattgtgtactgataaatagtcactggactggattccatctcttcatcctgtaacaagatt

SEQ ID NO: 36197 - DNA, 121 bp, Artificial Sequence
  Synthesized
  misc_feature (61): n=a or g
gttctagcatgtctggcacagcagcacttatctgtggagtaacttcattcagcccacaatnatctactgttagcctccactctccattggactttgcactagccacatggtactatagaaa

SEQ ID NO: 36198 - DNA, 121 bp, Artificial Sequence
  Synthesized
  misc_feature (61): n=a or g
gtgaggctatttacttaggcggcagagcggtgggaaattatgtgataataatctcaatccntttaagccacctggtatctctccatggactcatctcttggtttggatcagaccccgatcc

SEQ ID NO: 36199 - DNA, 121 bp, Artificial Sequence
  Synthesized
  misc_feature (61): n=a or c
cagttactgctttgcccaatatcctgctttaattatggttgaggatttctggtataaaaanagttaaactatcctttgtaagaataattgtcttatttgtgggttggattttgatctcagt

SEQ ID NO: 36200 - DNA, 121 bp, Artificial Sequence
  Synthesized
  misc_feature (61): n=c or g
attctcctgcggatgtcacagcaatttgtgtgtgtagaaaaatgatgcctttacgcacaancttatatgaagattgatttgtagctcagtcaagaggataagcatgaaaattctgctcagt

SEQ ID NO: 36201 - DNA, 121 bp, Artificial Sequence
  Synthesized
  misc_feature (61): n=a or g
acctcaaatgtacttacagccagtcttagaaagaattactacacagtgtcaaaacttgatntttccttataggtacacagtactatattgttctgatcagtgcaaagaaacattttaatga

SEQ ID NO: 36202 - DNA, 121 bp, Artificial Sequence
  Synthesized
  misc_feature (61): n=t or c
caaacgacagctgaacaaagtccatctactgcactcaaactttagggaggcataaacttcngttttcttccgttaagggactgtgaacccctaatgttaggatagctgctaacactgctac

SEQ ID NO: 36203 - DNA, 121 bp, Artificial Sequence
  Synthesized
  misc_feature (61): n=a or g
agaaaaaaacaaacagtatgtatttgtagtcccaaaagcagaaaaggcaagagcaaaattnattaggttaccattatgttgtttccctacaggcactaagttctgaatacagctcctaaag

SEQ ID NO: 36204 - DNA, 121 bp, Artificial Sequence
  Synthesized
  misc_feature (61): n=t or c
tattcccccccccccccccctcctgtaactccatgctgcaggaaacttcctttgaccattncaccagcaaggcaggtgcctggcaaaagatcatcccactgggttcctgacaatatctcaa

SEQ ID NO: 36205 - DNA, 121 bp, Artificial Sequence
  Synthesized
  misc_feature (61): n=t or c
aagagtgagtgttaacattttaagcaagatggagaatatcttatactataattattgttgntcaaggagagaaaatctgtgattgtgcaaggagatgaggaagtgatggagtggctccact

SEQ ID NO: 36206 - DNA, 121 bp, Artificial Sequence
  Synthesized
  misc_feature (61): n=a or g
attctaatgtgaaaagcacagacatcctgtccccagacaagctgtgtgcaggttcagatgnatttctcagagagctcagcaaacaggataagcctttaactcaggagcatgagattcacta

SEQ ID NO: 36207 - DNA, 121 bp, Artificial Sequence
  Synthesized
  misc_feature (61): n=a or g
ttattgtggaacttctcagaggaatttcaatgactagttcattataaggaaccttactcanttcttaatctgtagtaagttttccatagagtgtgcaaaggaacatttatgtccatatgtc

SEQ ID NO: 36208 - DNA, 121 bp, Artificial Sequence
  Synthesized
  misc_feature (61): n=t or c
gaaaatagctaaaagaacaaacacccaccaaaaaccaaacccatctggcaaccccatttcnttcattagagagaagggataattccatcacaacagagtgtgatggagaactcctttctac

SEQ ID NO: 36209 - DNA, 121 bp, Artificial Sequence
  Synthesized
  misc_feature (61): n=t or g
tgcacgcatccacagcaacaggctctgcacaggctaagggggaggagggctcagaggaacnatcactgaagtcagcggttctctctgagtgtttttggatcgagtcaggctgtgctttaca

SEQ ID NO: 36210 - DNA, 121 bp, Artificial Sequence
  Synthesized
  misc_feature (61): n=a or g
cacacgccatgctttggattaccttaagttcttaaaaattgtttcaggaaggaagactgtntacattctgatacctagctattgttacatgcatatcatctacaaatacactctcctcaag

SEQ ID NO: 36211 - DNA, 121 bp, Artificial Sequence
  Synthesized
  misc_feature (61): n=a or c
tttttaatctagcagagacataagaaagactaagggctgaaaaatggaagtgattcaaacnagaaatgaaacacacattttttaacagtagtgatgattaaatttgggaacaaactaccac

SEQ ID NO: 36212 - DNA, 121 bp, Artificial Sequence
  Synthesized
  misc_feature (61): n=t or c
ccatgtggtgtgactggtagtacaaagcctggctggagaccagttggtagtggtgtatccnaggtgtcagcactggggctgtttaatgtatctgtttaatatatactgtttaacgtcttca

SEQ ID NO: 36213 - DNA, 121 bp, Artificial Sequence
  Synthesized
  misc_feature (61): n=a or c
aaacattgtttcacagttttgcataggtaaattatcaatctataccacagaattaaggacnaggaagattttcaatataaaaacatgacataaggcttcaaaataatgattgactgggttt

SEQ ID NO: 36214 - DNA, 121 bp, Artificial Sequence
  Synthesized
  misc_feature (61): n=t or c
tcattatcgactagaaatgcaaaaaatacataaaacatataagagtctgtttatgcattangtaaaactgctgtacaatctagcaagtaggataatgaatcatgctcagtttctgcagctt

SEQ ID NO: 36215 - DNA, 121 bp, Artificial Sequence
  Synthesized
  misc_feature (61): n=a or g
aatagatgcctgttacctctgatccagcaaaactctccaatattgcatttttaacatttcnctgattagaagtttataaaactttcaccctcccaaattaaatttattctgtattttccag

SEQ ID NO: 36216 - DNA, 121 bp, Artificial Sequence
  Synthesized
  misc_feature (61): n=t or c
tctagacagtagccagagctcgccctcttatctcaccctgaaacctttggctgctctttangtgcaggcagctggagggaggtccagctccagacctcctcctgtttgctgcatgttctac

SEQ ID NO: 36217 - DNA, 121 bp, Artificial Sequence
  Synthesized
  misc_feature (61): n=a or g
aactgcaccccacagctctccacatttaaaatacagcaagtgataaactcacaaaaaagtntattttagcaatgctgtatctcatggaagaactgaaaagttcaaagggaaagaagaacgg

SEQ ID NO: 36218 - DNA, 121 bp, Artificial Sequence
  Synthesized
  misc_feature (61): n=a or g
ttcattgctgtcatcttccttgaactctcaggaaaacctccctgggcctacttttggccanataacatgaagtaataaaaaaagaaagtcatgttcaccaaaggaggcatggcattagcta

SEQ ID NO: 36219 - DNA, 121 bp, Artificial Sequence
  Synthesized
  misc_feature (61): n=t or c
atactgcaaaaaattcagtagtactctgaagaattaaaaggccctcaagcaaatacattanacccaaacacactaccacacacaagtaaagttctatcctccccccccacctttttttttt

SEQ ID NO: 36220 - DNA, 121 bp, Artificial Sequence
  Synthesized
  misc_feature (61): n=t or c
gcatcctttcagctcatgagctttattgcgctgcacgtgttgaatagagaaggcacccaangttggattcaccatcatccccccatccatcctccgaggattttaaggtttcctgacctcc

SEQ ID NO: 36221 - DNA, 121 bp, Artificial Sequence
  Synthesized
  misc_feature (61): n=a or g
tgtgctagcatgaggaacaaagccagcacgaggaggttgtgttgcccagggagcagctctntccctggagtgagtcacgatgctgatgtcttaagccacagggagaaagcacagcatcaaa

SEQ ID NO: 36222 - DNA, 121 bp, Artificial Sequence
  Synthesized
  misc_feature (61): n=a or g
ttttgcaatgaattctctagtcaactaataaatctcagtgtggctttttgagttgatgtcntttgtatgatttcatgcaactttaacatactatttctcttttatgccttcaagcttggga

SEQ ID NO: 36223 - DNA, 121 bp, Artificial Sequence
  Synthesized
  misc_feature (61): n=t or g
catgagcttttctgtcacacctgatttgcgtttcttttcattttcctttacctgaaccagnccagagttccttcagatggataaatttgttttgttttgtttttcttgcaccataaaatat

SEQ ID NO: 36224 - DNA, 121 bp, Artificial Sequence
  Synthesized
  misc_feature (61): n=c or g
gacttctggtcgatgctctcttgcagtgtgatcttgtggttgggcgacctcaactatcggntggaagaactggatgtgacaaaagtgaagcagcttgtggatgagagagcatttccagagc

SEQ ID NO: 36225 - DNA, 121 bp, Artificial Sequence
  Synthesized
  misc_feature (61): n=a or g
aacacaaagaaataggaaatattttagcagcactcttcacatgttaaactaatgagcactngccaatgcaataattcatcatttaggagaacaaattcagtagacatactctgtaaattct

SEQ ID NO: 36226 - DNA, 121 bp, Artificial Sequence
  Synthesized
  misc_feature (61): n=a or g
aaaattgcaataacattcaatagccttcagaaaggctaagtaaccttttctcctgtaactntggtatactaggaaataagctctgcatgtctctccaccagcagaaagataaataaatata

SEQ ID NO: 36227 - DNA, 121 bp, Artificial Sequence
  Synthesized
  misc_feature (61): n=t or c
tggtgtctgttactgtgactgctaatagcctgctgagatggagtgctgtaggatgggacanggccatgagtgcacaaccacagcacagatctgccccgttgtgcctggccatgtcgctcct

SEQ ID NO: 36228 - DNA, 121 bp, Artificial Sequence
  Synthesized
  misc_feature (61): n=t or c
aagcaacatcaaaaaggtacatttaagataaccagcaaagctttgacccacttaagatcanagaatgacagaagaatctgcaacaaaggcacatcctcaaagagaaaagcactgttgaggt

SEQ ID NO: 36229 - DNA, 121 bp, Artificial Sequence
  Synthesized
  misc_feature (61): n=a or g
ctgaaaatgctcagaactggagccaaggctctgtcctggccctaaacccttgacttggccnattcacagttgtctctaccaaagcgcaggtgaattgtttgaattaagatgtacttccatt

SEQ ID NO: 36230 - DNA, 121 bp, Artificial Sequence
  Synthesized
  misc_feature (61): n=t or g
agaataagcagtaagcttttgctggtttattgatgagttacatgagatcacctttgtctanctctacgctgtaactctggaaaaaaaacagatgaaagtattggaaggagtggaaaaaaga

SEQ ID NO: 36231 - DNA, 121 bp, Artificial Sequence
  Synthesized
  misc_feature (61): n=a or g
acttgccttctacaaagagatggaagaaagggcaagccactgtcttgtattaacattagcnaggaaaagactgaagagcaaaagataaaatacagcatgtgcatttaagccataatagtat

SEQ ID NO: 36232 - DNA, 121 bp, Artificial Sequence
  Synthesized
  misc_feature (61): n=t or c
atccgtatggtgccagattcagctgactgagctataatctatgaaataaaataatatctgnttttcacatgactcacagatatactttgatgcttaattgaagcataatgcaacccataaa

SEQ ID NO: 36233 - DNA, 121 bp, Artificial Sequence
  Synthesized
  misc_feature (61): n=t or g
tcagcatgaacgtagctctcctctgagaagtgacaggagtgaacaaaaagggcagggaganaagtggtttgacctgaacagcgccgtgccttaccctgcttgccattcacagagccctcct

SEQ ID NO: 36234 - DNA, 121 bp, Artificial Sequence
  Synthesized
  misc_feature (61): n=t or c
ttttatgcatatggctgttgcatttggacaaactctcagttgttgtagccttggaccttgntactctgctgttactgccgtgctttccttcacattacaccttatgtttaagtatttaatg

SEQ ID NO: 36235 - DNA, 121 bp, Artificial Sequence
  Synthesized
  misc_feature (61): n=c or g
ccatgaataactaataactttttgagcatcttgtttacaagaataccacttggcagagaanggagctgtccagtttttcattaggctttaccagcactgatgacaaactgcacagcagtaa

SEQ ID NO: 36236 - DNA, 121 bp, Artificial Sequence
  Synthesized
  misc_feature (61): n=a or g
aagtcactgttaaccataatttctaaacaacttgtagctaagcttgactggagcagctgcngagcaatagaagaaataaaacttctgtaatgctaagcccaaaagtcagagctactcagat

SEQ ID NO: 36237 - DNA, 121 bp, Artificial Sequence
  Synthesized
  misc_feature (61): n=t or c
catcttccccctttctgttcatagctgcccagcctgaaccaaagttttctcagtagtgtanaccacacctgtcaatttgacacacagataaatcaactttaactaatggaagataattttt

SEQ ID NO: 36238 - DNA, 121 bp, Artificial Sequence
  Synthesized
  misc_feature (61): n=a or g
ttattgtttatgaatttgttattttaataaactggagccagcagggaacgcagcattcccngccctaacagcattcttgtatgatttaggtcaaaataatcctcacattcagagttgaatc

SEQ ID NO: 36239 - DNA, 121 bp, Artificial Sequence
  Synthesized
  misc_feature (61): n=t or c
cgtggaggtatgctgctttccctgcaggaacaagatccattttcagagttactctgccagngctgctggtttccccttgtgcttcctgtggtggggttggttgataatgaaaagagcattg

SEQ ID NO: 36240 - DNA, 121 bp, Artificial Sequence
  Synthesized
  misc_feature (61): n=a or g
cctgttaaacagcaacgctaataaaagcagcaataagttcgaggtggtctctgggacctcntggtaacggtgcagtccgacatgcagcaggtgtgcaaacgaaacccttgcactgcgacag

SEQ ID NO: 36241 - DNA, 121 bp, Artificial Sequence
  Synthesized
  misc_feature (61): n=a or g
aatgctgctgagggatgatgagagctggatgatttaactcccagtttacttttcctcttcnggacatccccagcccacaacggagaatggtgttctttatttaagcagactccttcaacct

SEQ ID NO: 36242 - DNA, 121 bp, Artificial Sequence
  Synthesized
  misc_feature (61): n=t or c
tgctgtgcctctcacttatgccagccaagctctgtttgggaccaagctggaacatggctcngtgtctttttaggacgttacccaaatacgcctggcatcacaccattctgttttcttcaaa

SEQ ID NO: 36243 - DNA, 121 bp, Artificial Sequence
  Synthesized
  misc_feature (61): n=a or t
aaatcccaaaggggccacattctgaaacaatatttctatgaaaatggagctccataacagngctccataaacaagaattagaattcaatgcagctcagaagtcaaagataaacaacagatt

SEQ ID NO: 36244 - DNA, 121 bp, Artificial Sequence
  Synthesized
  misc_feature (61): n=t or c
tgctactgtctctggacaagaatataggaattgctaagacagtaagtggaaaacacagtgntataagggcacatttcttcatttaaaagaatgaaatacctctgatttgcttgaacacagt

SEQ ID NO: 36245 - DNA, 121 bp, Artificial Sequence
  Synthesized
  misc_feature (61): n=a or g
tatgtctattataagttttcacttcctagaatgtctgtaagatttcaggtacattcctgantggtattatgctaggaataagcctttacttctagagcatcagtatggaaaataacacagg

SEQ ID NO: 36246 - DNA, 121 bp, Artificial Sequence
  Synthesized
  misc_feature (61): n=t or g
ctgacaagtagtgaacttgaaactattccttgctattgtgaaatctgcctctgatttcagnggaaactttgactagtacagaaaaagcagagactaatctatactttctaaaattgaggat

SEQ ID NO: 36247 - DNA, 121 bp, Artificial Sequence
  Synthesized
  misc_feature (61): n=t or c
gagtctaaatttaccctcttctatcaaatgcattgacaccacagaagagttgagttttgtnagatttgcttgccctaaagaggcttaggttgtatcactggcacttctggatacccgctgc

SEQ ID NO: 36248 - DNA, 121 bp, Artificial Sequence
  Synthesized
  misc_feature (61): n=a or g
ttgcgaaaacactggagacactgagcaatgccctcagggagcactggcagatagcaaatcnctccatcgaggcctgtagtggaaatcttggtaacacaggacactgggtcagttttattgt

SEQ ID NO: 36249 - DNA, 121 bp, Artificial Sequence
  Synthesized
  misc_feature (61): n=c or g
gagcagatgaagggattaaagatccctgaggatttagagtgaaagtacttcccatccaggnttgtatttaaactttttgttgatcagggtcatgttttccctcggagttttgtggtgtggt

SEQ ID NO: 36250 - DNA, 121 bp, Artificial Sequence
  Synthesized
  misc_feature (61): n=t or c
tcaaggatagaaaacctatggaaaatgtctatggattaattaagttaaaagtaaagacganaagggaaccttgctggaagtttccaaagacttagagaaacacatacaacttctagagtct

SEQ ID NO: 36251 - DNA, 121 bp, Artificial Sequence
  Synthesized
  misc_feature (61): n=t or c
aagcctcactcaaagttgagcagttaagaggttaaaggaaacccaggtagcctcaggatcngaagtaatgtagggctcttcctcttgctcttctccctgcttcacggtttacaaccagcac

SEQ ID NO: 36252 - DNA, 121 bp, Artificial Sequence
  Synthesized
  misc_feature (61): n=c or g
tttttattgggatagcgtaagagggaatgacaagaaggggcaggaagcaaattaagctctnttaggtggcatctgttaacccccatatccttttttttattattacaaaaggcaagtacac

SEQ ID NO: 36253 - DNA, 121 bp, Artificial Sequence
  Synthesized
  misc_feature (61): n=t or g
tgtgtcttttgcataaatgtatcctcaccagccaaaccaaatgttgttacagtgccactgnttctcatcaacaaagtgtgctgttaatggcttcccagcaacagacttcatggcagattaa

SEQ ID NO: 36254 - DNA, 121 bp, Artificial Sequence
  Synthesized
  misc_feature (61): n=t or c
ttcggcacaaacaaaagtgcctcagagcagagttttccctggggaaaagggaattgctctntcgcagcaagggtagtctggtgtgcgtgtgagctgctcttgtgcgtttccaggagagtat

SEQ ID NO: 36255 - DNA, 121 bp, Artificial Sequence
  Synthesized
  misc_feature (61): n=t or c
attctaaatggttcagttctctcacactgtttctgaaattactgcagcctgtgcagactgnggtgtggaagattggtgaaaagtcacttgaaaatggggggaaacgtaactgcatacaatc

SEQ ID NO: 36256 - DNA, 121 bp, Artificial Sequence
  Synthesized
  misc_feature (61): n=a or g
aatttctctttcatggaagaagttcataagagtttattttacttctggcccagaaatttanagtgcaaaaaaacactcaaaatccagactttctcataggtttgtcttccactatctgttt

SEQ ID NO: 36257 - DNA, 121 bp, Artificial Sequence
  Synthesized
  misc_feature (61): n=a or g
catcctgaaagaagtcttctgatggaggattcttctgtctcagcagaatagcagagtcttnataacagaatctaagtgtcttttgcagaattatgtatttgaaacacgtttcttttaggcg

SEQ ID NO: 36258 - DNA, 121 bp, Artificial Sequence
  Synthesized
  misc_feature (61): n=t or c
actacctaaatatttttccaccttgaattgttccaagatgatggataaaaataatatcttntgctacaaatctctaatttaagcagaaggaccagtgaaagaaaacagacaatttcatcac

SEQ ID NO: 36259 - DNA, 121 bp, Artificial Sequence
  Synthesized
  misc_feature (61): n=a or g
ggcatttggaaagtcaaaaaatctcggccttaagaaacagctccctttaggatagcaggcntgatgttgctttcagcactgcttgctcaggattgttgagtaaatactcaaccactggctt

SEQ ID NO: 36260 - DNA, 121 bp, Artificial Sequence
  Synthesized
  misc_feature (61): n=a or g
ggtgacagatgtcggctgcgaggagattctttacattggacttgcaaatgcaacggaaacncaaacaaacgctcctcgcttcctcgtggggatcctcgggcagcaccggggctgattttcc

SEQ ID NO: 36261 - DNA, 121 bp, Artificial Sequence
  Synthesized
  misc_feature (61): n=a or g
tcgaccctccacatctgggctgtaactaatatatgagctgtatatgtaggacagccactcnagacggccactgattccctgacggtaccacagtacataacttccaatgctgaagccatat

SEQ ID NO: 36262 - DNA, 121 bp, Artificial Sequence
  Synthesized
  misc_feature (61): n=t or c
ggccaacatgcttcaagtggattgtctggttacataggaaggacaaacgcatgtggagctnagctctgggcatccgggaggacacgtgccagctgggtggctccctgatgctggagtggag

SEQ ID NO: 36263 - DNA, 121 bp, Artificial Sequence
  Synthesized
  misc_feature (61): n=t or c
ttcttattgtacagcagcctcaggaaatgatcgctcagctcatgatacagtttttcctgcnaccagcttttctggaaggtccttactgtatagctgaaataacttctggttctataattaa

SEQ ID NO: 36264 - DNA, 121 bp, Artificial Sequence
  Synthesized
  misc_feature (61): n=t or c
tggattaaatcctttggggtagaaatgatctgttcctattttagccctccctcaccaccanctcaccccaaattccccttcctccagcttagcttcatggattcctgatgcactgcctggg

SEQ ID NO: 36265 - DNA, 121 bp, Artificial Sequence
  Synthesized
  misc_feature (61): n=t or g
ttaacctgtatcactgtcctcatcattttacatactgttccaaacatggcactgaaagacntaacagagtagaagtgctttaaagttcatctgtttgctggatttgtcagcagtcagagat

SEQ ID NO: 36266 - DNA, 121 bp, Artificial Sequence
  Synthesized
  misc_feature (61): n=c or g
gtttgttttctcagttttcagtgtgctgaactatccaatttaaatgacgagataacccagncttctactgctctggtctggataagtttcttttcaggctgctgttttcacatggggcctg

SEQ ID NO: 36267 - DNA, 121 bp, Artificial Sequence
  Synthesized
  misc_feature (61): n=a or t
ggtcatgtttactgggaaaaccttcaacatgacaccagagcaaggctaaactgcctccatnataacataccttcctcagtgaggcacatgtaagataaatcatgatgtcctcaattcaaaa

SEQ ID NO: 36268 - DNA, 121 bp, Artificial Sequence
  Synthesized
  misc_feature (61): n=t or c
atgggtggtgacactgcatgcatcggccccacatccccagtaggaaaacaaacagcaaagnctctgggagccagagctgagtctggacaagagatgcacttcaggcagagggttaaagccc

SEQ ID NO: 36269 - DNA, 121 bp, Artificial Sequence
  Synthesized
  misc_feature (61): n=a or g
caaaacacaattgaaaaaagtaaaacaagtttttctcagtatcgtgatgagctcatctccncccaaggaaaattgagagaaattctgttgatttaaatagaaacagggtcaggtctgttct

SEQ ID NO: 36270 - DNA, 121 bp, Artificial Sequence
  Synthesized
  misc_feature (61): n=a or g
aaaaagcaggtgaagtaaggaccgtggtggttctcacctcaagtcagacacagtgcacagncacaaggaggatccgaccaaagaagatctccatttcttcaggttatgctttgcatctctt

SEQ ID NO: 36271 - DNA, 121 bp, Artificial Sequence
  Synthesized
  misc_feature (61): n=a or g
gtcttgagctgaggttcatgctttctctggccttggtttaagcttctcatgcttgagaccngtaatgtcagttcagaaactatggtatctgaactctggtataccaaaaacttgttttaat

SEQ ID NO: 36272 - DNA, 121 bp, Artificial Sequence
  Synthesized
  misc_feature (61): n=a or g
aagttaaacagaaagagtgctcaggaataatgatgaaaagcttttctttgggcagatccantaggatagaatagtatctcacagggagttgaagcatcacttggtatggcctcagagacta

SEQ ID NO: 36273 - DNA, 121 bp, Artificial Sequence
  Synthesized
  misc_feature (61): n=a or g
gcatattaaacagtaggaagtttcttcactatccgctaacttaaagaaatggtatagaccnaacagttggactccatggtctttgtacatcccttccaattggagttattctgttctattc

SEQ ID NO: 36274 - DNA, 121 bp, Artificial Sequence
  Synthesized
  misc_feature (61): n=t or c
accttctcatatgaattacaccaatacagcagcaacaataaaacctagcacagctgctccnaggggtataagtctactctgagactttttatgtgctattttcacttggctactaaaatgc

SEQ ID NO: 36275 - DNA, 121 bp, Artificial Sequence
  Synthesized
  misc_feature (61): n=t or c
cacttccactgctgctgcctgttctacttaagcacactggagaaatactctttgtgcactncaacctgactagctgggagcaacacaataccaccatgtgtactcgtttatttattaaaag

SEQ ID NO: 36276 - DNA, 121 bp, Artificial Sequence
  Synthesized
  misc_feature (61): n=t or c
cttagtgtgcctcccggttcatggtgcacaaagcacagatttgttagctatgcaggtgccngtaaccctggttgagaatacacaggtacatgctgcacgaagagtacaatggcatcactat

SEQ ID NO: 36277 - DNA, 121 bp, Artificial Sequence
  Synthesized
  misc_feature (61): n=c or g
cagaagtacaaatatagtatcagtagcatacaagttgcataattcctgtatgtttatacanacaccctccaataattttcttccaaggacaaagattcagatttacccataaaggctagta

SEQ ID NO: 36278 - DNA, 121 bp, Artificial Sequence
  Synthesized
  misc_feature (61): n=t or c
gcaccttctgatccgctgcagccgagtggacttaagaaattagactaacagagccttcctnctctccctctggaaacaaaagcagaataaatgagagcacacagtgtttttcagttttcct

SEQ ID NO: 36279 - DNA, 121 bp, Artificial Sequence
  Synthesized
  misc_feature (61): n=a or g
ttgggaaactctgtgattaagtaaccattaataaactttccccgccagcgttgcattagancagggtgctactgagtcagtgccagcaggtacagaaatcccaaaataaataaataaacaa

SEQ ID NO: 36280 - DNA, 121 bp, Artificial Sequence
  Synthesized
  misc_feature (61): n=t or c
aaagagtttttctcttcaagagattacacaggtgatcttttacattcagtaatgaaacgtntgttgaatagttttaatatccctttctcttggaaagcactcacattttagaaatactctt

SEQ ID NO: 36281 - DNA, 121 bp, Artificial Sequence
  Synthesized
  misc_feature (61): n=a or t
ctatttttgtaggtgtttcctagtaattttggtgtgtctattcttaaatggtaccgttaangtgagatgctaaaggaagaaaagcctgaagggttaagttagcgttacacttggaatgggg

SEQ ID NO: 36282 - DNA, 121 bp, Artificial Sequence
  Synthesized
  misc_feature (61): n=t or c
aaaagaacaacaaccaaaaaaaaaaaaaaaaaaaaaaccaagaaaccttagatttcttgtnaatagtgggcagtagtttaagttcttagaactcctgttgagaatgttgagcaagtttatt

SEQ ID NO: 36283 - DNA, 121 bp, Artificial Sequence
  Synthesized
  misc_feature (61): n=a or g
aaaaagtagaagtcctcttgcctttcatggatgtctaagggaggtacttaagaacagactntgtttttgtatgggaactattgggtcacagcctgaaccactgattgagcacctggggaaa

SEQ ID NO: 36284 - DNA, 121 bp, Artificial Sequence
  Synthesized
  misc_feature (61): n=a or g
aacacaagaaattttaataaagaaccatttgcttctgaattgtcagaagttggcatctgcntagcattctgtcatgttttgcttaagaatttggtgagagatcagcgacagtggcggagta

SEQ ID NO: 36285 - DNA, 121 bp, Artificial Sequence
  Synthesized
  misc_feature (61): n=a or g
gggacagagcattcctgttggactgaagcactcatacgaatgtagtctgtcttttcacacngtcattttcttggatgggagtcatccccttgcgttgtcctcctgctttcttttcctgcgt

SEQ ID NO: 36286 - DNA, 121 bp, Artificial Sequence
  Synthesized
  misc_feature (61): n=a or g
gcaggcagtgctctccagcttcacttgcagggcagtacacatcatgggtcagccacagacncagcaagaacataagagaccctccctgtcaaaagctggcgtgaactgaaagatgctcaga

SEQ ID NO: 36287 - DNA, 121 bp, Artificial Sequence
  Synthesized
  misc_feature (61): n=a or g
gggacaagagtgaggctgatgtagtgctgctcctccacagggacgtcctggcatgaatggnctgaagggcgagaagggtgacccagtggacatcagtagtgtgctgagcttgcgggtgagt

SEQ ID NO: 36288 - DNA, 121 bp, Artificial Sequence
  Synthesized
  misc_feature (61): n=t or g
gcgtggctcagatagcagcagcccagtacaactcctgagtgctccgtcaggacttctaagngtcacacagccccggagagctgatgccaaaaaaggacacagacagaaaagggtaaagcaa

SEQ ID NO: 36289 - DNA, 121 bp, Artificial Sequence
  Synthesized
  misc_feature (61): n=a or g
atgacacactttagtgatgccaccaaggcctcctttggacgtaccatcatagaaccccagngagatgccaccaggacactttgaaactccatagtactctgcaggagatgccaccggggtc

SEQ ID NO: 36290 - DNA, 121 bp, Artificial Sequence
  Synthesized
  misc_feature (61): n=a or g
gtgtgcatttcatgctgagatcagagctagaaagaattgactgtttttcagaattcctcantgcgtgtgtgtgggttttcatcaagatactcttagacagctgatgactgaaaatacattg

SEQ ID NO: 36291 - DNA, 121 bp, Artificial Sequence
  Synthesized
  misc_feature (61): n=a or g
gagaagtgtgaattaaaacagagtacggcatcaataatgagccgctgacaaaaggtggccnacataaaatgtaaaacgttagcctgtggcaatatctcatcaaagacatgcatttcttaaa

SEQ ID NO: 36292 - DNA, 121 bp, Artificial Sequence
  Synthesized
  misc_feature (61): n=t or c
gccagtacagaaagtgacatcaaacagcttccctataaacaagcacggtggtgtttagtgnatttcagtgagaggagaagggcagggtccctgcagcaggaggccctgtgccagctgccag

SEQ ID NO: 36293 - DNA, 121 bp, Artificial Sequence
  Synthesized
  misc_feature (61): n=a or c
ataaattgaagcagactttggggtcagagcagaatggttggatcaggtcccaccaaaaatngggaccaagagggattctctcgttgatattttaaacttctgttcatggaagttttaatca

SEQ ID NO: 36294 - DNA, 121 bp, Artificial Sequence
  Synthesized
  misc_feature (61): n=a or g
caagtgtgtgcttggtcagaccaggttatctgtaggcagttcttcccaattgtttcccttnggatgtgcatctttttgatcgtctctggtttgttttgaatcttggtctgttttctttact

SEQ ID NO: 36295 - DNA, 121 bp, Artificial Sequence
  Synthesized
  misc_feature (61): n=t or c
attccctttaaactacttcagttttcaaggaaaaggtgttctctttggattagaaagcatntgaaggataatgtgcacacaaattatttagtcttttaaacaaaaacaaaacctcattaga

SEQ ID NO: 36296 - DNA, 121 bp, Artificial Sequence
  Synthesized
  misc_feature (61): n=a or g
accttatttgtcagtactgttgtcctcagatggcagaaagctttctgaagtgtcagctaanaatgctgtgacattactgagttggcactgttgtatgtgaatttcagctctaagcacatca

SEQ ID NO: 36297 - DNA, 121 bp, Artificial Sequence
  Synthesized
  misc_feature (61): n=c or g
aagccgtagaagtcatctaaacttgagtgcttgggcaactttaaacaatgctcatttaaanaaggagttacaaatttggtcagggaaggcaaaaagagttttaagattattcggaggggga

SEQ ID NO: 36298 - DNA, 121 bp, Artificial Sequence
  Synthesized
  misc_feature (61): n=a or g
aaacctttcttagaacttgatttcgaacaagaaaagacattcattgataattcacatagtntctcttgtttggaggctattagtggactcttaacaccaaataggttgccaacctgccaaa

SEQ ID NO: 36299 - DNA, 121 bp, Artificial Sequence
  Synthesized
  misc_feature (61): n=t or g
tttatttttcactcagacacaaaaatcagagctttttaccgagtctcccagttgccaatgnactggcttgactccatcccactggagtttgttggcagctcctatctaggaagaggagaaa

SEQ ID NO: 36300 - DNA, 121 bp, Artificial Sequence
  Synthesized
  misc_feature (61): n=t or c
tcctagtctggaaataaaagtgaggcaggaggaaatgactcttccataaagcccaaaacanggaacaccaaggtgaaccaaagcacctggttcgactcaccatctatacaatgcctttgat

SEQ ID NO: 36301 - DNA, 121 bp, Artificial Sequence
  Synthesized
  misc_feature (61): n=a or c
cacatacttggaatcctgcaatttggattcctcaagttgctccataaatagcaaaaaaaancagataaactatttacgcattctatgaaattcggtgtgtcaacttaaagacctgatgtta

SEQ ID NO: 36302 - DNA, 121 bp, Artificial Sequence
  Synthesized
  misc_feature (61): n=t or g
atgaccacagaggttattaaactttttggtagttttacaaaataaacataaatctccaagncatcttgcatatctttcctctccaaggaaaaatatactcagatgactataatttggttta

SEQ ID NO: 36303 - DNA, 121 bp, Artificial Sequence
  Synthesized
  misc_feature (61): n=t or c
actttctcttctagataaagtaaatcactccccaggagaaactagagctgagctcagatgnaggaggcatcagagcttatagggagttccatgcctgcacagacatcacctcaatctctat

SEQ ID NO: 36304 - DNA, 121 bp, Artificial Sequence
  Synthesized
  misc_feature (61): n=t or c
ttttttctgaaaagcttgtccaattagttgttcccctaaagcatctattgcaatttcttangcaaactaaaagctatagctaccaaaggcaacataatacaattttaggtagcctaaaaca

SEQ ID NO: 36305 - DNA, 121 bp, Artificial Sequence
  Synthesized
  misc_feature (61): n=t or c
accgtagatgtgtacatcatttttacatggcagttacttaacggtgcaggtaatgctgtgnagcactttggaagcaaacacaacattccttgtttttcacttgaatggattgctagatgag

SEQ ID NO: 36306 - DNA, 121 bp, Artificial Sequence
  Synthesized
  misc_feature (61): n=a or g
tgatgccacagctgctcagaaccacacaagagctcagcagaagtttttgggctgcaacacnagaatcataggaaatgcagacatataactaactcctggctgcaggtcctcatgtccctgt

SEQ ID NO: 36307 - DNA, 121 bp, Artificial Sequence
  Synthesized
  misc_feature (61): n=t or g
gatctatatgcttgtactcttagttaccactgccatatcaatgctctggaaaaaaaattgnattcaaaatcatgtcctgactgagcagttaggctagaaaatgtggatccttctccaaaaa

SEQ ID NO: 36308 - DNA, 121 bp, Artificial Sequence
  Synthesized
  misc_feature (61): n=t or c
tcagttatcccaccttctctaaagatattcagtcactcacaagcctacctcttatttacantagaagcactgcatttcctgaattaaatacataattactttaggaattgaaataattcaa

SEQ ID NO: 36309 - DNA, 121 bp, Artificial Sequence
  Synthesized
  misc_feature (61): n=t or c
acctgggagcacacaatgaccatcccatgctcacaatcagggatggaaatccaggaagtcnagtgtgtctggcaatatcagacctgctgtgagtgtacgaaaggccttttatggtgctgca

SEQ ID NO: 36310 - DNA, 121 bp, Artificial Sequence
  Synthesized
  misc_feature (61): n=a or g
gcagaaatcccatgcaaacttgggtaagcttctccgattgaaagaatgaacattaaggaanaaaaaaaaaaagcgttaaaactttgggctgctcctggcagggttacattctaaaaggatg

SEQ ID NO: 36311 - DNA, 121 bp, Artificial Sequence
  Synthesized
  misc_feature (61): n=t or c
tcaaggatcaactccctgccagaagcaatagtggctacaattgaattttgaggagagaaangagacagctgccttgaagcctcattaatacaattttctggtcttcatccttacctttctc

SEQ ID NO: 36312 - DNA, 121 bp, Artificial Sequence
  Synthesized
  misc_feature (61): n=a or g
caaaactgagtagtttgaagtgtttcttgttctctttggttctacagtgtaatagtgaagngctaaataacagtcatgttatttgatgttacttaatgcttgggttagaaatattaaaaga

SEQ ID NO: 36313 - DNA, 121 bp, Artificial Sequence
  Synthesized
  misc_feature (61): n=t or c
tctgaagtgcccaatatattcggaaagaaataaggactgagagtccctcccctccttttgngtgctgtgtatttcataggagaatacacgcctttgcactgagtaagggttagcactgggt

SEQ ID NO: 36314 - DNA, 121 bp, Artificial Sequence
  Synthesized
  misc_feature (61): n=a or g
cagaactaccttgaatgtttttgctttgctgatacatttctttcttcttttacagtacctncagagatcatctgtgtgctgcatttgtaccaaatccaaaccttgtgagctatattaccct

SEQ ID NO: 36315 - DNA, 121 bp, Artificial Sequence
  Synthesized
  misc_feature (61): n=a or g
gccttaggttagctttacgtcaaggctctgttataatgaaaagtggcaatttaggaggggnaaagtcctatctcctgggctgtgatgttgtcagtgcagctatccactccacactgttatt

SEQ ID NO: 36316 - DNA, 121 bp, Artificial Sequence
  Synthesized
  misc_feature (61): n=t or c
ccatgaactgacacttaaaccttggaaatacgtgatcctatcatccaggggtcatttgtcnagcttattgaggtctccaaggacaaaagtacactggaatgatgggagggagctgacagag

SEQ ID NO: 36317 - DNA, 121 bp, Artificial Sequence
  Synthesized
  misc_feature (61): n=t or g
tattttattcccctagtgtttttcgctcccctatctctttaaatcttacagatcaatcaanatacagttaggaaatctaattaagtgcccgtggtaataacgatgaccttcctttatcctg

SEQ ID NO: 36318 - DNA, 121 bp, Artificial Sequence
  Synthesized
  misc_feature (61): n=a or c
gtagacagtaaaggaactacataaaagtggctctttcttagttggcagttctccctccctngtcaggtctgctgacctcagtaacgtgcaaaaaaaaccccaatcaaaaacaaaaacaaaa

SEQ ID NO: 36319 - DNA, 121 bp, Artificial Sequence
  Synthesized
  misc_feature (61): n=t or c
cagtagtacaggaagagaaagggagctgtctgaaagcacacttaaaataaataacaccacnatcaggggaaacaaagaacacgctcaaaatgtgtagaaacactgaccatttctgtagaac

SEQ ID NO: 36320 - DNA, 121 bp, Artificial Sequence
  Synthesized
  misc_feature (61): n=t or c
aatgctacaatgcaatcacttgccacctagtgaccaaagcacagcaataatacaactgctngctgagcagtggcccaccagcaatgcaaaggcttaccctcactgatcaatgcccagcaac

SEQ ID NO: 36321 - DNA, 121 bp, Artificial Sequence
  Synthesized
  misc_feature (61): n=a or g
cagataaactcctggatctaccaaaattcagtggaaggtggaccaccccattcagatgatngcaaagagacaaaaagacattactgcttctcagctcacagagatgtacacggccactaag

SEQ ID NO: 36322 - DNA, 121 bp, Artificial Sequence
  Synthesized
  misc_feature (61): n=a or g
tattgtcatttgtatagggagagacacattattcattttggggtctgtcatttgtgactcntgtagttgttctacactgtggccataaaaacctcacaaagatccgtaccatcccactcct

SEQ ID NO: 36323 - DNA, 121 bp, Artificial Sequence
  Synthesized
  misc_feature (61): n=t or c
gagagcccgcttcagtgggcttggggggccaaggaagctcagagtccaaagaacccttcancaatgaagttatcagtgatttggagcccttacttctaactaaagaaattattcttttaaa

SEQ ID NO: 36324 - DNA, 121 bp, Artificial Sequence
  Synthesized
  misc_feature (61): n=a or g
aagaaagaagcagctaaaacaaatgagacagtatttcagacaattgtaattgtgaacctanggtagaaatatttctttgccttttcttgttctgcacaagacccttcttgcagtcctcaat

SEQ ID NO: 36325 - DNA, 121 bp, Artificial Sequence
  Synthesized
  misc_feature (61): n=t or g
gatcttgaagataaattctgttttctttttgttatgtatgtacgtagtagtttcaaagacncccctgctcagaaaattattccaaaactcagctccttacctagttaggagtgttctaact

SEQ ID NO: 36326 - DNA, 121 bp, Artificial Sequence
  Synthesized
  misc_feature (61): n=c or g
aatttgccaaccaagctcgaaggtggaattatgtgcagtttttagaacataaaaactcaanaaaaaagtctatgtacctgtctaaaagtctactccctgtcatttttcatttctttgttac

SEQ ID NO: 36327 - DNA, 121 bp, Artificial Sequence
  Synthesized
  misc_feature (61): n=t or c
ttcattgtcattttgctaatgagctgcgtcagtgcatcttttcaagtaccgaattgctctnctctcctttctcttgccctaagaaatgattgaatgtttctccaggagttccatctactaa

SEQ ID NO: 36328 - DNA, 121 bp, Artificial Sequence
  Synthesized
  misc_feature (61): n=t or c
gcacgcgaataaacaaaacgtggtcacttatttttacatctgcaattactggctatagcanggtcagcatttactaaagccccaagccgagttcacccctaatggaaacgagtggccatcg

SEQ ID NO: 36329 - DNA, 121 bp, Artificial Sequence
  Synthesized
  misc_feature (61): n=a or c
atgttgcattggcttgatatattagtttatgttggcagcagcgtgggatattttactgggntacactgtttgatgtgcacgtgccacacgtcctataaaatataatggaactcaaacttag

SEQ ID NO: 36330 - DNA, 121 bp, Artificial Sequence
  Synthesized
  misc_feature (61): n=t or c
aatttgttgccttatttccattctgataatccaagtcatttatacagcacaactctgctgngtgcagactcacctcttgtcttctttcttgtatttgatgtgggtctcatgattatgctta

SEQ ID NO: 36331 - DNA, 121 bp, Artificial Sequence
  Synthesized
  misc_feature (61): n=a or g
cattggttcaggcccagttaataaggaatggtgctgtgatctcagtgcatttatggtggangctcttgcattatttacaggacgtgagggcgtgatggcatttctctgggcatagcctagt

SEQ ID NO: 36332 - DNA, 121 bp, Artificial Sequence
  Synthesized
  misc_feature (61): n=a or g
gagcttgtgttagttttaagcactctgttgagtagcaactccaaggatgacagtcatcctngcctctttgactctgtattgatagttaatcctttgcccttccctactcatctgctgagag

SEQ ID NO: 36333 - DNA, 121 bp, Artificial Sequence
  Synthesized
  misc_feature (61): n=t or c
ttagctacaattgggaattggataccattctaaacagatttttacttttacctggtatggntgttcttacagtttatttctatgtggacagctttctggccgtattcaaccaagaagagag

SEQ ID NO: 36334 - DNA, 121 bp, Artificial Sequence
  Synthesized
  misc_feature (61): n=c or g
aaagtggcaaagcgtgttgagcccggatggaaagcagagcctcaaccccaccttggttatnggatggtaaaagatggtgcacaaaactgatgtgccaaacctcgtgtgcaagatgtggtgc

SEQ ID NO: 36335 - DNA, 121 bp, Artificial Sequence
  Synthesized
  misc_feature (61): n=a or g
cagtgctgattactaggaaaaaacttttaagcaccagctgaaaaatttaccgagttttttnaagcaaagatttggaaaatcagagcaattactctgagaaaactgggttacaacacatcat

SEQ ID NO: 36336 - DNA, 121 bp, Artificial Sequence
  Synthesized
  misc_feature (61): n=t or c
cacttacttgaagatgtacctgctcacctaacagcatcctctctctgcaattgcaatttanattacacaagcaacaagagagaaatcaagctgaaaaacacaaaatgttctctgttgccca

SEQ ID NO: 36337 - DNA, 121 bp, Artificial Sequence
  Synthesized
  misc_feature (61): n=t or c
aggactggttcagtaactacacagcatacctgaaacaatggagttctcattgtgaacccanataagtttcactctgatgtagttacaatgacttcagcagtcatttcagaaatacatacgc

SEQ ID NO: 36338 - DNA, 121 bp, Artificial Sequence
  Synthesized
  misc_feature (61): n=a or g
gccctgcatccaatcatttctgtaaattttaaaactatgactttagtagcctggttatacnagactgaacagcttacctaagaccatgaggtctcatccccatggtgctcatatctcctgg

SEQ ID NO: 36339 - DNA, 121 bp, Artificial Sequence
  Synthesized
  misc_feature (61): n=a or g
ttgatgccaaaatgtacctaattaataagtctgatgatgtttagattaaaacagatgttgnctatgttgttaacggaacagcagctaataaaaataattgcaacatatatgcctaaaaact

SEQ ID NO: 36340 - DNA, 121 bp, Artificial Sequence
  Synthesized
  misc_feature (61): n=t or c
acactgtatgccttctggtcgctacagcagagaaaatgaaagttgagtcctatagcaaagnctataatcttcatatgaccaaaagctatgcagctatacaggaaccaacataagaaacaac

SEQ ID NO: 36341 - DNA, 121 bp, Artificial Sequence
  Synthesized
  misc_feature (61): n=t or c
ccaggaagggcagtgcaacatcctgcagcatagctggctgagcccagcgcagggccaccancacgacactgagctcagtactgctctgaggaaagactgaggcaccagacatgttcacaac

SEQ ID NO: 36342 - DNA, 121 bp, Artificial Sequence
  Synthesized
  misc_feature (61): n=t or c
atattgtgatcccaatgcccttagctgctgagctgcttggaggtgtttctagtgtccctgntggggaaggcccaactggaacatctgaaatggggatcaagagaatgttctgaggatagat

SEQ ID NO: 36343 - DNA, 121 bp, Artificial Sequence
  Synthesized
  misc_feature (61): n=t or c
gctattccgctgcactctagtagcaagcagtaacaatctttgttgcattttctactttttnactaatgtcagtgtaaatacaatcagcaatatattttgtttaaaaatgggtgcttatagt

SEQ ID NO: 36344 - DNA, 121 bp, Artificial Sequence
  Synthesized
  misc_feature (61): n=a or g
tgtaggaaatggccagcatcattatttgtttgctccagagaatattctctgaatgccaggnggatgtgaaaatgttcacatcggagactgtttttttctaaaaggtgcttttctttagaaa

SEQ ID NO: 36345 - DNA, 121 bp, Artificial Sequence
  Synthesized
  misc_feature (61): n=a or g
gtatgctcaggtaactctcatcctacataacacaagtgagtttagggtaatgctgtagatnctgtagggagctctgttccctttggagcaaagaaaaccccagtgctcaagagaaccaaaa

SEQ ID NO: 36346 - DNA, 121 bp, Artificial Sequence
  Synthesized
  misc_feature (61): n=a or g
aagcaaacaaaatatttgcctgtaaattctatgtaaatgcctagaagacttggcatcacanagtttgtttgttgagtactactttgttgttcttgctaaatcatatcagaaagacaaagta

SEQ ID NO: 36347 - DNA, 121 bp, Artificial Sequence
  Synthesized
  misc_feature (61): n=a or g
ccaccattacaggctttccaaatctgtcagtattccatggccagctctttaaaagcaacantaagatgctgtgtctcagctagctgtcaaattttctggagttgtccctaggagaaagggg

SEQ ID NO: 36348 - DNA, 121 bp, Artificial Sequence
  Synthesized
  misc_feature (61): n=t or g
tcttgggaatgcatcatttgagccagtagacattagtatattctcaggtatagtgtttttnaaaatcctcaacctatatgttgtattttctccaaataactttaattcatattcacagcct

SEQ ID NO: 36349 - DNA, 121 bp, Artificial Sequence
  Synthesized
  misc_feature (61): n=t or c
aaaggtttccttctggaataaaggctttctgtgtcctctctttggggctgggaatcacccngaccacggctatagtagtgaagtatggcttgcccccaccgcttccatcaattaaagactc

SEQ ID NO: 36350 - DNA, 121 bp, Artificial Sequence
  Synthesized
  misc_feature (61): n=a or g
gccaggaccccgggtgagtcccttgtctttccatgtcactgtgttacccaggctgtgtgcntcccagcacacatggctcagaggaatgagggccacgcattgcaggcatcttccatgctct

SEQ ID NO: 36351 - DNA, 121 bp, Artificial Sequence
  Synthesized
  misc_feature (61): n=a or c
ttataagtccgctcacattccatatctaaactatcttgattatagattcacaaatagcgcnctgcccaattcgtctagcaccattccatgagttcattcttgactccttcataatttgtct

SEQ ID NO: 36352 - DNA, 121 bp, Artificial Sequence
  Synthesized
  misc_feature (61): n=a or g
agcaaaacgcagaccattacaggcacgtggatatcatggccactgtcatcctttccccacnttattggaaagtagctattttatccacgagcagtattgcttttttgtacatcagtctctg

SEQ ID NO: 36353 - DNA, 121 bp, Artificial Sequence
  Synthesized
  misc_feature (61): n=t or c
ctgacgtgtaaaacccacaacttctctgactaaattggtatacgttccatttattgtctangtacagctcatctccagactacactctcagatcttccatatgtaaaaataaattcttgag

SEQ ID NO: 36354 - DNA, 121 bp, Artificial Sequence
  Synthesized
  misc_feature (61): n=a or g
aactggaaaatatgtaaatggaatattttgtccacagtttcagagaatactctttagattnaacacaatattttgaagatgactttgtacaaactacctttcatttagagctataaaaaaa

SEQ ID NO: 36355 - DNA, 121 bp, Artificial Sequence
  Synthesized
  misc_feature (61): n=a or t
cctaccttattttattaggatgtatttcttcctcatatggacatttgcttgtaaatttttnttcttgaaagactgaagcttttggggactttccaggaggctttacaccttggaactaaag

SEQ ID NO: 36356 - DNA, 121 bp, Artificial Sequence
  Synthesized
  misc_feature (61): n=a or g
taaatatcagctactgtacttcttgatagcactgctcatattaagaaagtagcaactactncactttctgtgattcctctcccagaacacatgctagttaagctggcattattgttctttt

SEQ ID NO: 36357 - DNA, 121 bp, Artificial Sequence
  Synthesized
  misc_feature (61): n=a or g
acacagatgttttatcaagggctcgtagtagcaaatgagaaataatttgggttttgtactncagcatttttttttgtcttcaaagactgcaaaccctataattaattgacaggtagaaaat

SEQ ID NO: 36358 - DNA, 121 bp, Artificial Sequence
  Synthesized
  misc_feature (61): n=a or g
aattagccatgtaacaacattaatatcctttgattgcattgtgttggctcaaataatatantgtatgaaacatcagtaactgggcaggaaggtagattttgacttttattgcaacatggta

SEQ ID NO: 36359 - DNA, 121 bp, Artificial Sequence
  Synthesized
  misc_feature (61): n=a or t
aacatgagccaaaggtggtgggattaacaatgttttacaggtaggcatgtttctttcctgnagagcttgcatattagcaaagcatatcatgctggcagctttgcaagcacagaaactactc

SEQ ID NO: 36360 - DNA, 121 bp, Artificial Sequence
  Synthesized
  misc_feature (61): n=a or c
gggacagtagagaatgaggtttgcctgttacccttccttcatctagctcatcagaagtccntgagttgtgtgcttaccacgagatctacctcctgcgtcctattcttgtggttctctctcc

SEQ ID NO: 36361 - DNA, 121 bp, Artificial Sequence
  Synthesized
  misc_feature (61): n=a or g
cagcccccaagttcacctagatgtctatttctttgttcctgtgcttgtatgttttatgcancgttgacagccacagtgcactaccgtgctgcagttcagtttcatagggatacgaagcagc

SEQ ID NO: 36362 - DNA, 121 bp, Artificial Sequence
  Synthesized
  misc_feature (61): n=a or g
aattttacttttttgccactattttattatcaagggaaataaatagaaattgcactcatcncagtaaagttcccatgtctctaagggaaatattcagtggcagaaatatttgttccagata

SEQ ID NO: 36363 - DNA, 121 bp, Artificial Sequence
  Synthesized
  misc_feature (61): n=t or c
cgctctcacccaacatcccattggtgagaccattgttctcttgacaagggagttggggacnacagtgctgctctgataatgttcaggaggagcagttttgtcccatcatctcacttttgca

SEQ ID NO: 36364 - DNA, 121 bp, Artificial Sequence
  Synthesized
  misc_feature (61): n=t or c
ctgtatgcaatcattaactcattaaactttctcaggtggtctttttcttgattccacattngctgcaacagagccaaacgacagcaaagacccaagaagttaaactctccactacaaccaa

SEQ ID NO: 36365 - DNA, 121 bp, Artificial Sequence
  Synthesized
  misc_feature (61): n=a or g
tttttcaccataatggtaccagataattttactttctttaatcaatatgtgcacacaaatngtactgaccgccagtgtagataattagggtaaatcttttctccagataattcaaaggtta

SEQ ID NO: 36366 - DNA, 121 bp, Artificial Sequence
  Synthesized
  misc_feature (61): n=t or c
gggacctgcaatctgtgaggaaggaaactggcctcaggagcaggaaaaaagggcaatctcncagcacttcccaaaagttttcccaccctgtgaaaaaaaaaggcagtggtgcacatgtgca

SEQ ID NO: 36367 - DNA, 121 bp, Artificial Sequence
  Synthesized
  misc_feature (61): n=a or g
tgttagattcaagttttgttatacttctgctatgttgtccgctgtctgtagctgatttgcntacatgataaattttatttgcttacttaggactttgccagtaatttctattaatttcatt

SEQ ID NO: 36368 - DNA, 121 bp, Artificial Sequence
  Synthesized
  misc_feature (61): n=t or c
atgaatgttggatgggacagatgaaggcaccactggtctggtagcatggtggtgtgccacntcccaaccagcagcagacacagtgcagccatagtggcagaggggacaagggggctgagct

SEQ ID NO: 36369 - DNA, 121 bp, Artificial Sequence
  Synthesized
  misc_feature (61): n=a or c
taagtaatgggccttccaaagccaacatccagttaaaataccaaacttaacttgttttctncagagtttttataccattctcctccttgttttactccatatggaaacaccacctacaacc

SEQ ID NO: 36370 - DNA, 121 bp, Artificial Sequence
  Synthesized
  misc_feature (61): n=a or c
gctgtgatcctgttgtttgtctttcctttagaaaacatagatggtggcagtgataagccgngcgtcctttggccaccagcattgctttctccttcggcccctcgctggtgccttgagctgc

SEQ ID NO: 36371 - DNA, 121 bp, Artificial Sequence
  Synthesized
  misc_feature (61): n=a or g
cagaagaagccagctgtgtcggatgcttcccttggagaaaaggtaaaactgtcactagaanaattaccttgtcttggcccttgcagcagttttttgcctcccaggcccatgcactcaccaa

SEQ ID NO: 36372 - DNA, 121 bp, Artificial Sequence
  Synthesized
  misc_feature (61): n=a or c
cttttagacttgaaaaattattatttctgtaagtgcaaaaatgtattcatttaactttaanacgggggtttctctgtaaaacttatgggtttgactattaaatgtgtttgacacaagaatt

SEQ ID NO: 36373 - DNA, 121 bp, Artificial Sequence
  Synthesized
  misc_feature (61): n=a or t
ccctgtctgtctgctgtgtccaggcccccggaaggcagcctacgtatttttcctacctacngaaggaaagactgcagtctgaaaagaggcattagaccacctcacatctatctttaccagt

SEQ ID NO: 36374 - DNA, 121 bp, Artificial Sequence
  Synthesized
  misc_feature (61): n=t or c
gttccacatcgaagtagctttatggactgtatttattcctggcttgaggcagcacgagcanaggcagaatcaggctcagcatctgcaaatgcagacctcttctgtggtgtggattgatgta

SEQ ID NO: 36375 - DNA, 121 bp, Artificial Sequence
  Synthesized
  misc_feature (61): n=a or c
gaggtttgaagacatctgcagtgtgagacaaggaagagccagaaaactggaggagagcagngggaaaaagggcccaggaaagcaaatcctggtctttaaattcccataataaccaacagct

SEQ ID NO: 36376 - DNA, 121 bp, Artificial Sequence
  Synthesized
  misc_feature (61): n=c or g
tgttttcttttctttttcttttattcatagtcttcagtatagccagtatcttaccaaaatnaataacccgtgagttacaatattgtcttggaaaacaaacagataaataatacctgataag

SEQ ID NO: 36377 - DNA, 121 bp, Artificial Sequence
  Synthesized
  misc_feature (61): n=a or g
agcctctaatttcagttcagactctttgtttgtgaatatgttggttacttcacctgcaagntgaaaagaacaactttattcttcaaggaagtgtttgagttaggtcattttgaatcatctt

SEQ ID NO: 36378 - DNA, 121 bp, Artificial Sequence
  Synthesized
  misc_feature (61): n=c or g
taagcagtgaatggtggatttcattgttaattgatacttagaaataatgttttacctctgnaaatagctatgcaattaatttaataaaatgaactgatcagaatgtatgtgtttattttga

SEQ ID NO: 36379 - DNA, 121 bp, Artificial Sequence
  Synthesized
  misc_feature (61): n=t or g
aagtaatctttcttctacttacctgcacagttcattttcctcacacatgtgaattacactnagacatgatgggagtggagctgaagtaattgcacagggcttgccatgaagaagttctttg

SEQ ID NO: 36380 - DNA, 121 bp, Artificial Sequence
  Synthesized
  misc_feature (61): n=c or g
ggttttaagtttactaccagtggttctttgcatcttaaaaccaacccaccaatgttcctgngtgttacttgggccatactgagggaatggctttctgctccagaggtcactaattgctgtt

SEQ ID NO: 36381 - DNA, 121 bp, Artificial Sequence
  Synthesized
  misc_feature (61): n=t or c
aggctatcagtcccattatcccagcatcagagcagccaggtgacaatttctttgcctggangatggctgaaatctttctgcatgtctcacagatcatctagggataggcattgggtgggtt

SEQ ID NO: 36382 - DNA, 121 bp, Artificial Sequence
  Synthesized
  misc_feature (61): n=t or c
aacagttccctttccacaaatatatacaagctgtatgatttccagtggtcagaagatagcngcagaacagcagaaaattatctataaaagcagagaaaatgtatccatttcacacttccta

SEQ ID NO: 36383 - DNA, 121 bp, Artificial Sequence
  Synthesized
  misc_feature (61): n=a or g
ttcacttcggtaaggagcttgtttaggcttgtccacatggagaattcatattattttgcancagctttccttggcagcagttccgatcagttcaaacagcctgtattgatgtgacagacag

SEQ ID NO: 36384 - DNA, 121 bp, Artificial Sequence
  Synthesized
  misc_feature (61): n=a or t
cacggtgttaaaaaaaaacctcttactggaggggtctgaagactgacatacctacaaaaangttgcaagttgaggaaatgcttatttcaaaaagaatctaatggctcagcagatttgtttc

SEQ ID NO: 36385 - DNA, 121 bp, Artificial Sequence
  Synthesized
  misc_feature (61): n=a or g
agctaaagccagaaggccttgtaaaatatttgacctagccaacaggaactgtgagcttggntctggatgcagaagtgttccaaacttactgactttaacacaaagctagaagtgcaaagtg

SEQ ID NO: 36386 - DNA, 121 bp, Artificial Sequence
  Synthesized
  misc_feature (61): n=a or g
aacagttgatcggaagtttaaaatatatcaacttcacttaatgctcaactacaagcatccngccaaaactgggtcaaagtgagtaaagtgagttgtaaagagcatccagattgcatatatc

SEQ ID NO: 36387 - DNA, 121 bp, Artificial Sequence
  Synthesized
  misc_feature (61): n=c or g
ctgtgagaggaaaagatgaggttcattccagtccacatggacttcagttgatcacatctancttagaggaattcacttcagagctggcgtgttaccagaacttcatcaagaggtgactcct

SEQ ID NO: 36388 - DNA, 121 bp, Artificial Sequence
  Synthesized
  misc_feature (61): n=t or c
tgctcaccctctggatgagtcccaacaagctctgcttcttctggggctctctttgaatcgngctcccttttctgtttaactgctgaaatgaaatgaacctgtgtttcttggaaattcattt

SEQ ID NO: 36389 - DNA, 121 bp, Artificial Sequence
  Synthesized
  misc_feature (61): n=t or c
tggtacacatcccagtgcatcagcattgatgcaaagttctgcagcatacagccctcttctnactgagagatttctcttctattagaactagtagtttatttttcttcacactggagtgaaa

SEQ ID NO: 36390 - DNA, 121 bp, Artificial Sequence
  Synthesized
  misc_feature (61): n=t or c
tcactgaaagcagaattgctccatggttgcactcctgcaaaggatttccatccatactctngcagtgtcactgcagcactgacgagaaaatctgttcacagagctgctttttaattgctgt

SEQ ID NO: 36391 - DNA, 121 bp, Artificial Sequence
  Synthesized
  misc_feature (61): n=a or g
gaggaggagaatggtgtccaaagagcccttgaaaaggtgaagccaagagaatgagggtcgnggagaaccaaaaggaagggaccccaaaaagagggaggggaatggggaaagagagaaaggg

SEQ ID NO: 36392 - DNA, 121 bp, Artificial Sequence
  Synthesized
  misc_feature (61): n=a or g
tgcaccaaagattctcgatcaatctaacaggctgctattggagaaactcactctgtgtcantcttcagacagaattccaggagaaacagtccaacatttgataagtggtgataaaatgcaa

SEQ ID NO: 36393 - DNA, 121 bp, Artificial Sequence
  Synthesized
  misc_feature (61): n=c or g
ttccaagcacccattactccaagcctatgggctccacaacctacaggaacctcagcacagntgggaagccaaagcaaatgctactgttttgaatttggaaaactcaaaagagaccaaaaaa

SEQ ID NO: 36394 - DNA, 121 bp, Artificial Sequence
  Synthesized
  misc_feature (61): n=t or c
ccaaccttcacttgcaagctttattcccctgcatataaaattaaagcgcacccaaaaaacngctgtgtcatttatcaaggaactgaggtgggtttctgaacaagtcatagtgcacgagcat

SEQ ID NO: 36395 - DNA, 121 bp, Artificial Sequence
  Synthesized
  misc_feature (61): n=a or g
gccactctcaggacaaaagtgggtctggaagaatcaatatcctctagagaacagtctctanaggatacccaggttgacagaccctcagagttggcaaaataatcacagcttttctgccagc

SEQ ID NO: 36396 - DNA, 121 bp, Artificial Sequence
  Synthesized
  misc_feature (61): n=a or g
cactgactttaaacaaagacaggcaaatccctgggtgagagaaatgtggttgatacacagngggctttgacatagtgtttttcagcagttccatctttagtcactcacttcagtctattga

SEQ ID NO: 36397 - DNA, 121 bp, Artificial Sequence
  Synthesized
  misc_feature (61): n=t or c
atagaccaaatcctgattgcggtgaatccactaagcagtggattaatacaaaattcacttnttcagaagtgataagtgaatatggcagtaagtagtaaatagacttgcatagaactttgga

SEQ ID NO: 36398 - DNA, 121 bp, Artificial Sequence
  Synthesized
  misc_feature (61): n=a or g
tatacttcaatcataatatcaattcctcgggaatggtatattctatattgcttgcagaacntctatgcactatagttaaaacacattataaatgtaaaattatctaagtactgaagttaaa

SEQ ID NO: 36399 - DNA, 121 bp, Artificial Sequence
  Synthesized
  misc_feature (61): n=a or g
tcctggagggcaagttggatgtcagtcagtagtgagagattttaactctcaaattaacttnatactggaccaaatgaagagtgcagccagaaggatgagagaagtgatttagcccttcatt

SEQ ID NO: 36400 - DNA, 121 bp, Artificial Sequence
  Synthesized
  misc_feature (61): n=t or c
ggtcttaatattagcttgtagaaccataatgtttaaagagagctccaaaagccatatgganaaattgtgcatatttatagtaagagggctcctgtgtgaatactgcagctggctctgaggc

SEQ ID NO: 36401 - DNA, 121 bp, Artificial Sequence
  Synthesized
  misc_feature (61): n=a or t
cagttcactaaggtgagaacgttgtgcttttttgcaacaaagaatagatacacttgctttnaaggcctttggttctaagagagggaacaaactcaaaattgcaaaggctgtcaacatatct

SEQ ID NO: 36402 - DNA, 121 bp, Artificial Sequence
  Synthesized
  misc_feature (61): n=t or c
tgcattatcattggcataagcaaaatgtgttgggaagagccctgtgcctgttctggcacantgcacaattactggcccttcatcatcaacggacagggcagttgtgggaaaggaagttaag

SEQ ID NO: 36403 - DNA, 121 bp, Artificial Sequence
  Synthesized
  misc_feature (61): n=c or g
cattggtattcacaaagcaaggtgttagcagagagcacgatggggcaacgcttcttgctanctcacttcctgaggctttctttcccagcttacacgagcacaaggattgacacaccgcaga

SEQ ID NO: 36404 - DNA, 121 bp, Artificial Sequence
  Synthesized
  misc_feature (61): n=a or g
atggagatgccatgggatacatcttcaggttttgctggttgggcttcttctgtatcacgcntttgtgcagaaatgaggtttttactaaaatacagcatccaagattttccggagcataagt

SEQ ID NO: 36405 - DNA, 121 bp, Artificial Sequence
  Synthesized
  misc_feature (61): n=a or g
cttggattcggacacgatgaagtacaagcccttctcttggacttggctttctgttgtgggnctcttgcttacacgagtgtcagcgagaaaagaatcaggcccgtcacattaaatggaaaac

SEQ ID NO: 36406 - DNA, 121 bp, Artificial Sequence
  Synthesized
  misc_feature (61): n=t or g
tttatttcatcacagcaatgtaaattcaaaaataatgaaagcactttcaatctttcctttngtctttcatgcatgcaaagtcatacagatagttaaaaataaaggtgttcacctggtacaa

SEQ ID NO: 36407 - DNA, 121 bp, Artificial Sequence
  Synthesized
  misc_feature (61): n=t or c
gctcctgggagctgtctccctgctgggagatatctcggtctccaggtgtgtcccatttccncctgttcagacaagtgggctcctgcccctgccctgatctcttgtcttcccaaaccacagc

SEQ ID NO: 36408 - DNA, 121 bp, Artificial Sequence
  Synthesized
  misc_feature (61): n=a or c
ggatattcttgcaatgtgtatgacaaaaaaattacatatatattcacgctgcgttgctagntagacatgtatattgcaaattacttaacttctcctccttaaattctctattactctagtc

SEQ ID NO: 36409 - DNA, 121 bp, Artificial Sequence
  Synthesized
  misc_feature (61): n=t or c
gctgtgcatgcagcatctaacaattcctgctttaacgttgcaggtctgtgctggcagacgnctggctgtggctgcaaccaaagctgctccttcccgagctgccctgcaggatgacttcact

SEQ ID NO: 36410 - DNA, 121 bp, Artificial Sequence
  Synthesized
  misc_feature (61): n=a or g
catgagctggtagggctgtgctggcatgtggatactgacaaagcccaagaccccatacacntgaaggacatggacatccaaatccacttccctgagcagctcattgacccctttttcatca

SEQ ID NO: 36411 - DNA, 121 bp, Artificial Sequence
  Synthesized
  misc_feature (61): n=a or g
tttcataaaggtaaaggaagggaagaacagcataaaaggtgcttttcatcagttgatggtntgtgtttgtttgaaagctatcatatgcatacatcattttcacaaaagagttagcctgatc

SEQ ID NO: 36412 - DNA, 121 bp, Artificial Sequence
  Synthesized
  misc_feature (61): n=t or c
gatatatttagaatagctgcaatattgttgccactggcattttaactatgagctaaaccangactgctgacaggctaaaaggttgtcacagtcaaggtcctaattactctacaaattgaag

SEQ ID NO: 36413 - DNA, 121 bp, Artificial Sequence
  Synthesized
  misc_feature (61): n=a or g
atgaacctgcagcctttctacccgccttgggggcctgagctgcaggattcaaaccaccgcntgcttagaagttgaaaatctctgtaatgtagaaggtttcattcactaaactcagcggcgt

SEQ ID NO: 36414 - DNA, 121 bp, Artificial Sequence
  Synthesized
  misc_feature (61): n=t or c
ccgtagtccgtttttgctgcagattccttggggccgtacctatcagtctgcaacaccgacngcagccaaacaactgcgtggccctgccaagcccacactgcctggaataatcctcctagat

SEQ ID NO: 36415 - DNA, 121 bp, Artificial Sequence
  Synthesized
  misc_feature (61): n=a or t
gctcagtgcagtgaacactagtatgatgcgtggtccagaaggtatcctgatttgaatttantaaatcagttcctctgatatagctaggatatgtagaaactgagacatgtatggagaatga

SEQ ID NO: 36416 - DNA, 121 bp, Artificial Sequence
  Synthesized
  misc_feature (61): n=a or g
atggaaattgtcttgtttaagattttcacagtttggtctttggttttactggttcagcctngattctacagtctatgtaaagcacacccagcacagatctctcttaaattttgtcttttgt

SEQ ID NO: 36417 - DNA, 121 bp, Artificial Sequence
  Synthesized
  misc_feature (61): n=a or g
atttttttcctctcttattcttgaagatgccatagtggactaagattagtaagaaccagtnctcagcatgtggaagagtagggcttgtgtagcaggtgcataccagttgtgtccaaagaat

SEQ ID NO: 36418 - DNA, 121 bp, Artificial Sequence
  Synthesized
  misc_feature (61): n=a or g
aatagttggtacttaaaggcaaaacttcagatatttacagtgtaatacatctgcacacagnatagattttattgtggtcttaacacacacacacacaaatgcaaacttcaaaagatttata

SEQ ID NO: 36419 - DNA, 121 bp, Artificial Sequence
  Synthesized
  misc_feature (61): n=t or c
tgataatcttgattatgcaagcaaaatacactctcctattgtcagtgatgaaccatctgtnaacagaagcagctacatcatggaataatctagtttccaaaagatctttacaatcatcaag

SEQ ID NO: 36420 - DNA, 121 bp, Artificial Sequence
  Synthesized
  misc_feature (61): n=c or g
cttgtccctatgctgacaacaggcctacaggtcttcttttgtcagtatacaaagagaaaanaacagaaatgatgctgctaaaagcagttagagaaaagaggtggccatgtttttctgtttg

SEQ ID NO: 36421 - DNA, 121 bp, Artificial Sequence
  Synthesized
  misc_feature (61): n=a or g
tctccatcctgcatctgttccttctctacccttggcaccatcccaagcctttttctggtgngtttcctgtttcaggcatggttccctgctccccacagcattcccaactcaccaaacacaa

SEQ ID NO: 36422 - DNA, 121 bp, Artificial Sequence
  Synthesized
  misc_feature (61): n=a or g
acctgaaagaaggggtgagcagcccattaattaaatttatatatgcttccaaaatgagagnttctgcaatctctaatacagaggtaggacaaaaagccggtagtgactgaaagtaaaagtt

SEQ ID NO: 36423 - DNA, 121 bp, Artificial Sequence
  Synthesized
  misc_feature (61): n=t or c
agctcccatgtgggccgtgttcgtaccgcgatgtcctgcagtgctctgcacggtgtgcatngctgccgacacagcccagcacttcgcctctttaaaatgttgcagcaaaaaagatgccgtc

SEQ ID NO: 36424 - DNA, 121 bp, Artificial Sequence
  Synthesized
  misc_feature (61): n=c or g
ggagtcttttgctctgcattgtggaaggacaaagagaaactgaacccttcacaagggtctnagtgcagcggtctaaagcatctttggcccagcagagaacaaggcccagtattagatcagt

SEQ ID NO: 36425 - DNA, 121 bp, Artificial Sequence
  Synthesized
  misc_feature (61): n=a or g
actaagcactagtcaaagcttcagcatgcaagtaaaagcattccaggttacatggcttgcnaattttatcccccttgaaaagtcagcaagactgtactggtgcttcagcaaaagctattta

SEQ ID NO: 36426 - DNA, 121 bp, Artificial Sequence
  Synthesized
  misc_feature (61): n=a or g
ttaggaaagcacacaactagagtgtgcctcactgtaataagacattggaccgggcaccctncaagctgagcttcccccactgcaaccatctctctaggggtcttgcagtgaacattgctgg

SEQ ID NO: 36427 - DNA, 121 bp, Artificial Sequence
  Synthesized
  misc_feature (61): n=a or g
cgcagcctctcgccttccttcacgctgtcagtacagaggagccattgggtgacctctcttncttgctgcccccacacagcgccagcaccagtgctgctccttctcctgctggcacagtgct

SEQ ID NO: 36428 - DNA, 121 bp, Artificial Sequence
  Synthesized
  misc_feature (61): n=c or g
tcatgctctgcttcctgcaatgcaatgctccatttctgggcaaagcctgcagcaagcagtncagcactgggagcagtgtggcacttacacttcagcaaaccagacagtgggaggggaaatg

SEQ ID NO: 36429 - DNA, 121 bp, Artificial Sequence
  Synthesized
  misc_feature (61): n=a or t
gacccccacctgaagaagcttcccaatggaaaagagcaagagaatctcagtatagttaacngagtggactagaaggcccactataatttactaagccttgcaatcagcagagaaaagatgg

SEQ ID NO: 36430 - DNA, 121 bp, Artificial Sequence
  Synthesized
  misc_feature (61): n=t or c
ctttgcaggtcttcaatttgtagttttctttctgacattattttagttaagaatactttgntttcagaatgagaaaacatgcataaaaagcccagctgaagccaaatttattttaccattg

SEQ ID NO: 36431 - DNA, 121 bp, Artificial Sequence
  Synthesized
  misc_feature (61): n=a or g
ttgtctgatggaatatgtagtgaggaataacaaaatatcagcatgtagctagaagggttgntgacatcaatttctaagcaataattaagcagtgacatagaatttgaaatatcgaacacgg

SEQ ID NO: 36432 - DNA, 121 bp, Artificial Sequence
  Synthesized
  misc_feature (61): n=t or c
ttatttggttgcctaatgaaatatgaaatggtatggagaaagatggtaatgtttttagcangggttttcctgcatgcactactaaaacacatctttgcattaaaagctcaggaattaccgt

SEQ ID NO: 36433 - DNA, 121 bp, Artificial Sequence
  Synthesized
  misc_feature (61): n=a or g
aggataattttgttctctgcttcgtaagcccatccgaaacttgatgaaagactcatggatntaatattaccaatggaatttaaattttgtagcttcatgccaacatatgaaatgagaaaaa

SEQ ID NO: 36434 - DNA, 121 bp, Artificial Sequence
  Synthesized
  misc_feature (61): n=t or g
gtgctccccttggatatttattcatttcctcagcattaagtaacaacagtacactgtcatntgaaaccagaacgtgaccttcattgccaatagcaattaaacacattaacttatcaccaga

SEQ ID NO: 36435 - DNA, 121 bp, Artificial Sequence
  Synthesized
  misc_feature (61): n=a or t
tgtgttagtctctgctgccacccatgtctttctgaactgaatcagacttcaggttacgttnttatttacctgtacctacctctgtcggtgcagcagctttactaaccaaatgcatggcccc

SEQ ID NO: 36436 - DNA, 121 bp, Artificial Sequence
  Synthesized
  misc_feature (61): n=a or g
gcatcctgcccacgtgtcagattctgctgccaactgtgctgggccaaccgcacggggatcngcaacacttcatccaatacaagtcttagcccatcctgtcccagacaccaaaccccagcat

SEQ ID NO: 36437 - DNA, 121 bp, Artificial Sequence
  Synthesized
  misc_feature (61): n=a or t
gaagtagcaaggacatttcttatactgaatagctactacattgatttttctactggaaagntttccagtaagttaaatcaaggcagaagccactgcaagcaagtttgattttaactttttc

SEQ ID NO: 36438 - DNA, 121 bp, Artificial Sequence
  Synthesized
  misc_feature (61): n=t or c
ttcactttctatttccgtggaagactgaagaaatacagaggataaagcaggataaagtctnctccgagcactgtttggatgcattttgacagcttcataacgctcagccaaaccattttga

SEQ ID NO: 36439 - DNA, 121 bp, Artificial Sequence
  Synthesized
  misc_feature (61): n=t or c
agtgtttaagatttaaaaatatatataaaaataaaaacaatgtttatttatgtcaaattantggacaagagctcccttccaactttacaatttggtaacttttccgtttctcacataaagt

SEQ ID NO: 36440 - DNA, 121 bp, Artificial Sequence
  Synthesized
  misc_feature (61): n=c or g
ggcaggactggggagctcgtctagcacatgccaaagctgtgcctggcagtgggttaaacantgcaggtaatccgtgggcagtgctcagatctgcttctggccggggtccagctggcggatg

SEQ ID NO: 36441 - DNA, 121 bp, Artificial Sequence
  Synthesized
  misc_feature (61): n=a or g
cctgaatactctgagaagcaactccctctcccccgctagctataactaagcacaaaggtanctcattaatgacacagaaggtaacagtatagacttcacgccttgacagggcatatttctt

SEQ ID NO: 36442 - DNA, 121 bp, Artificial Sequence
  Synthesized
  misc_feature (61): n=t or g
ggttaacagggtctgtggagatgggaaggttcatcattcctagcagctgtgactgcactgnggctgcactaccacccttggagaggatgccacctgcaccccagcctggcttaaggtgcta

SEQ ID NO: 36443 - DNA, 121 bp, Artificial Sequence
  Synthesized
  misc_feature (61): n=c or g
ccgtgggtcactaccttgaaatgtaaaatgtcagcctaggcctgcaacattccagccgttntgtgttgtggttgttattgtatttggcaatccagacagttttgttgcacaggttttgtgg

SEQ ID NO: 36444 - DNA, 121 bp, Artificial Sequence
  Synthesized
  misc_feature (61): n=a or g
tgccttttcttaatgcccccttatgcagtcctttgtaactggctgtgaggtgcagtgcagntcgcaagctgcatgcagtgctatcggtgcacactagagggtagtgcaccactgactgccc

SEQ ID NO: 36445 - DNA, 121 bp, Artificial Sequence
  Synthesized
  misc_feature (61): n=a or c
ctagtgttgctctgcagaacgacctcagtctgggcctcaaggatctgtgctttatgctttntgtgctttgctttccacacagagtgggttttggtgtctgccctgtaaatagtgctggaac

SEQ ID NO: 36446 - DNA, 121 bp, Artificial Sequence
  Synthesized
  misc_feature (61): n=a or c
agcaccagctctgctgtcactaatgaacgagctgacgggtgagctgttccctcttcagtgngcagggaacggccaccttcactgacaccccctcctggatctgcaccagaggcaatgctgt

SEQ ID NO: 36447 - DNA, 121 bp, Artificial Sequence
  Synthesized
  misc_feature (61): n=c or g
cttgaaggcggctctgttctccccgagggacctcaatgcttttttcagcgccctcacccanagctttctccctctccttgtttgcagactggtttcctgcccagcgagatgggaatcgcca

SEQ ID NO: 36448 - DNA, 121 bp, Artificial Sequence
  Synthesized
  misc_feature (61): n=t or c
ccagttctggttatttgcaatcggacagaagacaggatgccatcagggaagctaatggtcngttagcttctatgtgagggccaggcatgggagaggagaatatggacatgccagagactgt

SEQ ID NO: 36449 - DNA, 121 bp, Artificial Sequence
  Synthesized
  misc_feature (61): n=t or g
tagggcacatcctttagtcaggattatcaataatttaactaatctagtagtcaaccagtgnttgactactagatcagtactcatccatgggcctgagcaccataggcatctcctgggagca

SEQ ID NO: 36450 - DNA, 121 bp, Artificial Sequence
  Synthesized
  misc_feature (61): n=a or t
tgaataagttatttatctgattaaaaggtaattagttactttagtggggccacatgtatgnaactgagaatataattctgcctaaagaatttttaaaataaaatttgtaataataaaagta

SEQ ID NO: 36451 - DNA, 121 bp, Artificial Sequence
  Synthesized
  misc_feature (61): n=t or g
caccacactgagaactgctccccactgcagaaaagcagtggcaatgagaattattagttangaaaaaaacatcctaagtgatgctgtagctttggaaactgtagctaaaactactcagtgt

SEQ ID NO: 36452 - DNA, 121 bp, Artificial Sequence
  Synthesized
  misc_feature (61): n=t or g
agacttcaacagataaacattttgagacttaaaatccaattttccaaaatccatacctaanaattataagacttcaacagccaggtttgttctgtctgccaagtattgttctggaagttcg

SEQ ID NO: 36453 - DNA, 121 bp, Artificial Sequence
  Synthesized
  misc_feature (61): n=t or g
actatttgcaagattttaaagaaaatctccgatcaaaccattgcttctacgttctcatctntatataaagtgtatccatctaatacagtttcactccttgtctctttctgagcttttgtta

SEQ ID NO: 36454 - DNA, 121 bp, Artificial Sequence
  Synthesized
  misc_feature (61): n=c or g
tttcagggttgttctgtatggaactgaaaggcgcattattgcctacaggaaggctgcgganggactttttgtagcagcaggatgaggggaaatggttttaaactggaagagggtagattta

SEQ ID NO: 36455 - DNA, 121 bp, Artificial Sequence
  Synthesized
  misc_feature (61): n=t or c
catatgagaactgctatgtgagctgtaaaaaaagtatctgcgcaaaagatttacagtaatnctgtaatggataaatagaagtggatccaaactcgcagggagtatacctcttatttaagaa

SEQ ID NO: 36456 - DNA, 121 bp, Artificial Sequence
  Synthesized
  misc_feature (61): n=a or g
tcccagctgcaaggctcagcagacaggttgagaattgggtgagcatggtcacttaataccntctttgctctcatagaaatggcttcttcataggagagatgaaacacggtggtgaaagatg

SEQ ID NO: 36457 - DNA, 121 bp, Artificial Sequence
  Synthesized
  misc_feature (61): n=a or g
gaattgaaagctgaagcaacttaaaccactcaaaccacctctgttgccttcagccttctgncactaactgtttctttgtctgtgtacatgctttttgcatggtgagacaaatgggggagga

SEQ ID NO: 36458 - DNA, 121 bp, Artificial Sequence
  Synthesized
  misc_feature (61): n=a or g
aggaggtagttttgtccattataaactagaggaattcaaagtactccatggatttgttacncgagttctttgaaaatactccattgtcttctggcagcagcagcagcgataaaggtttgaa

SEQ ID NO: 36459 - DNA, 121 bp, Artificial Sequence
  Synthesized
  misc_feature (61): n=a or c
tattgcagcatccctttcacatcacttgaatctctgttatctcacaccaaataattatttnatagatggaaaaataagcatcctccttcaccagatggaagctaaatacaccaaataatta

SEQ ID NO: 36460 - DNA, 121 bp, Artificial Sequence
  Synthesized
  misc_feature (61): n=t or c
cagatttggtaaataaggccatcaaagaatccatcctggttatccacaccttcatttcttnagcttccaggctgaaatagaacttttttactgaggagaggaagaggaagggtacatttta

SEQ ID NO: 36461 - DNA, 121 bp, Artificial Sequence
  Synthesized
  misc_feature (61): n=a or c
agttgacctttggatgctctaggattctggtaagaaagtacttgagcctggtggggagganagaccactgggctcttttggcagctctgtctctggcagccacaggaacacagatgaatta

SEQ ID NO: 36462 - DNA, 121 bp, Artificial Sequence
  Synthesized
  misc_feature (61): n=a or c
tggagctagtggctggaactttcagaaagggaaggaagtttcttccctttgtaccagcagnaaaaagagcccctgtgcggagacagccaacgccaagggaaataagggatgaattcagatc

SEQ ID NO: 36463 - DNA, 121 bp, Artificial Sequence
  Synthesized
  misc_feature (61): n=a or g
acagcccagctcccggcacacgactgcagcatcctgtaggtcccaggtgtcatcacacacngtcccccacttctggtcgtgaaaaacctcaactctcccaatgcagttgttcgatccattc

SEQ ID NO: 36464 - DNA, 121 bp, Artificial Sequence
  Synthesized
  misc_feature (61): n=t or g
agctctgatgttaattcacggtacatcttcttatgtttctcttcttctccctgttgctctncatctttctctccccatttatttatgtttttaatttttaatttcctaaatatcagttcca

SEQ ID NO: 36465 - DNA, 121 bp, Artificial Sequence
  Synthesized
  misc_feature (61): n=c or g
gttatttgggggctacaccatccccacggctcagaaacgtgctccaagccaggaagcagcnagcagctctgtaagctgaagtggttcagtaaaagagctggagactacgtggaaaaactca

SEQ ID NO: 36466 - DNA, 121 bp, Artificial Sequence
  Synthesized
  misc_feature (61): n=a or g
cttgtcttccacacacagagcccctcatctgtgaatgcatcatagcatctgcagacactgnggcttgcagactagtgacagaccatatgacaaactcctaacaccatgacatcatgtgaca

SEQ ID NO: 36467 - DNA, 121 bp, Artificial Sequence
  Synthesized
  misc_feature (61): n=a or g
tacatgcaatcactctgcagtgctgctttagcagcagacattactccctcaagaccacgtncttattctttgtgcagttagtaacaattataattagcattaagaattattatattgttac

SEQ ID NO: 36468 - DNA, 121 bp, Artificial Sequence
  Synthesized
  misc_feature (61): n=t or c
gaccacaagccctgggccctcagcatccctggaggtaggtacggcattgctgttattcccnttatagcgatggggaaacggaggcagaatgctaaagcaacttgcctgcaggctcagagga

SEQ ID NO: 36469 - DNA, 121 bp, Artificial Sequence
  Synthesized
  misc_feature (61): n=a or g
ccttagaaatccccagaccttgtccttggtttccctactccgatggtctcacatgaaaagnactggggcactggtagagtggaaatgttcaagtgtgagaaggaggaaataaaagcagact

SEQ ID NO: 36470 - DNA, 121 bp, Artificial Sequence
  Synthesized
  misc_feature (61): n=a or g
ggacagtcacattaaatggattccaaaaagttaccttgaggtttggtctggagagatgagnaactagcaaagacagagttacaaaaagctgggaaggagggaaggagaggactaattgcag

SEQ ID NO: 36471 - DNA, 121 bp, Artificial Sequence
  Synthesized
  misc_feature (61): n=a or g
gggcacatctccactggggtcgtgttgagccttcttcagggctgtgcccattcatgtcctnttttaggacagcctttgtctctgtaggatgtagcagttggtaatgcacacatccccatcc

SEQ ID NO: 36472 - DNA, 121 bp, Artificial Sequence
  Synthesized
  misc_feature (61): n=a or g
aagaaatataaaaggaaactcagactgaagaaatgccttcaaatctgcctatggggtgtcngtgttgtcactgctgggaatatgctcctatgctgcagaaagtaaatgtcctgatgggaaa

SEQ ID NO: 36473 - DNA, 121 bp, Artificial Sequence
  Synthesized
  misc_feature (61): n=t or c
tctcagagctaataccgatacaaaactattcttgacacacatatgtttctgcaatttagtncttccaaataagagaaaaatcatctcacaagattattttttgtgtccacattcaagacca

SEQ ID NO: 36474 - DNA, 121 bp, Artificial Sequence
  Synthesized
  misc_feature (61): n=a or g
aaaagtgtggcattcaaagaacagcagtctcctgtttgggcaagacagtattgtttgaacnaggcatacttgtccttgcctttctaaaggttaggcaattactttcatgaaaccagaattt

SEQ ID NO: 36475 - DNA, 121 bp, Artificial Sequence
  Synthesized
  misc_feature (61): n=t or c
gtacatgtgtatgtataagaatcactatgagctatcaggatggcactttaatctaagctantaattcaaataatgtaaagcttgcttaacacttcacataaaacaacacacaaataacttt

SEQ ID NO: 36476 - DNA, 121 bp, Artificial Sequence
  Synthesized
  misc_feature (61): n=t or g
tgagcttgttgtgtattgagtgtcttactgctggaaggatcacgaggaaaaaataaaagantgctagccagttttgctttgtaaccccaattagcatgaaacaaatagcagcaatgcagaa

SEQ ID NO: 36477 - DNA, 121 bp, Artificial Sequence
  Synthesized
  misc_feature (61): n=t or g
gtgttcagaggaaccaccaagttcccctactgctcggagttcacttaataacacaattacnggagccagagcatcaaggaaaacgatgtcgtcagccttgagataaaaattgcaggagcta

SEQ ID NO: 36478 - DNA, 121 bp, Artificial Sequence
  Synthesized
  misc_feature (61): n=a or g
attgatcacattcttatggagattttacattctgttttcttaagcattcactactttactngtagttccctgcaggagggataacactacctgtgtgtgtgtgtgatagctgctgctctaa

SEQ ID NO: 36479 - DNA, 121 bp, Artificial Sequence
  Synthesized
  misc_feature (61): n=a or t
cttttttattctcacttataaaagctgagtgttttctgtggtttcagcatgaagccagaanaaatagggaggtctgaagtgggttttgctgatttgtttgaacctgtagctcaggaggctt

SEQ ID NO: 36480 - DNA, 121 bp, Artificial Sequence
  Synthesized
  misc_feature (61): n=c or g
tttgctggctgtccagcttatgtatgtgattgcatttaggaaagtatctagatcctggatnagatggagtttatttctggttgttgcagaggaagggttgtccctccagtgtgaaaaaggg

SEQ ID NO: 36481 - DNA, 121 bp, Artificial Sequence
  Synthesized
  misc_feature (61): n=c or g
cggctccccggcttccccatcagccagggctgaactctgcaggttgtgtgggaggcagtgntgtggtcatggggcaggaaacgtaagagctcactgcatccaactgtgcaactcgcaggaa

SEQ ID NO: 36482 - DNA, 121 bp, Artificial Sequence
  Synthesized
  misc_feature (61): n=a or g
agctccaaggtttttgagatgggtcaggagcctttcatcaacattcttttaatcagaaatnttacgaacagcactctccaaagccccgcttctcgcaagcacagcccccggggagatggag

SEQ ID NO: 36483 - DNA, 121 bp, Artificial Sequence
  Synthesized
  misc_feature (61): n=t or c
agatgttgatagtggtgatggcagacattctttataagtaggaatttactatcttgaaacntttgggctagtaaaggcagattacaggaataggctagttagtataaactgaaggaagaaa

SEQ ID NO: 36484 - DNA, 121 bp, Artificial Sequence
  Synthesized
  misc_feature (61): n=a or c
ggatttaacctccccctgcaggaacccaccaggttgctgcgggcagcacaaggcagtgtcncaacacaaacagggcacacgttccctgcagctttgttctcactcattgtccttcggggaa

SEQ ID NO: 36485 - DNA, 121 bp, Artificial Sequence
  Synthesized
  misc_feature (61): n=t or c
tggccatggtaaaagctaaaactagcttttaattaggtaagctatagattcagacattcangattttaggtcagaaggtacaactgatcacccaatccacaggctaaagggcttctcaact

SEQ ID NO: 36486 - DNA, 121 bp, Artificial Sequence
  Synthesized
  misc_feature (61): n=t or c
gatctggggaatgtaatcaacagctgcaggtaaatatataatataactgcaaaatgcattncttcatatttattacaactttcacatctacatcaggcagttttcattccacagattgagc

SEQ ID NO: 36487 - DNA, 121 bp, Artificial Sequence
  Synthesized
  misc_feature (61): n=t or c
cttgacttcagcatcagccctacatccaagcagggacaagttctcaactgtgcactctgtnttgtgggacagaggactgcggagagacactggttcacttttgctgcaaggaatgtaaatg

SEQ ID NO: 36488 - DNA, 121 bp, Artificial Sequence
  Synthesized
  misc_feature (61): n=t or c
tggcggtggatacggtgggtggggtgggtcccaaggtcgagaccaccgccggggactgaanggagggataacacccctgaactccatctcgccattaaagaagaattttgccagtaatcat

SEQ ID NO: 36489 - DNA, 121 bp, Artificial Sequence
  Synthesized
  misc_feature (61): n=t or c
ttaacatgtggagctgcggtagtggggatgagtcacttctctgcaggtgatggtttctgtncattagccatgggcagactcccgtgtccaagccagccaagcctggctaaaatgagagcta

SEQ ID NO: 36490 - DNA, 121 bp, Artificial Sequence
  Synthesized
  misc_feature (61): n=a or g
tcattggtcagtgcagctttcagattttactatgggatctccaaaaaaccctgtccagagntaagcccaccatccgactcaagcctttgtctaaaacccaacttcactcctgtcatggaga

SEQ ID NO: 36491 - DNA, 121 bp, Artificial Sequence
  Synthesized
  misc_feature (61): n=a or g
gatgcatctgtttttaccaaacttcattagaggccatgttttgccagacacaaatcatacntgcaccctctacttaatgctatattttttgctgcagatgacagcgtctatctgcactgga

SEQ ID NO: 36492 - DNA, 121 bp, Artificial Sequence
  Synthesized
  misc_feature (61): n=t or g
agagttacatctaattgatgaaaacagtgtaatgttcgtagatacagaggctgtacctctnttgttctgttccagtattctgggaaattctcagctgccttgcaaaagtgtttgtgagcat

SEQ ID NO: 36493 - DNA, 121 bp, Artificial Sequence
  Synthesized
  misc_feature (61): n=t or c
atcataaatatgtctatattgatatatgtagatagaagtatagataggtaaatatatatanttatatattaccttaaaggatccagttacaagcatggatgccctcttgtggtttagaatg

SEQ ID NO: 36494 - DNA, 121 bp, Artificial Sequence
  Synthesized
  misc_feature (61): n=a or c
aaggagagaggaggaggagatgggggacgttatttgtggaggaaatatgctggcgggaggngtgcgggactccgggtctctcaggcgctatttttcccttctcgcctccgtgcagaacagg

SEQ ID NO: 36495 - DNA, 121 bp, Artificial Sequence
  Synthesized
  misc_feature (61): n=a or g
gaagggaaccacaggcactccatgctaacccgatgtaagcggtgttccgtcatcacctagnaacaaaaagaacgttccctgatgtcagaacctcagctacaagagttaaacactggtccaa

SEQ ID NO: 36496 - DNA, 121 bp, Artificial Sequence
  Synthesized
  misc_feature (61): n=a or g
aggagtgttatttgatcaaaagaaagtagagggtgctctacacccattgtacaactccaanttgtgcaaaggtatcttttacatccagctaagcaagctttgctaaagaaaacaataggaa

SEQ ID NO: 36497 - DNA, 121 bp, Artificial Sequence
  Synthesized
  misc_feature (61): n=c or g
aagtttctccgctgctccaaaggtgacctttggggaagtttccacactttcactccgagcngctcaaggactccatttgaagctccttggctgccagctctctccaaagctcaacctgtgt

SEQ ID NO: 36498 - DNA, 121 bp, Artificial Sequence
  Synthesized
  misc_feature (61): n=t or c
gcaggtccatggtcattaaaattttatcatttaaaccctgccgtctgcaccgaggaggaantgagagccttggcagaggatgatcacatacttcatcagaatcttctgaaagggaaaaaac

SEQ ID NO: 36499 - DNA, 121 bp, Artificial Sequence
  Synthesized
  misc_feature (61): n=a or g
cctaaggatgtgtttaaagtagctcaactaatgcttgataaagcccatcttcctgaagtgngctctttttgctttggtttggaggcagggctcgatttgtgacttaacatgttatctcctt

SEQ ID NO: 36500 - DNA, 121 bp, Artificial Sequence
  Synthesized
  misc_feature (61): n=a or g
gtttatagctttgccataaaaatacaccttgggttgagtcttggcacaaagccatttggcngcttctaacaccatattaattcagaacatccagacaacgtttttaaagaccagtatctga

SEQ ID NO: 36501 - DNA, 121 bp, Artificial Sequence
  Synthesized
  misc_feature (61): n=a or g
actgtgcacatgcgcatccagggcttgcctgtgcaaatgtcagttatcagagaaatgtcangctacggttaatttaatatcagtgccccttaggcttgagcagatggccaaagttcagcaa

SEQ ID NO: 36502 - DNA, 121 bp, Artificial Sequence
  Synthesized
  misc_feature (61): n=t or c
ctatctcttatgactcctagttctttttcattagaaccagtcatagaatatatggctttgncattaagatgcattctaaacctccacattagactggttacatcaatatattgcccacttt

SEQ ID NO: 36503 - DNA, 121 bp, Artificial Sequence
  Synthesized
  misc_feature (61): n=a or t
aggacacagaagataaattttggatttggaactatcagtaccatacagagtacttttctgnccagctaaaccgaaaagaggaaaaggagtcaagcggaactgtaaatctaatctcacagtt

SEQ ID NO: 36504 - DNA, 121 bp, Artificial Sequence
  Synthesized
  misc_feature (61): n=t or c
catgctcttacatgctttaaagccggcttggagacagggtggcattgcaatagcaagaaanactgagcgatcccatcttgctcatccccaaactgcacagcgccgtacctctgagggctta

SEQ ID NO: 36505 - DNA, 121 bp, Artificial Sequence
  Synthesized
  misc_feature (61): n=c or g
gttacggcattccctgtcctctgccaggaactgagctcaacgatatgtatggatgtcacanagcaaggaggcccagtgtggcctcctgcatcccaaagagatgcagacactcacacctatg

SEQ ID NO: 36506 - DNA, 121 bp, Artificial Sequence
  Synthesized
  misc_feature (61): n=a or g
ctgtagttcacttcttaaataaatcttaactatttttacaatcaccaaaggactttgccangtggaaaaactagttcattttatttggcaataataaccacataagtgttctgaactaacc

SEQ ID NO: 36507 - DNA, 121 bp, Artificial Sequence
  Synthesized
  misc_feature (61): n=c or g
gatatttcactccatttgaggtgtctgtttacacagcgtggtgtaacatctccaggttagnccaggcactgcttctaaccaagagctggccttttgtaattgcatccagtaatagaaggca

SEQ ID NO: 36508 - DNA, 121 bp, Artificial Sequence
  Synthesized
  misc_feature (61): n=t or c
gtcttatcttcacttggtaagtgaccaaaatccttctgtttttatacgtatattgactttnctcactttagtacgtggtgataaaataggcattgtggaaatcatgtgttgaaataaaaag

SEQ ID NO: 36509 - DNA, 121 bp, Artificial Sequence
  Synthesized
  misc_feature (61): n=t or c
ggcagagccagatgaaggtaggtgggggtggatattgctttctgctgaaatatttgtggcngggcatctccatacttgcaggttatttaggtttttttttgttttttttttttaagatgct

SEQ ID NO: 36510 - DNA, 121 bp, Artificial Sequence
  Synthesized
  misc_feature (61): n=a or g
attcttgtggtcattcttaatttgctatccacatgttcataaccttcattgaaaaaggatntcacggagtatctactttccttaaaggccagtttgttatttaaaaaataactaattaagt

SEQ ID NO: 36511 - DNA, 121 bp, Artificial Sequence
  Synthesized
  misc_feature (61): n=a or g
ttgaattctttttcccagccacactccaaatattttgggctagaaaacgagagctgcgtgntgcgcgaccaaaacacgcgcgctgccatcgccaacagcagcccaaggaatcggccccggg

SEQ ID NO: 36512 - DNA, 121 bp, Artificial Sequence
  Synthesized
  misc_feature (61): n=a or g
atgctcagatccaggttctgtaccgtgacaattccaagcatgcagcccataaagatgacgnctctgcctggcaggagctgtacagccggatcacagccagcctccccggcctgcgtttggg

SEQ ID NO: 36513 - DNA, 121 bp, Artificial Sequence
  Synthesized
  misc_feature (61): n=t or c
gacagacaacttccataagaacatacaacttttttttttaagatggcagacaaaacacatngatttcttacctattcttgttgaactgaatggcaaagtcagtcatgtgctgcaaagcctt

SEQ ID NO: 36514 - DNA, 121 bp, Artificial Sequence
  Synthesized
  misc_feature (61): n=a or g
gcatccacctgaactttctctgatttctgcctctatgtgaaaacacataactcttcagacnaagtactgagtacacacaattccctcactaatatgcacctgtctcacaaatgaaatgcaa

SEQ ID NO: 36515 - DNA, 121 bp, Artificial Sequence
  Synthesized
  misc_feature (61): n=a or t
aaagtgcagtgtgaatgcataacctttattttcattggtcttttaatgcttcgatttatcntctacagcttcctatgtaattcagattgactttcaattaccaattaagggagcaatcgtt

SEQ ID NO: 36516 - DNA, 121 bp, Artificial Sequence
  Synthesized
  misc_feature (61): n=a or g
ctttctttctctccctccctccgcagaggaatgggcaagacctttgcattcaaagggaggntggctctgtgaggtcttactgagggtggaaatcactttagcagagatgatgtttctttgt

SEQ ID NO: 36517 - DNA, 121 bp, Artificial Sequence
  Synthesized
  misc_feature (61): n=t or c
tggttgttttttttttaatacataaatgcttttatttttaataggcacactggaaatagangtatttcaggagcatgaaatgttcactgctgagcagcataaatagcagctgctgttgcaa

SEQ ID NO: 36518 - DNA, 121 bp, Artificial Sequence
  Synthesized
  misc_feature (61): n=a or c
ctgccgaaagagcagggagctgtatgacagttgtttatctactggtagatgtatttggaantgagcgctctcgttcttcctgctcattctttttagtgcaccttcctctgttttgcctcct

SEQ ID NO: 36519 - DNA, 121 bp, Artificial Sequence
  Synthesized
  misc_feature (61): n=t or c
ccaggagagcctctgtctgttcaccaagtggctgagaaggaaggttttatccttgtgtggngaatcccatcccagaagagcaggatgaaggcaggggctggaacacatcctgtagggtgaa

SEQ ID NO: 36520 - DNA, 121 bp, Artificial Sequence
  Synthesized
  misc_feature (61): n=a or t
atggttgtggtacctagtgtacgtgctctatgtgaagatctttgtccttcttttgaacccngcctcgagacagctaaaactacaactgcaatctcactcaaaacaaaagccatttgttaag

SEQ ID NO: 36521 - DNA, 121 bp, Artificial Sequence
  Synthesized
  misc_feature (61): n=t or g
gcccttgaattctgacagggagaaacacgcatgcttccactgggcttgaaatcttcaagcnccaggattcctagtcctacgatttctctctggtttttcctttcatatggaaatattcaag

SEQ ID NO: 36522 - DNA, 121 bp, Artificial Sequence
  Synthesized
  misc_feature (61): n=a or g
ttctccctgcctttctgttttatagaaggtaaactgtagcactcacagcacttgtgcttantgagaactctagtgagggtctctaggcagaatgtcttatggcagtcagacatccttattg

SEQ ID NO: 36523 - DNA, 121 bp, Artificial Sequence
  Synthesized
  misc_feature (61): n=a or t
ttgttacatagaggtacttacattgtacatctcctgccttcccttcatgttttgctcttanacaccagaggtggatcaaaggtcgggatgcttctcctttacagcccttgtgctgtccctc

SEQ ID NO: 36524 - DNA, 121 bp, Artificial Sequence
  Synthesized
  misc_feature (61): n=a or g
tcaatcacaaagttgaggccaaaggatcaggatggatttcagctgtgtttctgcatatccntggctcatggaatgctgcactcagttgttacctcttgctggttcacctgccctgaaactg

SEQ ID NO: 36525 - DNA, 121 bp, Artificial Sequence
  Synthesized
  misc_feature (61): n=a or g
tggcaatgatgtgtagtaacatacatacggaacgcacaaaaatttcgtacagagtgtacanaaatagagtgggcctacacagatgcctgatatcagtaggaaaatttgtcgtctggatgca

SEQ ID NO: 36526 - DNA, 121 bp, Artificial Sequence
  Synthesized
  misc_feature (61): n=t or c
ttttgccaatgtcttcattattaaatagtattttcatacctgaatttaagaaaaaaagttnatagttgacttattctcagactgtatttttattggatttttgcttaccagatatttgtat

SEQ ID NO: 36527 - DNA, 121 bp, Artificial Sequence
  Synthesized
  misc_feature (61): n=t or g
ggctaaattttcttctgtctaagggaaacaaaactacttcagaatctcttaaaattgttgnaacacctcggttgtatattaacaagcataaattgaagctaatgctatattctgttttaca

SEQ ID NO: 36528 - DNA, 121 bp, Artificial Sequence
  Synthesized
  misc_feature (61): n=t or c
cccaaacaaaaaagacaagcacaacaaagaacgcaacccttaaccttgtcaaaattgaaanatcattgtagatgggtgacacaactatgaatcaactcaaatttttgcaacatcagtgtaa

SEQ ID NO: 36529 - DNA, 121 bp, Artificial Sequence
  Synthesized
  misc_feature (61): n=t or c
ggacaaatgcttctctttatcacgctcagtccagtgaggtcaaccattacgtggagcttangcatccagccaccgcctctgctatgacacacagtcatttttttgcatgctggtggcaaaa

SEQ ID NO: 36530 - DNA, 121 bp, Artificial Sequence
  Synthesized
  misc_feature (61): n=a or g
gtgtgaaaccaccgtaacatatcaaggaaactgcttttccattggtttgaatgcagttgtngtgaaacaaatgcacagtggtatcgagagtggtgtgtttcagattagcgtctgaagaacc

SEQ ID NO: 36531 - DNA, 121 bp, Artificial Sequence
  Synthesized
  misc_feature (61): n=a or g
tcataggggtgagacagtagcttgatgcatctgtgcagggacaaaaggactctgcttccanagctgtcatgttggcaccttttgctaacataacattcacaggtaaaggtaatgcatgggg

SEQ ID NO: 36532 - DNA, 121 bp, Artificial Sequence
  Synthesized
  misc_feature (61): n=a or g
attccctccctgcctggccgtccctttcactacagggatcaaggccttaacttcagcaggnaaaaaaccccatagaattctacatattagctgatggtggttttgtttgtcctacacagca

SEQ ID NO: 36533 - DNA, 121 bp, Artificial Sequence
  Synthesized
  misc_feature (61): n=c or g
atggttcccctgcacatggaacacagcagcaccaacagagtagcccagtaacagacccctnagcttcagaaacgttatgctaaaggaggctgagatcagatggttggccctgtgcttccag

SEQ ID NO: 36534 - DNA, 121 bp, Artificial Sequence
  Synthesized
  misc_feature (61): n=a or g
tattatagatatagatatagatatagatacagatatagatatatacttattatacttagcnttatacttacagcttttcttctttgttttcctgaggtctgaatggaagagattttttgtt

SEQ ID NO: 36535 - DNA, 121 bp, Artificial Sequence
  Synthesized
  misc_feature (61): n=t or c
tgaggctatggctatcagaaagcatttagttagctcccaagccaatattttttgtatctgntttattatgaaaccataacatattttcaataacttgtagctttgctatacagggaaggaa

SEQ ID NO: 36536 - DNA, 121 bp, Artificial Sequence
  Synthesized
  misc_feature (61): n=a or g
atactgtatgtttcctacctgtgcaaaaattctaggggtatcttttacttattttatgctntgccctcacactactttcatttcctggaaagagggcatagttttcagtagtgcaggaaaa

SEQ ID NO: 36537 - DNA, 121 bp, Artificial Sequence
  Synthesized
  misc_feature (61): n=t or c
gcagagcgaggatgtaggacaatgtccccatgcctatcacctgtgatagtgtcagagcagncagccccagccacagagaccccaccgggacggcaccagctgggacaccggtgccatgatg

SEQ ID NO: 36538 - DNA, 121 bp, Artificial Sequence
  Synthesized
  misc_feature (61): n=t or c
cacagagcagtcctttggagatggccaaaagccaccgggacacacgttgggcagccctcantgagcagggcttggaaacggcaacctccagacaacccttcagcctcagctctctgccatc

SEQ ID NO: 36539 - DNA, 121 bp, Artificial Sequence
  Synthesized
  misc_feature (61): n=t or g
acttgaaacttctagactaaataactcctgtaatctatctgcgagatttgttttgttatanggttgtttttccaagaaaactcttgaccataattggtaccaagttgtgggtttggcaggt

SEQ ID NO: 36540 - DNA, 121 bp, Artificial Sequence
  Synthesized
  misc_feature (61): n=a or g
tatggaacgagtggcatcagcttccacctcgtgaaactgaggctcacggttatttacaagnctactgccatcagaaagggaagagcatgcaaagcctgacccttaactccatgtgcttcca

SEQ ID NO: 36541 - DNA, 121 bp, Artificial Sequence
  Synthesized
  misc_feature (61): n=t or c
agcagaagatttactttaccaccctttaaagttgtaggttcccggcttctaaaacaaaaangacaggaatttttaatcactgagtgtgtgttttgtgaattgaaggggggcattgaaagac

SEQ ID NO: 36542 - DNA, 121 bp, Artificial Sequence
  Synthesized
  misc_feature (61): n=t or c
gcaaaaagatctacactgtatgcctacattaactacattacacagcccactacaattttgntgccaagcagcagctaaagccagcagatacagcagaatgatcttctcaggctctcatact

SEQ ID NO: 36543 - DNA, 121 bp, Artificial Sequence
  Synthesized
  misc_feature (61): n=t or c
gctgaataagaggagtgcaagttgaggaactcctccctgctcctcgatgttatatggattngaagactggttaaattcaagcaagctaacaccctttcccccacctccgagtatatcatac

SEQ ID NO: 36544 - DNA, 121 bp, Artificial Sequence
  Synthesized
  misc_feature (61): n=t or c
tctcattgcctgcttttctttttcctatttttccccccaatatttaatcccatgttaaatncttcttcaatctctcaacattttgcaagtctctctattttcttcttcttcttcttttttt

SEQ ID NO: 36545 - DNA, 121 bp, Artificial Sequence
  Synthesized
  misc_feature (61): n=a or g
cagaaagattattctgaaacctgctcatcctggagaagagtagatgagaaggatcttagcngctcttataaatcattaaatggtgggagtcaagtggatggggccaggctcttctcattaa

SEQ ID NO: 36546 - DNA, 121 bp, Artificial Sequence
  Synthesized
  misc_feature (61): n=t or c
ggaaacaaacacaaataccgagcagcaaagttcggctagggctggctggagtatgcaagcngagcaaaagctcctgctagcacttgttccagctttcgtgcgaagccccctgctcattaaa

SEQ ID NO: 36547 - DNA, 121 bp, Artificial Sequence
  Synthesized
  misc_feature (61): n=c or g
cctactaagacacaaggatgtttaaaagtgtgatttgtttggaaatcctactcttttatgntgagcaagaatctatgcattcaaatgttaacataatgagagagggaggaaaaagtttcat

SEQ ID NO: 36548 - DNA, 121 bp, Artificial Sequence
  Synthesized
  misc_feature (61): n=a or g
cttccaacacctacttcactgtcccaaccaagtttcctctcatcacctcaatggatgctgnagacttctccaactgcaccccagctgcggaggccttggtaagtagccacctggaaaacaa

SEQ ID NO: 36549 - DNA, 121 bp, Artificial Sequence
  Synthesized
  misc_feature (61): n=a or c
taagggataggcatagtatttgtaatagcatgcaatatttttcaccctattccctcatatngtacctcaaaaatggggactaattgccacattaaaaaggcgcgttgtcaggtcacgtttt

SEQ ID NO: 36550 - DNA, 121 bp, Artificial Sequence
  Synthesized
  misc_feature (61): n=t or c
atgaaaccagtaaaaagtctggtaattatttacattacattctccagattatagctactgnatgttattttctttccaagcacgaaggactataaggagcacatgacatgaagaaagggaa

SEQ ID NO: 36551 - DNA, 121 bp, Artificial Sequence
  Synthesized
  misc_feature (61): n=t or c
aaaacaaactcctaaaaagtttctggagacacaacatattttaagacaccgctttgtctgnctacagcttgaggttacgcacatttaattcctcaacatgctgatgattttacaaaacctc

SEQ ID NO: 36552 - DNA, 121 bp, Artificial Sequence
  Synthesized
  misc_feature (61): n=c or g
atagataaagatataaattctaagcttccctgtccatcacaaagagcatacttgttaccanttaattctgcaaattactggaggaatatatacataaatacacaagtaaataaataaatca

SEQ ID NO: 36553 - DNA, 121 bp, Artificial Sequence
  Synthesized
  misc_feature (61): n=a or g
agattttgcatcagattttcttgtctcgttgctcattctccctcctgagcagcaagaaacnctgcagaggttgtgtgcagatcaaactggctcctgacttggtttctttcatgatgctgaa

SEQ ID NO: 36554 - DNA, 121 bp, Artificial Sequence
  Synthesized
  misc_feature (61): n=a or g
ggccctgaccacagactgaagaagtgaaaaaacacttccatagatgctgtttgtgaccacncagggttattagctgtgctaatacatttaaaaaaataatacattttactgacagcccttt

SEQ ID NO: 36555 - DNA, 121 bp, Artificial Sequence
  Synthesized
  misc_feature (61): n=t or g
gacctgaatactggtggtgctccttgtttgtccaggaaattaagctgcagtacaaattcanagcacctgttttgattccagttccagcaacttggggtttctgcggaaagaataacactct

SEQ ID NO: 36556 - DNA, 121 bp, Artificial Sequence
  Synthesized
  misc_feature (61): n=a or g
tggtggcacaatctgcactccagagaaacaccccagtaaggtgtgtgatggttttgaagtnttttcaaatttatctgtatctaaagcaaggaagctgctatcttcccttgtcttcctgaga

SEQ ID NO: 36557 - DNA, 121 bp, Artificial Sequence
  Synthesized
  misc_feature (61): n=t or c
aaatggatccacaataaacccaggagctagaaaataatgcacccaagagatgaggttatgngtagccagtgttgccagaactgaaaactctgctgatctaacaacatgaaattcaaaatac

SEQ ID NO: 36558 - DNA, 121 bp, Artificial Sequence
  Synthesized
  misc_feature (61): n=t or c
ccttccctgccgctgtcatctgctcgcttccccctaagctgcttttccaggtcaggtgganggcagcgatatttctgctgctgtttccgagcaggaggtgctctctgcctgtgagctgatt

SEQ ID NO: 36559 - DNA, 121 bp, Artificial Sequence
  Synthesized
  misc_feature (61): n=t or c
aatgctcctcttttgaacccaggctgtaacagggacaaacaatcaggagttttcccaccanaccccagccatccaggcactactggatgttcagcttttcagttaatcacaaggtccggtt

SEQ ID NO: 36560 - DNA, 121 bp, Artificial Sequence
  Synthesized
  misc_feature (61): n=a or g
ggcaggtttactcaaatagggtaaatgcccactggcactgagttgtagatgtgcagggctntatgcctgtgatcaatctgttgatgggtttccgtctttggaacccatcgttgcatgaaag

SEQ ID NO: 36561 - DNA, 121 bp, Artificial Sequence
  Synthesized
  misc_feature (61): n=a or g
gaggcatcctcgctgtagagagagagcacatttactaggtggtcttctcctgttccttaanatcagtaacagggaatctaaagaaaatagttcttcagattacattcaagtccctagagaa

SEQ ID NO: 36562 - DNA, 121 bp, Artificial Sequence
  Synthesized
  misc_feature (61): n=a or g
tacacccagcagaggtaaacagattaatgtcctttcttttaaacagttcagactgtactcntttcataagcttataaaaaaaatgctgaactatgaaagctgtcgggacagagctttaata

SEQ ID NO: 36563 - DNA, 121 bp, Artificial Sequence
  Synthesized
  misc_feature (61): n=a or g
tccagtttattaacagaagatgaagatcatatggctacagagtatgagacagatcttttcnttgacttttgatgatcttcagatgccaaggaagactaggaagcatgttttagtttacaag

SEQ ID NO: 36564 - DNA, 121 bp, Artificial Sequence
  Synthesized
  misc_feature (61): n=a or g
aatccagaaatgtcttaccttgtgccagcttttgtagctttctgagaaattcttttatcanaggacatcccttcctgacagtcaggatgatttttgtatctgaaaggggggatgtatgcat

SEQ ID NO: 36565 - DNA, 121 bp, Artificial Sequence
  Synthesized
  misc_feature (61): n=a or g
gtctgctctcatttttgaagcagctacaaagacttccacacgaaaaaaaaaccaagagganaaaaaagcacaattcatatggctgtccccgtgaaaactcccactggcatcgagtggcaag

SEQ ID NO: 36566 - DNA, 121 bp, Artificial Sequence
  Synthesized
  misc_feature (61): n=t or c
ccagtacagccaacagcccgatgtcttccttgctaagcttactggatttcattttcctgangtaaggcacagacacatgttgtcttctgccacttcagggagtacctgaccctcacatgct

SEQ ID NO: 36567 - DNA, 121 bp, Artificial Sequence
  Synthesized
  misc_feature (61): n=c or g
ggttccatgtgcgttaggagcagtccatggcttaggagcactccgtatgtgctggtgaggntcacacaggctacaatttgcattctgaaaccttgcagccatgcaatgcattcccaaggct

SEQ ID NO: 36568 - DNA, 121 bp, Artificial Sequence
  Synthesized
  misc_feature (61): n=t or c
gggtttgaacaggaagacaaagctctgttagtccccttgtagaaaagaagcaacagaaagnaaggatgaatccccagaaacagacagaatttcacccaagagggagagcacaaagcaaacc

SEQ ID NO: 36569 - DNA, 121 bp, Artificial Sequence
  Synthesized
  misc_feature (61): n=c or g
tggtcccaaaagatgtaaggatgggcctgtgggctttagggatggtcccatgggatgcaangatgttcccatgggtcgtagagataatcccaagggatgatcccaagggatgcaggaatgg

SEQ ID NO: 36570 - DNA, 121 bp, Artificial Sequence
  Synthesized
  misc_feature (61): n=a or t
ttcctccttgtcctgttgctatcagatcatgcaaaaaggcagtctcccttctgcacatttntttattttcattttttagcatcttttgtgattcccatctaacagagcagtgcccaccctc

SEQ ID NO: 36571 - DNA, 121 bp, Artificial Sequence
  Synthesized
  misc_feature (61): n=a or c
tgcacagatagggaaaacgtgattgattgtaagaaatggtgcttcaccaataatttccgcncaggatcttgtgtctttttctgttggtttgtttttttgtttacttgcttgtctatacttt

SEQ ID NO: 36572 - DNA, 121 bp, Artificial Sequence
  Synthesized
  misc_feature (61): n=a or t
ttctatagagcacattttctctaattattgactattttattccctgcttgcaaaggtctanttttcaggaaaatttcagaaaaattatatgttgactgtccagcatccttgcccttaagga

SEQ ID NO: 36573 - DNA, 121 bp, Artificial Sequence
  Synthesized
  misc_feature (61): n=t or c
tgcaaagccagtacctagtcacagctccagtcctctgcatcatcctccccagccattcttnctcctgacaagaacgtgttttgaaggagtattgtgtagtcctttcagtaggaaaagtagc

SEQ ID NO: 36574 - DNA, 121 bp, Artificial Sequence
  Synthesized
  misc_feature (61): n=t or c
cactgaatttgggttatattgtcttccagaggaagggaacctactgcagtaactcacttantggttttttgaaaccaggggaagatagttgtgctagttactgtcagctttttcctaagtc

SEQ ID NO: 36575 - DNA, 121 bp, Artificial Sequence
  Synthesized
  misc_feature (61): n=t or c
aggtggcaagagagccacaggtgtgcaagcaagcagattagggtttggcttttcacatctnctgctagtgaaatgccacgaaatagactgggattgtatcacagagcctgtgcaagtctga

SEQ ID NO: 36576 - DNA, 121 bp, Artificial Sequence
  Synthesized
  misc_feature (61): n=t or c
ctgccttctccatccagctcagccacctacatctcaaagcaggcacaaggatgagaccctnccttgtgcaccctgtggtcttccagctatagccaccatccagtgccatcagctgtgtctc

SEQ ID NO: 36577 - DNA, 121 bp, Artificial Sequence
  Synthesized
  misc_feature (61): n=a or c
gcaagccctgaaaggagagtggtggagtgattggagggaagacccctcagatcaaaaccanaggcaagaactactgcttacttgtaaaatttttatttgctttatagattttcgtataata

SEQ ID NO: 36578 - DNA, 121 bp, Artificial Sequence
  Synthesized
  misc_feature (61): n=a or g
tttataatgtctttctaaacatatggatgtttttaaagatttctccttaaggacccatctntatgaattattcccattgcacaagacatttcgtaaaccttcttgaatcactggattcatc

SEQ ID NO: 36579 - DNA, 121 bp, Artificial Sequence
  Synthesized
  misc_feature (61): n=a or g
tcataccatgatctttctgattttagtaattttgactagttaaacttcaacaattggtacncctctttgttctctagagattggaatattctgcaagttttcttttattatctcattagtg

SEQ ID NO: 36580 - DNA, 121 bp, Artificial Sequence
  Synthesized
  misc_feature (61): n=a or c
ttgttagatatttgtctccatgcatcctccacattatttttagaaagcaaaatggggattnatttcacgataacatcagaaaggttgaaaaaacaaagttgcaaccaaataactgagagac

SEQ ID NO: 36581 - DNA, 121 bp, Artificial Sequence
  Synthesized
  misc_feature (61): n=a or g
atgatccttggggtcccttccaacccaggccattctgtgatcctgcgattctgtgattgcntcatgtatttcatacatctttatggagtacaccacagaaaatattgttcctttccctgag

SEQ ID NO: 36582 - DNA, 121 bp, Artificial Sequence
  Synthesized
  misc_feature (61): n=t or c
tgagacattttaaactctgttcaaaaatatttgtgtatccaccaccttctgctgagcttgnggcagaatttaatgttctgacacttggtgcagtcagagggggaaaagcccctctttttga

SEQ ID NO: 36583 - DNA, 121 bp, Artificial Sequence
  Synthesized
  misc_feature (61): n=a or g
tccgtgtcgctcacgatgggttaaatgcttctgtgctgggtgctgcccatcaccctggganggttgtatgaacaaagacagccccacgggtgccctttggtctgagggaagcacttgggga

SEQ ID NO: 36584 - DNA, 121 bp, Artificial Sequence
  Synthesized
  misc_feature (61): n=c or g
tttcagtacccagatgacacacgctttttaaaaaatactttgcattatatccaaggccaangtaatataatgtaaaggtcccttctttccggacaatcataaatggttcgattcagaggtg

SEQ ID NO: 36585 - DNA, 121 bp, Artificial Sequence
  Synthesized
  misc_feature (61): n=t or c
cacagggctttaccaaaggggtgaataaagactgggttctgggcaggggtaattcagtaangtctggcaaattctggagagaatttgacaaaaatgtgctttgttttagaagtgaaggaag

SEQ ID NO: 36586 - DNA, 121 bp, Artificial Sequence
  Synthesized
  misc_feature (61): n=a or g
taatgaggagagtccccgggcgagcggccgatggatgctgggaggtgacaccatgggaacngggacatggacacgtgctgattatttccccctctgctgctgtgggactgggctgtcccag

SEQ ID NO: 36587 - DNA, 121 bp, Artificial Sequence
  Synthesized
  misc_feature (61): n=a or c
tctcattttaccacattaacatgaagtttcccatgactatattggtactttgtaaactagntaaagttggaaaacgtttgccccagatctcacagactgtgtattaaaatgaataaggcaa

SEQ ID NO: 36588 - DNA, 121 bp, Artificial Sequence
  Synthesized
  misc_feature (61): n=t or c
ctttgacggttgaatcttttaaaaatgcactccttgtttctaggggctcaagaaaacttancttttatgtagacaaataaagagacatagtgagatgaacaaattcatacagacaacgcct

SEQ ID NO: 36589 - DNA, 121 bp, Artificial Sequence
  Synthesized
  misc_feature (61): n=t or c
gagtggttctgtgtttgaaatatggatccctctcactgaggattgggcagaggtgatgttncttacagtccattgggtgttttttgcaaggcacaagcacccagtgcttgtgacgggtttg

SEQ ID NO: 36590 - DNA, 121 bp, Artificial Sequence
  Synthesized
  misc_feature (61): n=a or c
tttcctcaccacaaagtttctaggaaccactttctgaaacctatgttccctgtgatatagntagtactgcctctaaaatcactatgtattcaataaatagaccataacagtacaagcacca

SEQ ID NO: 36591 - DNA, 121 bp, Artificial Sequence
  Synthesized
  misc_feature (61): n=a or g
caatcctgaagtttatctatctgggttccctgaaaggatccccattatctacagagctctncataaatctgacaagattggcatgttttagcatggccaaaagtttcacgttctttcatac

SEQ ID NO: 36592 - DNA, 121 bp, Artificial Sequence
  Synthesized
  misc_feature (61): n=c or g
tacaccatgacaactgctttttcaggctaactctctgcctcctctttgttttggcttctgnttgaaagtgaattgcaaataacaaggcaggcagtctatcttgccagatagccttaactaa

SEQ ID NO: 36593 - DNA, 121 bp, Artificial Sequence
  Synthesized
  misc_feature (61): n=t or c
catttactccaacaatagagtcggaccatacctgcgtattacttacaaccattatccaaanaataaagcaattggcctacaagcctggcaaaccagtgctttgtaagtgaaactgcaaaca

SEQ ID NO: 36594 - DNA, 121 bp, Artificial Sequence
  Synthesized
  misc_feature (61): n=a or g
atccatgtaggctcaggtcagtccttccttcctcttctctgctgtatgacatatggtgcantagcacatcaaatagggcgcacattgtgggtgcactagaaactacttctgtatagatgct

SEQ ID NO: 36595 - DNA, 121 bp, Artificial Sequence
  Synthesized
  misc_feature (61): n=t or c
cctcttctttaaaccagggaaagaaaggagtacgatcccatttcctccaaaataaacaaantgttgcatggccctttgcaggcattaacggctcagtttatcaacaaagaaaggaccctct

SEQ ID NO: 36596 - DNA, 121 bp, Artificial Sequence
  Synthesized
  misc_feature (61): n=a or g
ggtctctactgaagagagcttagaaaggtagctgccgtgtagccacttagggcttgattcngttgccaaaatgtcaatacttcgtgtgatctgaaatgccctagggcacctgagacagctg

SEQ ID NO: 36597 - DNA, 121 bp, Artificial Sequence
  Synthesized
  misc_feature (61): n=t or c
aactctctgacagagcatgtttttaaagccctggagaaattcctgatcttaattttctttntaatgaaaaatattaagtttggggacagctgctgtccctgtgaccaacgcattctgagag

SEQ ID NO: 36598 - DNA, 121 bp, Artificial Sequence
  Synthesized
  misc_feature (61): n=t or c
aaagcacaactcagctgcacatcacagtaaatggcatgctgactaacagaaagatgaaatncttccttcatcagtacaaaagctaaagtaatctgtagaaattaatttatattgctatcca

SEQ ID NO: 36599 - DNA, 121 bp, Artificial Sequence
  Synthesized
  misc_feature (61): n=c or g
aaggggaattaaaggactaccatttgcccagatctttccaacctgcaaagcaaggcatttnaaagcatgaggtgtttcaattcaaatgaatcggtgcagcatctaaaaagatgcaaagaga

SEQ ID NO: 36600 - DNA, 121 bp, Artificial Sequence
  Synthesized
  misc_feature (61): n=a or c
ctgcaaggccgccaggttggctcactgctccctcgcatcttttctcattgggatgtatttntggtctccagccccatgctgcaggttggtgcaaaggacccgcagccacactggcgcagtg

SEQ ID NO: 36601 - DNA, 121 bp, Artificial Sequence
  Synthesized
  misc_feature (61): n=a or g
taaacccgctccaaacgcatatgagttttttatatagctctatgtgatctgcaaaatgtcncttcaatggtagccagggatataatttgtacttcccatgagaaaactgaaacaaagttaa

SEQ ID NO: 36602 - DNA, 121 bp, Artificial Sequence
  Synthesized
  misc_feature (61): n=t or g
tactcattaggtgtggttacatcaggctggtggccggtcaggtgttggatttctctgagcnggattttgggactgttctcttccatgttttgataaatgatctgaatgcaggactcaaatg

SEQ ID NO: 36603 - DNA, 121 bp, Artificial Sequence
  Synthesized
  misc_feature (61): n=t or g
gaagtcagagctaggggagcaggctaggcagccctgctcctcccactggctctgcttcatnctcttgcatgctctcaaaagcctgagcaattacagggtgcagcacctctacagctcactg

SEQ ID NO: 36604 - DNA, 121 bp, Artificial Sequence
  Synthesized
  misc_feature (61): n=c or g
accactggttaagtttgtttgtgttaaaactgttactactttgatttcatgtttttattantctgctcatctgtaggagattcatttatatgtgaacttcacttgcatgttcgggcttcat

SEQ ID NO: 36605 - DNA, 121 bp, Artificial Sequence
  Synthesized
  misc_feature (61): n=a or c
ctggatgactctcattacgccttggtggatcgtgtcatcgcgcagctcaccaacagcatcncagggcagctgcccaggtacgttgtgtgtctgtgtcatcatgcactgagcaccaccggtc

SEQ ID NO: 36606 - DNA, 121 bp, Artificial Sequence
  Synthesized
  misc_feature (61): n=t or g
aacaggttgtagcactgtgtttgctttggtgagggctgcactggggagaaaatgcagaganctcctgctcacaggtgatggtctgtcaggtgagtacagccccagatgtttgaggtacaca

SEQ ID NO: 36607 - DNA, 121 bp, Artificial Sequence
  Synthesized
  misc_feature (61): n=a or g
tgctgtttccttgttcagttgttttgacctttcagacccacagccatggttcccatgagcntattccctgcttctgtgaattaaataaactttccagttctcatctgcagccagctaagta

SEQ ID NO: 36608 - DNA, 121 bp, Artificial Sequence
  Synthesized
  misc_feature (61): n=a or g
tctccatataattggggtaggctacgttatcctttcctagtctgggaaattgaggcagatnaaatgtgttttgcctcagcctgctcagtcagccagtatcagacctgggaagtaaagatta

SEQ ID NO: 36609 - DNA, 121 bp, Artificial Sequence
  Synthesized
  misc_feature (61): n=a or g
aagtctatgacactccattcattttcttgaatgaagaaatgaacaaatctacccttgaaangtttcagatgtgtccacctttcctcactgattagagaaaagaagcaaagggggaggatag

SEQ ID NO: 36610 - DNA, 121 bp, Artificial Sequence
  Synthesized
  misc_feature (61): n=a or c
gtgtcctggtgcacgctgctacctacgtgtgctgaagctgcagtttggggctgggatgagncttcctcatcatcaccagcccttctcaccattgctgcgcccctgggctatgcaggtgggg

SEQ ID NO: 36611 - DNA, 121 bp, Artificial Sequence
  Synthesized
  misc_feature (61): n=a or g
taagatattgccacagcataatttttcctttcagccatctggaacattcccaatattccangaattagtgaaaaatggctttagcatacggagagatatagaggaaagagcacatgaagca

SEQ ID NO: 36612 - DNA, 121 bp, Artificial Sequence
  Synthesized
  misc_feature (61): n=t or g
ctgggagagctgtagtgagggatactgctacagaaaggtactgtctgggttttctttcagncaaaggtgttctccttaagtagatgtaggtgttgcccctgaactgttagttgtgccttca

SEQ ID NO: 36613 - DNA, 121 bp, Artificial Sequence
  Synthesized
  misc_feature (61): n=t or c
gttgcccactgctacaccggtaatgctttggtctcttcttctaaggggttgtccatccatntctgacccaataaatatccttatttgtttaaactagagcaactcctccagatgagactag

SEQ ID NO: 36614 - DNA, 121 bp, Artificial Sequence
  Synthesized
  misc_feature (61): n=a or g
gcactccagaaacaaagaacataccagcagaaaagaacaacatcgagaaaaatgaaatcantgtttttgcttaagcaatctttcccactagctggtcccatctccaagctatcattaatat

SEQ ID NO: 36615 - DNA, 121 bp, Artificial Sequence
  Synthesized
  misc_feature (61): n=c or g
gctcagccgcagctgctgttggttacatcccaaagccctgaggtgaaaacactcctcttancaaacacgctgccctgctcatcactaagaacttctggaggatggggaatgttacagcaga

SEQ ID NO: 36616 - DNA, 121 bp, Artificial Sequence
  Synthesized
  misc_feature (61): n=t or c
gactagaccacatcattggaagcactagaaacacagctcttcgttggaactatacagatcngtattttctctagcaatacaacagcagagatggtcaacacgaaatttaaagtccaacagt

SEQ ID NO: 36617 - DNA, 121 bp, Artificial Sequence
  Synthesized
  misc_feature (61): n=a or c
tctccagaaactgctgctcttgatgagggtatgaactcatcagtgtggaaagatctagcantttttatttaaatcaggttgtataaggcaacaaccagatacagtctatgctactctcttt

SEQ ID NO: 36618 - DNA, 121 bp, Artificial Sequence
  Synthesized
  misc_feature (61): n=t or c
gaggaccagagcagttctcggaagagttgaggtcacttgaaagaaaactggatgtcactanacagctctttctcccacgggcttccaatgagcatgaaaaggaagatagaagagttgctgc

SEQ ID NO: 36619 - DNA, 121 bp, Artificial Sequence
  Synthesized
  misc_feature (61): n=a or g
aagtttcagcttgaccctcatctgtgctgctcacttcagtacttaaaagacagcttcatcnctgtcacgatgcggtgtgcggcctcatatggaagcacagatctcagcccacctgagaagg

SEQ ID NO: 36620 - DNA, 121 bp, Artificial Sequence
  Synthesized
  misc_feature (61): n=a or g
gacaatgaattcttacttttaattacagactttcaacccattaatatcagctaaaaaaaanacacctaacaaattttcctgagcattgagaaaatgctcagaaaatgttcttttcccccaa

SEQ ID NO: 36621 - DNA, 121 bp, Artificial Sequence
  Synthesized
  misc_feature (61): n=a or g
cggctttcatactgcagacctgaggttttggtctcacaaattcctgtgttgtgttgccacntcacaattccagtgtaaatagtgttactttgttgtgatacacccgcatctgtgcatctca

SEQ ID NO: 36622 - DNA, 121 bp, Artificial Sequence
  Synthesized
  misc_feature (61): n=c or g
atgctttttgatgacattttattcgctgagatgaccagacttaattgacctcaagcccaantaggatctcgtcctatattaacacttatgttctaatatccaaatttttacttcaaaatga

SEQ ID NO: 36623 - DNA, 121 bp, Artificial Sequence
  Synthesized
  misc_feature (61): n=t or g
cgttagtaatagctgaactcttcgacattaataggcaaatgctttctaaattgaccgcttncaagcagatgaggaagatttgccagttacccagaattacgctcttattggtcataatttc

SEQ ID NO: 36624 - DNA, 121 bp, Artificial Sequence
  Synthesized
  misc_feature (61): n=a or g
gagaaatagtcggaacaaactggggatttctgtcattctaaaggaaaaaagtcgtaagctngagtacattagaaaagtaagtgctgcaccagtcttatccttttttacttttaatagtgta

SEQ ID NO: 36625 - DNA, 121 bp, Artificial Sequence
  Synthesized
  misc_feature (61): n=t or c
aatatggaaaggctggaatgccactagcagccaagtttttctagcacagctgcgctgttcngagaagctcttctctctgtagtctcagcctacagccatgctcctagttgcacctggacca

SEQ ID NO: 36626 - DNA, 121 bp, Artificial Sequence
  Synthesized
  misc_feature (61): n=c or g
agcatcacaccctctctcaacgttaacctgttgtgtacaacattaatgcaaatatgaaatnagcaatttctgcgatgtttctgcacgtcggatgagtgttgtaggctccagaaattacagg

SEQ ID NO: 36627 - DNA, 121 bp, Artificial Sequence
  Synthesized
  misc_feature (61): n=t or c
tctcacaggcagtgtttcacctgctctggttttcttatttctgttcagagcaatttatttnggtttacaccaggactgttttacactgtgctttggtggaaacagcacagaaataaacctc

SEQ ID NO: 36628 - DNA, 121 bp, Artificial Sequence
  Synthesized
  misc_feature (61): n=a or g
ttaaaggaaagccagagcatgaacacaaaccctccaagcgagatgaaggacccaggtgacngagcacagaaacacaacaggaccgccacctggtcctccctctccccaccctgtaagagcc

SEQ ID NO: 36629 - DNA, 121 bp, Artificial Sequence
  Synthesized
  misc_feature (61): n=t or c
tccagagctctgctgggtttaaccttctttggctcccgtgagcgtcgcagcagagcaccangaccaccagctacctgctgcagccacaacgggagcccctgcttccccccaaatcaaccaa

SEQ ID NO: 36630 - DNA, 121 bp, Artificial Sequence
  Synthesized
  misc_feature (61): n=t or c
cctcctcctgccaaacaggttccccaaaccctctgctccatgaatgtgttcctctgactcngggatgggagcgggcaggcccagagctgacaaaggggtgaggcggctggccaggtctggg

SEQ ID NO: 36631 - DNA, 121 bp, Artificial Sequence
  Synthesized
  misc_feature (61): n=t or c
aaaagcagggagaaaggttgctagtgaagataagggttatttttccagaaaacatcagaancactgattaaataaactgtatgactgtgctatttaaaacaaaattaagttttacagtagc

SEQ ID NO: 36632 - DNA, 121 bp, Artificial Sequence
  Synthesized
  misc_feature (61): n=a or g
gcaagaaggtccctcttgtcacaaaacctgtaggagcggctcagtgaaagcaacggcgtcnccatcccatggaaaacaccaagtatcagggcttctggcctacagagtagcatgggctctt

SEQ ID NO: 36633 - DNA, 121 bp, Artificial Sequence
  Synthesized
  misc_feature (61): n=t or c
aatatcatagtcacagcaaagtgaggtttcaataataagttccatagtttattaatgctangataacttccatgtttgtatttcttagttttcctgtttggacaaccgttctggctgtttg

SEQ ID NO: 36634 - DNA, 121 bp, Artificial Sequence
  Synthesized
  misc_feature (61): n=a or g
cgagtcatttattagtctccttaactgccagagaacatcggcagcgaaagactggagcgcngcatttaatggctccttgctggccagcacaggacgtgtgctgcatgccagggctcccacc

SEQ ID NO: 36635 - DNA, 121 bp, Artificial Sequence
  Synthesized
  misc_feature (61): n=c or g
cagctacaaggaaacacccgagtatacctcaaaacagattgccgacagactacccaaatcntatttgacacttgtatgtctgtcatattttgttttgtgtaccagtacagagatgacattt

SEQ ID NO: 36636 - DNA, 121 bp, Artificial Sequence
  Synthesized
  misc_feature (61): n=t or c
tggggcttgtgccccagagctgttccacgtgactttagtttgcagataaacctttggcagntccccttctgaataaattctggccttcatctctggccacttctggatcctgctgatttca

SEQ ID NO: 36637 - DNA, 121 bp, Artificial Sequence
  Synthesized
  misc_feature (61): n=a or t
acagccacttgattagggaaaagggaatttatttagaatatttcttagttttctgtgtatnatggctaggggcctaataaatctcggttccattatgctgtgcagagctactaacgtgtaa

SEQ ID NO: 36638 - DNA, 121 bp, Artificial Sequence
  Synthesized
  misc_feature (61): n=a or g
ctagagaaaaacatggggaaaagtagtgcttagaagagtattgtaggagaaaatatatatnttttttgtaaaatacgtcagagatttgagatgcttgtgctctttttcagaaagcaaaacg

SEQ ID NO: 36639 - DNA, 121 bp, Artificial Sequence
  Synthesized
  misc_feature (61): n=a or g
gcttaatgagaagtgcgctttgcatttctggcatgttaaggatctcggcgttgcagcagcnctgataagggccagctgcgtccctgggaagcaaacagcattaaagagcatttgaacgcac

SEQ ID NO: 36640 - DNA, 121 bp, Artificial Sequence
  Synthesized
  misc_feature (61): n=a or t
ctgtggctgctctctggtcttctccttggctttctgcctttcagccttaatgggtataacngcatccaatattttcccttgaggaaggatgttgtggggtgggagtgcggtcaaataatgg

SEQ ID NO: 36641 - DNA, 121 bp, Artificial Sequence
  Synthesized
  misc_feature (61): n=a or c
atcatagaaagttatagaaacgttcaggatggaggatgactagagatcaccttgttcaacnttctgtggaaagctgtgccttggattaagttatccaagctctatcaaacttgagtatgtt

SEQ ID NO: 36642 - DNA, 121 bp, Artificial Sequence
  Synthesized
  misc_feature (61): n=t or c
attaagtcttctattaaaaaaattttaaaattttaatggccacagaaactgactatttctngtctgagtagtcagattttctcaggaagggtggcagaagctgtcagagttagtgcccatc

SEQ ID NO: 36643 - DNA, 121 bp, Artificial Sequence
  Synthesized
  misc_feature (61): n=t or c
ggttttgcttacactgatatttcctgaactctcaaagtgaccgtagactctactagagatnttaagactcagtaagccaagttgttacttctaactttgccccaggcaataaggctttatg

SEQ ID NO: 36644 - DNA, 121 bp, Artificial Sequence
  Synthesized
  misc_feature (61): n=a or g
cttgtcagacacggtcttgttggctcctgccatctgaggacttctaaaacatgctttgtgnggatcccactgtgcagaagtagctcaaactgcctcggttagtctggaggtctctgctgaa

SEQ ID NO: 36645 - DNA, 121 bp, Artificial Sequence
  Synthesized
  misc_feature (61): n=a or g
cagtatgctcagatgtgattcctagctgttctttggtgccctaaaggccatttttttcctnggctacatcaaaataagggccccaaaagggcaatggagatgattctgctctcgtgaggtc

SEQ ID NO: 36646 - DNA, 121 bp, Artificial Sequence
  Synthesized
  misc_feature (61): n=a or c
agggttagcacacagagttgttgcatttctagtgttgtcatcttctccatactactcacanaattcacattatcataaagcacaggttcaaagtaccaccttgggtttgttattttctttg

SEQ ID NO: 36647 - DNA, 121 bp, Artificial Sequence
  Synthesized
  misc_feature (61): n=a or g
accggccaagtgcacccaagcttccctgggtgctcgggaaacatttttcaaagatcattanctttaacttggctcagccatccccagtgttaacatatctgcaaaccggtttttaaatctc

SEQ ID NO: 36648 - DNA, 121 bp, Artificial Sequence
  Synthesized
  misc_feature (61): n=a or g
gcaggaggctggaagaaaaggcagatttacagtgggccgagagctttcgttggctgcctgnccctcatgctggtgagggctgagtctgggtgccagcggggcccagtggctatactttcag

SEQ ID NO: 36649 - DNA, 121 bp, Artificial Sequence
  Synthesized
  misc_feature (61): n=t or c
cttctgcatcactgcaaaatggtgtgcgaccaaccagccgtgtgcacacagcctgcttccncccttccacatccgagcgcggcacggatggaacccacaccctctgcctccctgcccctca

SEQ ID NO: 36650 - DNA, 121 bp, Artificial Sequence
  Synthesized
  misc_feature (61): n=a or g
ttaattttctattaaaagatactggagaataccaggatgtcttgttgaactaacaggtacncgatcagatctggtctctgatgtgcacctagctttcagtgctatagcatgcatttgattt

SEQ ID NO: 36651 - DNA, 121 bp, Artificial Sequence
  Synthesized
  misc_feature (61): n=a or g
ggggtgctggaatgtcctaacccacatgcaacaagagccctggaattacttgacaaaggtnatgctggtctcagacactgtgattcaagtgttgcaacaacttaactttctgtttcacttt

SEQ ID NO: 36652 - DNA, 121 bp, Artificial Sequence
  Synthesized
  misc_feature (61): n=t or c
ttataattgaaaagtaacactgtatataacattatagtctgactattacaaagggtgcttntggagtgacttacattagttgttgccctttattttggagaatatgttttgttgttgttgt

SEQ ID NO: 36653 - DNA, 121 bp, Artificial Sequence
  Synthesized
  misc_feature (61): n=a or g
cccctcttcctattacctacaagccaaggttcacaaaacataggctttttccccccctaantacaacgtgactttatcatgagcgctgcacagatcaaaggttcaggtttacccccaggac

SEQ ID NO: 36654 - DNA, 121 bp, Artificial Sequence
  Synthesized
  misc_feature (61): n=t or c
tctacaaatgcattagtaattgcttaaattgatctaccatgtgtaatctcaccctattgcngttagggtactgaagttagactttgaattcatagaatttccttacgagagaataaaaaaa

SEQ ID NO: 36655 - DNA, 121 bp, Artificial Sequence
  Synthesized
  misc_feature (61): n=t or c
ctttcaggattttaaaggaagcaatgtgcagcagaaaggcccgatcaattaattgtttaancaagtggacaagcagcaatgattcagggaacagccagggaatgctgtcattttaggaaaa

SEQ ID NO: 36656 - DNA, 121 bp, Artificial Sequence
  Synthesized
  misc_feature (61): n=a or g
gagaatattttgtcttttatttttttccagagtccttaaaataaaaggtttgactaacagngaaaatgttggtcaattttaaacaacaaagaacctgtcatttggaaagaaagaagtctga

SEQ ID NO: 36657 - DNA, 121 bp, Artificial Sequence
  Synthesized
  misc_feature (61): n=t or c
gcaccgggccaggaaagcacagaggagatgaaaaaaggctccatgttgctcctgagccatnggtgcaccattctccctctgcagaatcagacacaaacattcactattgaatgtttcttct

SEQ ID NO: 36658 - DNA, 121 bp, Artificial Sequence
  Synthesized
  misc_feature (61): n=t or c
gcatcactgctaatctaaaccacctgaccagataaacaacagtttccccttctctcttcantgagggtatttctgtttattgtcatatgatttaccaatttgaagaacatgaagaataaat

SEQ ID NO: 36659 - DNA, 121 bp, Artificial Sequence
  Synthesized
  misc_feature (61): n=a or g
tttagaggaggaaaacccatatgtatacactactggggtcatctgaatgaatataccctcnacaatacaccacacacagtagagagaaaccacataaataaataaatttaagcaagcaaat

SEQ ID NO: 36660 - DNA, 121 bp, Artificial Sequence
  Synthesized
  misc_feature (61): n=t or c
gccttcccaccaggtgcttaatcactgtttcaggtcatgacttagcacttctgctatatangtataagttggaagtgagagagtggaagtaggtgttaatatacagatgcttgaatgttgt

SEQ ID NO: 36661 - DNA, 121 bp, Artificial Sequence
  Synthesized
  misc_feature (61): n=t or c
cttcacttttctgtgtggatgccaccacctgctgcacattgctttggctggtgggaaatangacagcaaaggattgctctatgatggaacatggagaactctgccacaaggctgtgtgctg

SEQ ID NO: 36662 - DNA, 121 bp, Artificial Sequence
  Synthesized
  misc_feature (61): n=t or c
agaaagcattaggaagagtgatccagatcccctgaaattagtggaaaagtttcagtagagntagaggacagtgaatcacaaggtgtttcttaaaacagtctgcttgcggcccacgttatct

SEQ ID NO: 36663 - DNA, 121 bp, Artificial Sequence
  Synthesized
  misc_feature (61): n=t or g
tactctgctggctaaccaaaccaacacaaatatcttctctgctttgggctacagatctatntacaacccctaacagagacaacacaatgcagtgtttggaaagggtcaacagaggcacaga

SEQ ID NO: 36664 - DNA, 121 bp, Artificial Sequence
  Synthesized
  misc_feature (61): n=t or c
aacagggccaaaaggaaaatatttctgctcccaattcctatgctttgtgctgcaatggccnttgacaaataggaagtgtgacagcaagcataaggtatgaaaggaaggcaatgtaggcagc

SEQ ID NO: 36665 - DNA, 121 bp, Artificial Sequence
  Synthesized
  misc_feature (61): n=t or c
catgagaagcatgctgcccatcccaccataacatttaaaaaatgtcactacaaaaacatcntatctgtcttgattttcctgctctagttcttaattcattacttaaatacatatatctaag

SEQ ID NO: 36666 - DNA, 121 bp, Artificial Sequence
  Synthesized
  misc_feature (61): n=c or g
taccaaagaatcttcctctttggaggtcatcctattttcaccctgcctttcagataaaatnctttcaaaatgatgaataaatgtttaccagattaaggctctggaaggaggaggagaagtt

SEQ ID NO: 36667 - DNA, 121 bp, Artificial Sequence
  Synthesized
  misc_feature (61): n=c or g
actccagttggtctcattgaagattcaggtagaatgggaggtgttccattttttcctcagnaaaactgaatggaataagaagtggaattcatgtccaattaaaaacaaaatagatatattc

SEQ ID NO: 36668 - DNA, 121 bp, Artificial Sequence
  Synthesized
  misc_feature (61): n=a or g
tgtgtttctactgtttgttgaggtctttcttatacagaagaatttgttttgaactgtcttnctgatcttgtgaacaattgtatatctgtatttataaagagacaggaagaaattagactgt

SEQ ID NO: 36669 - DNA, 121 bp, Artificial Sequence
  Synthesized
  misc_feature (61): n=t or c
gaagtctaggactcgtactcttgacacagtgttggactgctctgaagagctcaaggtgaanagaaattaatggcggctgtggtctcaggtcccttctttattctgttcccagttaatcttg

SEQ ID NO: 36670 - DNA, 121 bp, Artificial Sequence
  Synthesized
  misc_feature (61): n=a or g
gcaactttgaacctcctttgtgccaagctgtacagtaagagtgacttactgtcctcaaagntggagagatatttctcaccagtgcagattaaggtgtctcttgcctccatggacataaaag

SEQ ID NO: 36671 - DNA, 121 bp, Artificial Sequence
  Synthesized
  misc_feature (61): n=a or g
ttgaactgggcgggtagaggcataggtgtgatattcagcaacatgtcaggctgaagtgtgncacacaaccctacctggaatacaagccctgagccgctgacacgtcttctcaatccataca

SEQ ID NO: 36672 - DNA, 121 bp, Artificial Sequence
  Synthesized
  misc_feature (61): n=a or g
ctcctcacttctatgtgagctcatggcttcatgttagggattccagctgcaagcctcagcntgagccctgtcgctttcatcatactttaaagagctttcctcagaactgcaacatggaaca

SEQ ID NO: 36673 - DNA, 121 bp, Artificial Sequence
  Synthesized
  misc_feature (61): n=a or t
caactttcatggatttttggagtggtcccctcaaaccactgaaaaaataattcagtagttnacaataataagtctataatgctgttttcactgcacttcatgatttaacagatgttaaatg

SEQ ID NO: 36674 - DNA, 121 bp, Artificial Sequence
  Synthesized
  misc_feature (61): n=a or g
cttcttcttacattttttgctttttggattgatcgatagagtaaatgtggtaaaggcacantgatcttttacacatttatttcaagtctgttgttgtaactaactaggagttcctgaagag

SEQ ID NO: 36675 - DNA, 121 bp, Artificial Sequence
  Synthesized
  misc_feature (61): n=a or g
agactgctatctgctaagcaaggcactttttcatatgcaatacatattcactagttgaacngctatcacactcaccatttactaacactgaacagctgaaaaacaacagcataagtccttt

SEQ ID NO: 36676 - DNA, 121 bp, Artificial Sequence
  Synthesized
  misc_feature (61): n=c or g
ccattccaccagccacatctcataacctgaattacaggagatctcccacagctgatgccanacatgttggaacagttgtttggtggaagggagaacatattcctctgattaaatacagaat

SEQ ID NO: 36677 - DNA, 121 bp, Artificial Sequence
  Synthesized
  misc_feature (61): n=a or g
gaaagtttgtgatcttatttttaaggagtcttgtaaagagaaaatgaggagttggaaaacnaaaagcctggtgtaaactttttgtatttgtattgccagaatccttacccttccattcatt

SEQ ID NO: 36678 - DNA, 121 bp, Artificial Sequence
  Synthesized
  misc_feature (61): n=t or c
atcttgaagttagcaaggttagatttaacagatgtatatttttaaaaccacaaataaatgngcagagataactagacacagaaatgctagagtatttgactttgttctccattaatctata

SEQ ID NO: 36679 - DNA, 121 bp, Artificial Sequence
  Synthesized
  misc_feature (61): n=a or g
gtaccagttacagggaaggaactggggaagacgacacattaaggaagggcaataggaaaanataatacttttttcccctgtcattacacgctcttggaggtggcataccgcacagagcaac

SEQ ID NO: 36680 - DNA, 121 bp, Artificial Sequence
  Synthesized
  misc_feature (61): n=t or c
tttgacttgaatatagatgaagaacagctttacagcaggcaagtggttaagacatgaatgnacatatgaatgtcattcattccattggaataaattgcaaccgattctactggtgccagtg

SEQ ID NO: 36681 - DNA, 121 bp, Artificial Sequence
  Synthesized
  misc_feature (61): n=t or g
acatctgggctccaaccacactgtgatgctgtgatccccatttgctgtgctctccagcacnctgtaggttaaaacatcaattcttagcaactttcaacccaaggctgcagagctgatcctc

SEQ ID NO: 36682 - DNA, 121 bp, Artificial Sequence
  Synthesized
  misc_feature (61): n=a or g
tacaagacagggaagatccaggtgatgaacagaaaaactgaataatttaataaattccacnagatcatttaaacctagaaagtcagtggtggaataggaatgtaaactatggtctgtgtga

SEQ ID NO: 36683 - DNA, 121 bp, Artificial Sequence
  Synthesized
  misc_feature (61): n=c or g
tcattatctgcaggctctgaaggtgaaatatataaacttaacagcaaaaagaaagcctacnagctgcacggggagatttcccaggtcctccaccccgggtgtggacgtggccctgccccgg

SEQ ID NO: 36684 - DNA, 121 bp, Artificial Sequence
  Synthesized
  misc_feature (61): n=a or g
aaataattttgaaattacctaatcaaactatatttccaaaaacagggctctgagtattgcnaagacatattttactgagatctcaatacccacagaactacagccaggtttatgttttaga

SEQ ID NO: 36685 - DNA, 121 bp, Artificial Sequence
  Synthesized
  misc_feature (61): n=t or c
ttcttgggtaaataacactggcaaggtttgtagataagcgcacgaaggcaaagaatttagnactaattaggaggaacacccagaacacccattgactgatgttccagattgttgtgaggtc

SEQ ID NO: 36686 - DNA, 121 bp, Artificial Sequence
  Synthesized
  misc_feature (61): n=a or g
tctgcataggcatgtgcccatacaggtacgtgtgtgtgcgcatacaggggtgtgtgtgtcngtacgtgtgtccatacagctatgtgtttgtgcacaggtgtacgcaggagaatttccaacc

SEQ ID NO: 36687 - DNA, 121 bp, Artificial Sequence
  Synthesized
  misc_feature (61): n=t or c
tctttggatatttaaagacttatcatgtcatacttaaaaaatattttgaaacctcagtagnttggacctgagttagctccgagtcaggtgaaaagatattacattttttttaaagctttaa

SEQ ID NO: 36688 - DNA, 121 bp, Artificial Sequence
  Synthesized
  misc_feature (61): n=t or c
taactgcctgatacctcatattcgccacagttagacagtcacaccagattctattgaactntcattatatagtactaaatgtcctgtttcaagcaactgttgtagcatacttgtttaggtg

SEQ ID NO: 36689 - DNA, 121 bp, Artificial Sequence
  Synthesized
  misc_feature (61): n=a or c
tcaaggagtcagcggaataaaaaatgacaccacctttccctcatttttctctatcttattntttgtagagggaatacttggacatttcatttgatgaataaatatacagcaatgcctaatt

SEQ ID NO: 36690 - DNA, 121 bp, Artificial Sequence
  Synthesized
  misc_feature (61): n=t or c
ccttgcttgttttgctaggagaaaagtgaggctgggatcagtgacacggctgtaatcctgntgcattagcaggatcatgggaagggccccagggcttgtgcaatgtacaccgtgcagccta

SEQ ID NO: 36691 - DNA, 121 bp, Artificial Sequence
  Synthesized
  misc_feature (61): n=a or c
aagagagagatggattagacatgaaagctttcttatggtaagaactggtgtactaaaatantctgcagaggctgtgaatcagatgtttaaggacaagtcagaccagtgggctcaatcttct

SEQ ID NO: 36692 - DNA, 121 bp, Artificial Sequence
  Synthesized
  misc_feature (61): n=t or c
cggcaggtgtacggaaggacgaggagctgccaacagggcacgtacccttccgggtctacangctgcttttccgcgaatcagtggttggaaaacaaagcacgggttccgcactgagacgaaa

SEQ ID NO: 36693 - DNA, 121 bp, Artificial Sequence
  Synthesized
  misc_feature (61): n=a or g
ctgtgggcacagcatatgtttccatcatctcagctgtggaaaaataggagtggagtggtanccacagcttctgtcactgatggagcagcatgtgatgatgggtcagggcacagccccgttc

SEQ ID NO: 36694 - DNA, 121 bp, Artificial Sequence
  Synthesized
  misc_feature (61): n=t or c
tgtagcttgtcactgccttcctggcacttgtgatgacagccacagttaaatacaagagagngatggcagttaagggcagttattggttggggctgctacactttcgcctcacatatgctta

SEQ ID NO: 36695 - DNA, 121 bp, Artificial Sequence
  Synthesized
  misc_feature (61): n=t or c
tcctctgattattagattataatttctctgcctcgttagcgaagtacagttgtaatcctgnttaccttgttagttttctgactgcatcctctttctccaacatgggagttgttctgtactt

SEQ ID NO: 36696 - DNA, 121 bp, Artificial Sequence
  Synthesized
  misc_feature (61): n=t or c
cttgcgtgcgacaaaccagaaagggaaaaataacagagaggagaaacgagaagcccagcangcaggtcgggggctttaattaagcaccgcacagccacggctgggcgcagcgttcccacgc

SEQ ID NO: 36697 - DNA, 121 bp, Artificial Sequence
  Synthesized
  misc_feature (61): n=t or c
acagacaaaataattaagtaaaaacctgtcaattgagcaacagtaactgacataagagttntcatctctcacaactgtgggttagaacacactagacaaatacatgttatttttatttggg

SEQ ID NO: 36698 - DNA, 121 bp, Artificial Sequence
  Synthesized
  misc_feature (61): n=t or c
gaagccatacaagcccaagtgttgagaggctttgatacatgcaggtaatgtaggaggctcnccagagcttgagggtttgattcaactcccatgtctttttttgttcggcgtgtcttgccga

SEQ ID NO: 36699 - DNA, 121 bp, Artificial Sequence
  Synthesized
  misc_feature (61): n=a or g
ttccctactcccacccacttccaaaaacaaaacaataacccaaccaagaaaccaaaaaaangaaccacccaggtacttgcattcgtattaacctcaatgaatgacaattttacattcttcc

SEQ ID NO: 36700 - DNA, 121 bp, Artificial Sequence
  Synthesized
  misc_feature (61): n=t or c
ccttacagattcaaaggcctcactcatgttttagcagaggcctagctaagaagctgatcangctgtctgctgaatcctcacaaatttcacctcccaggctaccatgatgctaccaaaaccc

SEQ ID NO: 36701 - DNA, 121 bp, Artificial Sequence
  Synthesized
  misc_feature (61): n=a or g
gacagagataaccttctggggagaagtgatggatctttgcaggctgtgtcactttttgacnctggctagtggaggcagaggaagaagtctgtggcacaagggagtgagaaagtattaatac

SEQ ID NO: 36702 - DNA, 121 bp, Artificial Sequence
  Synthesized
  misc_feature (61): n=t or c
gatcatctaaaagtctccccctaccttaaaaaaaaaaaaaggaatctgttaatttaatggncccctcgctagcacattgaagtggaagccaggaaaactgctgtggttttaatcactgaat

SEQ ID NO: 36703 - DNA, 121 bp, Artificial Sequence
  Synthesized
  misc_feature (61): n=t or c
gatttccctgtaggcactgtgaaggcttaaagatagacaaatcacagaaccgtgtctgagncaaaatccacaaaatgtcttcccctgctttgattttcctaagtccttctgcagagtgtga

SEQ ID NO: 36704 - DNA, 121 bp, Artificial Sequence
  Synthesized
  misc_feature (61): n=t or g
agctgtacatgtccaggaaggttaaagctgttatacattcagaagcatacattgcccagtnatgtgttaatccatggtctatgataaggcagctactgacagttcaggaaaggctttaaca

SEQ ID NO: 36705 - DNA, 121 bp, Artificial Sequence
  Synthesized
  misc_feature (61): n=t or c
ctgtacaggagtgctcctatcagatgagtggatgcatacagtccagtgcacttcaccactnggagccataagcatagaaaagatcactaaaatcagaactggaatactcagtgagcggggc

SEQ ID NO: 36706 - DNA, 121 bp, Artificial Sequence
  Synthesized
  misc_feature (61): n=a or c
tgagcacaggatctgaagcgtggtgtaggagtgcccttcgaggccttgtttttgctcttcncttgaggaaatgtgaagtcgtgtggcttgactgtgtccactttcattttgatgacccgtt

SEQ ID NO: 36707 - DNA, 121 bp, Artificial Sequence
  Synthesized
  misc_feature (61): n=a or g
agagcagatactaaactcatccaaaagaagcactccctttctctatggagttagggtattngcctccattatcaggtggtgcaactctaaacttctccaaagcagagtacgactagtcccc

SEQ ID NO: 36708 - DNA, 121 bp, Artificial Sequence
  Synthesized
  misc_feature (61): n=a or t
ggaggccagcttaggaaacaggagtgggatcaagaagaagaatgacaaagtcatgaacacngcaagttttattatgatcattcaagtacttccaggctgtggtagtaggagatgcagcaat

SEQ ID NO: 36709 - DNA, 121 bp, Artificial Sequence
  Synthesized
  misc_feature (61): n=a or g
ttttcaagacagagcatcataaagtaactgctcattttgtagagcaatttaagggggcaantgtgcatgtggttatgtatagatggatggtaatgcaaacacattgcagaagaagagatag

SEQ ID NO: 36710 - DNA, 121 bp, Artificial Sequence
  Synthesized
  misc_feature (61): n=t or c
tagcgctttaatgcctagggaagctgagatacttgttctactttgccacttctcttctaangagaacatgagtcaatagtgtgctttttcagagaaaaaaaaaaaaaaaaaaaaaaaaaaa

SEQ ID NO: 36711 - DNA, 121 bp, Artificial Sequence
  Synthesized
  misc_feature (61): n=t or c
ctctttttggttatctaactgggcacatcctgttgattcttaacccatttccaagtacaanaatccacacagatgtatctctagcttttaaactgctcagtgaagtcatctgtaactccag

SEQ ID NO: 36712 - DNA, 121 bp, Artificial Sequence
  Synthesized
  misc_feature (61): n=t or c
gagatgagtgttttcattacagataaaatgttgacagcatgacagcattccatgaaacagnaaaaataccttccctacagctggtagtgtgcatacctgcttctggtcatcagaagatgct

SEQ ID NO: 36713 - DNA, 121 bp, Artificial Sequence
  Synthesized
  misc_feature (61): n=a or g
tgcatatatgtgcctttatatgggatacatgctctttatatacgtacatgtgcaattaacntacaaaatgcatgtatgagcagatcaattttaaaatatatgttttgtatataaacaatgc

SEQ ID NO: 36714 - DNA, 121 bp, Artificial Sequence
  Synthesized
  misc_feature (61): n=a or g
gggcacttccagcatggtgcacgcagctcctgctcccagtgctgtgagcggctgaggcacnttaggagctgccctaattggtgaatgggacacaccagtgataaactcagtgtaagatggg

SEQ ID NO: 36715 - DNA, 121 bp, Artificial Sequence
  Synthesized
  misc_feature (61): n=a or g
tagactgtttttcttcacaactttttgtttcatgtcttccctgctactttttcccatggcntccctgttcctcattgcacctcacaggaaataaatgcttcaagatctcaaagggacatgg

SEQ ID NO: 36716 - DNA, 121 bp, Artificial Sequence
  Synthesized
  misc_feature (61): n=a or t
agcacaatttaaagagtagagtatgtcatcaaataataaattgatgcatactcctgaaaantttcaggaatttctgccaattcttgcactctaccatctggggaagactagcctacataaa

SEQ ID NO: 36717 - DNA, 121 bp, Artificial Sequence
  Synthesized
  misc_feature (61): n=t or c
ctctaagtagttgaaaattaatgactatatttatcatactgataagtaatttgtaggtagnaatacgttacccttagaagtgtggcaggacatttttatgtactatattcaccacgccatt

SEQ ID NO: 36718 - DNA, 121 bp, Artificial Sequence
  Synthesized
  misc_feature (61): n=a or g
tcacctctgtagaggctgcccttcaaagcatagtgctttgcaaggctgtcttcaggtaganccttgcagccttgtgatagagaagtagtataatgcagcagcaacaacttcgttgaactag

SEQ ID NO: 36719 - DNA, 121 bp, Artificial Sequence
  Synthesized
  misc_feature (61): n=a or g
agtaaaactagatgtggagacatctgttgaatttgctctcagtgtatgctcagagcttcantcttgtaacagggtttaatgcttactcatgggactgcagctgatgaggcagagttgtgca

SEQ ID NO: 36720 - DNA, 121 bp, Artificial Sequence
  Synthesized
  misc_feature (61): n=t or g
gcatctctgtgtaactggcaaagaaattaaacctctgctagaacaaaagcatcggcagtgnttaataatgtgcttcaaaacggtgtatcagtgagagcctgctcctgcttccctgttctga

SEQ ID NO: 36721 - DNA, 121 bp, Artificial Sequence
  Synthesized
  misc_feature (61): n=t or c
tgcaacattcctgctgcagcccgcgtgttaactgattcctttctgacatctgggagagcanagccaggccttctggtgggtttttaatgagccacccagtccaccatctccccccttcctc

SEQ ID NO: 36722 - DNA, 121 bp, Artificial Sequence
  Synthesized
  misc_feature (61): n=t or c
tggctccactgagagctttgaagagtagctgcaggttgtttccataacgaatcagaatatngagactgaaccaaaaagcttatatgaaattatcactgcattggtaatccgcgatggtact

SEQ ID NO: 36723 - DNA, 121 bp, Artificial Sequence
  Synthesized
  misc_feature (61): n=a or c
atctgggcaataaataaagaagcataacaaataattgtcacaaaaacagcttcagcaaagnaaggctcctttctattgtctgtgaggtgctggggcagtgctggaaggaaagcttcccccc

SEQ ID NO: 36724 - DNA, 121 bp, Artificial Sequence
  Synthesized
  misc_feature (61): n=c or g
ttttttttaatccatgaaaaccactccagaggcatttttattcacaactgttgataagagntatatacattctatacactatgttacacccaaggagaaaataaaaacctggttcatcaga

SEQ ID NO: 36725 - DNA, 121 bp, Artificial Sequence
  Synthesized
  misc_feature (61): n=c or g
tgctatttaacaaatattcagtcttaacataaggctcttcctactcaatgggctttgactngtgacctctcttgatttcattatttatagagatacagttcaaaaatgtcttgcacctcat

SEQ ID NO: 36726 - DNA, 121 bp, Artificial Sequence
  Synthesized
  misc_feature (61): n=t or c
aatattaaagctgttgcttacagaatgagcagttgtgcttgtttttaagtcaaggaagccnttagtgcttttacttgtgtggataatgtgaatctttcactatgctaaaagaagatttcac

SEQ ID NO: 36727 - DNA, 121 bp, Artificial Sequence
  Synthesized
  misc_feature (61): n=a or g
ccagccagttccacagaagtccaccttttcttccttctctttggatgacaaataaaaaagnaacttacatcaacacggaggtgcactcttccttgtttacagagatccctacctgcaggca

SEQ ID NO: 36728 - DNA, 121 bp, Artificial Sequence
  Synthesized
  misc_feature (61): n=t or g
gtacaaccaaatcttctataatcagggtcttgaactatttgaagatgttgatttggatcanactttgtgcctattttgcctgaggacaaagtgagaatagtatcaataaaatagaaattac

SEQ ID NO: 36729 - DNA, 121 bp, Artificial Sequence
  Synthesized
  misc_feature (61): n=a or g
tgtttattccaattgaagccgacaccagaagcgctccggacccacccgatgagtttatgcntcccactttatttccagcttggattaatggcacctctttaatttctggtggcctgagcag

SEQ ID NO: 36730 - DNA, 121 bp, Artificial Sequence
  Synthesized
  misc_feature (61): n=a or g
taaaactgtgagattgaggggtgaattacatctgcatgagagctggaaggggctctggccnttcctgcagcagttttggtctgctttcatccacaaactgcccataaaacaaaggtgaagc

SEQ ID NO: 36731 - DNA, 121 bp, Artificial Sequence
  Synthesized
  misc_feature (61): n=t or c
gaactctcttggcctccaggaattagcaagtaaaaataatggtttagttgagaagatgganatgattgtgtggccagtttattttaacaaaggaggtcttatgcccaccactccggtatca

SEQ ID NO: 36732 - DNA, 121 bp, Artificial Sequence
  Synthesized
  misc_feature (61): n=a or g
ataatatatatgtagcaaactaaaacaaaatcatatgaagagcaatttttaaaggagatantaacaagagaaaaaagcctgctgacaatctttagggtcaataaataatgaagttataagg

SEQ ID NO: 36733 - DNA, 121 bp, Artificial Sequence
  Synthesized
  misc_feature (61): n=t or c
atctcagaaagccaaaaactcatgctgtgaaagtcactctttaaaatgcatctctcttccntgacttcaaatctgatatgttatccctaaaggtgtttacccctaaaggatattaagtttc

SEQ ID NO: 36734 - DNA, 121 bp, Artificial Sequence
  Synthesized
  misc_feature (61): n=t or c
taaggtctcaaaaaacgacacgggcctacatgactgtcagagtacccattgatctttttcntcttagcacgtgaactcaatctgatcttttgcgcaagcttcgttgtaccccatggcactg

SEQ ID NO: 36735 - DNA, 121 bp, Artificial Sequence
  Synthesized
  misc_feature (61): n=t or c
caaagtgtctctctgctaggttaatcaattccactgtaaaacctttccactatggaccaanacaatagaaaatggggctaagtaaaaatgcacaaatcttaatctttcagaataccaatac

SEQ ID NO: 36736 - DNA, 121 bp, Artificial Sequence
  Synthesized
  misc_feature (61): n=t or g
atctattcagattttacttttatcacctagctgagtaagtggcgagtttgaactttatatncagaaagcaaatgcctcttgaatttctcacagacatttaattatacaatcagagatcctt

SEQ ID NO: 36737 - DNA, 121 bp, Artificial Sequence
  Synthesized
  misc_feature (61): n=a or c
aaggctctgattgataggaacgttagtttgtaatctgtcagctgttctagatgctgtaggncgagtgttggatggagaacgggagacctgcttgctttcttgctgtgtgtggcatacacca

SEQ ID NO: 36738 - DNA, 121 bp, Artificial Sequence
  Synthesized
  misc_feature (61): n=a or g
taccttggagtcgtgggagctgaaaacactggggtcatctgtgctgcccaccatgatcttntgtgggtgctccttagagggatgggcagtgccagagccgtcggagcggtgggacttggag

SEQ ID NO: 36739 - DNA, 121 bp, Artificial Sequence
  Synthesized
  misc_feature (61): n=t or c
gtgtctcggtaggaattgtggcatccctgaaagcctgtccttgagttaagcaggtaccagnttattcaggctcagctcagaagagaaatatgaattcacatctacattagaaataaaacca

SEQ ID NO: 36740 - DNA, 121 bp, Artificial Sequence
  Synthesized
  misc_feature (61): n=t or c
cctttggcaaaagcacagagaccataacgccacgagatgattaacatggaaacaaccccangcggttttgggaactgaaccaatggaagttcctctgcctttctgcagagtcatgtgtttt

SEQ ID NO: 36741 - DNA, 121 bp, Artificial Sequence
  Synthesized
  misc_feature (61): n=t or c
ttttttttatcaactcacactttttcctatagataattaccctttacttgctggtggcacngatactttggctgtgcttttttagtctcctaaaatgaaggggaaacttttgcttctgctt

SEQ ID NO: 36742 - DNA, 121 bp, Artificial Sequence
  Synthesized
  misc_feature (61): n=c or g
gcaaagagcagctctcagaatatggcacacaacaaaaacactaacttgaaaatttgtcaancctacctgtcactttgctggtaaaaaatgccccaagtttcaaacacgtctcggttcataa

SEQ ID NO: 36743 - DNA, 121 bp, Artificial Sequence
  Synthesized
  misc_feature (61): n=t or c
cttagaagaagcccagctctgtgtaagttcaagcactgcaaatgctcagaattaagactcntgagcagactctatacttctctgtaagatgagtagttcttctgtgtgaaggcagaattga

SEQ ID NO: 36744 - DNA, 121 bp, Artificial Sequence
  Synthesized
  misc_feature (61): n=t or c
aattttgtgcactaatgtagacctaaagtactactgtcaaatcagaaccaatacaagagtnaggaactataacaggaagatgatagcaaacaaattctgtaatggaatttttctttaggtt

SEQ ID NO: 36745 - DNA, 121 bp, Artificial Sequence
  Synthesized
  misc_feature (61): n=a or g
tcatacaagatcacattccaaatgactgtgctgaaacaataaggttctataaaggcaattncttaggaggagggcagtgtcagtggtttaccaattgacttcgacttggcccccttgtcat

SEQ ID NO: 36746 - DNA, 121 bp, Artificial Sequence
  Synthesized
  misc_feature (61): n=t or c
agcaattccatataacatagaacaatgtccagagccgattttacatcttgtgtatttactntgtgagcagtaaataatgaaagaaggtagaatgacaaaagacatggggaaaaaaaatgaa

SEQ ID NO: 36747 - DNA, 121 bp, Artificial Sequence
  Synthesized
  misc_feature (61): n=t or c
cagatgttaaaagaaaccaggcttcttcagtcagtaagcaaacaagaagcaatgagtgtgngtgttcaggtgttcactgccacagatgaacctgacaaagcattacttgagaatatgataa

SEQ ID NO: 36748 - DNA, 121 bp, Artificial Sequence
  Synthesized
  misc_feature (61): n=t or c
ttgtttttaggggtgctgaggctcacaagctggatattttgttgggagccttattttttgngtatgggagcaaaatactgaggggactggtgcctaactttggctgtagggcaagggaggg

SEQ ID NO: 36749 - DNA, 121 bp, Artificial Sequence
  Synthesized
  misc_feature (61): n=a or g
tgtcagcatgccaataaactcatgtgccagaaataaatgcattatctattagtccatcagngaaagaaaaagaaaggcattcctttatggagagagacagtccagtagctcacaccattag

SEQ ID NO: 36750 - DNA, 121 bp, Artificial Sequence
  Synthesized
  misc_feature (61): n=a or g
aatgtggcactcccctcttgaacgtatggtgattgatggcatcggtgcctaacacactgcnggtttgaagtgcttgtagcttctctttcctcctcacttctggcttttcttatgtttctga

SEQ ID NO: 36751 - DNA, 121 bp, Artificial Sequence
  Synthesized
  misc_feature (61): n=a or g
ctgcccaaaggagctgcccgcagtctgtaccccaggagcctctatgcacagcaaggcaacnttcttattccagcttatgggggtgggtggtaggtctatcaaattaattttaattgccatt

SEQ ID NO: 36752 - DNA, 121 bp, Artificial Sequence
  Synthesized
  misc_feature (61): n=a or g
ttcacatgcattgtgtgtacaactctaactctgctcatgagcaaaaactggcaattcaccnaatatttggttcagatagttctgacacaacttgagtactcttttcagttttggactcctc

SEQ ID NO: 36753 - DNA, 121 bp, Artificial Sequence
  Synthesized
  misc_feature (61): n=a or g
cagagcaaagtgttccacaggcatgcacaagactgcatttctgacgtacagaaatcacatngacactcaaaggtcctgcttaaagctcttaactttgtgtacactacgactgttcttataa

SEQ ID NO: 36754 - DNA, 121 bp, Artificial Sequence
  Synthesized
  misc_feature (61): n=a or t
ttctacactgtgattatccatttcctctcacactgaaattctcacaggcttacaagtgcanatgacattttatcacacctgaacactttgtacaaacagcagcaactatcaccgctcccca

SEQ ID NO: 36755 - DNA, 121 bp, Artificial Sequence
  Synthesized
  misc_feature (61): n=t or c
aagatgacaagcagaacaggcaggcagaactcctagtcttgctgcttggggtgatgatacnattcctagaaacccttcaccaaggggaaccctacaacgtgcaggcttgagggaccacagc

SEQ ID NO: 36756 - DNA, 121 bp, Artificial Sequence
  Synthesized
  misc_feature (61): n=a or g
tatcatggaagtcacagaccatttctagttaccatattaaccgagaattgttagcgagcantgtgtgcatcacacgtacatgtgcaattcccatgcatttacaagacatgaatttcagaag

SEQ ID NO: 36757 - DNA, 121 bp, Artificial Sequence
  Synthesized
  misc_feature (61): n=a or g
aaagtggtagctgactgtgacacagcgatgggatgactgtcttttctacaccaacaagccncacttcagactagaaaaaagtgctagacagagcagttgtgttggttttgctgtgttgctg

SEQ ID NO: 36758 - DNA, 121 bp, Artificial Sequence
  Synthesized
  misc_feature (61): n=a or g
ttcatagaaaagttagagcttgatatcagttaaatttcagtgttttacaacacgaaatacntaactgcaaaatcacaagtaagacagcctcaacactgctaagtccaatccaagcataagt

SEQ ID NO: 36759 - DNA, 121 bp, Artificial Sequence
  Synthesized
  misc_feature (61): n=a or t
gcctcagcactgtggattactgcaagcacctagattgcaaccccagagaatatcaagtcangttcaaagttgtagttattatttgctttggtcatactttattgtagctataattatattt

SEQ ID NO: 36760 - DNA, 121 bp, Artificial Sequence
  Synthesized
  misc_feature (61): n=a or g
ttctgtcatcccttctgcagttttgtaactctctaaaaatttattaaaatttttctgggangaagtatggtgatcttcaaggaaatgaaggaatatacaaacacaggagcacgcgtaactc

SEQ ID NO: 36761 - DNA, 121 bp, Artificial Sequence
  Synthesized
  misc_feature (61): n=t or g
ctctttactgtttaagcaattaaacactcatacagaatcgcgtccttgcaccactctttcntggttattgatattgaaagagaaaataaacatgactgttccactgtgtcagtagagaaat

SEQ ID NO: 36762 - DNA, 121 bp, Artificial Sequence
  Synthesized
  misc_feature (61): n=t or c
taggtctattttaatgacaataataccatatggaacaaaaatcacgtcgtctttttagcantgacagacaattcaagtcataatattttgaagtaccaatataggcaagtttgtgtttcct

SEQ ID NO: 36763 - DNA, 121 bp, Artificial Sequence
  Synthesized
  misc_feature (61): n=a or g
ctgagcaccccagcaatgggatgttggcaggggaatccaagtggtgtccatcggctcttcnccaggactcggcttgcgctggatcagggttgaaattaattcctgtagcatctctgacgtt

SEQ ID NO: 36764 - DNA, 121 bp, Artificial Sequence
  Synthesized
  misc_feature (61): n=t or c
ttcccttctggtcaacaaaacacagagaacaatgctgtatctcgcatatccaactgagacnctggtaagtgcagtggtgactacgttgaaaattatatacctgagacctcagagccaggct

SEQ ID NO: 36765 - DNA, 121 bp, Artificial Sequence
  Synthesized
  misc_feature (61): n=t or c
taagtaaaagaaagaaaaagctcttgatcagaagaaataaataaccttttaaagtgtaatngtgggttaatccagcttaatttggaaggaagaagaagcacaaagaggccaaagcttggga

SEQ ID NO: 36766 - DNA, 121 bp, Artificial Sequence
  Synthesized
  misc_feature (61): n=a or g
attgttacttactcaattaccacaaaaatggtaccgatgctgtctgcagaagcattccacntttgaagaatttggcaggcacaacagatccgatgcttacctccattatagattattttat

SEQ ID NO: 36767 - DNA, 121 bp, Artificial Sequence
  Synthesized
  misc_feature (61): n=t or c
taaataggctgataagggagatgaataatgaaattgcggggttaggaggaaaatttccctncttatctaactcaggatgtttatctgatgataccggtctgttctccacctggaaatgtgc

SEQ ID NO: 36768 - DNA, 121 bp, Artificial Sequence
  Synthesized
  misc_feature (61): n=c or g
caatttcccattgctttcctgcagcttctctcctctcccaccctttggcccgcgatgccgnagtctcagctcaaggacaggtcacttttccctgtgttttctacactcagccccaggaatc

SEQ ID NO: 36769 - DNA, 121 bp, Artificial Sequence
  Synthesized
  misc_feature (61): n=t or g
taagttgatgctctttcaaaggttttgctcttttcctctgttaaagtttcttactcacatngagatatgttgaggtggcagggctctaagatgctggctagagaggtacaggcttctcagt

SEQ ID NO: 36770 - DNA, 121 bp, Artificial Sequence
  Synthesized
  misc_feature (61): n=t or g
aaagctatctgcagatgcagcacagttagattctacgtgtgcttgcaaaagaaaccaggtnccttagctgactttatccttttccagtggctattaatatggtgaaccatttccaatataa

SEQ ID NO: 36771 - DNA, 121 bp, Artificial Sequence
  Synthesized
  misc_feature (61): n=a or g
aaagatttgttgttcctaagacagatttttttttttgtggaagtgttcccataattagtcnttccctggaaacagcggtgctttccccagaaacaactgaaattgagcagagaagtcagtg

SEQ ID NO: 36772 - DNA, 121 bp, Artificial Sequence
  Synthesized
  misc_feature (61): n=t or c
ggtaaggttactgaacacaagaacactacaggccaaatttagtcaaaagtgcagtaaagcncatagtaaaacttggatgttaattaaatgagttgtgaataacttgcaatggcaaatttct

SEQ ID NO: 36773 - DNA, 121 bp, Artificial Sequence
  Synthesized
  misc_feature (61): n=a or t
tttgggtttttttttctggaggggtgatgtggagagagagcttcagtacatatcacaaatngttgatagctatttgaggaaattacctttacataatacatacattagtaagtacgagcat

SEQ ID NO: 36774 - DNA, 121 bp, Artificial Sequence
  Synthesized
  misc_feature (61): n=t or g
ccattccaatgtcacataagttgatattgttcagtatgtatggactgtgccaagtctgtgnaacttctgtccttaggagcaatagccttcctaggtagtaactttggcactgctgtaggga

SEQ ID NO: 36775 - DNA, 121 bp, Artificial Sequence
  Synthesized
  misc_feature (61): n=a or g
ttgtgtcctcactgaaaattttaatggccattttgcagaaagcaaaatacaggctacactnaaaagaaattacaaacaattctgtggcatcctttgtgttttgacatagcagtgaagatgt

SEQ ID NO: 36776 - DNA, 121 bp, Artificial Sequence
  Synthesized
  misc_feature (61): n=a or c
ccctccctgacataatttgcatgcccagcaaacttgctgtccagagtcaaaccaatacacnggctttatattcgtacagtgtagtcctaaccagtagcaaagctcctagatttttcataaa

SEQ ID NO: 36777 - DNA, 121 bp, Artificial Sequence
  Synthesized
  misc_feature (61): n=a or t
acagcaaccatcacaaaatgataattcttatccagacaaagggaaaagctataataggagnatgtttatacacccttatttgtttgctacgaagtattctgaacagcttctagggagctct

SEQ ID NO: 36778 - DNA, 121 bp, Artificial Sequence
  Synthesized
  misc_feature (61): n=a or g
ccctatttcttaattcagctttcagcactgtattattgcattgctgtaagaatctcttctnaaatgtgccattttgtggattatgtcattagtaatattctcaatacctgatgaaatgaca

SEQ ID NO: 36779 - DNA, 121 bp, Artificial Sequence
  Synthesized
  misc_feature (61): n=c or g
atgtttcccccaagggaaaagccgtcgttgcctcttactcttttaaaactgtagcacaaanggataaatatctattcgaaggggttctgaaccgctgcatctgcatcgattttgcagcaga

SEQ ID NO: 36780 - DNA, 121 bp, Artificial Sequence
  Synthesized
  misc_feature (61): n=a or g
tttgaaactgcaatacagcgcctttacacgagttaggcaacctacggaaacctatgcatcncctctaaccttaaagcttcagcagaggctcctcagtgaagaggttttaaatattctgcaa

SEQ ID NO: 36781 - DNA, 121 bp, Artificial Sequence
  Synthesized
  misc_feature (61): n=t or c
acttttgaaaatttgcttctgttaaaggaataatagaatctctgcacttagtagcagtctnatgaccacgttgctcaaatccagaatccatctaggagagcagcagatgcgaacctcagtc

SEQ ID NO: 36782 - DNA, 121 bp, Artificial Sequence
  Synthesized
  misc_feature (61): n=a or g
cattcacatggggaaatgttattcctgtggtaacagtaatattgcagcaaaaatctaagcncacctcaagaaattatcatgaatctagagcaggaagttttagtggctaaggggtgctggc

SEQ ID NO: 36783 - DNA, 121 bp, Artificial Sequence
  Synthesized
  misc_feature (61): n=t or c
ctcccaagcagctccagctcatgaatccatcttctgatccagtcacatgtaaacaattagngccaagttaagaaacctcaacagcataggataagcctgccttttgcttgactgaggagca

SEQ ID NO: 36784 - DNA, 121 bp, Artificial Sequence
  Synthesized
  misc_feature (61): n=t or c
gaaaaatgatgccttattttcagcatcaacaccaccaagggccgggcgctgcactttggcnacagcaacccgaggcagcgctacaggcatggggcagagtggctggaagctgtgcagagga

SEQ ID NO: 36785 - DNA, 121 bp, Artificial Sequence
  Synthesized
  misc_feature (61): n=a or c
aatatatggcttttgttctatagattgcactgatattttcttatatattgaggaatatatnatcattggttatttaatcattactgaactggctggttggttttggttttaaatcattcta

SEQ ID NO: 36786 - DNA, 121 bp, Artificial Sequence
  Synthesized
  misc_feature (61): n=a or g
aagggccagattggaaatcatcactgctgagcttttgcaggtgcaaaaatcggccggatgnggtttgaacgtgaaggcaacaacccagttgagtggcaagcgctctgctcggtgttttggt

SEQ ID NO: 36787 - DNA, 121 bp, Artificial Sequence
  Synthesized
  misc_feature (61): n=t or c
agtggtgaagcattgaacttgcactcctttttctttaaaaaaaggactaacaaaatttctnggtttttctttaggcaaaattgggttaaactttcagcaccaataagaaaatggagcagtt

SEQ ID NO: 36788 - DNA, 121 bp, Artificial Sequence
  Synthesized
  misc_feature (61): n=a or g
acatttattctagtgcctcagtaaagttcatacggttgtttgtgcttttggtttttctgancaccaacagaaaattcagttaaccctttctcagtccggtgttctattacactgactgtgg

SEQ ID NO: 36789 - DNA, 121 bp, Artificial Sequence
  Synthesized
  misc_feature (61): n=t or c
tctttcttccaaaatgtgggtaaatatttaatatgaaagccaatccagtttaataatgtantagaagaaatcacaatttgtgaattaaaggaatcttggtgggttgtttttcttttttttc

SEQ ID NO: 36790 - DNA, 121 bp, Artificial Sequence
  Synthesized
  misc_feature (61): n=t or c
gaagcctgttgtacacaagatcaaaaagatcttagccaacatgaatcccacttcagaaaancccaggtgaatgcatttgacttttttgacatttgaatgcttggacaggttccataataaa

SEQ ID NO: 36791 - DNA, 121 bp, Artificial Sequence
  Synthesized
  misc_feature (61): n=t or c
ctgtctttaaaggactcagagactatttcttccatggaaagacaggcaacatcaaatgccntcccttggcctaaactagacagccctgaaagccatgaggactgtgctcctaactctaccc

SEQ ID NO: 36792 - DNA, 121 bp, Artificial Sequence
  Synthesized
  misc_feature (61): n=t or c
tatagcaaatgacttgtgtggcaccagaggtggagtgaaggattagacttcacagtttggntgcagaaaaacttcaatatcgtgcttcttggatcagcatcgggaaaatggctgaaaaaga

SEQ ID NO: 36793 - DNA, 121 bp, Artificial Sequence
  Synthesized
  misc_feature (61): n=a or g
aaataaataaggacacactcctttttctatttaagtagaaacacaacatttgagggcttcngggtcaccacaataaataaaacttctctagatatctttttagtatgtctcacgagagttt

SEQ ID NO: 36794 - DNA, 121 bp, Artificial Sequence
  Synthesized
  misc_feature (61): n=a or t
ttttcattacttttctgcccatttgtaattcctacatgaatcaaaccataaaatctatttntacatttttgttaatggagaaaattacagatgtttactctccctttggcttatctgtgat

SEQ ID NO: 36795 - DNA, 121 bp, Artificial Sequence
  Synthesized
  misc_feature (61): n=a or g
acacacaatctggaggaaaaaacaatcactataaccacattcacaaaacgcattaatgacntggccacttttatttcaagctgcatattctttggctatggatttcgtgttaatgcactga

SEQ ID NO: 36796 - DNA, 121 bp, Artificial Sequence
  Synthesized
  misc_feature (61): n=t or g
gctgagctctgtgaagggttgattattttagttgaagtggtttttcacttttggacaactntttaaagacagtcatagaatataacatctctagatgaaatattttcccaagttattgact

SEQ ID NO: 36797 - DNA, 121 bp, Artificial Sequence
  Synthesized
  misc_feature (61): n=t or c
cccaaggtcactgtcaccatcctggatgcactgtcacctttcccaacgatgctgccacttntccaagctcaccgttgcctccctgggcatgttgtttggcacactgtcaccttctcaggca

SEQ ID NO: 36798 - DNA, 121 bp, Artificial Sequence
  Synthesized
  misc_feature (61): n=a or c
atttctcctttttaactgaagataagctctatttatgtccacaatatttacatatgtacanagctacatttgggatgacgtctcagcatctgcttcatttctatccttcagtcagttctag

SEQ ID NO: 36799 - DNA, 121 bp, Artificial Sequence
  Synthesized
  misc_feature (61): n=t or c
agtcaagctcattcatgtgagaaggactgcactcaagcctaaaataggagtttagttaccnaggctccctgtagagtcagtcaagagatgcactttgaagcaagtaaggaaggagccttct

SEQ ID NO: 36800 - DNA, 121 bp, Artificial Sequence
  Synthesized
  misc_feature (61): n=c or g
ttctagcaattctccagtatcagggtgactgatatttcactacaactgtttacggcagtanatagaaatagtcccaatgcttattggaaaatgtagttctttacaatcaacagcagtgtct

SEQ ID NO: 36801 - DNA, 121 bp, Artificial Sequence
  Synthesized
  misc_feature (61): n=a or g
agactgtaccaaagctggttgattccaaaccaaaataagaacgtctacactcagctttacnccacggtgagaaacccaagcggcatttgtgtgcgtgaatttgtcatttgctgatgtacac

SEQ ID NO: 36802 - DNA, 121 bp, Artificial Sequence
  Synthesized
  misc_feature (61): n=t or g
gctgcatgcatttctgtttctctcttccacagggattgccaacattggttctgcaaactgncataaccagattcctccttcttagagaatcataccacagagtcatagaagggcttggatc

SEQ ID NO: 36803 - DNA, 121 bp, Artificial Sequence
  Synthesized
  misc_feature (61): n=t or c
atagaggggaaggagtgcccccattgtgagcgatttcctctggatgcaacgagattgtaanctcggtgctgttctaatttaacaaagcacagcctgagcagcagtcaggctatcatcctga

SEQ ID NO: 36804 - DNA, 121 bp, Artificial Sequence
  Synthesized
  misc_feature (61): n=t or c
tatcagatttgcggacattaacaatgacatctcagcctattcaagataatggtctagttgntactgatcatttgcataccagaggatgaaaattaaaacgaaagggaaaaggatgaaaatt

SEQ ID NO: 36805 - DNA, 121 bp, Artificial Sequence
  Synthesized
  misc_feature (61): n=a or c
aaacttcagtgtgaatacacaagatgaacctcttcagaaaaagtaaacagaaaaattcttnaaaattacttagtgtaatagcatggacaatatattttttattattactttacttggaagt

SEQ ID NO: 36806 - DNA, 121 bp, Artificial Sequence
  Synthesized
  misc_feature (61): n=a or t
atttattagaatcacagaattatcaaatcacagattcatggaaccatagaattatttaggntgggaaagacatccaagaaaaaatgaacattctgtatactgtctctaatttggcatgcct

SEQ ID NO: 36807 - DNA, 121 bp, Artificial Sequence
  Synthesized
  misc_feature (61): n=a or g
gactagctttgactaggtttttaattttaaggcaaagttaaagctgaagaaatgagacttntgagctctggccttttgagcccaggtgtgtgttagttggataagactgggagagaaggga

SEQ ID NO: 36808 - DNA, 121 bp, Artificial Sequence
  Synthesized
  misc_feature (61): n=a or g
tgcccctgacttattcctttcttattcctgagacaagtacacatctttcttcaaaggtacntgttcctgacccctgggagcccagaataaatggttcaaatgtgttggttgactggcctga

SEQ ID NO: 36809 - DNA, 121 bp, Artificial Sequence
  Synthesized
  misc_feature (61): n=a or t
atgaacattgaaatcttctgctatcgttgtgtttccttgttgcctttcctttggcacttcncttatgttgttgttcagaagacttagacaatttatttaaaactgaagttgcatttggttt

SEQ ID NO: 36810 - DNA, 121 bp, Artificial Sequence
  Synthesized
  misc_feature (61): n=t or c
cagctctttactcattgagaacgaagtcatagaagtattgttttaaactttttggcttttntttatgttatttcagtatttaatttttcctttttcatcctatcaggttacaaatcgttat

SEQ ID NO: 36811 - DNA, 121 bp, Artificial Sequence
  Synthesized
  misc_feature (61): n=t or c
attttaagtatttcaactcaaatgataaccagaaaaatacaatcactggaacactaagagntgtgattgcatcacatgttttgtaatatctgttcctcaaagaactcatacagccaataca

SEQ ID NO: 36812 - DNA, 121 bp, Artificial Sequence
  Synthesized
  misc_feature (61): n=t or g
acagcaagttggcagactgtttaatgagattaaatggttgtgtgctagtcatttgaaaatntattttcctgtggaacttggaaggggacatctgtatgtgaagagtagagttttgctgtca

SEQ ID NO: 36813 - DNA, 121 bp, Artificial Sequence
  Synthesized
  misc_feature (61): n=t or c
gggaagaaactggatggagatttttttttttctctccaatatcaaccaatcaaatcagtgngtttattccagaagcataagatgacatccagaagtgaacacctcctgagcccactactct

SEQ ID NO: 36814 - DNA, 121 bp, Artificial Sequence
  Synthesized
  misc_feature (61): n=t or c
tgactttttcagagtttctgcaagtccagcgtgcgtatcttgaaaaatgtctgtgttccantgaatgagaaagtttgtttataagccatcatgtaattgccaccgactcataatgctcttt

SEQ ID NO: 36815 - DNA, 121 bp, Artificial Sequence
  Synthesized
  misc_feature (61): n=t or c
attacagccggagcacagtgagcaggaggtcatatgagaatcgcatggaaattccctgcgnggaattactacagtgagattatccactcagaagatgtgtcatcctgtgagtcatatcgca

SEQ ID NO: 36816 - DNA, 121 bp, Artificial Sequence
  Synthesized
  misc_feature (61): n=a or c
tgcactctctgctgtcatctctgtcactaagcaagatgttaaaacccacaacttgctcaanttgtctaagagtgacctcgcaatggtatgggacaggtcattcagtagttgtgggtgcatc

SEQ ID NO: 36817 - DNA, 121 bp, Artificial Sequence
  Synthesized
  misc_feature (61): n=c or g
tctgtctgttgagagagaggcctgggattcatttgaaagggggcttcccatgtggattcantcagtatggcctaatgtggggatggaaataatacccactatcacaggatttactgttcct

SEQ ID NO: 36818 - DNA, 121 bp, Artificial Sequence
  Synthesized
  misc_feature (61): n=a or g
ttcctttttcttttcatattttagcatacaaagatgatatagcagctttaataacatttgncaaaaatgcttattagtacacacagcaaatacagcataaaaagaatgcaaccttgacatt

SEQ ID NO: 36819 - DNA, 121 bp, Artificial Sequence
  Synthesized
  misc_feature (61): n=t or c
aattcttttttgctttctcctctccaatcaaacaaatcacacattgcaggcgaaggacaantcaatactttggaaaaatgatttcaacaggagcaaaaattaacactcaaatactaagtgc

SEQ ID NO: 36820 - DNA, 121 bp, Artificial Sequence
  Synthesized
  misc_feature (61): n=a or g
ccttttttttaacatagggaagctttcattctcatctgaaatggcagtgttcgtgtttgcntcagcagaactgggctttacagactgaatggtaagggtgctggagaaacagaggcagtag

SEQ ID NO: 36821 - DNA, 121 bp, Artificial Sequence
  Synthesized
  misc_feature (61): n=t or c
gcttattcctgagatgggaaaacctagcaagtcaagctgctgggacaaatcacatcatccntgggaccacgcaaggcctccagtgaccaaaatccttgtaggaatctggctttcctctctc

SEQ ID NO: 36822 - DNA, 121 bp, Artificial Sequence
  Synthesized
  misc_feature (61): n=t or c
ttattgaattatatcattaacagcagtgagaaaacggtggcacaaagtgaaatgtgcagangtaggaattgagagaacagtttacaaatactaacgctatttcataaagaagcctttccaa

SEQ ID NO: 36823 - DNA, 121 bp, Artificial Sequence
  Synthesized
  misc_feature (61): n=t or c
ctccctagtaagggttcctctcccttggccagtgtcagtggctttggagctagcagccgangtttgatccacccacctgcaatatctgcttgcctatcctcaacagcttggcttcactgcc

SEQ ID NO: 36824 - DNA, 121 bp, Artificial Sequence
  Synthesized
  misc_feature (61): n=t or g
tgttgtttgccacacacaggtgatgatcatctttcaaacatgcatcagaggtgaaaaaatntagtagttagactttcagagcaggcactgactcccactgctggcagaattgggcagggtg

SEQ ID NO: 36825 - DNA, 121 bp, Artificial Sequence
  Synthesized
  misc_feature (61): n=c or g
cctggagtcgggcagtgctgtgagtgcaaaatcacttggagaagtttgtatccagctctcnaggtttggtttttactgctcagcagctccaggccatcactgctgggtatacccaaccatc

SEQ ID NO: 36826 - DNA, 121 bp, Artificial Sequence
  Synthesized
  misc_feature (61): n=t or c
accccagccccagctctgggagcagcactcacaactgacctggaggaactatgggccctgngactttgggccccatcgtgacttcagtgaccagtcacagaataatcctgctctccctcaa

SEQ ID NO: 36827 - DNA, 121 bp, Artificial Sequence
  Synthesized
  misc_feature (61): n=t or c
gtgtccttgcagggcctgtttcaggcctcagtgctgtcacccaacggttcacagctacagnagggctgtggccagcagttgaagcacaaacctcaaggcactgggtaaggctggatatggg

SEQ ID NO: 36828 - DNA, 121 bp, Artificial Sequence
  Synthesized
  misc_feature (61): n=a or g
aatatattagactgtgtgtttatctcctcttttatcatataactccaacttttaactgggnaaaaaataaaatcatgatttgataacaactgaagtgataaaggacacgaattcctaccgg

SEQ ID NO: 36829 - DNA, 121 bp, Artificial Sequence
  Synthesized
  misc_feature (61): n=a or g
ggagtttgtcatctccatttcaaggatgcaaatgcaaagacaggtgctggctgggggcccnctgttcctcccaacacccagcaccagcagctattcccgtcctcccaaatacacctatcca

SEQ ID NO: 36830 - DNA, 121 bp, Artificial Sequence
  Synthesized
  misc_feature (61): n=t or c
ttccaagctggcagccaaaaaatatctggttacttctctcacatggatcacggtgcaaggnatatcttcatgctaaaataaatgaataataaaataataataatttaatatattgttcatt

SEQ ID NO: 36831 - DNA, 121 bp, Artificial Sequence
  Synthesized
  misc_feature (61): n=a or g
taaaagacctaaagccataaatgcctctagaatgactttgagtgagggacataagctgccngtatcttgcattagtaggaaattctttgggaaaaaaaatgcagatgataagaggaagtgg

SEQ ID NO: 36832 - DNA, 121 bp, Artificial Sequence
  Synthesized
  misc_feature (61): n=t or g
agtagcaggaaaaagagctgtcttgctttgtgaaccttacccctcatcccaaataatattnaaggatttattggcctttctggctctcaacagaaatggaaagaaaagatgatttggggaa

SEQ ID NO: 36833 - DNA, 121 bp, Artificial Sequence
  Synthesized
  misc_feature (61): n=a or c
caacgcatgggcagcatcaccacctggctggccaggagggacacccaacccaatgctctcncgccaaccacacacagttgaattaggattgatgccaaggctggaaggaaagccagaggtc

SEQ ID NO: 36834 - DNA, 121 bp, Artificial Sequence
  Synthesized
  misc_feature (61): n=a or g
gcacaaattcatttaaaaattcattaaaatcaggatcattaatgtgttacacatttctgtncagcctgaaaaccttttgctggcacagcataatgctgggcaaaagaagccctgtgctgca

SEQ ID NO: 36835 - DNA, 121 bp, Artificial Sequence
  Synthesized
  misc_feature (61): n=a or g
tgggccgttttctcttgcaggataccagttaccacccaaaaatgacattttctcagcccanattgaaaccaatcactatcaattttctccccaaaataagtcttctcacctgctaatacca

SEQ ID NO: 36836 - DNA, 121 bp, Artificial Sequence
  Synthesized
  misc_feature (61): n=a or g
agcttaaaccaatcttgattccatggtggggaagtgatctctcatacttggagcactgagngagctcttggtaaacctgggtagaatggcttcatttctggaatggcagtaatacgtggca

SEQ ID NO: 36837 - DNA, 121 bp, Artificial Sequence
  Synthesized
  misc_feature (61): n=a or c
ggcatctgagaggccaacaaataattatgtttggaaacgttaattggctccagtttctacngttaatagcatcctctgaaactcagggtgaagtactggaattaattaaacataaaatcat

SEQ ID NO: 36838 - DNA, 121 bp, Artificial Sequence
  Synthesized
  misc_feature (61): n=a or c
ctgtgtcccttttcctcctggaggaggaatctgtgggtgctctgaatccccagatgttggngaccaagattctcatcttgtaaagagagggcaggtgctccgtgtgtggaaggagtgtttc

SEQ ID NO: 36839 - DNA, 121 bp, Artificial Sequence
  Synthesized
  misc_feature (61): n=t or c
tatgttcttgatcctgtgacaaacagacacacacacacatacgaacacaaaattgttcggnaggatttttgttagaattatgctgctgtaattcagagatggtgggttgcatggaaaagga

SEQ ID NO: 36840 - DNA, 121 bp, Artificial Sequence
  Synthesized
  misc_feature (61): n=a or g
cttctgttcttttttttttcactctaacaaaactagcagtgcttcaaagtcttcgatctcntaaaatcatcctaaaaaagaatttagaatataaaacgtaatacatgcttttatttaaagc

SEQ ID NO: 36841 - DNA, 121 bp, Artificial Sequence
  Synthesized
  misc_feature (61): n=t or g
ttaataaatcaagtcaaagtgaaaaaaaaaacaaaccctacactcaattatacaacgtatntgtttgtgtcttggaggaaaaatatgacatgatgatcaacccacagaattaatgtaattt

SEQ ID NO: 36842 - DNA, 121 bp, Artificial Sequence
  Synthesized
  misc_feature (61): n=c or g
atacacatttgaaatgagtttgaaagttggtttgggattctgtagccaaggtgtttaatantattactagtatcattatttttaaaccttccctttcctgagaggcttatgctggaaaatg

SEQ ID NO: 36843 - DNA, 121 bp, Artificial Sequence
  Synthesized
  misc_feature (61): n=t or c
tcatagcaaaaaaagaatgatccatcttggtcttgttttcctttgagagaagctacccacngtgtctctacacgagtacaaatatcctactaacacaggacaacagcaaaatatgtttggt

SEQ ID NO: 36844 - DNA, 121 bp, Artificial Sequence
  Synthesized
  misc_feature (61): n=a or g
tacttgttgctcacagtctctataactctgtttgctgtgtagcaaaggcttattttatccntatctgcttggaagcacagagaaagcagaagtgagaagtaaatgggcctcagcccaatcc

SEQ ID NO: 36845 - DNA, 121 bp, Artificial Sequence
  Synthesized
  misc_feature (61): n=c or g
acagaatccaaaagaacattgtcactataaacaacaatgtttgtacttacaataatcctantgttctccaatattgccttcagtgataatattcaatctgcctctacttaaaggcaataca

SEQ ID NO: 36846 - DNA, 121 bp, Artificial Sequence
  Synthesized
  misc_feature (61): n=a or g
actcaaattctactgtacttcaaagcacctgcaatcacagtatactcatttttgattttanaatttaaaacttccacagcaaataataacaactgctcacaaagaaaatttggagaggcca

SEQ ID NO: 36847 - DNA, 121 bp, Artificial Sequence
  Synthesized
  misc_feature (61): n=t or c
acttttaatataataaagcctcagttgaatgtgacaacacctggattaaattaagcatttnggatgctcttctctacctgcatattacctggagtgtttggacagtctgcatttatgcttt

SEQ ID NO: 36848 - DNA, 121 bp, Artificial Sequence
  Synthesized
  misc_feature (61): n=t or c
cagaagcacatacagaaggtcatccaaagcaagaaaagatcctgtataaactactaaaganacatgaagccaataataaggattggttcttcaaaacgtcatttgcaaagagttacaattt

SEQ ID NO: 36849 - DNA, 121 bp, Artificial Sequence
  Synthesized
  misc_feature (61): n=t or c
ttccctgatgaggaaagacctacaccaagacttttttcatacaaatcaccattttatgctncctaatgtacttcaccatcagcagcacctggcacattccatacagttttggtattttgga

SEQ ID NO: 36850 - DNA, 121 bp, Artificial Sequence
  Synthesized
  misc_feature (61): n=t or c
gggaaaatttagcatccggtgcactgtgtctctccatccactacctgcttattgtttcagngcaattaattttctctgtgtgctgggttctttcccccccgcaggaagcaggaaaatgaca

SEQ ID NO: 36851 - DNA, 121 bp, Artificial Sequence
  Synthesized
  misc_feature (61): n=a or g
aatattgacttagtcattcatttttctccctttcatttttctcccttcagttgttgctgcnctcttaaaataggctagacatgcttatttgaacattgagcattaccaacacttctgctct

SEQ ID NO: 36852 - DNA, 121 bp, Artificial Sequence
  Synthesized
  misc_feature (61): n=a or t
aacttattttaatgaatgttggtaacaaaaagctttgcatgtctccatctctatgaaattnagtcaaatacaacctttttcatgtgacattcttaagtgtggagtgatggtaaattatgta

SEQ ID NO: 36853 - DNA, 121 bp, Artificial Sequence
  Synthesized
  misc_feature (61): n=t or c
ttcactgatctactgtaattaaggcacctgtaatgcttatgggatttgggcccttacatcngaagaattttggacttgtgcctccattttaatcaagtgtgggaccggttattattaacgt

SEQ ID NO: 36854 - DNA, 121 bp, Artificial Sequence
  Synthesized
  misc_feature (61): n=a or g
tgtcaaaaagtgatgtgaatacataatttgtagtgcagaataagatacaaaagtgaagtancaaatgtcccaaagacctgatttttaactccacttcaaatacgaggtctggtatttactg

SEQ ID NO: 36855 - DNA, 121 bp, Artificial Sequence
  Synthesized
  misc_feature (61): n=t or c
aatacactttgctatttcggacttttttcctgcagaaagggcatcttggtcaagaggaganaggcatcctgccacttccagaaaggacccagtcatatttccagtaggaccatggtttgct

SEQ ID NO: 36856 - DNA, 121 bp, Artificial Sequence
  Synthesized
  misc_feature (61): n=a or c
aatcagcaaacagataatgtctatattatagcagtctatttttaaatgcggcatggcaacngttctctatcagtgagtaaaccacaaattttgcaattagagaactggggggccttaccat

SEQ ID NO: 36857 - DNA, 121 bp, Artificial Sequence
  Synthesized
  misc_feature (61): n=a or t
agcataattttttttaaacgaacttgaaaattgatgacaatatatagcatcagccataccngcaaaaataaaatctttaataatacttaatgactgatggaaagtacttggagtacttttc

SEQ ID NO: 36858 - DNA, 121 bp, Artificial Sequence
  Synthesized
  misc_feature (61): n=a or g
attatcagttccacaggcagattttcattttgtattttaaatgagctattttgtgcctgcnttgcttttaaactgaggttggatattctcaaaagggaaaagcttctgggtttgagacttt

SEQ ID NO: 36859 - DNA, 121 bp, Artificial Sequence
  Synthesized
  misc_feature (61): n=c or g
tccttccactgtcatacctgctctcctggctcacatgcagcctcgccttcaggatgttatnatgactctctgctcagcatgctttttccttattcttctccttcctccagtgacaccagga

SEQ ID NO: 36860 - DNA, 121 bp, Artificial Sequence
  Synthesized
  misc_feature (61): n=t or c
gacggggtcatcctcaatgggttcaggtctggttggcggctgataacaagcggggtgattnaggtattgatccaagagcctggttgcacatctcagtgaatggatggtgagactgagtgca

SEQ ID NO: 36861 - DNA, 121 bp, Artificial Sequence
  Synthesized
  misc_feature (61): n=a or g
gctactcacctatggctaggagaagagttgtggacaaggtgggcatgtgctttcctgcccntcctcctttggggcaaagcagctggtaccaaaactaccagtccctgcaaagtggttgtga

SEQ ID NO: 36862 - DNA, 121 bp, Artificial Sequence
  Synthesized
  misc_feature (61): n=a or t
acctttgccagatctgtaattcttttccttaatcgtcattcgcattcactactggaacggnggtagtgtagtttgtatggttattactgagctggaatatgttacttctgtgacttatcac

SEQ ID NO: 36863 - DNA, 121 bp, Artificial Sequence
  Synthesized
  misc_feature (61): n=t or c
atttccagatgcctcatccagcctcagcagtgacgtttcagttctctttttgctcattatntactgaagtagcagcagcttttccaatactttctgctaagctgttacagcttcagcttta

SEQ ID NO: 36864 - DNA, 121 bp, Artificial Sequence
  Synthesized
  misc_feature (61): n=t or c
ttatggggaattgtgtcaaaggccctactgaagtccaaacagataacatcagtgtctcttnccatgcccactgatccagctataccattacagagtgccactaggttcatttggcaggatg

SEQ ID NO: 36865 - DNA, 121 bp, Artificial Sequence
  Synthesized
  misc_feature (61): n=a or g
atgcgtgctgggaagctctgcagtcacaaaggacagagaactgataacctgaagccacatnttgccacagacttattccattattatgattaaatcattgagtcccattgagacgaaattt

SEQ ID NO: 36866 - DNA, 121 bp, Artificial Sequence
  Synthesized
  misc_feature (61): n=t or c
aacagattatcaattataccaatgcaatgcaacaacttgtgcaagtaacagaagcagaacngagccttttatctgctctgtttaggcaatttgaatagaaagtgtaagcgtcatcttttgt

SEQ ID NO: 36867 - DNA, 121 bp, Artificial Sequence
  Synthesized
  misc_feature (61): n=t or c
tggacactttctgctctgacagaaaggcattttggatctagcaaatatttttatatttaangctaacacctctaataaaaagcattgtctttataggaatcattttggtggcacctaagat

SEQ ID NO: 36868 - DNA, 121 bp, Artificial Sequence
  Synthesized
  misc_feature (61): n=t or c
agctggcggtatagcttgctgggacaggcgaatttaacttagaaagtctgtgtgctgctangtagctcatcgtttttactttgccaatcagaagcaaaatcaaaacagaactcgcctccat

SEQ ID NO: 36869 - DNA, 121 bp, Artificial Sequence
  Synthesized
  misc_feature (61): n=a or c
gttttaggtagttcaaatccaataacgttttcatactctgtggaagaaggcggccctgaantgatgcagcttttgttattttggtcgtgtctgggaagccaagctgctccagctctggatg

SEQ ID NO: 36870 - DNA, 121 bp, Artificial Sequence
  Synthesized
  misc_feature (61): n=t or c
ttcaggcagaaaaggaatttctacagtttagccttacacatgacaaaaaggacatgaatantgagaggaaataattaaattacataatgagaactatgtagtccattaacacaaatggtat

SEQ ID NO: 36871 - DNA, 121 bp, Artificial Sequence
  Synthesized
  misc_feature (61): n=t or g
ttgggccatcaaaagctaatggcaagaattgctttgtgtttcacttaggttccctgttctncgtcctaagcaggacatggaatgagagatactgtcagcctgccaacgtaccaacaagctg

SEQ ID NO: 36872 - DNA, 121 bp, Artificial Sequence
  Synthesized
  misc_feature (61): n=t or c
attgtcgttcatttagctttactgtgggttactgaacttctgttgtttgaaaggctctcgntgctgaatgacactgagaacacaggctctgcacagacgaatgccccatgctagctctcct

SEQ ID NO: 36873 - DNA, 121 bp, Artificial Sequence
  Synthesized
  misc_feature (61): n=t or c
tttagaaatggtttctgtggtgtttgccttctgctattgtggttacctcagaataatctgnaactacttgcaaacttctattttaaggttttcattctctctaatgaaatatttttcatta

SEQ ID NO: 36874 - DNA, 121 bp, Artificial Sequence
  Synthesized
  misc_feature (61): n=t or c
ggaacgctgagagcctttctgtccactttcactgaatcctttcccagtgtcaccatcaatnccctttcaggaaaaggtttggtgttttgtgtgccaaaagaaacactgggcaggaagacac

SEQ ID NO: 36875 - DNA, 121 bp, Artificial Sequence
  Synthesized
  misc_feature (61): n=a or g
acctgatgacaagaaagcaagttttcaagtctcaaacaaactgacattgactcttgggatngagcaaaaatgacccatgaagtttccatctgctgacagaataaacatctgtagtgctcat

SEQ ID NO: 36876 - DNA, 121 bp, Artificial Sequence
  Synthesized
  misc_feature (61): n=a or g
gttatcccagcaaagtacagtggaagaggtggggccttcttagtgctgcagcctccacacngggcacccctgtgtaccaccagcagagcaatgtgaggagtggtgcacggagaagggtgtg

SEQ ID NO: 36877 - DNA, 121 bp, Artificial Sequence
  Synthesized
  misc_feature (61): n=a or g
tgaggcagctctaattgccttcctgggcccttgaaatagttataatcagagcagcaaaganaaacaggacttcaaagggcgcagctggtgccctcccacagccactatcccaaatgggaca

SEQ ID NO: 36878 - DNA, 121 bp, Artificial Sequence
  Synthesized
  misc_feature (61): n=c or g
tgaaagtggttatgacaaggatagagcattagttagtgacaccaacaaactacattagtantgtgcattttacctttattcctgctcctggaacagggtaaaataaggacagaatatgttc

SEQ ID NO: 36879 - DNA, 121 bp, Artificial Sequence
  Synthesized
  misc_feature (61): n=a or c
agtgaccacacaaaggtgcaccctcatggatttgtttggagatctggaggctgaagtttanagttctttctttgggatactactcatcttccactaaaatcaaaaggagaaaattacttcc

SEQ ID NO: 36880 - DNA, 121 bp, Artificial Sequence
  Synthesized
  misc_feature (61): n=a or g
aaagacttcaagtagttgtgttttctccagatttaggattcatccatattcttgtgaggtntcacaatctgagttacacattccacgaaattcagaaacacagctttattttttatttttt

SEQ ID NO: 36881 - DNA, 121 bp, Artificial Sequence
  Synthesized
  misc_feature (61): n=a or t
ctgcattcatggtagcatccaaggatccatctccagacactgctcattgagtattgttatnaaataaacactgcagcccacaagtgaggaaatctgaagtcttttccaaaggtactttaca

SEQ ID NO: 36882 - DNA, 121 bp, Artificial Sequence
  Synthesized
  misc_feature (61): n=t or c
cgtcccactgatctttacctggtgtgtcccaaggatttgctcctttaggagggcagactgnagcgtagcaagctgtacctactgcagaatggtattccgagggtaactgagaccacaaaac

SEQ ID NO: 36883 - DNA, 121 bp, Artificial Sequence
  Synthesized
  misc_feature (61): n=c or g
gaagagtctgccagaatggggtctttactgctgcgggtgagtctcgggaaggaagaacctngcacagaagattcgtgttgccctctgtatcaacctcctcccttcttgcagggttttgctg

SEQ ID NO: 36884 - DNA, 121 bp, Artificial Sequence
  Synthesized
  misc_feature (61): n=t or c
tgctcacataaatgagctatagatacattagttggaaagattttacacacactgttttccntccttctgacttggagtccatcatcagtgttacgggagtattagaaattcagattagcaa

SEQ ID NO: 36885 - DNA, 121 bp, Artificial Sequence
  Synthesized
  misc_feature (61): n=t or c
taaaagattaaatctatctgaaactgtttttagagtgcccttaaaaccatggattggatgnggttgaaagagtggatgaataataggaaagtgctcttcagaaggcaacaagttgctacca

SEQ ID NO: 36886 - DNA, 121 bp, Artificial Sequence
  Synthesized
  misc_feature (61): n=t or c
aaagaagcaaaaagaaacaaaattagatttggaaggataacattttcagaaagacaatggnaaacaagtacttctacctccttattcagagatattctgtcatgggtttaactttaagttt

SEQ ID NO: 36887 - DNA, 121 bp, Artificial Sequence
  Synthesized
  misc_feature (61): n=t or c
agtcctgcgattggttacaccgaagttgcttgtaaaaatccagttctcctttccctggggntgtcacctttgatttgtaatcataactaataaccaaaaaggaagagacaattactgtctg

SEQ ID NO: 36888 - DNA, 121 bp, Artificial Sequence
  Synthesized
  misc_feature (61): n=c or g
tacattatgaaatgcatcttcaatttcttattcctcgaagatacagattcctttagaccanttcaggagtgaattagtaccaaaactgcctttttccaactccttgagccaaacaaacaac

SEQ ID NO: 36889 - DNA, 121 bp, Artificial Sequence
  Synthesized
  misc_feature (61): n=t or c
cagaaacgccagcagaactgggtagcatcagagctctgccagatgtattaaatgatgttcngtgatcacaacttaacacaagtccatatataagggaatacctgcgaagcaagtgaggagt

SEQ ID NO: 36890 - DNA, 121 bp, Artificial Sequence
  Synthesized
  misc_feature (61): n=a or c
gcttctcccatcctcctttctcccaccctctccagcctttcaagaaagacataatggtacnatttgcaattgagtagggactttaatttgacaaagtaattgtgctttcttttcccccatt

SEQ ID NO: 36891 - DNA, 121 bp, Artificial Sequence
  Synthesized
  misc_feature (61): n=c or g
agaaaaagggtgcacaaaagtcactaaatcagtactacaacactacttaaactcacaatantacaagtgaacaggacataagttcagggctgaaggaaagtaaatacctacatttcattcc

SEQ ID NO: 36892 - DNA, 121 bp, Artificial Sequence
  Synthesized
  misc_feature (61): n=a or g
gcagggagcagccgggctgaattaagtaatgacaagctacattttatataaactgattgtnctgaacgcaacttctggttaagaaatgaagcagttgatgttgccgagtaacagtgcacac

SEQ ID NO: 36893 - DNA, 121 bp, Artificial Sequence
  Synthesized
  misc_feature (61): n=c or g
aaatgttaatttctttgtgttttgtctaggttaaagaaaaataaagcttttcccagatgantttcactaacatgactgacagccattttatttgctacaaagacactctgtggtacctaaa

SEQ ID NO: 36894 - DNA, 121 bp, Artificial Sequence
  Synthesized
  misc_feature (61): n=t or c
tgaaacaagcaagacatagcagaattaaaggctcaaaacactggaccattaaggttaatgnttatttaagcggggaactttccttatgttccccagaccaaaagggcactcagatcgttgg

SEQ ID NO: 36895 - DNA, 121 bp, Artificial Sequence
  Synthesized
  misc_feature (61): n=t or g
ataattagattttgctcacttactgtctgtcaccatcaagtagtcctcaaacttcttctanccttccaagagaaatagttaaccagctgtgaatttctaatgcagaaggcttgttgccttt

SEQ ID NO: 36896 - DNA, 121 bp, Artificial Sequence
  Synthesized
  misc_feature (61): n=a or g
gctcgggagctcattgctgggacacaatggtgccggggcacaaaggtttctggtgtcaccnagaggagaaccccacgtgcagggtggctccattccccaaaatgcagctgcacgggttcag

SEQ ID NO: 36897 - DNA, 121 bp, Artificial Sequence
  Synthesized
  misc_feature (61): n=a or g
taggtctagcagagtacctctaggtactaacttaggagatggggctcagaccaaaattgcntggaattttttattagtgtctgcatagtatgataatgcctaggaaacaggtattagaagt

SEQ ID NO: 36898 - DNA, 121 bp, Artificial Sequence
  Synthesized
  misc_feature (61): n=t or c
acttttgcccagcaaagaatctgatagctgaaatgtgcccagttcaaactggcagctcttnggaacgcagcgcgtgggacggaaaggccagaaattgaacaccgttttgttgctggagaag

SEQ ID NO: 36899 - DNA, 121 bp, Artificial Sequence
  Synthesized
  misc_feature (61): n=t or c
catcagtgtcttgggtttcctctccttccttcccaagccaagggcacgaagcccagtcttngcagcaagcagagacagtgccagcccagcacagcatcccaaactctctggacaagagttt

SEQ ID NO: 36900 - DNA, 121 bp, Artificial Sequence
  Synthesized
  misc_feature (61): n=t or g
ctatttttgtcagccgatttagttattaagatagatcatattcccattagcacggaaaatnttacctttagatcaggatttaccgttgttcaagggctggagctttctcactcctgtctgc

SEQ ID NO: 36901 - DNA, 121 bp, Artificial Sequence
  Synthesized
  misc_feature (61): n=c or g
tgggctgtgtgctttctccatgtactgtggaatgagaaggagtgcacttgaacagaagcancactgctgctgcagctgtttgagttcttgctttagcaggagtgtctctcgttggcgtctc

SEQ ID NO: 36902 - DNA, 121 bp, Artificial Sequence
  Synthesized
  misc_feature (61): n=a or t
ggaatggcttaattgcgtatgtatgtagatggctgctgttcacttcccatcctgcagcatngataatgaagaatgtgttcagatagacagactgccagcacacagccttcttccttattgg

SEQ ID NO: 36903 - DNA, 121 bp, Artificial Sequence
  Synthesized
  misc_feature (61): n=t or g
gtgatgcacatggtgaaggtgggatactggatgagaccatcagcactgattttggctattntttctcctcccacggggcaggaaaatgggttggacaccctctcagggtccattccagctt

SEQ ID NO: 36904 - DNA, 121 bp, Artificial Sequence
  Synthesized
  misc_feature (61): n=a or t
ctttgttatagagcctcactttcttcatacatctgtttctgccactctgctttgaacaggncacaaactgacaacgttccatttgacctaagggtcactaaagtaggatgtgcaacactac

SEQ ID NO: 36905 - DNA, 121 bp, Artificial Sequence
  Synthesized
  misc_feature (61): n=a or g
ttctatgatcctatgatctctttaccaaacctttaccaatgatacgagagaatggatgctncttggtggacacgtaaacatatcacgtctatttcattgtcagggctactgcaagtactga

SEQ ID NO: 36906 - DNA, 121 bp, Artificial Sequence
  Synthesized
  misc_feature (61): n=t or g
tcttttttgaagatatctgtcaatatcagcaacaaaattactgaaagtgaatgacctgagnaactaaaagatgtccatcatcatccatagctaaaagagaatttctcttcgatcagttttc

SEQ ID NO: 36907 - DNA, 121 bp, Artificial Sequence
  Synthesized
  misc_feature (61): n=a or g
ttccctctctggctctgggattttttctttttacagggattaattgaacatatattggtgngttttgttgtaatgggagttgccatgacaactgctacagctctccagaaaaaaataaata

SEQ ID NO: 36908 - DNA, 121 bp, Artificial Sequence
  Synthesized
  misc_feature (61): n=t or c
agaaatagtactcagaggcaggagtttgattctcagggaacccacgagattcattgcttcntggccgaatgggttgtatatgactaagggaaatcaaaatataaaccactccctgcccaca

SEQ ID NO: 36909 - DNA, 121 bp, Artificial Sequence
  Synthesized
  misc_feature (61): n=t or c
aaatggcctttctagggctgatggtttaaatgagcagaacagcaaggcaggcaaatggacntggaattttcatttttctgaagcttctaaatgaaaagcatggaaaatattgggctacaat

SEQ ID NO: 36910 - DNA, 121 bp, Artificial Sequence
  Synthesized
  misc_feature (61): n=a or g
tccactgggtagtacaaaagtggcaatgttgagaaagtccatgctgcccatgggatgcgtnatggtgctgctgtgagtgagagcagagccctagggaaagctccatcctaactcagaagct

SEQ ID NO: 36911 - DNA, 121 bp, Artificial Sequence
  Synthesized
  misc_feature (61): n=a or g
tttttgggacttcccaaagtgagtatgttttcctattcctgttcagaacttcatcagaaanttgatggtgccaagcatttcacagttttacagggctcaagcatgacctaacactttaagg

SEQ ID NO: 36912 - DNA, 121 bp, Artificial Sequence
  Synthesized
  misc_feature (61): n=t or c
tttgttacaaacactaagtacagctaagtgaattaagcctctttaacatcgagataaggcngttagttttcatgcaaatgcactgaatccgtttaatcttcttggaaaatgatttaatagg

SEQ ID NO: 36913 - DNA, 121 bp, Artificial Sequence
  Synthesized
  misc_feature (61): n=a or g
aattacaatatatttaaaaaaagaaaggctctatgtggagcctacaagcaatccatactcngatggatgttttaatatgggccatagtgcaactgtgcaattacaattagtttgggtaatt

SEQ ID NO: 36914 - DNA, 121 bp, Artificial Sequence
  Synthesized
  misc_feature (61): n=a or g
tcttacactccttacacttcagtgtttggttttttttttttatgctggccttctcatttcntttatttagtgacagtcttcttcgggaatggcaaatagatatttcttcccctttcagtaa

SEQ ID NO: 36915 - DNA, 121 bp, Artificial Sequence
  Synthesized
  misc_feature (61): n=a or g
ttttaaagcagtactgaggtagtaaaaaaaaaaaaacctgattacattgtgcttaataagntgaaagctgtagactgtcctcttagtataggaaaatatactatacagaaagaaggaggca

SEQ ID NO: 36916 - DNA, 121 bp, Artificial Sequence
  Synthesized
  misc_feature (61): n=t or c
gacttgtttatccctcccatccaaatttgctttagatgctttaccaagttagatgcaaganttcaatgctatcaactggactgaagttatggtatgacaagagtctgagcatgttttgccc

SEQ ID NO: 36917 - DNA, 121 bp, Artificial Sequence
  Synthesized
  misc_feature (61): n=t or c
gctcgctcttgttgcgttgctttgaggtcaggatttcctctgaaatgcttcttgctctggngctcaagggtgcatgtgcccatggattgctttgggttggagggttgcttagctcttaacc

SEQ ID NO: 36918 - DNA, 121 bp, Artificial Sequence
  Synthesized
  misc_feature (61): n=a or g
gctgttctgatcatatgttgtttgtgctacgttagaatttaattctccaaaagttgccaangcataactactacttatcagatagttgttatttctgttgtttggctcccacttcacaaaa

SEQ ID NO: 36919 - DNA, 121 bp, Artificial Sequence
  Synthesized
  misc_feature (61): n=t or c
ttttagaatcttatttctttgttgaatgccaaattcccatagaagcatacttttccctcanacatccaaacacctgaagacatacaaggtacatcctaattttacttatggcaaagcattt

SEQ ID NO: 36920 - DNA, 121 bp, Artificial Sequence
  Synthesized
  misc_feature (61): n=a or g
ttgcaaatgtatagatcacaaattaaaatcttatggtttcactcatagcttttcattcatnttcatacatatccatattacaagtccttggacgcatagcaactcccattgcagtgttaga

SEQ ID NO: 36921 - DNA, 121 bp, Artificial Sequence
  Synthesized
  misc_feature (61): n=t or c
cctttctgcccccccagctattgtttctccccaaaacgcatgactgatagcttcaccattncaatacaagtggtccttccatagaagcgtctattttatcgcttaaaatatttttttaaaa

SEQ ID NO: 36922 - DNA, 121 bp, Artificial Sequence
  Synthesized
  misc_feature (61): n=a or t
ggaaatcactatataaacaaacagtatctttttttgcagttatggaagaagcctttgttcnaggaattcataagacatacaaagggagtgaaactgtgcagcttctctccatgtgcattct

SEQ ID NO: 36923 - DNA, 121 bp, Artificial Sequence
  Synthesized
  misc_feature (61): n=t or c
cacgactatgggaacatgcagccttgttggccagggagtaacttgcccatggcaaggctcngagtccttgcctggtagcatagtaaaatagagctagggaagttaacaacacgagaaagag

SEQ ID NO: 36924 - DNA, 121 bp, Artificial Sequence
  Synthesized
  misc_feature (61): n=a or g
ggtcactgctgcctctttgctttcctgtttgatgaagcttatacgtgcttcagctctctcntgtgagcaggcttggcagtgtggttttgaagaaataaaaccagaaatcagtgcaggtagt

SEQ ID NO: 36925 - DNA, 121 bp, Artificial Sequence
  Synthesized
  misc_feature (61): n=t or c
aagttcaaatgaatcttggctcaaggtagaaaagtccagctttgaagcttttttcttcccngtttctttcctgaaagtggtatgagcttgaggaacagagatgctcatgaagctgctttgt

SEQ ID NO: 36926 - DNA, 121 bp, Artificial Sequence
  Synthesized
  misc_feature (61): n=a or g
tcactttgttttttgaacaaaaaacctctcacatgtcacaaaacaggtaccttcaggcccngaggagccagaacaactgattcagtgggctgaaacctggtgttagctgaggaagctattg

SEQ ID NO: 36927 - DNA, 121 bp, Artificial Sequence
  Synthesized
  misc_feature (61): n=t or c
actggcacggtatctatgtagggcaatttatgtgagctatttgcacccatgtgccttgaanagctgcatgtattccattggaagtctatgggccacaagcacaatcagggcaagaaaattg

SEQ ID NO: 36928 - DNA, 121 bp, Artificial Sequence
  Synthesized
  misc_feature (61): n=a or c
cttttaaaggaacagtcatagaaaaataatactttactattaaacctatggcattttctgntgctcagatgcagtctgattttgcagcctctctgctggtagaactcttgatgaaattagt

SEQ ID NO: 36929 - DNA, 121 bp, Artificial Sequence
  Synthesized
  misc_feature (61): n=t or g
taagttaactgggaggctgtgtgttcctataaatgaaagaagtttgacacacattttcacntatgcttttattctgatttaatttattccattgtccatatgacaaagcttttgcatgata

SEQ ID NO: 36930 - DNA, 121 bp, Artificial Sequence
  Synthesized
  misc_feature (61): n=a or c
aacaaagcagaagaaaatcctcttgaaatgtgaaggacagatagcctcttaaaatataganacacatacagtaagttgttccagacacgttcaaagatacagtcttttttcagtgccctgt

SEQ ID NO: 36931 - DNA, 121 bp, Artificial Sequence
  Synthesized
  misc_feature (61): n=a or g
tttcattttattttattttattttattttattttatttttaattgaaagagtcttgcaaanacctggacaagttttcctggggaagagtttttttttactttaagaaaacatttatttttc

SEQ ID NO: 36932 - DNA, 121 bp, Artificial Sequence
  Synthesized
  misc_feature (61): n=c or g
ttttttaaagtagctgaacaattcatttagttactgaactaactggtcagtaactaaatanacaactgaggactcttaggtgtgaaagagagaagagaaatgatttgcaggttgtggttag

SEQ ID NO: 36933 - DNA, 121 bp, Artificial Sequence
  Synthesized
  misc_feature (61): n=t or c
agcttaaataatagagacatatttgccttttcagatgtaaataagtgacagcttttgtacngttcaggcctcagtatccttttaatgttttaagccagaaccatgggccataatgaatcgg

SEQ ID NO: 36934 - DNA, 121 bp, Artificial Sequence
  Synthesized
  misc_feature (61): n=c or g
gttttcatggaattaaatgggaggcattactttcggaacaacctatgcagattgtctgatntgataaaccagggttttcttcagagctaaacttcaaactttcatcctatcccgtactttt

SEQ ID NO: 36935 - DNA, 121 bp, Artificial Sequence
  Synthesized
  misc_feature (61): n=a or c
ttcctctttatcttttctagagttttgttcttaacatcaattttggtagccagcagaagantgaatatgttaaaatcttaagcaaatcaaatccagttacaagatgagaacaatgctgcaa

SEQ ID NO: 36936 - DNA, 121 bp, Artificial Sequence
  Synthesized
  misc_feature (61): n=t or c
aaaaccatttcctttgcaagtagctggctatagcatttgcagggaagtcgatcaactttcnatagctggcagtcaaaattagttgaaagccagtgaaaaagaatacttcaaggttatactt

SEQ ID NO: 36937 - DNA, 121 bp, Artificial Sequence
  Synthesized
  misc_feature (61): n=a or t
ggggtttctcaaacctctttacatcgtgctttgacagtcagttcacctatgcatcatccgngtttgtggaatggcaaaaaccatattaattcaggtagaaatttttcagaataaagttaca

SEQ ID NO: 36938 - DNA, 121 bp, Artificial Sequence
  Synthesized
  misc_feature (61): n=t or g
cttggatgattgctcttggttatttaatagtgtatgctctgtaaaagcagggggagggagnaaaattaagcttctattataaaactgtagaagaaaattaaatgcaaatgtttgcctggtg

SEQ ID NO: 36939 - DNA, 121 bp, Artificial Sequence
  Synthesized
  misc_feature (61): n=a or g
taaagcaaaatatgccctgctacaaactcctctgaaagcctatacatctagcttatcattnctgcctgttcacttactgtcagccaagagtttatcttttaaaaacaaagaaacaaaacca

SEQ ID NO: 36940 - DNA, 121 bp, Artificial Sequence
  Synthesized
  misc_feature (61): n=t or c
tgctgagtggatagacagggataggcactgggcagaaccagcacgcgttgtgtcatcctgntttcactgacccgtgagaaatagggcataattcctgtgaagtctttggatttcctcattg

SEQ ID NO: 36941 - DNA, 121 bp, Artificial Sequence
  Synthesized
  misc_feature (61): n=a or g
actgccccatgcatcaccctgttacccagtatctcaccctattgcctcatgcggcaccctnttgccctgtacagtaccctaccaccccttccagcaccatgttaccctatgcatcaccctg

SEQ ID NO: 36942 - DNA, 121 bp, Artificial Sequence
  Synthesized
  misc_feature (61): n=a or t
aaattaggagactagagtagacatggagaatgggaaaaacagttcttatttcagaatattnacttaaatattttaaaacttacaaaatcctttaagtagtctaaacaaacagtaaacacat

SEQ ID NO: 36943 - DNA, 121 bp, Artificial Sequence
  Synthesized
  misc_feature (61): n=a or g
tggtcttctgctcctttcagtgcgttcgttgggtctctgatgcatcaggtggtgctgatgnggtggttctgctgagcagtgacctgtagtagcggcagcaaacacctgaaagcttgcgccc

SEQ ID NO: 36944 - DNA, 121 bp, Artificial Sequence
  Synthesized
  misc_feature (61): n=t or c
catcctttgttggttttttttgcctctgtaaacaaatggagaaattaagtgagcaattctncacataattctgagtaaagaatcgtgttagctcttaagttctgaagttctgaaggcagct

SEQ ID NO: 36945 - DNA, 121 bp, Artificial Sequence
  Synthesized
  misc_feature (61): n=a or t
acatatagaacaatgatttcctatttactgagataacgatgaacacttacagtactgacanaataaaactccctgcaacctaaaaagttaatttctatgtttataatattggtcccagtgg

SEQ ID NO: 36946 - DNA, 121 bp, Artificial Sequence
  Synthesized
  misc_feature (61): n=a or g
acgtgcttctctcctacctgtggtttaatcaagcgatcgcagctccatctttccattaaanaagatggtgcctggtgtttaaattcttcatgaaatagagtaaaaagacagaagcagctta

SEQ ID NO: 36947 - DNA, 121 bp, Artificial Sequence
  Synthesized
  misc_feature (61): n=t or c
cgcggtatcaccactcagctgtggtctacgggagcagcatgtttgtgttcggtaaggcagnagcaggttacagctctctgtgtttggaatgatagctgtgacggtgctttgttatctgaaa

SEQ ID NO: 36948 - DNA, 121 bp, Artificial Sequence
  Synthesized
  misc_feature (61): n=a or g
accctgctaacacatgttaacagtcctggctgctccttctaaagcacattttcttacagcnctattaccgctaccacccatttgctgtcctctaatgagtacctcaaaaaatcctcatcgt

SEQ ID NO: 36949 - DNA, 121 bp, Artificial Sequence
  Synthesized
  misc_feature (61): n=a or t
gtgccctgacttttaaaagttattctacaagcttctgttctaagaaaatgcgatgcccatntaaataataacttttctgcttaaagagttaaaacacagttctgtaattctacttgaagct

SEQ ID NO: 36950 - DNA, 121 bp, Artificial Sequence
  Synthesized
  misc_feature (61): n=t or c
agctctccataattataaacattgctatcaccctggatgcacaaacaagcttcaaccagcntcagcctgtattcatccagtgaaaatggaattagtaagactcgtaatactataacaacct

SEQ ID NO: 36951 - DNA, 121 bp, Artificial Sequence
  Synthesized
  misc_feature (61): n=a or t
tgctttttttttttttccttccagtctagaggcttattctacttcgatatcaaactcagantaatctacataaatgcctcagcgttgaaaaactctcttttaatatccagaacactatcat

SEQ ID NO: 36952 - DNA, 121 bp, Artificial Sequence
  Synthesized
  misc_feature (61): n=t or c
aaaaatatcacagtccccgatccactgcaactgctcatcaccgtttggttaagccaacacngcatgggaggactctcccatttccctcaggtaacgtcagctaacattttaaatagtgtaa

SEQ ID NO: 36953 - DNA, 121 bp, Artificial Sequence
  Synthesized
  misc_feature (61): n=t or c
gcttagaaaaagctgattctacagcacgacatacagccatctggaaaccaggtttaggttncccgcaaaacagctctgtgggacacagcattagaactagcaggtatcaaagcaaggttgc

SEQ ID NO: 36954 - DNA, 121 bp, Artificial Sequence
  Synthesized
  misc_feature (61): n=a or g
cacagccactctcagcataaagaaacgcatagatggtatacataacgtgtgcttttctaanttgggcagcttttccatgccagatccctggcagatctcccagtaaaaaaaatttgctaaa

SEQ ID NO: 36955 - DNA, 121 bp, Artificial Sequence
  Synthesized
  misc_feature (61): n=c or g
tgcaggcaagtttgatgctatcctgttgtgctaatggattaattacaaataggtaatatanctaaatctggtaccctctaagaggcacctcagtgttgagaaggggctggaacaaagacaa

SEQ ID NO: 36956 - DNA, 121 bp, Artificial Sequence
  Synthesized
  misc_feature (61): n=a or t
tgtgataccttgctaaatgctgctctggaagggctgttctggggcctcagcttcattctgngtgaacctgcaggtcctggcagccccattcccacccatttcccaggaagtttcagtgaag

SEQ ID NO: 36957 - DNA, 121 bp, Artificial Sequence
  Synthesized
  misc_feature (61): n=a or t
tgtcttgtctacattcttaaggcctagctatgcgtgtgcttgaatattcttgattaaaacnctcctctaaataagatttcatatcagttctgtaaaatacaaagaatttctcaaggctaat

SEQ ID NO: 36958 - DNA, 121 bp, Artificial Sequence
  Synthesized
  misc_feature (61): n=t or c
tgtcagcggtttgctgtaattagcttccctgtgctgggaatgcctcgttatgaggcggctnggtgctgccctggtctcaggagtacaactgacagcaaggggtggtgcttaatagacacaa

SEQ ID NO: 36959 - DNA, 121 bp, Artificial Sequence
  Synthesized
  misc_feature (61): n=a or g
tgacacttgcatttacaggcgtgaaggatgggctcctggcacccacaaacgcagtgcagtnctatgggatccaccattggtcggtgccaaactcccccccagcctggcagtgaaggcccca

SEQ ID NO: 36960 - DNA, 121 bp, Artificial Sequence
  Synthesized
  misc_feature (61): n=a or g
ctgaatgccatttgtggtccctttttattttgattttctttcccccaggtaacattattcntatgcattgtttgtagtgtcaatggcatgcaggaaatactcagatatactctgagtcttg

SEQ ID NO: 36961 - DNA, 121 bp, Artificial Sequence
  Synthesized
  misc_feature (61): n=t or c
gctatttctatgttccttgagatcccaaactcaaccaaggtgctactgcagcctaggctgnctccaatcttaactttttctgtgatcgtctccatgttggtgagagccacgtccagcaaat

SEQ ID NO: 36962 - DNA, 121 bp, Artificial Sequence
  Synthesized
  misc_feature (61): n=t or c
ataaaatatcctaaattaacttattttaattaggattttaattaataaacatttatatttnctaatatagaatactcaagagctaagcaaaccctttgtccttatcttactgtgttttaag

SEQ ID NO: 36963 - DNA, 121 bp, Artificial Sequence
  Synthesized
  misc_feature (61): n=a or g
ccagaaataagatccctctcaagtcagactgtctgcagacaactcagaccacccactttcngctcaaacacagcctgttcaaagtctgcggcagctcagatcagagcagtagctgtctgct

SEQ ID NO: 36964 - DNA, 121 bp, Artificial Sequence
  Synthesized
  misc_feature (61): n=t or c
cagtttgctgtattgcagctgttttgggacttaacaacacttgggttattgacctaaatcngcacagcctcatctggaaccgtaacggcccattgtgtgccagggcctgctccggactcct

SEQ ID NO: 36965 - DNA, 121 bp, Artificial Sequence
  Synthesized
  misc_feature (61): n=a or g
cctgcagcctccctgccattactacttctgctgcatgatcccacttgcaggtgcagtgacngtaacatggatcactcaaatgcacagcacggtggctgtgccagcataagggatcacagat

SEQ ID NO: 36966 - DNA, 121 bp, Artificial Sequence
  Synthesized
  misc_feature (61): n=a or t
gtatttttatccaggttttcatagaatatgtcctgaattccacgaaaaagtgatagtcctntggaacgaggattctcttgctcattttgttcgctctcatggaagtacttgtctgtagaaa

SEQ ID NO: 36967 - DNA, 121 bp, Artificial Sequence
  Synthesized
  misc_feature (61): n=a or g
cccttctcggtctatcagttacacattttcaagacacttactccaatgttgttgcatctcnccaccacatctctgaattcattttcattgcctgattgactgcagatcttgtagctgatgg

SEQ ID NO: 36968 - DNA, 121 bp, Artificial Sequence
  Synthesized
  misc_feature (61): n=t or c
cctttccaagctgttactggagcacaacctctcatctggtttctcacaggaggttgttaanggtattctcttaaggtagactcgctcctccttatagagaccaaattttctccttaattgc

SEQ ID NO: 36969 - DNA, 121 bp, Artificial Sequence
  Synthesized
  misc_feature (61): n=t or c
ctccttcctcccagctccaacaaggcagcagctgagtgggcaccgaggcgattattatttncttctttgtaagggtggacgtttagggttttttttgcctgatttcctggtattttcccag

SEQ ID NO: 36970 - DNA, 121 bp, Artificial Sequence
  Synthesized
  misc_feature (61): n=a or g
aaagaaaccccacaggctgaaaactgttccgagtctttaattagccaaaaaaacaaagagnttacaggaaaatgagagttaaagaggggatcccaggagagtgcctgcaataccccacctc

SEQ ID NO: 36971 - DNA, 121 bp, Artificial Sequence
  Synthesized
  misc_feature (61): n=a or g
gtccaggcaacctaggatgagagccgccttccccatagctgtgatgactgtccagtcactnctggcttcactgggcccaagagtcctgctctggggctggcttgattccagacttggagca

SEQ ID NO: 36972 - DNA, 121 bp, Artificial Sequence
  Synthesized
  misc_feature (61): n=c or g
tcctccccttttgcgttgctgagacctcagcttcattacgaaggaggcttcagataacccnttgtcatttcagcttcgctccactcaggagctgcatctcatctgccatgtgtgcactgct

SEQ ID NO: 36973 - DNA, 121 bp, Artificial Sequence
  Synthesized
  misc_feature (61): n=t or c
ttaccaaccactgtgagaactcatcctgaatctctttttttcacactgtcaaaaaaactcnaccaacacagcacttcatctttgctacaggtactgacatctccactacctacgctatcac

SEQ ID NO: 36974 - DNA, 121 bp, Artificial Sequence
  Synthesized
  misc_feature (61): n=a or g
tcagcagttttccaaccactctgccccaagcctgtagcagtgcatgaggtttttgttaccnaagggcaaaactcagcacttgatctttcttaaagttcatcccattggcctcagccaatcc

SEQ ID NO: 36975 - DNA, 121 bp, Artificial Sequence
  Synthesized
  misc_feature (61): n=t or c
ttcatgtcttaagacatcaaatgcataacgtaaacagtgcagtaaacgcgcctacctttgnacacaaatatatgtacatttgctgccaacatgtttagacactggttttgatgatacttct

SEQ ID NO: 36976 - DNA, 121 bp, Artificial Sequence
  Synthesized
  misc_feature (61): n=a or c
acaacttccctcggcagcagtgccagggcctcacaaactgcaaaaaatcaccatccagacnaaaaaaatctcagcaacacgatgcattccctagcagcatccggagttcaaacccaccaga

SEQ ID NO: 36977 - DNA, 121 bp, Artificial Sequence
  Synthesized
  misc_feature (61): n=t or c
tatcagttttctgctaatggccttagagatttggagaaaataatctgagtattgagcttcngagggaactcagttaagtctgccttttggattattgttttgggatctgtatgatttaaaa

SEQ ID NO: 36978 - DNA, 121 bp, Artificial Sequence
  Synthesized
  misc_feature (61): n=t or c
gctgccggccagaaggctcctgtctgcacaatgtttgcccccaaaccagtcccaaaacagngcttctttcagacatggcttttgccatttcttgtctttccgtagtacaagtctcaggtct

SEQ ID NO: 36979 - DNA, 121 bp, Artificial Sequence
  Synthesized
  misc_feature (61): n=c or g
ttaagcagtgctactctcctttccagcacacaataaaagttttgacatcaaaaataatatnatcaaaatctgtttatcacagtagttaatattactttcacggttagttcatttaggtgtt

SEQ ID NO: 36980 - DNA, 121 bp, Artificial Sequence
  Synthesized
  misc_feature (61): n=a or c
gtgaacacagcagctgagcagccgttgtgtggctgccatccctgatgggttttatagattnttctaaggaaaaggcatatttcaaaggaagttatgctctactgttaggagcaataacgtt

SEQ ID NO: 36981 - DNA, 121 bp, Artificial Sequence
  Synthesized
  misc_feature (61): n=c or g
atcagataatgttgtttgtctgaatgccaaagcaatgaactgtaaaggcaaatttattagntgttgcaccttttatttctatttcagttaaagaataattctttttttctgttaagagcac

SEQ ID NO: 36982 - DNA, 121 bp, Artificial Sequence
  Synthesized
  misc_feature (61): n=a or g
gttctgtcttttttgcttacttcttttgtatctcaccctttgaataaaatcaagtgccctncattaaacaagtggaattactggtctttagttaaatacacgtaaaagtatcaagcaagca

SEQ ID NO: 36983 - DNA, 121 bp, Artificial Sequence
  Synthesized
  misc_feature (61): n=a or g
attactactccatacctcctaacatcagtaaactgaactgagtttcttctggagcaccccnaccaatccacagctagaaagaagagatacgtagacatactatgacggtaacaagtatttt

SEQ ID NO: 36984 - DNA, 121 bp, Artificial Sequence
  Synthesized
  misc_feature (61): n=t or c
cagctgtgaatgaattttcaggactagagcagtatgctgctatatactaacgtatattgcnatctctgaaatagagaagtgctttttctggcacatgagaataggcaaatgagatataagt

SEQ ID NO: 36985 - DNA, 121 bp, Artificial Sequence
  Synthesized
  misc_feature (61): n=a or g
tctaaaaagaaacagcttcaagtgaggtgaaagcttactctgacttgctgtctatgatacntaaggccacacgtcattttgggctaagccctcatcgtcactattgcagagcagtgatgaa

SEQ ID NO: 36986 - DNA, 121 bp, Artificial Sequence
  Synthesized
  misc_feature (61): n=a or g
ccttaggcagttctttagcatttctccacttcgctgtgctgcaaaactgcttattttcacntgtagtaaattgttgatgaattgattgattatataaagcttattataaatgattgtttgg

SEQ ID NO: 36987 - DNA, 121 bp, Artificial Sequence
  Synthesized
  misc_feature (61): n=t or c
cagtttattggatgggttcattacaatactgcagtgtgcaagataggccttgcacatattntgttcccaggctttttgaataaaatggttgtactcaagactgcatattgacgtaccactg

SEQ ID NO: 36988 - DNA, 121 bp, Artificial Sequence
  Synthesized
  misc_feature (61): n=t or c
tattgctcacagctgaggtgagacatgcatggggcaaacgggggcaggttagaaagcaaantgtactgacttcttatttggaaagcttatggtgtttcctaaatgaaatgtaaattttgag

SEQ ID NO: 36989 - DNA, 121 bp, Artificial Sequence
  Synthesized
  misc_feature (61): n=c or g
agaccacagggcagggctgatagcactgccttgtttactggccgtgatctccgctccgctnagacctcactgggatttcttactgcttcacgggaaaattgccttgcaaaaggcaatcgca

SEQ ID NO: 36990 - DNA, 121 bp, Artificial Sequence
  Synthesized
  misc_feature (61): n=a or g
ccattactgcaggccctttatcaatctctggtaagttttgcttttgttattatagagcacnttagacaagcctgcagccttagatgtcaactggacttcctgaagagtataaagttgaggt

SEQ ID NO: 36991 - DNA, 121 bp, Artificial Sequence
  Synthesized
  misc_feature (61): n=t or c
gcccacggtggaggcccccaaggctgtcagatccctccaggcagcctccacagaaggtccncattgccagtctccctgctctgttctagggctggattgctgctctgaatgccatgggacc

SEQ ID NO: 36992 - DNA, 121 bp, Artificial Sequence
  Synthesized
  misc_feature (61): n=a or g
tttagttgccatgtgacagacactgaggatctggccaaaaagaggaggctgtttgcttggngaagttctcttggatctggtgtattttgacacagaccgtcttcaggcgctttgtaaagca

SEQ ID NO: 36993 - DNA, 121 bp, Artificial Sequence
  Synthesized
  misc_feature (61): n=a or g
gtctgaatgatctaaaggagtaaaagagaagtaaagaaataaagatttaagtaaaggaatntctgactggcaaagatttacacattttattgagagcatgagcaagcaaattgcccaacat

SEQ ID NO: 36994 - DNA, 121 bp, Artificial Sequence
  Synthesized
  misc_feature (61): n=a or g
tctgcacaagggacattttccttgcaagaacacggactacaaagagttaccagttcttctnccccctgtaagagaacagagagggctgaacctccctccagcagtcctgaccacccacccc

SEQ ID NO: 36995 - DNA, 121 bp, Artificial Sequence
  Synthesized
  misc_feature (61): n=a or c
tgctgttcaggaactgatgaacagaagtccacaagggttcagccacatgaattaattcacnctgttggcagcttcaatgaagaatcatgaatcgaaattttcagttttcttcagggatatg

SEQ ID NO: 36996 - DNA, 121 bp, Artificial Sequence
  Synthesized
  misc_feature (61): n=t or c
gaaatgaattacagtggttggcctttggggttttaacacggctatgcaggcatttgggtanggaggagggctgccctttattcatcagcacaacaaactgtgtgtgcttgtgggcaggatg

SEQ ID NO: 36997 - DNA, 121 bp, Artificial Sequence
  Synthesized
  misc_feature (61): n=t or g
taagatgggatagaaacttgctagcatgttccattttgctatcatcatggtcttcaggagnaaaccagaccatgtatgatcttaaatacatggagaaaataggtttatgaaggagatttac

SEQ ID NO: 36998 - DNA, 121 bp, Artificial Sequence
  Synthesized
  misc_feature (61): n=t or c
aaaggatttcataccttagtccatgtacaatgactttgtatgtagcttatgttgaaagatnatcttgcatttctctctgaacatttctctttttgctagacaagcaaacttgaaaaaacta

SEQ ID NO: 36999 - DNA, 121 bp, Artificial Sequence
  Synthesized
  misc_feature (61): n=a or g
acagcatggaccttgaattgcaggtgtgtttgttatgtatctttagacaaaattggtcagncataaatgaacacagggatatttgtttgcaattgaacaaattctttagctacacttcagc

SEQ ID NO: 37000 - DNA, 121 bp, Artificial Sequence
  Synthesized
  misc_feature (61): n=t or c
gggctctgcctgctccgtctgcacagaactgctggcagatcccacagctgtttggtacaangaccacacaggtatatggagatgtccaacgtgccgtgcctgaaacatcacacacagctca

SEQ ID NO: 37001 - DNA, 121 bp, Artificial Sequence
  Synthesized
  misc_feature (61): n=t or c
ttatataaatcctatatcaacacaaagtattgttatgttttcaatttataattagcaagtngggtattttgtgtcctgaactgttttatctatctggaataacaacgtataatatagtttt

SEQ ID NO: 37002 - DNA, 121 bp, Artificial Sequence
  Synthesized
  misc_feature (61): n=t or g
gtgaagatgtggatccctgatgtctactgaactggacaggcaacagagtccccttcagttntctccaggatttatcctccaagagcgtggcttttactgagttgcattgcagggagttaat

SEQ ID NO: 37003 - DNA, 121 bp, Artificial Sequence
  Synthesized
  misc_feature (61): n=t or c
tgccctaagaggcttcgtggctttctctgaacctacagcatttttccaaaatgggagctgngctgtgggaagggtcccattactcaggatcaaatgcatcgattatctgcacccatacaac

SEQ ID NO: 37004 - DNA, 121 bp, Artificial Sequence
  Synthesized
  misc_feature (61): n=t or c
cgcttggtggaaattcattaggagatggaaaacccatcctaactaaactaccatgatcatntgtgggtacattaatgagcctgctgtttgttaaaggatgcagtaagtcacaatggaacat

SEQ ID NO: 37005 - DNA, 121 bp, Artificial Sequence
  Synthesized
  misc_feature (61): n=a or g
tttcttctaattcatcagtgaggatcagtttgctggcagcagctggaaaatgatagcaatntaagtgaagaccctcactattctacttacagagcaatacacatttcttttgctttcattt

SEQ ID NO: 37006 - DNA, 121 bp, Artificial Sequence
  Synthesized
  misc_feature (61): n=a or g
gcctttaaataggtttaaattccaatctgaatgtataggcaaatgcatgaaacagatcacnaaataaaatcctaccgattttgtttgaattatataatttttaattctacagtgtttagat

SEQ ID NO: 37007 - DNA, 121 bp, Artificial Sequence
  Synthesized
  misc_feature (61): n=a or t
gtctgacaatatgtaaattggtatactttttgagaatggaaatgtaggattgttacggtcncctaagaaaggtgccagcattaatatcttttgcatcttgtgctacattctcattgaaacc

SEQ ID NO: 37008 - DNA, 121 bp, Artificial Sequence
  Synthesized
  misc_feature (61): n=c or g
gtaacttaagtagcatctctagttgacaaaggaacatgtcagtaggggatttgtctcatanttgtcataaagtcagaactgactttaagaagatactggttatttttcttttttaaaatgt

SEQ ID NO: 37009 - DNA, 121 bp, Artificial Sequence
  Synthesized
  misc_feature (61): n=a or c
attattatagctgctaggtattggtaggagtaagaatttgttttcctcacatgagttaaanctaacaatgcagtatgctgaagtcacagatatttcatgagtgtggattgttttaaaagct

SEQ ID NO: 37010 - DNA, 121 bp, Artificial Sequence
  Synthesized
  misc_feature (61): n=a or g
ggaggctgagagggcaaagctcagtcttcacgtggaccctgtagggccatttacattccantgaggtcctcattaagatcatggaatcatagaatgattggggttagaagggacctttaag

SEQ ID NO: 37011 - DNA, 121 bp, Artificial Sequence
  Synthesized
  misc_feature (61): n=t or c
tcagggacccgtgaccccgagacgagtgatactgagggttatgttctcagggggttacgtntgggggtcgtttttcagatgcggtgcattaaaggcacgttgtgtcactgtgtggctttcc

SEQ ID NO: 37012 - DNA, 121 bp, Artificial Sequence
  Synthesized
  misc_feature (61): n=t or c
aaaacttcgttaaaaaagtagacaaaaatgagccactccttttacaaattgtcatatgttnttggctcctgaagagagtttgaattctggactgtaaattacacaagaggagcatctctag

SEQ ID NO: 37013 - DNA, 121 bp, Artificial Sequence
  Synthesized
  misc_feature (61): n=a or g
gtttctttaaaataggaagaagaaaggtctggcattcacttggaatgctgagatagcccanagtttcagatataattcgcaccatcaggcacagcatatagtaatcctccatgatgatgtt

SEQ ID NO: 37014 - DNA, 121 bp, Artificial Sequence
  Synthesized
  misc_feature (61): n=t or c
cttggtgcttatttcttgggctgaaggcagtgatccacaggtgggaagagcttagagagancccaaacacctttagcccacggtggtgagtttgcatcaactacacccaaattggttcctt

SEQ ID NO: 37015 - DNA, 121 bp, Artificial Sequence
  Synthesized
  misc_feature (61): n=t or c
tggaacaagggctgaggtgggtctattggtcagggcacaagggagtaatgatacttccaantgaccagagttaggactgctgggtaatgtggaccctgcaacatatcttaagtatcatgcc

SEQ ID NO: 37016 - DNA, 121 bp, Artificial Sequence
  Synthesized
  misc_feature (61): n=a or g
caaataataagttcctaaacatcacctggtccacagtaattgcacagtagttacatctttntagcttgtgaaaaatggggaacaatttggggaagtatcactttcaagaaaaaaaatgcat

SEQ ID NO: 37017 - DNA, 121 bp, Artificial Sequence
  Synthesized
  misc_feature (61): n=a or t
gagggaactgttggggtacccacagtgctgagagcagtgcctgagactgctgggtgacaantttctgcctacgtgcagaatctcctttcccacctttgtctgcattctctcccttctgcta

SEQ ID NO: 37018 - DNA, 121 bp, Artificial Sequence
  Synthesized
  misc_feature (61): n=t or c
tgctgggtattcactgagtgggctgaactacagctatacagtgcccagctgttcctgcttnccaacagggtattttgccggcttcgcagcaaaccagctacaactggtgttggcaccaagc

SEQ ID NO: 37019 - DNA, 121 bp, Artificial Sequence
  Synthesized
  misc_feature (61): n=a or t
aaggtcctgttttgtagctttccaaccctgaattttagttttattaaacaagacaggaacntcccttgctctggggaaaaaatcattagatgcagctagttccaccctgtctctcttatat

SEQ ID NO: 37020 - DNA, 121 bp, Artificial Sequence
  Synthesized
  misc_feature (61): n=a or t
tatactccatctctccttgggctgagtccctgtaccctctttggttttccagaccagaaangatggaatatagctacagaatcctttgaactggaagagaccttcaagatcgtctacttcc

SEQ ID NO: 37021 - DNA, 121 bp, Artificial Sequence
  Synthesized
  misc_feature (61): n=t or c
gaagtgttgtttttctttatacctttataaattctgtccttcagaccaaattattatatgnttaactgctgaaaattggacacctttttgctaaaaaaaatctctgaaagagtttacaaaa

SEQ ID NO: 37022 - DNA, 121 bp, Artificial Sequence
  Synthesized
  misc_feature (61): n=a or g
ttgcatctcactgacaccctgcgatcttttagggcgttctggaggctgcccctgctaatantgatgttatgctgcacattagcttttatcactgttctgctaacttgcttactagagacga

SEQ ID NO: 37023 - DNA, 121 bp, Artificial Sequence
  Synthesized
  misc_feature (61): n=t or c
ctgtgtgtagcagtaaatgacagaggtacaaactggaaaacattctttgcagtctcacttnggctggccatgaaaagggaaaaacaaatcaaaaatacatcagaataaaaacccattaaaa

SEQ ID NO: 37024 - DNA, 121 bp, Artificial Sequence
  Synthesized
  misc_feature (61): n=a or c
catagtgatgcattgtaggaggatgagagtcaggaaagtttcaaattgggaatgatgaaancctatttttcccctagaaaaaaacctcaattctggtagcttaaggactttttttctgact

SEQ ID NO: 37025 - DNA, 121 bp, Artificial Sequence
  Synthesized
  misc_feature (61): n=t or c
gtctgtgctaactgtttccttccaaggcaagcaggtcactttattgacttccagaaactgntagcacttagtggcaggctaacaaagtttgtcttttcctgcaaattccttagaataatga

SEQ ID NO: 37026 - DNA, 121 bp, Artificial Sequence
  Synthesized
  misc_feature (61): n=t or c
gcacatttgaccaagggaaagtttgagtgatggaacaagcagagatgatggttagggctgnacagtacctgcctgaagagatctctgttgccttcaagaggtttcaatggaaggaacctct

SEQ ID NO: 37027 - DNA, 121 bp, Artificial Sequence
  Synthesized
  misc_feature (61): n=t or c
agcaaaagcctggggtgacacccgagtttggctggggcacagacatcaggacccaacccanttgccagtgtgtgtgcgagcagcaggtctgtgcacccaaccagcctgtaaaattagtatt

SEQ ID NO: 37028 - DNA, 121 bp, Artificial Sequence
  Synthesized
  misc_feature (61): n=a or g
tagagcttgcagcactgttaagttgaatttacatagcaattcatagagaatttatggttcngttctctgctgtagtctatcctgatcctgtaccgtgaaagaaacccatcagtagtgtcag

SEQ ID NO: 37029 - DNA, 121 bp, Artificial Sequence
  Synthesized
  misc_feature (61): n=a or g
gaaacaccttactggggaacaggatgcatcacaaactacattataataaatgattaagaantaattctgactgcagcaacaacatcagtatacacaatagagcaaaaacaaaggccactat

SEQ ID NO: 37030 - DNA, 121 bp, Artificial Sequence
  Synthesized
  misc_feature (61): n=a or g
aggaagttaagacaaaaggaaggtctgaacaggagttctcagcctggtctgtcccagagcnagggtaagggtgtcgaagtgctctcgctgaatagctctgcttgttgggagcagtggaagc

SEQ ID NO: 37031 - DNA, 121 bp, Artificial Sequence
  Synthesized
  misc_feature (61): n=t or g
ctgttatgttcctttacttgccctggatgtggtgggataaaacgtttccaaaaggctcagntagggctatggaaatcagagctgctgagatatgggtgcagtagaagaccattggttttta

SEQ ID NO: 37032 - DNA, 121 bp, Artificial Sequence
  Synthesized
  misc_feature (61): n=a or g
aactcccatctctgaagaaaattagtagttagaattatcagcaaaaggcagtttgtctgcngtggtagatagaggagcggtatctccgaagaaagaagagctacaaattttcaaataatga

SEQ ID NO: 37033 - DNA, 121 bp, Artificial Sequence
  Synthesized
  misc_feature (61): n=a or g
agtagagttcatacagctcaagacagagacaaaaacgaaaagcagaagactgatactgccntttctttttccaatccaagcacaaactcatccttactaccagctcactgaagacaacaaa

SEQ ID NO: 37034 - DNA, 121 bp, Artificial Sequence
  Synthesized
  misc_feature (61): n=a or t
taattttaaaggtcctcccttgaaatgaactcaaagtgtaaagaggcggggaacaaaagcngcactacccaaaaaaacttcctcaaggtaaacagcctggtcttctacatgatgcagtagg

SEQ ID NO: 37035 - DNA, 121 bp, Artificial Sequence
  Synthesized
  misc_feature (61): n=a or g
tcattgaaatataaatttgttgtgaagttgctcagtcgtgagtaggctgtagactcagtgntaacagcctctgtctgtccttgctgctcccccctggcactgctagtagtacttagtaatg

SEQ ID NO: 37036 - DNA, 121 bp, Artificial Sequence
  Synthesized
  misc_feature (61): n=t or g
agttactgcatggaggtcttaataattcagtgctaatcatgtactaaatgaagatgaaagncaagataacatggaaatggctgccttctatactgtgaaagcatacctatctaccataatt

SEQ ID NO: 37037 - DNA, 121 bp, Artificial Sequence
  Synthesized
  misc_feature (61): n=a or g
tgggaagttccatctctgggagatcctcagctttaagttctgttgcacctgcataataagngcttaattactgttaattataatggaactggactgacacacttgcaggcaatccagaagt

SEQ ID NO: 37038 - DNA, 121 bp, Artificial Sequence
  Synthesized
  misc_feature (61): n=a or t
gctacaggttttccgacacgcctacttgaataaaacgtttcacccggagaaaaaaaaaaanaataaaagaaaatgcttttaaatcctactttatattcctactccacgacagtttagggcc

SEQ ID NO: 37039 - DNA, 121 bp, Artificial Sequence
  Synthesized
  misc_feature (61): n=a or g
gcgaaacaaaacagaagtaattagaaaaggttcgaagaaaacatacatcatccactggttngagcagacctcatatgaggagcagttcagtatgccacaattatccagaccagaaaatcga

SEQ ID NO: 37040 - DNA, 121 bp, Artificial Sequence
  Synthesized
  misc_feature (61): n=a or c
tcctttgcctggggttgctattgagcagtgcttacagagaggtactgtagcacatggtganacccagcagtgctgaagagatggcatccgtttaaacagaggatgaataacaagcacacaa

SEQ ID NO: 37041 - DNA, 121 bp, Artificial Sequence
  Synthesized
  misc_feature (61): n=t or c
gagagttgagatgctaacactgccattacttggcaattgtgggattgaagtgctgcgtttnctaaggcaaggagttctccttacatggctatcatgaagtaattacggtcccttgttaatg

SEQ ID NO: 37042 - DNA, 121 bp, Artificial Sequence
  Synthesized
  misc_feature (61): n=a or c
cagcacacaagctagacttgtaatgtattttcatttagatctgatatctttattttgcctntgaagattttttgatatcataccctttttagcacactgtgtacaggcaaaaaatagtgta

SEQ ID NO: 37043 - DNA, 121 bp, Artificial Sequence
  Synthesized
  misc_feature (61): n=t or c
ctcgtgacagcccagccagggaaggatccctgcagttccagtctactgcaaaccagggtanaaggacagaaggtcttgggctgggggtacaagggagctggactaccagagtgttatcacc

SEQ ID NO: 37044 - DNA, 121 bp, Artificial Sequence
  Synthesized
  misc_feature (61): n=a or g
tgcttttagcattggtgaggaaaataaatacaagtcctgttcaaagtattattgtggactnttaaactccctgctacttctcagtagcatcttgttctctgcctgatgagtgaagcattgt

SEQ ID NO: 37045 - DNA, 121 bp, Artificial Sequence
  Synthesized
  misc_feature (61): n=a or g
ctgcacggtaatcacaccgtggtggcactgcacagggctgggagtgcacagacaggaatgnaccgtggttggaatggttgtgatggtggtggaggtcctccttccaaaccagcacagagct

SEQ ID NO: 37046 - DNA, 121 bp, Artificial Sequence
  Synthesized
  misc_feature (61): n=a or g
tcactttgattcacctgaaaacgttgacagagctcagaggaagatgttctaatcccagtancagatacgctgaatcaggatcacctacttacgtttgatatcttcagttgtagatgcatca

SEQ ID NO: 37047 - DNA, 121 bp, Artificial Sequence
  Synthesized
  misc_feature (61): n=t or c
ttaggcaggttctgcatttgttagataattaggcatggaaaagtctttccttttgtcagtngtgaattgtacattcccttttcctgtaaaactataacaaaaatatctttttaactttttg

SEQ ID NO: 37048 - DNA, 121 bp, Artificial Sequence
  Synthesized
  misc_feature (61): n=a or g
actctgcaatagatttgtatggatatggtctgtatgcgtttatacgcaggtggcaaaacangagtaagccttgccatgttccatagctgtgctgtttatggagcatgaaagtgacaagaca

SEQ ID NO: 37049 - DNA, 121 bp, Artificial Sequence
  Synthesized
  misc_feature (61): n=a or t
gttttttatgtttcatacagaggatagcaatagaaatcacctgatttccttaggtgggtantttttaggggtgatcggggcttttctaggtaatatgacgtaagttgaatctgccttctct

SEQ ID NO: 37050 - DNA, 121 bp, Artificial Sequence
  Synthesized
  misc_feature (61): n=t or c
tctgacgaaagtacagcttgagttcaggctgctgggtcgttttactttttaaaagcttgangtcacagagcacaaaacctgctgcctcaaagttcaagatgcaggtcaccgatgatttcat

SEQ ID NO: 37051 - DNA, 121 bp, Artificial Sequence
  Synthesized
  misc_feature (61): n=t or c
ttaaaaaatcattcttattcggataacagacatatgcttttgatccttgctcttcattgtnggggaaacaatttttcgttgggtgaaaatcaacatttgcagaagatcctgaaagggatct

SEQ ID NO: 37052 - DNA, 121 bp, Artificial Sequence
  Synthesized
  misc_feature (61): n=a or g
agaaggggaataaatgactgaaaatgggcaagtaaaagcagcatcttgatacttttatttnaacagagaaaatacattaaaatacaaatttgaattgggtgttgctttttcccctaggaaa

SEQ ID NO: 37053 - DNA, 121 bp, Artificial Sequence
  Synthesized
  misc_feature (61): n=t or g
ctcctattggcttcagtgcgagagaagtcttcaagagcagacacaatcaggtgttttgttncacctgtgcatagctgaaactaaaagcagaaaaataaaaccctcttctaaacagttaaat

SEQ ID NO: 37054 - DNA, 121 bp, Artificial Sequence
  Synthesized
  misc_feature (61): n=a or g
gatgaataatacgatcagctctactagtagaaatacaaatggccctcacattgccttgtgnggaacagaaatatatactctatacagagtatatgcagaggaacagaaatatatactctat

SEQ ID NO: 37055 - DNA, 121 bp, Artificial Sequence
  Synthesized
  misc_feature (61): n=a or g
ggtgcatggaaaaaacagaaggaggtagagaaaatcccattggaaagggtgtgaatgaaanaggagatgggctgcaagctcagagcccaggagaaaaccaacctctgaaaaactgccaacg

SEQ ID NO: 37056 - DNA, 121 bp, Artificial Sequence
  Synthesized
  misc_feature (61): n=a or g
gttattgcttatttcacttcaagactgaattcattctgatcacatgtttttagcaaaatgnaagcagttacttcaggagtaacattttcaagtaacagatattactgtccatctccacatt

SEQ ID NO: 37057 - DNA, 121 bp, Artificial Sequence
  Synthesized
  misc_feature (61): n=a or c
gtcagaaaatcagttaaatcacaatctgttggttagaagaggaagggttaaatttaacttnttatcagtgaaaatagtggcacatcaaataccactgtgcactgtggcagtgttactggga

SEQ ID NO: 37058 - DNA, 121 bp, Artificial Sequence
  Synthesized
  misc_feature (61): n=a or g
tatcaagacagtttcaccaggcggtcgaaggccatgcaaagctttataaatcagcatgacnagcttacaactgacacaccgctgaacagagaacgctaaagacatcctctgctctgaaaag

SEQ ID NO: 37059 - DNA, 121 bp, Artificial Sequence
  Synthesized
  misc_feature (61): n=c or g
acaatcaatctccatgttcagtttttaactgagatacaaagtattgtagtgtctgttgggnccataggcatttttggtgtttagtttcttgttttccctgcatcaagtaaagcattcagaa

SEQ ID NO: 37060 - DNA, 121 bp, Artificial Sequence
  Synthesized
  misc_feature (61): n=a or g
gtggaataagtgtaggaagcaaaaagtccatcgcatggattgtgacgtgttcaaggtgggnatggaatggctctgaaataacgcacagcagtgtaattgcagcctgggtattgttttgcca

SEQ ID NO: 37061 - DNA, 121 bp, Artificial Sequence
  Synthesized
  misc_feature (61): n=a or g
ggtacaaagcagcaaagaaaaaacaatcagttgccataataagcagaatgaaagagggggnaaaaaaaggaacacaggagaaggtgggtggcagtaagaactgtgattctcaggcagaacc

SEQ ID NO: 37062 - DNA, 121 bp, Artificial Sequence
  Synthesized
  misc_feature (61): n=a or g
gccggtgaggccgccgaagatcaccagcacgtagctcacgtccagctctctcatgatctcntaggctttctcctccgtcgatgccatcgcctgcgggggacccaacggctgtgatgtgccg

SEQ ID NO: 37063 - DNA, 121 bp, Artificial Sequence
  Synthesized
  misc_feature (61): n=a or t
catcaatagaggaagaatcttagaaactcactccatgtggttttagttataggcatcttcntctcctcttacagtgacagcagtttgtgaatggtcccaattctcgtcttcctcattgcat

SEQ ID NO: 37064 - DNA, 121 bp, Artificial Sequence
  Synthesized
  misc_feature (61): n=a or c
ctgggccacactggggaacacggggtatactgtgggcgttctggggcatgcctggattatnttgatttttactgggaacatactggaggggtcccaagagccgtactgggggcatactgca

SEQ ID NO: 37065 - DNA, 121 bp, Artificial Sequence
  Synthesized
  misc_feature (61): n=a or g
aaatacatttgcaccaaaatgtttttaatgttgtgagctttttcatttctgtttggttgangatgctgctatacttgtgttcataatagatctactgtaaacagacctccataacaatttc

SEQ ID NO: 37066 - DNA, 121 bp, Artificial Sequence
  Synthesized
  misc_feature (61): n=t or c
gagcttcctttccctcctcctcctactggcttttggaaaacttcacgccgccccaaaggcnactggacaattcagtccctcatgcattttcaaatgtctcataatacttttgaatacacag

SEQ ID NO: 37067 - DNA, 121 bp, Artificial Sequence
  Synthesized
  misc_feature (61): n=t or g
actgtcatctatacagttacgtccttacaggttactctgtgcaaaataagtttacggtganagggagattctattcaaggtgacagaaagaggggaataaaaataagaaaatggatatttt

SEQ ID NO: 37068 - DNA, 121 bp, Artificial Sequence
  Synthesized
  misc_feature (61): n=a or g
agcatttatttttagaaaacgactctccatttttttccagagaccaaaaaatcactcctcnttaatgctgattaaggtggatgaaatggaaggcatccttccccctcccatctcttgctcc

SEQ ID NO: 37069 - DNA, 121 bp, Artificial Sequence
  Synthesized
  misc_feature (61): n=t or g
cctattttcctggatatggttaaatatctccttttcagttggaataagtaaattaattttnctctgtttacgtatgcagctttactttatctataaagctgtactcatctcgttccatgag

SEQ ID NO: 37070 - DNA, 121 bp, Artificial Sequence
  Synthesized
  misc_feature (61): n=t or c
tacagtcaggtttttaacatactaaaggtatttacatttcaaatggaccaagaagttgttngtagcgatgctcagcttaaacaactgtcattagagtagatgtgaatgaaacacaagttaa

SEQ ID NO: 37071 - DNA, 121 bp, Artificial Sequence
  Synthesized
  misc_feature (61): n=a or c
aattagtgctgttagactaattcatctcaaatattcaactcattgtgtaatagaagaattnattccttgagttaaagggctagagtgagctgcgtacctgcatcttaaacaaacaacaaca

SEQ ID NO: 37072 - DNA, 121 bp, Artificial Sequence
  Synthesized
  misc_feature (61): n=a or g
ctatgtagggatacacagaactctgggtggcatagggagtagtcatggcgtgatacctaantgaagtttaaaatactttgttaaacaactgttaaagctacactgttgtgatttatatgac

SEQ ID NO: 37073 - DNA, 121 bp, Artificial Sequence
  Synthesized
  misc_feature (61): n=a or t
gtgcttctgctatcaatatagatggatgcttttacagaagatgagccctgcagacttggtnttcaggagacgttaaaacaatcccgttcctagctgagtgcctgcttcttgtgaatttcat

SEQ ID NO: 37074 - DNA, 121 bp, Artificial Sequence
  Synthesized
  misc_feature (61): n=a or g
tcctgacagggtgttttgacagctgtgggagctgggaactggaagagcaggtagagccttncaggagtacagggctgagcactgggacctcagctgctgccagcagctctgcccaaaccca

SEQ ID NO: 37075 - DNA, 121 bp, Artificial Sequence
  Synthesized
  misc_feature (61): n=t or c
tcagttcagttaagataagcaagaacaggaaaagcctcgatcacatgagtggatagaaatntattacaagacatacaaagagaaacaagagcattgtgtttatcctgttttttactgtatt

SEQ ID NO: 37076 - DNA, 121 bp, Artificial Sequence
  Synthesized
  misc_feature (61): n=a or t
gtgaatgggcatcaagcatctgtcttagccttccctatttcttctgcccttatgtaaatanacaaaataagaaaaaatcaaaggaggagaagggaatatggtaaggcaggacaaaggtgag

SEQ ID NO: 37077 - DNA, 121 bp, Artificial Sequence
  Synthesized
  misc_feature (61): n=t or c
attttctgaacatagttctctttttaccacaaggttgcattgctaattgtctgaaagcatnttcaacagagaagtaatattatagattgtagcttggtaagttaatccatttatattttgg

SEQ ID NO: 37078 - DNA, 121 bp, Artificial Sequence
  Synthesized
  misc_feature (61): n=a or g
tttctgctgcagcaatttcagagaaggtgtgagcctggtttgcagtggtgttctgacctgnctcgtcagaatgatgaaaatggagcagatgcagactgcttttttttgaaaccgtaggacc

SEQ ID NO: 37079 - DNA, 121 bp, Artificial Sequence
  Synthesized
  misc_feature (61): n=a or g
acgtggaaacatgtctgggaagccagttctgcactatgccaatatacgaggccgaatgganccaataaggtggctactagcagctgctggagtggaggtttgtatgtagttgttatactaa

SEQ ID NO: 37080 - DNA, 121 bp, Artificial Sequence
  Synthesized
  misc_feature (61): n=t or c
attagtcatatgtagcgtgccaattggtttttaaaactaagtcttttgtcttcaaattctnttcaattcaaatcaacatttttgcagagatatttaaaccacttctggaagtgtcacattc

SEQ ID NO: 37081 - DNA, 121 bp, Artificial Sequence
  Synthesized
  misc_feature (61): n=a or g
attaacaagattctcagcaaacatagtttaggcgtgtctaaactgacaggaaagattatcnttattaaggcaacaaataatgatgtttgagaagtattaccgtttctgtaagcattactat

SEQ ID NO: 37082 - DNA, 121 bp, Artificial Sequence
  Synthesized
  misc_feature (61): n=t or c
tacagcacatctgctctggaggactacacttaacagcagttcacttgccctgttgaataanagcgtccaaccaaccagcttgccctcctcctacgctaattcagaggttccttctaaatca

SEQ ID NO: 37083 - DNA, 121 bp, Artificial Sequence
  Synthesized
  misc_feature (61): n=t or c
ctgttgatggtttggctcaaccattttgctgcaatcagcactgtctcgaactctgcttcangcaatggaggctcttggaaatggagagctggtggaactcacatggacacctccattaggc

SEQ ID NO: 37084 - DNA, 121 bp, Artificial Sequence
  Synthesized
  misc_feature (61): n=a or g
tctcaattttattttagtttttttcttgtatttgcatccattgcccattttaattatgaanaggaaaagagttacagaatgctgtaccttaaagtacttactaaagcaaagcccttgtctc

SEQ ID NO: 37085 - DNA, 121 bp, Artificial Sequence
  Synthesized
  misc_feature (61): n=a or g
ctgtgacatagtcaatgttaggttgactccagcattccattggcacatatacacagtatgnacttaactatttccctctgccatactagtgtgaaaactggaaggaaggctggatcaggac

SEQ ID NO: 37086 - DNA, 121 bp, Artificial Sequence
  Synthesized
  misc_feature (61): n=t or c
agattaggacaaatgcactcgggtgcaggtagatgtatacctgctccctggttccttctgnctctctgatgagggcaatgctcatgagcatttgtgctgttagagatatgtgctgtgtctg

SEQ ID NO: 37087 - DNA, 121 bp, Artificial Sequence
  Synthesized
  misc_feature (61): n=c or g
cctgaccttgccacaaccttctttcaagcagttgtagagagcatgaaacacccgttccaanaacatgaaacctgttccaaaacaacaaatattttgtgttcaggaaactgaagttctgatt

SEQ ID NO: 37088 - DNA, 121 bp, Artificial Sequence
  Synthesized
  misc_feature (61): n=t or c
agggtagatccaaaataactgctagtgaatggcctctcaaagctaagcaccaccatgtgtnattttagactcttaagcagagtctgttatgataggacaaggagaaacggtttcaaactaa

SEQ ID NO: 37089 - DNA, 121 bp, Artificial Sequence
  Synthesized
  misc_feature (61): n=t or c
gacattggagcacctgtgctcagagcaaactgtcattcttctttcctgccgtatccgctangaacgggataacaacttcttgaagatgctgaaaggccgtttctctgtcagtgaggtccac

SEQ ID NO: 37090 - DNA, 121 bp, Artificial Sequence
  Synthesized
  misc_feature (61): n=a or g
ggaggggctgcatcagttgtgcttgaaataattcagactctctcctgtttcctagcagatnttcctacactctccaagggaatggaggaaggtcttccatcttggttaacctccagagctt

SEQ ID NO: 37091 - DNA, 121 bp, Artificial Sequence
  Synthesized
  misc_feature (61): n=t or c
caacggacctagatgagaaaggtgacatgccggctcaccggcttgggagagaggtcaaggngctgctcatggctgagatgctttctgatgaagagctcttatgggagatcaaagatgaggc

SEQ ID NO: 37092 - DNA, 121 bp, Artificial Sequence
  Synthesized
  misc_feature (61): n=a or g
tttcctgtataataaaagccatgtaatgtttttctcataacctacattctaaaagaggggnaaaaatggtattatccctgaaaggtattctttgttcttatcagaaatacatttttcaaaa

SEQ ID NO: 37093 - DNA, 121 bp, Artificial Sequence
  Synthesized
  misc_feature (61): n=a or g
ccgggatcctgcacctctccacctcattacttcctcttttgaaggctgaccacaatcggangcaaggtatgcattaattacatgctgcctttaattacccttcctccagaaaggtggagct

SEQ ID NO: 37094 - DNA, 121 bp, Artificial Sequence
  Synthesized
  misc_feature (61): n=a or g
tgatgctgtgtactggtgggcagctctcacattacagctattgctgtttggtgaactggtngaaggacaagtttctcaccatggcagctgtgactgaaactgtgatttgttttcttttctc

SEQ ID NO: 37095 - DNA, 121 bp, Artificial Sequence
  Synthesized
  misc_feature (61): n=a or g
gcaagagcccccctcctgagctggcttttgtcagcagcaaacaaagccacggagatgaacngtggctcctgtaactggaagtagccctcacatgaacactgatacctcttagagcagcacg

SEQ ID NO: 37096 - DNA, 121 bp, Artificial Sequence
  Synthesized
  misc_feature (61): n=t or c
ggattacagcacttcaaaggagaagtaaaattgagaagaattcggtgaacctccttgaagngtccccatttgtgtctgtactaccataataatttggtggatgtttgaagctcctttttct

SEQ ID NO: 37097 - DNA, 121 bp, Artificial Sequence
  Synthesized
  misc_feature (61): n=a or g
agctggtagttcatggtttctgggttcttctatttaagaattttggagatggtatttgagnaaaagaattacagcttactaaacgtaattcacttctacccctgaaatatactgtagaaat

SEQ ID NO: 37098 - DNA, 121 bp, Artificial Sequence
  Synthesized
  misc_feature (61): n=t or c
ttcatcacagaattctatctatccagtagaccatggtgttagtagaatgaatttattgaanggtgattctatgactttattctattctatgcttctatgaatgggacatcctatttatttg

SEQ ID NO: 37099 - DNA, 121 bp, Artificial Sequence
  Synthesized
  misc_feature (61): n=t or c
caacctggtggtggaggcagtgaagaaggatcaggagggggatgcgtctgctgcgctcagnctctactgcaaagctctggagtactttgtgcccgctctgcactgtgagtccccgcgttcc

SEQ ID NO: 37100 - DNA, 121 bp, Artificial Sequence
  Synthesized
  misc_feature (61): n=t or c
ttgtccttgtaagcagctgttggtgctgagagttgataacaagtcaggagggcacaagggntggggaaaccctttagcagtttccttcgggctgcatgtgtaccactgactgctcctgttg

SEQ ID NO: 37101 - DNA, 121 bp, Artificial Sequence
  Synthesized
  misc_feature (61): n=a or c
tgaccccactgcctgtatctttgggtgtgctttggatctccactgattacactttgagctntgttttggaagtcacaagaaaagcagaagaaaacacagccagtcaagaataagagcagca

SEQ ID NO: 37102 - DNA, 121 bp, Artificial Sequence
  Synthesized
  misc_feature (61): n=t or c
gggagtttctcagtgctttatggagaggggttactgtagcactgataccataaaacaaacnggtactcaggtgcatctgttacctaaaaggaagtattttgcctaacaaattccctcctgt

SEQ ID NO: 37103 - DNA, 121 bp, Artificial Sequence
  Synthesized
  misc_feature (61): n=t or c
ccccagacaaactgatggttaagcgaagcagggagggtattacgatccctttgattccggngatgttgcagcacagttctgctctaggagagcagctgcggaaaaaagacagcgctcttct

SEQ ID NO: 37104 - DNA, 121 bp, Artificial Sequence
  Synthesized
  misc_feature (61): n=a or g
gtgaggctgtgtactgcttatatatctttttagtcagtgggacagactcagttttagtacngattatactgacatactaacatgcaaaactgtttactaaaataaaaagattttatgaagt

SEQ ID NO: 37105 - DNA, 121 bp, Artificial Sequence
  Synthesized
  misc_feature (61): n=a or g
gaacagcactgcaagtaaacctgtcttacacagcaaatactgaagggtattttcctatacngataaagaaaactagctcctagccttacaacagttattaatttgcaaggcagcgtcacta

SEQ ID NO: 37106 - DNA, 121 bp, Artificial Sequence
  Synthesized
  misc_feature (61): n=a or g
ggtgccagtgtttctggcaaaatctcttgggacgatggcttcagaagtccatgaatcaagngaaggcacctgcttacaagaataacatttcttctattttgcctttgtgagaatccagctt

SEQ ID NO: 37107 - DNA, 121 bp, Artificial Sequence
  Synthesized
  misc_feature (61): n=a or g
agcttaatcctgggaaatgttagcttggcagcgatgctgatttcagattcaatttcaggtntcccctgttttttgctgcagctcaaattagggacaagagtggtatttaaggacatggtga

SEQ ID NO: 37108 - DNA, 121 bp, Artificial Sequence
  Synthesized
  misc_feature (61): n=a or g
agtgatggccccagcactttcatgatctttactgggatacttccactcccatccacacccnatgcagacaggctcttatcatcagcatttgtttggcttaacttcacaacacagaatcttt

SEQ ID NO: 37109 - DNA, 121 bp, Artificial Sequence
  Synthesized
  misc_feature (61): n=c or g
tgagccagggatggtggaggaggcagaagttgctgaatcccattaagggaatatgggcaancacaagagttggtatagcacagcacagcataatgtcctgccaagaatacagtgcagagct

SEQ ID NO: 37110 - DNA, 121 bp, Artificial Sequence
  Synthesized
  misc_feature (61): n=t or c
catttgatcaatcgcaaaaatgcagacttctgtgtttcttctgcgaacctgtggacacatntttgtgacagcttctttagtggttatggaatctaaacaacgttgggtaatggcaacaaaa

SEQ ID NO: 37111 - DNA, 121 bp, Artificial Sequence
  Synthesized
  misc_feature (61): n=a or g
ccttgctcattgtccctcaacaccattcttaactaattaagatttggctcccttgaacacncaggggtatttcataccaatttcaatagaagtttacactgtgcaccaccttgctgtacca

SEQ ID NO: 37112 - DNA, 121 bp, Artificial Sequence
  Synthesized
  misc_feature (61): n=a or g
aatcggtttactaacctatctgttctaccaacatgatctttcaatcccagatcgcagtgtnaagacaaataaataaagatctccttacataatgactatgaaaaattaataacaacagcat

SEQ ID NO: 37113 - DNA, 121 bp, Artificial Sequence
  Synthesized
  misc_feature (61): n=a or g
aacacaaacataacatgagaaattaagagctttgttgggaaagagaacgagtgcagtcacntgagaaatgttaacagcttcatgtttctaccaggacaacccaatgaaaagcacaggagca

SEQ ID NO: 37114 - DNA, 121 bp, Artificial Sequence
  Synthesized
  misc_feature (61): n=a or g
tgctcagaattaaaaacagtggagttctggtaatttagtagcaataattatctgactacanaaagtaatttagcaatatttgaatacctgcatcatacatattttaatccttcacttctct

SEQ ID NO: 37115 - DNA, 121 bp, Artificial Sequence
  Synthesized
  misc_feature (61): n=a or c
gcaagcatttgagcagcacaaaagtggaacggtacagaggatatcagcatggctgctgtgnaagcacaacatcaattcatgaagcaaaatacggaataccaaaccgaaaggccactaatga

SEQ ID NO: 37116 - DNA, 121 bp, Artificial Sequence
  Synthesized
  misc_feature (61): n=a or t
gtgtggattttgagtagcaatagaagaacaaagcagaagtcttcatcctaagctcaggagnagaactgtgtcttcctttatttcctcaaaatcatttttagattaattcatctcctctgag

SEQ ID NO: 37117 - DNA, 121 bp, Artificial Sequence
  Synthesized
  misc_feature (61): n=a or g
ttaaggaccactatagttcccatatccacaactatgggaaccgtgaggaaacttagactgnttgattggactctgtgagtcatcttgcttctgtcagggatgtgaattgagagagccaaaa

SEQ ID NO: 37118 - DNA, 121 bp, Artificial Sequence
  Synthesized
  misc_feature (61): n=a or g
gcacaccgtgcacggtgacaagctgacactgcttaaactcacagcgtgggtttgattcacnctggggatactctcctggaggacacccaaatgctcgcagccactgcatccccatggccct

SEQ ID NO: 37119 - DNA, 121 bp, Artificial Sequence
  Synthesized
  misc_feature (61): n=t or c
tgctggcgtgaatgagtcagtgatgacgcaccaacggtcaacagcggtggaaaaatggccngttgagctaaatatacaatatatatatgtgtgtatattccccaaaggataagctggaagt

SEQ ID NO: 37120 - DNA, 121 bp, Artificial Sequence
  Synthesized
  misc_feature (61): n=a or c
ctctaaagcttgagagaaaaactgatgaaccaggatatatcagtgatttttcctaagaggnaaactcacttacctgtttcattgtaaagtactgaactgttagtgttataaaggaacaaca

SEQ ID NO: 37121 - DNA, 121 bp, Artificial Sequence
  Synthesized
  misc_feature (61): n=t or c
acagaaggagcaggggatcacccatccatcacattaggctcctcctgtcccagcactatanggcttctgcttaataatgagaaacagatggtgccatctatctctttttatgagatggaga

SEQ ID NO: 37122 - DNA, 121 bp, Artificial Sequence
  Synthesized
  misc_feature (61): n=t or c
cagtggggtgtccttgggtacgtggagatccagggctgtgggttcatccctgtgggacagngggttgggtttggaaatggggaattctggaaataaaagagaggggaataagatgggtcgg

SEQ ID NO: 37123 - DNA, 121 bp, Artificial Sequence
  Synthesized
  misc_feature (61): n=a or g
cttctgttgtgtctgcttaatttaggaggaaaatccacagtttggtatcctatgtaaaatntatgaagaacaacttgcatacatcctgccattgtggacgtgtttgttttttgttgttgtt

SEQ ID NO: 37124 - DNA, 121 bp, Artificial Sequence
  Synthesized
  misc_feature (61): n=t or c
agtagacctaccacttattgtttggggaaagaacagtggtgtgcggttgcacaaattatgncatttctatgtgtttccagaaaacctgaatgaagcatctcaaattatcaaacatactgcc

SEQ ID NO: 37125 - DNA, 121 bp, Artificial Sequence
  Synthesized
  misc_feature (61): n=t or c
tatgtttctgagagagaaaaaagcccagctgacttcaagctttctgttcagtgaaagaagncattctcggattagtagcacgtcttgccaaggtagatgtatttctcacaaaaaagcctga

SEQ ID NO: 37126 - DNA, 121 bp, Artificial Sequence
  Synthesized
  misc_feature (61): n=a or g
cgctgcaccctgtgatgctgctgctgtttccaagggactgtcactgagaatcagaccatgntgctacatcttaaacaaatcatagcagtctggatgatttgaggaagaccagaatctttga

SEQ ID NO: 37127 - DNA, 121 bp, Artificial Sequence
  Synthesized
  misc_feature (61): n=a or g
ctctcattcgtgagtttactcaggcatcccaaacatgcctgaagaaaaataagagtaagtncacttaatgctaaaccttgtcagcaggatcaggtgcaggcagagtaagccatgaacgtaa

SEQ ID NO: 37128 - DNA, 121 bp, Artificial Sequence
  Synthesized
  misc_feature (61): n=t or c
acccgggtatgttaaagcttagtttgcttgtgaccaagtcgtcatggctgccatctgtgtntttaaacggtgcacgtatatcatcagtaagtattttatgagcttcagctctgcatctgtt

SEQ ID NO: 37129 - DNA, 121 bp, Artificial Sequence
  Synthesized
  misc_feature (61): n=t or c
taaccacagcagaattctcttccctcaatgctaacatctctttacacaactttaatgcagnggatcctggtccagcaatttgggaatggggattactatctgtgttgattttcaccctttc

SEQ ID NO: 37130 - DNA, 121 bp, Artificial Sequence
  Synthesized
  misc_feature (61): n=c or g
tcatggtaacaaagcagtccattgcatgtcatacccaaatggtgccatttgggaagtgtgngcccttcatcatatttgtatactcgcaggaatttcagctttgtgtaatgcttggggagca

SEQ ID NO: 37131 - DNA, 121 bp, Artificial Sequence
  Synthesized
  misc_feature (61): n=a or c
tcatggaggcccacttctgcactctttccaagagctttgcatccctactgtgttttacaanagggcacaaatccaatctagtttgccaacaccagaaccctgatctctttcctgggcatgc

SEQ ID NO: 37132 - DNA, 121 bp, Artificial Sequence
  Synthesized
  misc_feature (61): n=a or c
gaaaaaggcaggaaatgggtaccaagttctacattggcactcatcttacagcacaggtgtnaggaacatctgctctgctccttgctctcttgaatcttctgccttttttttttttttgcct

SEQ ID NO: 37133 - DNA, 121 bp, Artificial Sequence
  Synthesized
  misc_feature (61): n=a or g
ctgttcagacttcctgtgggtttgtgcttacctcagctatgatgaccgttgatggttgtcnactgtcactgatttgcccttaaaatagtgttgtgagctgacattattactcttattagtc

SEQ ID NO: 37134 - DNA, 121 bp, Artificial Sequence
  Synthesized
  misc_feature (61): n=a or g
aatggattttagatgctagtttgaactccattaaagagtttgcagtaactaaaggtctctngactctgatgagaaactacaactattctctttttttttttttttttttaagaaagaaaaa

SEQ ID NO: 37135 - DNA, 121 bp, Artificial Sequence
  Synthesized
  misc_feature (61): n=a or c
cggtgcaatgtaactggttattacttgtttcccttaacaagactgatccctaacatgttanggccctcagtaacataggtaatttcttttccacctgagaaataaacgtgttacaaaagga

SEQ ID NO: 37136 - DNA, 121 bp, Artificial Sequence
  Synthesized
  misc_feature (61): n=a or g
gcctcgtggtcaacctgaacgaccccatcgtagataataacgtcggtacaatctgttgccngcgtccttttggggaagcaaatggcaataagcccaactcaaacccatagacctgacgtag

SEQ ID NO: 37137 - DNA, 121 bp, Artificial Sequence
  Synthesized
  misc_feature (61): n=t or c
caattggcaaatttgggttgacttcactaaaagcgttttgattgaggaaaataataattangactattactgtgattagtttagagctctgccttgaggtttaattagctgtaaaacaaaa

SEQ ID NO: 37138 - DNA, 121 bp, Artificial Sequence
  Synthesized
  misc_feature (61): n=c or g
tgttatgtggtgttttacagctctccccgcgctgcctgtgatgaactgccagccttgtttngattccctcctacctcagcttttgtttatttgttccattttcctcctcacgcgtcttgtg

SEQ ID NO: 37139 - DNA, 121 bp, Artificial Sequence
  Synthesized
  misc_feature (61): n=t or g
tctgaccctgcctgaacttgaggggtcctgtttgcattctaggtcctctttgggcttgganttctgtttggacagggagtcctgattgtgctcaggattctgtttgggttggggctctgtt

SEQ ID NO: 37140 - DNA, 121 bp, Artificial Sequence
  Synthesized
  misc_feature (61): n=t or g
ctttgtggatatggctcttaaccttttagctgagtctatgacttggttacagcttaactcnaggcttatatacactggaaacaaaagcctataagacaggaattatggctttggctgtgta

SEQ ID NO: 37141 - DNA, 121 bp, Artificial Sequence
  Synthesized
  misc_feature (61): n=a or g
gacagcagttcttcagctgctcccttgccagagacagcatctcttcctttgcttgctctcntaggtgctgctgcagcactgagctgtgcaagccttggacatcgccattcctttatcactc

SEQ ID NO: 37142 - DNA, 121 bp, Artificial Sequence
  Synthesized
  misc_feature (61): n=a or g
ttgtgctgtcgtattcctgtttttcttgtgctgcatctcagagctgttctatcacttctcntgtcttctgatgtgctgctgcacctgcactttcatcataagcctgatggtctctttcaga

SEQ ID NO: 37143 - DNA, 121 bp, Artificial Sequence
  Synthesized
  misc_feature (61): n=c or g
attgggggatgcacttagcatgctttgtagtgctgcagtttataggtggcagggtcaatanatccactgggtcaaacaaatgcttgagagtgcatttattacagttcctgggtgtttttaa

SEQ ID NO: 37144 - DNA, 121 bp, Artificial Sequence
  Synthesized
  misc_feature (61): n=a or g
cttaactttagaagaaatgcttcttgagaaatatggggtgcaccccgtgatgcatttatgnaaaatattgtcataaaatcaatgatctcctttctttagagcatgaaaatcactcagtgta

SEQ ID NO: 37145 - DNA, 121 bp, Artificial Sequence
  Synthesized
  misc_feature (61): n=t or c
tccattgttctatgattctgtaactctacgattccatgattccacgactctgtgactctangatcctttgattccatgactccatgattccacgactctgtgactccatgatactgtgact

SEQ ID NO: 37146 - DNA, 121 bp, Artificial Sequence
  Synthesized
  misc_feature (61): n=t or g
gggaaaggggtcctgttccatcgagccttctctttcttactccttaggtgttatattgttntttcattgtttttcacccttgtgtttctccctccgtactcgaagtctttcagaatgcagt

SEQ ID NO: 37147 - DNA, 121 bp, Artificial Sequence
  Synthesized
  misc_feature (61): n=a or g
aggctttgtggacaaggtgatagcccatctggtgtgctggagttctgggtagtgacaacgngtaggcccttgtcaccaaagcacacctccaagaaataccttttcctgggataatattgat

SEQ ID NO: 37148 - DNA, 121 bp, Artificial Sequence
  Synthesized
  misc_feature (61): n=t or c
tgtccatcaggctgttaattgcgttaattacagagctcggaggtgttaattggaaaacccnggtcccatgcctgtgatgtgtgtgtgttgggggggtgtcagtggcaaggaatggtgcaca

SEQ ID NO: 37149 - DNA, 121 bp, Artificial Sequence
  Synthesized
  misc_feature (61): n=t or c
aagaattaagtcgatctgcgaagctatgtaatattattctgtgctcattctgatttttaantttcttcattgttcctgtaatttactagagcttatcaaatcagttgtcattttgttttga

SEQ ID NO: 37150 - DNA, 121 bp, Artificial Sequence
  Synthesized
  misc_feature (61): n=t or c
tggctggaaggggaggaggaactcttgagactagggatgagaggaggaacccctcctctgnttccatttcagactctgtttcaattttcagcaattaaggacttctacttgctcctcgtct

SEQ ID NO: 37151 - DNA, 121 bp, Artificial Sequence
  Synthesized
  misc_feature (61): n=t or c
gctgtattacaaccctctcttctggcaaaagctcccgggggtcctcaccacacttcggtgngatcattgttctctgttttctcttttcagtcggcttcctctgaggccctgcaattttgtg

SEQ ID NO: 37152 - DNA, 121 bp, Artificial Sequence
  Synthesized
  misc_feature (61): n=c or g
gcaaacacctgtccacaagtagtcaaagtacaacacaaaaatgctgattaataagtcatanggagtaaagggaatgacataattccctgcatgatcatcaggaatacaatatgaggataca

SEQ ID NO: 37153 - DNA, 121 bp, Artificial Sequence
  Synthesized
  misc_feature (61): n=a or t
accatattccacagtgtaatacatagccttataattaaaacttctcaaaacacaaatagcngcagaatattctactatgtaaccatataagtgcaagaagattccctgtttttaaaattgt

SEQ ID NO: 37154 - DNA, 121 bp, Artificial Sequence
  Synthesized
  misc_feature (61): n=a or g
aggaggatgagactgaatggggtcacagcgtgggatagcaatttgtctgtcaagcaccacntctcccatgcagtgcacggaagttatcagtaatgcaaacacagaggtgaaatgataaaat

SEQ ID NO: 37155 - DNA, 121 bp, Artificial Sequence
  Synthesized
  misc_feature (61): n=t or g
gaacatgcgtcattggctttgaatgttccagctttcgctggtaatgttgagagaataacantgcttccctctgatctggatgcagatgcagacaccgtacaccttgccagtgtaggaagtg

SEQ ID NO: 37156 - DNA, 121 bp, Artificial Sequence
  Synthesized
  misc_feature (61): n=t or c
aactcaggaatttctttcattctacattaattcctagtttacctataaattagtaacttcnggagcaagcaatacctaccttctttgtcagctactgaccaggaatatttctgaaatgatt

SEQ ID NO: 37157 - DNA, 121 bp, Artificial Sequence
  Synthesized
  misc_feature (61): n=a or g
aggaggaaaatcattatgtaatactaactagtgtatttgatgtcccttctactataacgtngattttagctgaataaaagacaatgcatgggctattacttaattcaattacaaaaataac

SEQ ID NO: 37158 - DNA, 121 bp, Artificial Sequence
  Synthesized
  misc_feature (61): n=c or g
actccatggtgcgagcgagcgctgcctggcttttatttatctttctctttgtgtaccatancaaagtttgaaggcacgcagcatcattccttgtgctattcctccaagcgcgaccacaaag

SEQ ID NO: 37159 - DNA, 121 bp, Artificial Sequence
  Synthesized
  misc_feature (61): n=c or g
cttgcagtatgctccgtttttactttttccccaatttaacctcttgctgattagtgcagcnctgtcaaagaatttgaccaaacgagcagaacactggtgaggttttgctgcactgcatttg

SEQ ID NO: 37160 - DNA, 121 bp, Artificial Sequence
  Synthesized
  misc_feature (61): n=a or c
aggagggctaaggaactatcggagcaaagctggtggagcagagagaggctgatcattcagnctttctgtggcgatctactgaattttactgcatttctgatgcagctgtcatattcgttca

SEQ ID NO: 37161 - DNA, 121 bp, Artificial Sequence
  Synthesized
  misc_feature (61): n=a or g
agattcctttccccagcacaggcagtgttgcttggaagcttctctgcatctttttctcatnttttggtgcaacagacacgatatttcccctacattttttaacctgttacttacaggaaaa

SEQ ID NO: 37162 - DNA, 121 bp, Artificial Sequence
  Synthesized
  misc_feature (61): n=t or c
acccttattggcacagaggcagtaaaatatgatttatgatgaacagacaaaatttacagcnataactacgtttacagaaaacttaagttacactgtctgtaacaagatgctatcaagtaga

SEQ ID NO: 37163 - DNA, 121 bp, Artificial Sequence
  Synthesized
  misc_feature (61): n=t or c
aacttcagtgtgcagacttttagtcctaactgctaattgtcaaacgtttcaaactttccanagggaaatgctgcatgcctcctgcaccccacagaagtcctagggcctgagggagcatagc

SEQ ID NO: 37164 - DNA, 121 bp, Artificial Sequence
  Synthesized
  misc_feature (61): n=c or g
tgccctggttcccacgtgagcccagctggcacaggaaggaaacgaatcctccaagtacaanttgtgcacatttccctgcagaaagtggaaatggcaccagacaaactgattaggaaatgaa

SEQ ID NO: 37165 - DNA, 121 bp, Artificial Sequence
  Synthesized
  misc_feature (61): n=c or g
gggcatctgtcccacaaggaagatgacatggatagtggagctgaactcttcaggtggacantgaagaggacaagggccctgtctggtcctcaagctgagcgggcaggcctcggcggggacg

SEQ ID NO: 37166 - DNA, 121 bp, Artificial Sequence
  Synthesized
  misc_feature (61): n=t or c
acatggcacaggcattctcaccagcactcacaagggaagatgtttgttccctgtctcaacnggctttggttcacatctgatagaaaaacctagtgatagcaacactgatattaggcaagta

SEQ ID NO: 37167 - DNA, 121 bp, Artificial Sequence
  Synthesized
  misc_feature (61): n=a or g
ttggtcaatgcaaatgttgcagacgttttgcactgagaaacgcaggacatggatggtatgngcatttcccaatgggacagggcaggcgagttcccctgagctgcattacctggcgatgctc

SEQ ID NO: 37168 - DNA, 121 bp, Artificial Sequence
  Synthesized
  misc_feature (61): n=a or g
aagaaaatctctcaggaacaaaaagaagcccaggacacccagggcatcagagtgctccaangagggattagtcagtaacaccttgatttgaataaaacctcttcagcattctgttacggct

SEQ ID NO: 37169 - DNA, 121 bp, Artificial Sequence
  Synthesized
  misc_feature (61): n=a or g
gccaggagcgtcctgttgacagactttgagaaggatcaggggactgtagcataaacacaancaatatgatattcagatactataaaatgaaataaatcaaagaccattggagaatttatca

SEQ ID NO: 37170 - DNA, 121 bp, Artificial Sequence
  Synthesized
  misc_feature (61): n=a or g
atgagcatctgtttcagctcctccagatcccaggacacgtgtctgaccaacaccaccaccngtgtcaccgggtgcttctgtcccagcctacagtgatctcacaacaaaatgcactcgggca

SEQ ID NO: 37171 - DNA, 121 bp, Artificial Sequence
  Synthesized
  misc_feature (61): n=t or c
agctcatgagggtgaatggaaaagtgacagcaggagcagctctctttcctttctccaagcnctctctttgatgcaggagtgtggggtgaagagaagggagaaggataagagccaggtttat

SEQ ID NO: 37172 - DNA, 121 bp, Artificial Sequence
  Synthesized
  misc_feature (61): n=t or c
atacatagttccatttagcatctatatggtcagtaccttgctatttgaatttccctactangggcttaagtttgaccaccgctgaggtaggctccagatcccttgtactctgcaaatggta

SEQ ID NO: 37173 - DNA, 121 bp, Artificial Sequence
  Synthesized
  misc_feature (61): n=t or c
tggcctgtcttttgtaaagcttaggaaggcaagattagagagattgccaaaaaaagaagcngttgaacacaaagttctgtcggaaatttaacgcaagaaaatagaattcttatatgaatgg

SEQ ID NO: 37174 - DNA, 121 bp, Artificial Sequence
  Synthesized
  misc_feature (61): n=t or g
taactaattacagatatatagttgtttaaagccctgatagattccagagccctaaagcagncaccacacttcaaaatgataggtacccattaatgatatttcctgttggtttgctttgctt

SEQ ID NO: 37175 - DNA, 121 bp, Artificial Sequence
  Synthesized
  misc_feature (61): n=c or g
gatgaaccaggtgttttcttctctctacttctgcttcaatctaggaataaacaacagagcntcgtgctggagaatcagaacggataactaagaaggggataactaaaacaattccaggaat

SEQ ID NO: 37176 - DNA, 121 bp, Artificial Sequence
  Synthesized
  misc_feature (61): n=a or g
gtccccttctacactgacatgcttggaaatgtgaaacttgggttctgttaggaaatgttgngatttgaacagtgactgcggctgtgctataaaagtttgtgtctttggtttagaatttgct

SEQ ID NO: 37177 - DNA, 121 bp, Artificial Sequence
  Synthesized
  misc_feature (61): n=a or g
tttgtttttaattgtgttttgtcagaggcaagctatgaaattacatgcatgtgcgtgcacngcagagtcagagtgagacgtggcctgagcaagaagtgtgttggagctgacaaaccgtgca

SEQ ID NO: 37178 - DNA, 121 bp, Artificial Sequence
  Synthesized
  misc_feature (61): n=a or t
acatccgtcctgtgctgtgcttggctctctttctttacgaatcaataacatatataactgnttcacaagagagtcataagttcagtgagggcctaggctacatacaaaaagagaggtatat

SEQ ID NO: 37179 - DNA, 121 bp, Artificial Sequence
  Synthesized
  misc_feature (61): n=a or t
aggaacatcatatctggtaaacttaattttgtcaggtaagagtgcaaacaaaagcactatntattgctgctctggtctgtgcaatgaaacaaaacaaatgccacatctctcctttttagca

SEQ ID NO: 37180 - DNA, 121 bp, Artificial Sequence
  Synthesized
  misc_feature (61): n=t or c
gaagcaggtgcatttcacactcctttattacactgatcttagttcacgtccactaacatcngcagtgctgatggcttgatgttaccggacaaatgggactcctgaaggccaacgtggtgct

SEQ ID NO: 37181 - DNA, 121 bp, Artificial Sequence
  Synthesized
  misc_feature (61): n=t or g
aaattcagtttagcattatatgtacatttgacaatgttttacccctttgaacatctccttnccagaggcagtattaaaatgcagagccacagctacctgcatgtgtctgtttttcccaaaa

SEQ ID NO: 37182 - DNA, 121 bp, Artificial Sequence
  Synthesized
  misc_feature (61): n=t or c
aattacctaaatagtcaagacgcacgcatatataagtttaaatagctgcttattaaaatangtagtaaaaaatgagagcgtacaagcagtaaatatattacaggtctattaatctatcttc

SEQ ID NO: 37183 - DNA, 121 bp, Artificial Sequence
  Synthesized
  misc_feature (61): n=a or t
tgggtttaatatatttatttttcatatatgtcccaattatttactttgcatttcactccanttttttttgccacagtatgcttaggcaaatctatttttattaaccttccgtttctggatc

SEQ ID NO: 37184 - DNA, 121 bp, Artificial Sequence
  Synthesized
  misc_feature (61): n=t or c
atgggagatctgtctggaacatctaggcagagacaccagaacgagtgctgtccctggaaangccggtgccatcctcctatcccaaagtctgactttgctccatcagtggctctgttggtga

SEQ ID NO: 37185 - DNA, 121 bp, Artificial Sequence
  Synthesized
  misc_feature (61): n=a or g
ttaaagccatgcaagaggcttgaatatgtgacaaggcagaacatgaactcttcctgccatncatgctgaagaaggctcgccttcacccggtgcacagcagctcaaagaccctccagccccg

SEQ ID NO: 37186 - DNA, 121 bp, Artificial Sequence
  Synthesized
  misc_feature (61): n=t or g
ctctatctactggggcaccccttgttctctcagagccatcatcttcctcctgcttctaganctacccaatccccaactcagataggctgggaagcctttggttcccatttcctagcccact

SEQ ID NO: 37187 - DNA, 121 bp, Artificial Sequence
  Synthesized
  misc_feature (61): n=c or g
cagtgctagagtatgaaaataaagcatccgtgtatttgatagggggggaaaaagtcgaagnttattctgatagaattaatacagatgtgctgcttgctggagctaagcttcagtgattcag

SEQ ID NO: 37188 - DNA, 121 bp, Artificial Sequence
  Synthesized
  misc_feature (61): n=t or c
tgttgatttattactattattaattttaatttctcttgaggggcctggtcacgagctttcnctgattgagttccaaaaacagtctctgctctctctcccctgtttcttcacagcccttttc

SEQ ID NO: 37189 - DNA, 121 bp, Artificial Sequence
  Synthesized
  misc_feature (61): n=c or g
atgtataacaaagtttgcggaagactagcacccaaacctataagaggatgtgttgttttantgagttgggcagctaattgcagcaagcagctctcatcttggctgtggcagtgcctagctg

SEQ ID NO: 37190 - DNA, 121 bp, Artificial Sequence
  Synthesized
  misc_feature (61): n=t or c
tgatgtattacactgctatacctgttcagtgaatcagaacagataacttccgttacccatncttctagactgtcagtctagcatctttcacaagtactacagtcacacaaattattaaaaa

SEQ ID NO: 37191 - DNA, 121 bp, Artificial Sequence
  Synthesized
  misc_feature (61): n=t or c
gctggacgcgcggtgctctgtgaggaaaataattaagtgggctgtcaaattgaagcacagngttttcccggattgtggaaaacaagtcgtgattcagtacatgtagcacatcccgtacttg

SEQ ID NO: 37192 - DNA, 121 bp, Artificial Sequence
  Synthesized
  misc_feature (61): n=a or g
atcaacatatcagcatccacagtgaaaatcttggtgcgtgcactggaaggcaacataacgntacccccaggttgctgaaaaacaggcctctagtattctgttccttggctgaaatatagca

SEQ ID NO: 37193 - DNA, 121 bp, Artificial Sequence
  Synthesized
  misc_feature (61): n=t or c
agtgggttgataaatggattggcttaatgagacaatatacttgacatatgcaggactctcntgaggaataagattcatttttgcacttcacacatcaacatgctacagataccaacacagt

SEQ ID NO: 37194 - DNA, 121 bp, Artificial Sequence
  Synthesized
  misc_feature (61): n=a or g
atacctttctcccctgatccttttattgcctcaaattgggattgttcagcgccaaaatggnaaatccaaggcaaatatgtggaaaagttaagtttttaacttcttctggccatgaagatgc

SEQ ID NO: 37195 - DNA, 121 bp, Artificial Sequence
  Synthesized
  misc_feature (61): n=t or g
ataatcccatccaactaagaaagtgcccgtgcatatgaaataagcagatgcagtcttcaangagtttctgcaaggtgttgggacagaaatactggaagttacagctttgaagtgagccgga

SEQ ID NO: 37196 - DNA, 121 bp, Artificial Sequence
  Synthesized
  misc_feature (61): n=a or t
tagcttctcttctgccttctttccgtctgctttgttttggtgtcagcaatggcagaaggcnctgtagacctagtgctggtacactgcaccagggaggtggtgagcttgaggaaaattattc

SEQ ID NO: 37197 - DNA, 121 bp, Artificial Sequence
  Synthesized
  misc_feature (61): n=a or g
tccttccctcagccactgagagaacacacaaataaaaacgcagaagagatgcaaacattcngcacattcatctgcaccgaccatggggctgttaaagctctgctcactctgcacttcctta

SEQ ID NO: 37198 - DNA, 121 bp, Artificial Sequence
  Synthesized
  misc_feature (61): n=t or g
cttaaacagtctgctggaaatgcgctcacggggtggggttgcttgcaaaaataagccgggnctccaaaggaaatggctgtgtggtggtgcctgtggcagggcaaggctaggccatgcctgc

SEQ ID NO: 37199 - DNA, 121 bp, Artificial Sequence
  Synthesized
  misc_feature (61): n=a or g
taccctatcttctgaaagagcaaagatcataatgattgtaaggaaactagggtgtccactntcctgtatttacattgtctgatgaactagatgattggggttgaaactagatcattactgt

SEQ ID NO: 37200 - DNA, 121 bp, Artificial Sequence
  Synthesized
  misc_feature (61): n=a or t
atcagcccaaaatagcacaggcacatgaagttctattgattagcagagccgagaaagttcngtttgctattcacctgcatagcttacagagaatgagagtaaaaatatgatgcaacatgaa

SEQ ID NO: 37201 - DNA, 121 bp, Artificial Sequence
  Synthesized
  misc_feature (61): n=t or c
gggccctgtagcccatgtttccaccagtgcttgcagtctatttttgttcaccactacagcntcagtaacaaaggttctcagattttcttttcagtgccagaatatctgatatttgccagtc

SEQ ID NO: 37202 - DNA, 121 bp, Artificial Sequence
  Synthesized
  misc_feature (61): n=t or c
cagtacggtggcaaatttaattactgtagagatattgatttaatgattaggtttttttccngtaatggtgcatacttctacacaatattgcatctcttatgtcacttgtatagaatagaat

SEQ ID NO: 37203 - DNA, 121 bp, Artificial Sequence
  Synthesized
  misc_feature (61): n=c or g
aaaaactaaaatccacatcaaaccaccgtcccaaagcaaagcaaaacgccccttttattgnagtctgcagctttccaatggtataactgtgagatgtttttatttttcattttatgtatct

SEQ ID NO: 37204 - DNA, 121 bp, Artificial Sequence
  Synthesized
  misc_feature (61): n=t or c
atccatcctttgatacagtcttgatgatggtttattctttcttggtcactgtggatctcancaaaattctaagaggtcacttgtccttaaactgtaatcaagatgctatagctaacattct

SEQ ID NO: 37205 - DNA, 121 bp, Artificial Sequence
  Synthesized
  misc_feature (61): n=t or c
ggacacgtggtctgaaatttggtaagttttatattgctttcaaatactttgaatattttgnctcctatcaggaggctagagaacatcccatcttgcctttcagaggccaaggaaatgccct

SEQ ID NO: 37206 - DNA, 121 bp, Artificial Sequence
  Synthesized
  misc_feature (61): n=a or g
caaactagcagatttcagcaagatatggggtcagggatgctgtatgttcctggctccccancatccctcccctgggactttctctgtgccagcacagcgtggctcagtgtcactggggatg

SEQ ID NO: 37207 - DNA, 121 bp, Artificial Sequence
  Synthesized
  misc_feature (61): n=a or c
catgggtgccaccatgaccttataactactcccatggttgccaagtgtgaccctatcctcnctcccatgggtgccagcatgaccctataaccactcccatgggtaccagccatgaccctat

SEQ ID NO: 37208 - DNA, 121 bp, Artificial Sequence
  Synthesized
  misc_feature (61): n=t or c
atgcacactctcacagaccaaggatccctccattggctggatgagagctggaaaccagaanggcgatctcttcgtctgtctctttctctatccactccccctccccttttatttttgcttg

SEQ ID NO: 37209 - DNA, 121 bp, Artificial Sequence
  Synthesized
  misc_feature (61): n=a or g
acacaaatcagcttcagattgtgccctatacctttcccacagcagctcctcactgcagatncagtattttccacaaacacagaaaggaagcctcagtcacagcgctttctgaaggaggtga

SEQ ID NO: 37210 - DNA, 121 bp, Artificial Sequence
  Synthesized
  misc_feature (61): n=t or c
ttcatcatcctaactagaagggaaaaaagcagaacagaaatattactctgctttgcagtantaatgcatatgcattcatcaacctagcaatgaatcaaagttgcaacacaacaaggatagc

SEQ ID NO: 37211 - DNA, 121 bp, Artificial Sequence
  Synthesized
  misc_feature (61): n=a or t
gattttgtaccaaggaaattcctttcctcgtgatctcattggagaaacgtggtttccaagncgtatttaatcatcccagaaaatgctggagggtattctcaaaaggtttctgagaactgtc

SEQ ID NO: 37212 - DNA, 121 bp, Artificial Sequence
  Synthesized
  misc_feature (61): n=a or g
ggtttgttctgcatatcagggaaataaaaactgtgccagatttgtaacaggcataaatagncataggtcagtcaatgccagtggacatttggtgattcactcaatgtgtgtgaatcgttat

SEQ ID NO: 37213 - DNA, 121 bp, Artificial Sequence
  Synthesized
  misc_feature (61): n=t or c
tgttttgaccatcttaacttgaagcttactctttaacgtgtattaatactccagtattctnctattattcttctacattttatgataacctgtgctgcaattaaacaataaacctctgagc

SEQ ID NO: 37214 - DNA, 121 bp, Artificial Sequence
  Synthesized
  misc_feature (61): n=t or c
tcatttggcaccaccgctgttgttccaagaacaacggctctctgcaaagggaatgatctcnggacgtctcatctaaaaccttgaagtcaatggggatgaagtgaaatgcaaggcagagggg

SEQ ID NO: 37215 - DNA, 121 bp, Artificial Sequence
  Synthesized
  misc_feature (61): n=a or c
tactgactgtaaatatcaaataatgaatccaatatgaagacctagtattaatcagcctgcnttcttgtgtgaggaggttttccctgccataatatttctccaggtaggaggtaatagcagg

SEQ ID NO: 37216 - DNA, 121 bp, Artificial Sequence
  Synthesized
  misc_feature (61): n=t or c
ttgtctgctttgattgtcacttttttcccaggattcttacatttttatgcatctccagcanaagaaagcgtgtaattcttcagtgaatactgaagtctcaagcctcttgtaattaaaaagg

SEQ ID NO: 37217 - DNA, 121 bp, Artificial Sequence
  Synthesized
  misc_feature (61): n=a or t
aatagtaagagtgtgaaactgtcaagcttctgacttggtaacagaaactgaaaatcttacncagcaagttgtatttcaggatgccaaagtactttaaaaagtaaacacagaggtcactccc

SEQ ID NO: 37218 - DNA, 121 bp, Artificial Sequence
  Synthesized
  misc_feature (61): n=t or g
atcctccattcctcaaaggtcatgataaaggtatttatttgctgacagtataaatagactntgtaacaggttagactcactatggggaaaaactaggtgtaagtaagaaacaactgactag

SEQ ID NO: 37219 - DNA, 121 bp, Artificial Sequence
  Synthesized
  misc_feature (61): n=a or g
tcatttgctttggtgcacaaggatagtgctacactcactgataggcatgggcattttgctncaaataccactgtggtcaaccccacttgatagagtctcagtatgaaataacaaatccagc

SEQ ID NO: 37220 - DNA, 121 bp, Artificial Sequence
  Synthesized
  misc_feature (61): n=a or g
cattacatgatgcagtagttatccaaaatgctggcagtttaggacttaggacacaattatncattgccaaaaaattaaatcattttacagtccacaattcaataatgagttagcagataag

SEQ ID NO: 37221 - DNA, 121 bp, Artificial Sequence
  Synthesized
  misc_feature (61): n=t or c
ctaggagcatgattttctgcaggatatctactctaaatttttaatttagtttgaaggacangtgttgctaatgatcatcagcacacagaattcataccatccgaacattagtgttagtaat

SEQ ID NO: 37222 - DNA, 121 bp, Artificial Sequence
  Synthesized
  misc_feature (61): n=c or g
agtgagggaggttccggcacatcttcctatgccatgtgtgaaagtctcagctacataccanccagaggactctgggccaaaggtgctatttaagaggtactgctgagatcagagaagtggc

SEQ ID NO: 37223 - DNA, 121 bp, Artificial Sequence
  Synthesized
  misc_feature (61): n=t or c
ctctttctgcagaatgtatggaaacataataatctttgaggtcaacatccttttgtctaanctcagttgaaacaagactttaagttccaaagcaatttaggaaacacacatgcgtatgtac

SEQ ID NO: 37224 - DNA, 121 bp, Artificial Sequence
  Synthesized
  misc_feature (61): n=t or c
taagattacatgattaggagctcattatatttctgcaggtactacatattcacaatgcctncacgagataattaacatatacacgcctctctcaagtagtgagtgatgaagttttcactct

SEQ ID NO: 37225 - DNA, 121 bp, Artificial Sequence
  Synthesized
  misc_feature (61): n=t or c
agaaatagagctgtaaccacctgcatatgcgcacaactttccaagaaatacctaaaagtgnacttgttgtgggcaaagatttttccagcaatattcccaagcagtttgtgaaagcaagtgg

SEQ ID NO: 37226 - DNA, 121 bp, Artificial Sequence
  Synthesized
  misc_feature (61): n=t or g
gcccgtgcagaaaatacttccaagactctgagcactcctgtacactttctggcttaagaantttagatgttcattcttttttaatacaaccagtgactgcaatgatttgagtaacacataa

SEQ ID NO: 37227 - DNA, 121 bp, Artificial Sequence
  Synthesized
  misc_feature (61): n=a or g
cacgttaatttatttttttctggatttcttttgaccaaaatgtgtgtacatttgggttaanaccacaaactgagaataatacagactcctccatcttggcaaaggtccacagatttcacct

SEQ ID NO: 37228 - DNA, 121 bp, Artificial Sequence
  Synthesized
  misc_feature (61): n=a or g
agcctcagacagccccgtgagcagagcagttagtgaggtgagcagctctgtcttgccatantcctcagaagcagctcaacccaggccagactgcttcggcagctttttggggtgaccacgt

SEQ ID NO: 37229 - DNA, 121 bp, Artificial Sequence
  Synthesized
  misc_feature (61): n=a or g
cagcacagtggtcatgtcctcgacctctgcaaggcagtgcttgaacctttgctagtagagnaaaggtgtgtggtcactatggcaaggtgacacttgtatttgtggtggaaacagtgagcct

SEQ ID NO: 37230 - DNA, 121 bp, Artificial Sequence
  Synthesized
  misc_feature (61): n=a or g
aaatccgctggaacaactgcatgtacaacaaccgtatcattacattgcctgagcatctacnttctatggaaacaagtaaacctactcattccagatcctactgggcccattctaggtgctc

SEQ ID NO: 37231 - DNA, 121 bp, Artificial Sequence
  Synthesized
  misc_feature (61): n=a or g
tctcttgtgggatttgcgtgcaagcagaggacatcttcctgggcatagccaacacccaacntcttatttttctatcaggccatcatcgaagagaaaagaaggaggaagagtatctgagaaa

SEQ ID NO: 37232 - DNA, 121 bp, Artificial Sequence
  Synthesized
  misc_feature (61): n=t or c
taacatagaattgtaaccatcacctgccattgctcgctctcagtaacgatttaactaaagncaggtgagtaatgctaatcatttctaattactcccaatcaaaagcaaggtgttactttac

SEQ ID NO: 37233 - DNA, 121 bp, Artificial Sequence
  Synthesized
  misc_feature (61): n=c or g
tctgtttattccaaaaagtttttcaacatatttttctgaaatgagaacattcatgccttangtaggtaaacaaatggatagataacttaccagcaatttaacacaatctatgcttaattaa

SEQ ID NO: 37234 - DNA, 121 bp, Artificial Sequence
  Synthesized
  misc_feature (61): n=a or g
ttcttccaggctgcatgggaagtactagggaaatgcaaggatgtatggaatgaattctaantatatatttattttacctctatgtgaaccgtagtatctggaactgaatgtcatggcaggc

SEQ ID NO: 37235 - DNA, 121 bp, Artificial Sequence
  Synthesized
  misc_feature (61): n=a or t
gcaagttgcatccttttgaatgccccttgtgctatggccactgggatctcaataaaaatanttccaaagtattgtgaagtgaaggatttcatgctgagaaggtgtcaggcaggaaccttaa

SEQ ID NO: 37236 - DNA, 121 bp, Artificial Sequence
  Synthesized
  misc_feature (61): n=t or c
ggtgtggtttgctcgtgtctgtctgcatggaactgcatccttggaggtcccgaataattgnctgtaaaacttccaggtgtaaaggctggtgagtattgtattccatctcaaagaattcact

SEQ ID NO: 37237 - DNA, 121 bp, Artificial Sequence
  Synthesized
  misc_feature (61): n=t or c
tatgagacggttagctctgtgctattcatactaattaaaaatgcttatcaccagattatancacttgtttgcaccatccttgctccattagtgtagattatttctaattacaaccaatatg

SEQ ID NO: 37238 - DNA, 121 bp, Artificial Sequence
  Synthesized
  misc_feature (61): n=t or c
atgtgcacccagagctaatgtagtactgacacagggcaaaggcagtgaagcctcatccagncttcctgacaaacactgagcaccagcaaccaactgctcacaggtgaactcttgaaacctg

SEQ ID NO: 37239 - DNA, 121 bp, Artificial Sequence
  Synthesized
  misc_feature (61): n=a or g
ccctacctggaagcatgtgtcttgcaagtgggtcctcacaatgcatttgcccacacagtcnaggtgggacacagcccaaggtggttccttcacagtgaaaaccagagctagatattagaaa

SEQ ID NO: 37240 - DNA, 121 bp, Artificial Sequence
  Synthesized
  misc_feature (61): n=a or g
ccttgcagtcagtatggagaaacaggcaatttaaagagtgattcacctagtttgtcacacnatttttagcttgagatagattataccacagaaatgcatattctcttcatagaccacaagg

SEQ ID NO: 37241 - DNA, 121 bp, Artificial Sequence
  Synthesized
  misc_feature (61): n=a or g
tacacaaccatcacaacttcttacacaaacttcaatgaagtagcattttccatctgggttngagatattctgattgaaaacagctactgcaggagaaaaacatgcatacacacatttgtca

SEQ ID NO: 37242 - DNA, 121 bp, Artificial Sequence
  Synthesized
  misc_feature (61): n=a or g
gctcataggaagttgaatttaataacagagctgaagttggaataagcaggagagtcctgcntgtggtgctatgagaactacttcaaataggatatttctaggctgctttaaaaataggggg

SEQ ID NO: 37243 - DNA, 121 bp, Artificial Sequence
  Synthesized
  misc_feature (61): n=a or g
acgctgtattataatacaagaatcagaattatgtcccatgtagcaaatttaagtactaggnctaagttctgaacttgctctgcatattttatcatccaacttgaaaaagctgtggtttgtt

SEQ ID NO: 37244 - DNA, 121 bp, Artificial Sequence
  Synthesized
  misc_feature (61): n=t or c
ttgtcacatacctctttctctccaccctttcctttttatctgcaggaactaatattgctgntcttgcaaggtaagtaatcccaatattttgattactttaaagccattcacctctatttaa

SEQ ID NO: 37245 - DNA, 121 bp, Artificial Sequence
  Synthesized
  misc_feature (61): n=a or g
aaaaggaagaaactatatccacttactgaaatgctttgatgcttaaatttcctagttagtnaaacaattgatgatttcggtaatcatgcagttcttatgtggttgtgtgtactttcgtctt

SEQ ID NO: 37246 - DNA, 121 bp, Artificial Sequence
  Synthesized
  misc_feature (61): n=a or t
cattctaacaataaattcttagctttacttacatgtagtatatgatgtttctttgtccatnaacagtatttcaagctctctgctctgaaggcatgttctttcaatcctcattgatcagcat

SEQ ID NO: 37247 - DNA, 121 bp, Artificial Sequence
  Synthesized
  misc_feature (61): n=t or g
aaaggaagatggtgctatagagtctgcatagacagggagaggaaagtggggcaagtgtggnaggatttgggcacaaaggttccactcatctcaagatatctggatgcctaactactgatgg

SEQ ID NO: 37248 - DNA, 121 bp, Artificial Sequence
  Synthesized
  misc_feature (61): n=a or g
aggtgaagagcagagtttgcttcctgccatacctcctgctcttggctctcacccatggaanggctgtggagcaacggtgccatgaaataatgatgcttttatcagcagcatcgttccagcc

SEQ ID NO: 37249 - DNA, 121 bp, Artificial Sequence
  Synthesized
  misc_feature (61): n=a or g
ctctagaaagataacttatcagcagagtgacaaagttttatatcctttatatggtcctgtntgctatcttggaagtctgacagaggctttacaaatccaagtcatgttgaatgagttctgt

SEQ ID NO: 37250 - DNA, 121 bp, Artificial Sequence
  Synthesized
  misc_feature (61): n=t or g
agcatgggtcagtgctgtgtcccagcagtggagaggaaagcagaaaggtcttacaattganattgggctcatctcttcactaagaggtcctgatgggcatgacattcacccaccagtactg

SEQ ID NO: 37251 - DNA, 121 bp, Artificial Sequence
  Synthesized
  misc_feature (61): n=t or c
gtgctttttaattcagaattaaccccatcttattcgtgaaatagtgcactggtttaattcnaatgtctgaataaacagatagaacaatgtggcagtgtggtgcagcctggtctctgctgag

SEQ ID NO: 37252 - DNA, 121 bp, Artificial Sequence
  Synthesized
  misc_feature (61): n=t or c
taattgaatatattcatttacttttaattttaagtagatttaagaaagattttttttaccngatgtaatggattttttactgcacattctctctattccgtttttctccctattcctttga

SEQ ID NO: 37253 - DNA, 121 bp, Artificial Sequence
  Synthesized
  misc_feature (61): n=a or g
attctatatggtattttgaatgttatgcaagtttttaatgtatgtattagattttacgatntagtaatacgaacaactgggaagaatactctattaggatagactccagttaagcaaagta

SEQ ID NO: 37254 - DNA, 121 bp, Artificial Sequence
  Synthesized
  misc_feature (61): n=t or g
gaagtgggaatgtggggtgtgaatcccatctcctgcagcaccaggatacaggcagaagtangaggcctgtgggagccgggtgctctagcgtcgctctctgagcattgctctgccctaagga

SEQ ID NO: 37255 - DNA, 121 bp, Artificial Sequence
  Synthesized
  misc_feature (61): n=t or c
attgtgctcttaatagctggtatagggatgggaacttgggataggcttccttttattgtangaaatccaaatgggctgtaacctgttagcaaagcaaaagctccacatcaattgtactgta

SEQ ID NO: 37256 - DNA, 121 bp, Artificial Sequence
  Synthesized
  misc_feature (61): n=c or g
atcaccacatttcacattttggtgcatggaatgaataatgcacttctctgctcgtaacagnctatcaaaggtagcaaagacaaatggcactttgagaataaaagacatcgtgtcaatactg

SEQ ID NO: 37257 - DNA, 121 bp, Artificial Sequence
  Synthesized
  misc_feature (61): n=t or c
aaatacttgaaacttttttagctttttacccttgcttgtaaaattgcagtcagacagcacnttgttttagtagctactgttacaaattagccttagaagtaatgacttatggatgagtatc

SEQ ID NO: 37258 - DNA, 121 bp, Artificial Sequence
  Synthesized
  misc_feature (61): n=a or g
tctaacctgtatcacaaaaagaggcaagtgtctgcatgtggtacaggatgagggcaagatngcactgattgattggttcggatggaaaatagctccctgcacctttaggagcccagaggtg

SEQ ID NO: 37259 - DNA, 121 bp, Artificial Sequence
  Synthesized
  misc_feature (61): n=a or g
tttttttctcctttcctttaaataatttgacttgtttccatatcaaccaagaggtgtcggngtgcacgcatggaaatcacgctgagctctgcccagctgcaggaccccatcccagaggggg

SEQ ID NO: 37260 - DNA, 121 bp, Artificial Sequence
  Synthesized
  misc_feature (61): n=t or g
ctgatttgtttgcccgttttgtccagttctgggccctttggtgccaaagagacgcagatanagtggagagagcccaccagagggctaagaagatcctcctgttaggagaggctgagagagc

SEQ ID NO: 37261 - DNA, 121 bp, Artificial Sequence
  Synthesized
  misc_feature (61): n=t or c
aaagaaaaaatgacagaggagaaaataatattaatctcttttggttatggaaatatatgcnctcagttctgctttttccatagctcttcagagtattcattttctactttctattttcttt

SEQ ID NO: 37262 - DNA, 121 bp, Artificial Sequence
  Synthesized
  misc_feature (61): n=t or g
agtgcacaaagataacgtcttaattttcaggatcgataagatataagaatagactaagctngcttaaatttgctttttttaatatatgcagttacaattagaaattcatttgcttgtctag

SEQ ID NO: 37263 - DNA, 121 bp, Artificial Sequence
  Synthesized
  misc_feature (61): n=c or g
catctcacagctggatagtctaatacagagctgattatactccagcaccaatggcagcttnatagttatgtcctgggactccatttgacaagataaataatcaggtcagtgtatactgctt

SEQ ID NO: 37264 - DNA, 121 bp, Artificial Sequence
  Synthesized
  misc_feature (61): n=a or c
tgccgtaggagaagcagagagggagcctggaggcacattgacagagtgcctgtcaggctcnaagagaatctaagctgagctcggctctcagaggcatgcacatcataaaatcccgtttcgg

SEQ ID NO: 37265 - DNA, 121 bp, Artificial Sequence
  Synthesized
  misc_feature (61): n=t or g
tgtagcaatgtaacttctaggaagggagggagcaagtcccacagaactaagaagagaaagntttaagaatatcaatttcatgcctggtactaaaaaaaatctacttagccagccatagaat

SEQ ID NO: 37266 - DNA, 121 bp, Artificial Sequence
  Synthesized
  misc_feature (61): n=t or c
ggatgcataccatcactgttagaaatactttaaatctcaggttttggtaataatttatttntgtcgatggaaacagttaagaaagagtattgtagaattctaggtgtgttttgcattgaaa

SEQ ID NO: 37267 - DNA, 121 bp, Artificial Sequence
  Synthesized
  misc_feature (61): n=a or c
aagcctcaccccacggcgctcggaccaaaattaggccaaggttctgttctgccatggccanagtgtgattaataaatggctcaggggcagggaagcggggcaggacagcagcagcacggcg

SEQ ID NO: 37268 - DNA, 121 bp, Artificial Sequence
  Synthesized
  misc_feature (61): n=a or c
ggcattgaatttgggcttgaaattatcagtgtcagtgtgctttgttccttcttctggagcncctacagttctttctgttccattatcccttgaaagaaactgagatgggactcaggtaaac

SEQ ID NO: 37269 - DNA, 121 bp, Artificial Sequence
  Synthesized
  misc_feature (61): n=t or c
ggccccccagcagctgaggaaggcaccagctttgaggcatccttggaaagcacctctagtngctattgcttatgcagagacagaggtcaggtcccaagcagtgctggttggagctccatgg

SEQ ID NO: 37270 - DNA, 121 bp, Artificial Sequence
  Synthesized
  misc_feature (61): n=t or c
gactcggatgagagctttgtgagaagaaaaggaaatccaggtccccacaagcattaggggngcacagacctgcctctgaactctgcaggcaggacaaagattgaaggagatggatgtgatc

SEQ ID NO: 37271 - DNA, 121 bp, Artificial Sequence
  Synthesized
  misc_feature (61): n=a or t
caagaagttaagacatttcccaaacaattttttgtttcattctcaagtacctgcagtgacntttggccacattttgctgaaacaaaatgcatggaaaaccgcttctctctctcagaaagcc

SEQ ID NO: 37272 - DNA, 121 bp, Artificial Sequence
  Synthesized
  misc_feature (61): n=a or g
ccctctgctatgtattttcttacagcattagcttctttggcttgcatctgccctaaagcanagccataggctaaaacagcttcgtattttctagatgcttcacaacaaatcaaggatgtgt

SEQ ID NO: 37273 - DNA, 121 bp, Artificial Sequence
  Synthesized
  misc_feature (61): n=a or g
caatacctgggtgtcagcagtcccagcaggtgctgcccaagcacaacaaaggcgcagcccncaattccacgtgcacatagggtttccagtgtctatctgcccatctgcacctgtgtaagtg

SEQ ID NO: 37274 - DNA, 121 bp, Artificial Sequence
  Synthesized
  misc_feature (61): n=t or c
tgtttagcagtcgtttgctgcccctgcagatcaacaaatcaaaccgcacatcctgatgttngcaatgggaatgcatggcagaggagtgcagtcccaattgaggagaggaaggagagagtag

SEQ ID NO: 37275 - DNA, 121 bp, Artificial Sequence
  Synthesized
  misc_feature (61): n=t or c
gtcagctgagacacaaggccacagtgtataaagactagccttagtctctgaaacagcttgngatctctagaaattatgcatattgggatacaatggaggtgcccaacaagtggcttgggag

SEQ ID NO: 37276 - DNA, 121 bp, Artificial Sequence
  Synthesized
  misc_feature (61): n=a or g
gggcatgcaggcacatgagtgactaataacaaagatgaccctttggacaataattatttcngaataaatattctgaaattataatgccacagatttctaggcagagctggcatagtacata

SEQ ID NO: 37277 - DNA, 121 bp, Artificial Sequence
  Synthesized
  misc_feature (61): n=t or c
ctgagctcaagtattactcaagctgatagcaatttctgaatgccaaaatacacgtgcaaanatttatcaacaagtagaaactgcttatcacagaattaagtcaacttttcaagacaaacag

SEQ ID NO: 37278 - DNA, 121 bp, Artificial Sequence
  Synthesized
  misc_feature (61): n=t or c
ctgcattctctctgccctaaaactattgctctgcaaaaaatgctgctactgtgtaccatanaaaaattatttcatcgatgacaataacctacagtcataatatttagcttttctgtttgat

SEQ ID NO: 37279 - DNA, 121 bp, Artificial Sequence
  Synthesized
  misc_feature (61): n=c or g
tattattaatatttaatttttttcaggcagacttccttaaaaatagattcagttgactcangttgttttaaaagcaacgtccaattggattaaatagactttagtagcaacaaacaaaagg

SEQ ID NO: 37280 - DNA, 121 bp, Artificial Sequence
  Synthesized
  misc_feature (61): n=c or g
ggatagtgccttagtttttcaaatccttaacaaattcttcaagagaaatctcctgagtacntagggatgatcataagtggcaacagtcctgtagtgttcctgtgtgcatctaactgtacgc

SEQ ID NO: 37281 - DNA, 121 bp, Artificial Sequence
  Synthesized
  misc_feature (61): n=a or g
cagatcggctccctgtttttctttgggtagggatcattttcatgttttatcacaactttgncacaaacattctcctgcgaacaaaaacactacttcctgggaaaatcttttttaatgtcta

SEQ ID NO: 37282 - DNA, 121 bp, Artificial Sequence
  Synthesized
  misc_feature (61): n=a or c
taactgacagtgaagctggatttataatagccaactccactcatggcagatgaatttctgnctatatttgggaagtatgggggtcatgtcttcctgctctgtgaagaagatcagggcccag

SEQ ID NO: 37283 - DNA, 121 bp, Artificial Sequence
  Synthesized
  misc_feature (61): n=a or c
gttatttactaaggtgctggggaggggccagaggaagtgatcacagatgaacaacaacaanaaaaaaatcagcaatatggctaatagctattttagtgctgctcaccatcccaaagaacca

SEQ ID NO: 37284 - DNA, 121 bp, Artificial Sequence
  Synthesized
  misc_feature (61): n=t or c
aggcctgttttgactatgctaatagctttgctgaattaccttgggcttgcttttgcatatngtccttttgggtcctggtgtaacatccaaggtgaaattaggtaactgatgagagaagcat

SEQ ID NO: 37285 - DNA, 121 bp, Artificial Sequence
  Synthesized
  misc_feature (61): n=a or g
ctatgccaactcctttcagtgaaaaaggatatgaatcggaaactactttaattttgatgantcttttagtgtgaaagtgtcacactgagctggatgatcctaaggatattttaacatgtaa

SEQ ID NO: 37286 - DNA, 121 bp, Artificial Sequence
  Synthesized
  misc_feature (61): n=c or g
actgaaccatcagactgctcagactgctgaatgatacacggaagaagaatacagtggtgangagtagcgtattcaaactataaagatctgaagttttccattatatttttggggctgcagg

SEQ ID NO: 37287 - DNA, 121 bp, Artificial Sequence
  Synthesized
  misc_feature (61): n=t or c
caattacattcatgaatacaaggagtccagccatgcaaatacagtccaagtttccagttgntttttgaaggagacagagggagttctgttaagcattttaaactggcaaaacctgtctatc

SEQ ID NO: 37288 - DNA, 121 bp, Artificial Sequence
  Synthesized
  misc_feature (61): n=a or g
ctgaatttgctgacttcagtagagctgttcttgtctgagattggaggaggggatatggggntctgatctgggtttgaaggcatttgctctgcaagatcccctgaaatcgtccctatcataa

SEQ ID NO: 37289 - DNA, 121 bp, Artificial Sequence
  Synthesized
  misc_feature (61): n=t or c
ttccttgtttcagaggtttattgtattccttctatacaacgggtagtgtcttaattttctnttcctgcctaagaaagttgtgactatcactgtagaagtcaaggcttgcaagctttctatg

SEQ ID NO: 37290 - DNA, 121 bp, Artificial Sequence
  Synthesized
  misc_feature (61): n=a or g
tcaatcatttaggctggtctgaaagtgttttcctggtggtgtcacttcagttttgattttntagcatcttcatgtctaacaaaaagaaattgaaatgagaaactgcttcagactgaaaaaa

SEQ ID NO: 37291 - DNA, 121 bp, Artificial Sequence
  Synthesized
  misc_feature (61): n=t or g
ctgaagttagatcttgatcagtatggttattacttttgaaaaccataatgcatacagttangactgtctttcaggattttaaaataagtgtaatagctttgttacaggatactttgaaata

SEQ ID NO: 37292 - DNA, 121 bp, Artificial Sequence
  Synthesized
  misc_feature (61): n=a or g
ggtggggggatgtagcccacccaaggatgtgggattgggcagcatttccctttgggctccntcctttggcacttggtgagaagggaaaatctgctctggaagagcccatcctgaaggagca

SEQ ID NO: 37293 - DNA, 121 bp, Artificial Sequence
  Synthesized
  misc_feature (61): n=a or t
agagcttctttggaggctcttccataaggaaatggctctcttctttattgcagttaatatntttttttctgcctgcagctggcaccttgctctactcccatacactcctctttccctctct

SEQ ID NO: 37294 - DNA, 121 bp, Artificial Sequence
  Synthesized
  misc_feature (61): n=a or c
ataaatatgaaaaattttcaaattttcagcaatttctcttcccctgcatacgctaagtacnttattatttatattgctttgcccctggcaaaaaaaaaaaaaaaaaaaaaaaaaaagtcat

SEQ ID NO: 37295 - DNA, 121 bp, Artificial Sequence
  Synthesized
  misc_feature (61): n=a or g
tacagttaaacaacaaacatcagtgtgtagattgagctctttatcaccctgtttttttatntatgcatgccttgacttcttttctgttactcacaaatcccctcgggaaagctttcctgtg

SEQ ID NO: 37296 - DNA, 121 bp, Artificial Sequence
  Synthesized
  misc_feature (61): n=a or g
agagaaattgaatagtggcaggcttgtaaatggaaatgcaactgcttcaacatactgaganttctttgtcatagaaaagtggtttgtgaaatgaagatgactttaatgggatggtatttac

SEQ ID NO: 37297 - DNA, 121 bp, Artificial Sequence
  Synthesized
  misc_feature (61): n=t or c
tatgagctcaaagcaaaagaggagatgaagaagattcagggagtagcagctattgaccctnggtatctccttcttgggaacccagctttaatactttcagttgggtttccagatgtgttga

SEQ ID NO: 37298 - DNA, 121 bp, Artificial Sequence
  Synthesized
  misc_feature (61): n=a or g
ggtaacacaaaggagcacacacagctggccagagccatcttactaagaagtaaaggcagcntctgacttgaagtcactgaatttctgaatcacattttcactgtcaataaggacgtgcaag

SEQ ID NO: 37299 - DNA, 121 bp, Artificial Sequence
  Synthesized
  misc_feature (61): n=a or g
cacctctctgttcctgtggctcagggctggctggaagcaggtatacccatgcaggtcaccnggaaccacttgcttgagacaaatggccttgtttctagagccttgattttcctcagcagca

SEQ ID NO: 37300 - DNA, 121 bp, Artificial Sequence
  Synthesized
  misc_feature (61): n=a or g
attagatattaatatttaaggttatatgacattttgcagatgagtaaaataatcagacctnctgtcagccaattagcacattaaaatacttgcaaatgcaaaaatcactgacccgatatca

SEQ ID NO: 37301 - DNA, 121 bp, Artificial Sequence
  Synthesized
  misc_feature (61): n=a or g
aaattgtctatctcatagggggcctataagtgctctgtggcctgggcataaaagagaattnctgaatggttctagtaaggaaggtatgaatgtataaatatacaggcactgaaataagtag

SEQ ID NO: 37302 - DNA, 121 bp, Artificial Sequence
  Synthesized
  misc_feature (61): n=t or g
ttacttgtgccaatgataccactattcagtctccctgagaaatgaagcggatttgggttgntttttttttttcaggccatgcagatatgcttgttaatcagagaaagttgctaatattaca

SEQ ID NO: 37303 - DNA, 121 bp, Artificial Sequence
  Synthesized
  misc_feature (61): n=t or c
tacaagataacctgccagaaaacttcaaagaacagatatcagagtgatgaaagatcctttnttgctaggcaaccggaacacatagtgttgaggtacaacagagagctgaaactaaacttct

SEQ ID NO: 37304 - DNA, 121 bp, Artificial Sequence
  Synthesized
  misc_feature (61): n=t or g
ctccagtttgtgagaggaagaggaaatatgatgttgtaacttcagaaagtaagctctttangaatgtattctttattttactttaaagaagtgaactataaaacccctcaattcaattcta

SEQ ID NO: 37305 - DNA, 121 bp, Artificial Sequence
  Synthesized
  misc_feature (61): n=t or g
gtgctgaatcctccgtactgccactgccgctcttcttttttgtgattgtgttttgatgatntgtcttgtttccatagtctttttctgtaatggcctgagcacttcagctcatttggtcttg

SEQ ID NO: 37306 - DNA, 121 bp, Artificial Sequence
  Synthesized
  misc_feature (61): n=t or c
caaaacaagggtttgctggagcattcagctggcgttcggtggtgttatcttgctggaaagngttcgtcagtgcaccgcagatcattttggaggtctatagacagaatcacagaattggagg

SEQ ID NO: 37307 - DNA, 121 bp, Artificial Sequence
  Synthesized
  misc_feature (61): n=t or c
agatccagtaaccgtaacatccgaacctgctgtccgaggtgtgcattcgatccttttgtcntctttcagcacaggaaagcgtgcttgaattcttttagttactttatacagaataaaggtt

SEQ ID NO: 37308 - DNA, 121 bp, Artificial Sequence
  Synthesized
  misc_feature (61): n=a or g
ttattttttaaaattgttgttttaatgctcacatagcgtaaaataaaaaaatacattgctnaagttttgtattacataaactcaaaggcactcttacagcttagcaggctgcactggcact

SEQ ID NO: 37309 - DNA, 121 bp, Artificial Sequence
  Synthesized
  misc_feature (61): n=a or g
accctgccacttaacataactactagtccccacattatggtatctgctgacttgacaaacntgctccacatctgcaggtcacaaattatgatcaacagataaagaagataggccccagcat

SEQ ID NO: 37310 - DNA, 121 bp, Artificial Sequence
  Synthesized
  misc_feature (61): n=t or c
tctttactatcatgcagtaattatttgacaagggcaaggaaaagaaaatccacgcctatangggcaattccatctgtcctgaacatgaaatccttattctaggatcaagtgaatggctcaa

SEQ ID NO: 37311 - DNA, 121 bp, Artificial Sequence
  Synthesized
  misc_feature (61): n=a or c
atatgaaatatgatagtttttctggctttcaatgagtcagtagctcatggtttgtaggtantactgataatgctagtagccataattcaggtaccacaaatcatgtgcagcacttttttgc

SEQ ID NO: 37312 - DNA, 121 bp, Artificial Sequence
  Synthesized
  misc_feature (61): n=a or g
acattcttggccagctgcaataagaaaaagaaatgataaaagggagttttttccacccccnaccatcagtaagctaaaacctggactactaatatgcattttccactctgttatcaaacaa

SEQ ID NO: 37313 - DNA, 121 bp, Artificial Sequence
  Synthesized
  misc_feature (61): n=c or g
tctgcaggggattctatttatgtctgtaacattgcttcttactgctaagctgtaaaaatgntagataagactaatacaattatatgccatagcttgatttaaactgctgtgatttatggaa

SEQ ID NO: 37314 - DNA, 121 bp, Artificial Sequence
  Synthesized
  misc_feature (61): n=t or c
cagatgcattaagtcctctctgtcccacgcacagaagtgatgtcatctgaacattgccccntggcactgtaaagcatgtcatttcaagaggaatttgagcaacaagaaaaagaagaaggct

SEQ ID NO: 37315 - DNA, 121 bp, Artificial Sequence
  Synthesized
  misc_feature (61): n=t or c
attttgatataatttatgagatgtagcaataagggaagaagagacaaaataaaataccagncaataggaaaataagacttctatataataaatgtttatgcatcacctgtagcaatcaatc

SEQ ID NO: 37316 - DNA, 121 bp, Artificial Sequence
  Synthesized
  misc_feature (61): n=t or c
taattctttaccagtcacgtctcatacaaatctttccataattttctctgcgactgattcnggtctaatgtgcctgtgttttcttgagtgaacccatttatgctcttgaacaaacagacaa

SEQ ID NO: 37317 - DNA, 121 bp, Artificial Sequence
  Synthesized
  misc_feature (61): n=t or g
ttggcctgtttttaatctggcaaacgatagtgtttaactgaacatatataacagccctggnttttcctgttatcctctgctcctcccgcactggaggaacagtatacagatggaaactgaa

SEQ ID NO: 37318 - DNA, 121 bp, Artificial Sequence
  Synthesized
  misc_feature (61): n=a or t
caataaaaagctaagataagaacaatctcatcatgtaaatatgttttaaaataagcttaanggactcatatctacttactctggcagactgcccaacgaagaacactgcctgtttacctcc

SEQ ID NO: 37319 - DNA, 121 bp, Artificial Sequence
  Synthesized
  misc_feature (61): n=t or g
gaataggagagcagcgactatgccaccagcatggattgtcatttaaatcctttccaattanaagaacaatgagaatatatgcctgggaaggactttcaggagcgatatacttttaacctcc

SEQ ID NO: 37320 - DNA, 121 bp, Artificial Sequence
  Synthesized
  misc_feature (61): n=t or c
aagtaagatattgctctcactccaacagccaagccttatgggatctcctttcaccagccantcaagtaagagtcagagctcctgactcttgcatggaaccattgcacttcccagaattgtc

SEQ ID NO: 37321 - DNA, 121 bp, Artificial Sequence
  Synthesized
  misc_feature (61): n=a or g
gttattagtgggagcaggaaggtgattaagaaatgggttgcagggctttcatctggacgcntgtattttaagactggatgactaaaaaggggatttgtcagactaattcagttctgtagca

SEQ ID NO: 37322 - DNA, 121 bp, Artificial Sequence
  Synthesized
  misc_feature (61): n=t or g
agagtgtactttcagttcaaacacaatataatccacttcagtaaagagatggaagaacacngttttcaggagcatttttataaagtcctggagatccctcctgcatgttaatgcttgataa

SEQ ID NO: 37323 - DNA, 121 bp, Artificial Sequence
  Synthesized
  misc_feature (61): n=a or g
cctctcagtctccctggtagaattatctcccaggcttctcccacacttttgagctgctggncaagctcccattgaggcattgttgaggagaggtagccatttcatggcttccagtttccct

SEQ ID NO: 37324 - DNA, 121 bp, Artificial Sequence
  Synthesized
  misc_feature (61): n=t or c
ctctgatttaactcaaagcacatgcttttggggacgcacaacccacatctttggggctttngcagttcaaggagttgcaagttactgcaggcagaaatgctgatagtctgcaagagaagaa

SEQ ID NO: 37325 - DNA, 121 bp, Artificial Sequence
  Synthesized
  misc_feature (61): n=t or c
tgtcaaggtttatctgcatatttcacagagttttaattgcttcctgacctcttttcttttnacaattcagacaaatttctaacaagtagttttgtgctacaaattcatagtctctgatacc

SEQ ID NO: 37326 - DNA, 121 bp, Artificial Sequence
  Synthesized
  misc_feature (61): n=t or c
ctgcattttgtcaacaagacttttaattctgaatagatttttagttccgttacggtctcanttctgattggattaagattctcacagcttttttgcttagcatgcacagtgcatgtgtcat

SEQ ID NO: 37327 - DNA, 121 bp, Artificial Sequence
  Synthesized
  misc_feature (61): n=t or c
gtgaggtcaagccagaatatatgattggtttgacaagctgttgtgacaccatcacagggantcatagtgtaattctttgtgatggctgtcagacactgagcacaccagtggctttcatcaa

SEQ ID NO: 37328 - DNA, 121 bp, Artificial Sequence
  Synthesized
  misc_feature (61): n=t or c
ttgtggtgttcatctttccacatctttccttgggaaaaggtgagctcaatgcaaaaacaangcttgcaaaaagcacatgtggcatttacttgtgcttttctacttgatgtgtgacttcttt

SEQ ID NO: 37329 - DNA, 121 bp, Artificial Sequence
  Synthesized
  misc_feature (61): n=a or g
cacgacccaactacgaaaacaccgagtgagcaaccagctacacacacttatgcacacaaanaagtacttttaattcttacacatactggttctacagttcttcaaatatatccacaaactg

SEQ ID NO: 37330 - DNA, 121 bp, Artificial Sequence
  Synthesized
  misc_feature (61): n=a or g
ggagaaggccttcaacctggagggcctgggtggatgtgcagctgggaagtggaagcactanaacttctgcaagcagatgtcccacctctgctctatatccctgccaaaaaaacaacctttg

SEQ ID NO: 37331 - DNA, 121 bp, Artificial Sequence
  Synthesized
  misc_feature (61): n=t or c
taaacaaaactggactagcttttcagctaatgcaaatcagctaaggtttttggctgactcngtcaaagtatatttctttctttaacctttggatggttttctttcacaatggaatgcctga

SEQ ID NO: 37332 - DNA, 121 bp, Artificial Sequence
  Synthesized
  misc_feature (61): n=a or g
tgctgatgattccttggagcatattgttctgtatcctgaagaaggctttccagcatcattntaactccttatgcttgctgtactgaattgcagtggaaataggagaaagacatgacgttct

SEQ ID NO: 37333 - DNA, 121 bp, Artificial Sequence
  Synthesized
  misc_feature (61): n=c or g
taaataattttcattcacaaacacagttgtttaaattgtagtttttttatttggatttatnctatgaatctgtaaaccaaattgttcttgaagaatctagcacagttgtgggagagtaaag

SEQ ID NO: 37334 - DNA, 121 bp, Artificial Sequence
  Synthesized
  misc_feature (61): n=a or g
ctgatagtgggatataactaattatcaaagttacaccattatctgaccatctatttgatgntctcttgatgcattctgtggtgacaatgtggaactcatcccttcatatggctcccactgt

SEQ ID NO: 37335 - DNA, 121 bp, Artificial Sequence
  Synthesized
  misc_feature (61): n=a or g
cagctgtggactggaagaggtaagtgctcccaaaccagctactatgggggaaactggtgtnggtgaggtgagttccacactagtggatggagtgtggctatgggttactattcttgtgaca

SEQ ID NO: 37336 - DNA, 121 bp, Artificial Sequence
  Synthesized
  misc_feature (61): n=a or g
accaaggtcctgccagtgtaaggccatccttcttcagagtaatcctacagcagtagcaagnagagatttgttagaaaaaaagcctaggctgggattttctttcttgaataattaggtaatt

SEQ ID NO: 37337 - DNA, 121 bp, Artificial Sequence
  Synthesized
  misc_feature (61): n=t or g
cagtggtgagtaaattgtggcatgtcaatagttactctaaagtttcttttaaatctacacntattaatcaccctggaggttttgtttgtgatagtcattttgtgtgatcatctgttattaa

SEQ ID NO: 37338 - DNA, 121 bp, Artificial Sequence
  Synthesized
  misc_feature (61): n=t or c
atgcataaattgcccaacattcccattatcaatttgtgttgtttaaagttctactcagttngggttgaaatccacattcttatttgttaatctgtttctgaaaataaaagtaaggaaaatc

SEQ ID NO: 37339 - DNA, 121 bp, Artificial Sequence
  Synthesized
  misc_feature (61): n=a or c
gttggcagaatgcagccaaagtgcccgacgagcatttggtgaatgggaaactgttgtttcncatccctaagaacagcaaagaggccacaaaaccaaaccagcccagcaaacccagccggga

SEQ ID NO: 37340 - DNA, 121 bp, Artificial Sequence
  Synthesized
  misc_feature (61): n=t or c
tgattaagatatgcatcagaaacagtgctaagaaaggttgccaatgccttccattcctaangtgtacatttgtgcacattgtttataatgtattttgaaagacttaagtcaattattttct

SEQ ID NO: 37341 - DNA, 121 bp, Artificial Sequence
  Synthesized
  misc_feature (61): n=t or c
gaaaacactgattttatgtttgtgatttcagagggaattttcacaaaaactatgggaagcntcacaaccataaaagtagtaaagcgtatgttaatcttggcttccccagcactctgaaatc

SEQ ID NO: 37342 - DNA, 121 bp, Artificial Sequence
  Synthesized
  misc_feature (61): n=a or g
gcaacttaattccaaagccacgatttcctacagtttgtcaatatccactctatctgttcantggtattttctctgtcaagatacatatcttaatacacaccatagcaaggaaggtccagtc

SEQ ID NO: 37343 - DNA, 121 bp, Artificial Sequence
  Synthesized
  misc_feature (61): n=t or g
ccactgatgtaagaggcaatacttggatagacttacttgcctatttgctaagagcaggaangatgcatgtgatcaactaacgcctaagaaatacatttgtatttcacaaatggaaatgctc

SEQ ID NO: 37344 - DNA, 121 bp, Artificial Sequence
  Synthesized
  misc_feature (61): n=a or c
cagacaaatggggtaggtgcagcaatgaaagcagaaagccagaaaaaaagctaagaaaaanatgcataccaatatagcatatataggtatactatagtataacctcctttgagatattaca

SEQ ID NO: 37345 - DNA, 121 bp, Artificial Sequence
  Synthesized
  misc_feature (61): n=t or c
cttaatattcctgaacgaattatcgaagtattagtcctcagatcaggaagagtgatttttnttataaactgtcaagtttatatgatcaaggaatcaatggaacatagcaggtaagtatctc

SEQ ID NO: 37346 - DNA, 121 bp, Artificial Sequence
  Synthesized
  misc_feature (61): n=a or g
gttatttgttcatggctccatcagagcaaaaatggaaaaagaaacccatacattttaaggnaaaataaactgtctggggaggaggaagaagttatagtgtcttgaactaaaggttgaacag

SEQ ID NO: 37347 - DNA, 121 bp, Artificial Sequence
  Synthesized
  misc_feature (61): n=a or g
gcaggctgagtgccctcctggctaatgctggtaccagtggagaagcagaaacgggttcacngccaagaacactctgctatcaagcagctaagatgaatctctgttttgtggagatggcaga

SEQ ID NO: 37348 - DNA, 121 bp, Artificial Sequence
  Synthesized
  misc_feature (61): n=a or g
agtctctgaagtgccaatcccctgctgttctaataggaactcagaattttaaactaatggnagtacaacagaaaaaaggtgggagagttagttaaacttcagactttaagatgttcgtagc

SEQ ID NO: 37349 - DNA, 121 bp, Artificial Sequence
  Synthesized
  misc_feature (61): n=t or c
gttcacgtttaactaacaaataccattgactatcacagagctatttcaaagttgtttaccngacccattcaaaattgacaacatgctggcttgaagtattttgcacagtgctttcacttgc

SEQ ID NO: 37350 - DNA, 121 bp, Artificial Sequence
  Synthesized
  misc_feature (61): n=t or c
gcccaccctaggtgttcatttcagaagaccatcaaacaaagatgcctcttgccttctgacngaaggtctttcaccaaagacactcactatcaggttgctgctccattgctgccctttcagt

SEQ ID NO: 37351 - DNA, 121 bp, Artificial Sequence
  Synthesized
  misc_feature (61): n=a or g
acagtattaacgtgcaccagatcttttttttttattaaaaacccttgcactttcccttccnctctttcctccccccactcaatactgttattcaaaatgaaatacatctataatgctccta

SEQ ID NO: 37352 - DNA, 121 bp, Artificial Sequence
  Synthesized
  misc_feature (61): n=t or c
aacgactgtgagccacagggatcgtcagcaccatcattttacttttatctgtttcaccagncatttcagttgagccccttgcccagttggggaagttgcctgtgcaccggtggcactgttt

SEQ ID NO: 37353 - DNA, 121 bp, Artificial Sequence
  Synthesized
  misc_feature (61): n=t or c
gctgcatcctaagctctgtgtggaaattattcaccaacaaagcataagacacctatagtgngagtggtaatgacagtgctggaaaagggcacacgcctgtcccctgcaaacactcctgcgt

SEQ ID NO: 37354 - DNA, 121 bp, Artificial Sequence
  Synthesized
  misc_feature (61): n=a or g
gggcatggtgtgccccgctgccaggctgacgttgagccagtcacaatgagcagctgaaatnctcagtgtttcacaaatgaagccctgggaggaggcaatgggtcggataattccactcgag

SEQ ID NO: 37355 - DNA, 121 bp, Artificial Sequence
  Synthesized
  misc_feature (61): n=a or g
aagttccaaagcagcttggaatcctcctcctgctcactcctgctgttggcttttcctacanaccaaccccaccaacgtgggaagagcaggcagctccctcacatgggaaatccctcagcaa

SEQ ID NO: 37356 - DNA, 121 bp, Artificial Sequence
  Synthesized
  misc_feature (61): n=a or g
gataatgtcattgcaatggagagcaggtgtcttcaaagagaaccagaacttgttttttggngtattatatattgtagtctggtgcatgtgacttccatagtgaaaacctggctcacccgaa

SEQ ID NO: 37357 - DNA, 121 bp, Artificial Sequence
  Synthesized
  misc_feature (61): n=a or g
tccaggtactagaacctttttctgtaacaatttggaaaatagcagaaactgtgtccacgcntgagccagtattcccaagttagttttcctcttaagtcttttagcattaagaattcatttt

SEQ ID NO: 37358 - DNA, 121 bp, Artificial Sequence
  Synthesized
  misc_feature (61): n=a or t
gttacctaaactcgctcagcaccatgcagttaaagaagaggacaaatctctccaactggcncaactggccattgctcctctgcttggctggcacacagaatctgaggagacaggctgctgc

SEQ ID NO: 37359 - DNA, 121 bp, Artificial Sequence
  Synthesized
  misc_feature (61): n=a or g
attgtacaatagtctaaagcttgtaactacatatatacagttaactaaataatcttttatngtgagtttgaatgaaaaaccaaaaagacttgccatgcaaaacaacctttcattcttaaag

SEQ ID NO: 37360 - DNA, 121 bp, Artificial Sequence
  Synthesized
  misc_feature (61): n=t or c
ttctttcctttttaataaacaggatgattacacctcgtactcttcagtgctatttcaacanatgttgaaatccttatcaactgggagaataaacatctctcactctgtctttgcccacaac

SEQ ID NO: 37361 - DNA, 121 bp, Artificial Sequence
  Synthesized
  misc_feature (61): n=t or c
atttgcagtaaattatttgccaatagacaagcacaaaaagcctcggagttaaaataaattnccatttccctcctaatgacatgaggtggagcacatgtttctcttatatcacatcctgaac

SEQ ID NO: 37362 - DNA, 121 bp, Artificial Sequence
  Synthesized
  misc_feature (61): n=a or g
atatcagagtggagtggagcttgtttcgtagtattcctctgtggtggttcataggtgtgcntatacctctagtgaaactcatttggataggcagacacattgtcttccagctctttaaacc

SEQ ID NO: 37363 - DNA, 121 bp, Artificial Sequence
  Synthesized
  misc_feature (61): n=c or g
tactgatctcagaacgttcagaatccagacatgtagaccataatgaagctttttaataatnttgcttaatccagtctgttttaaatcacctaagagatactgaattatcatacttatctca

SEQ ID NO: 37364 - DNA, 121 bp, Artificial Sequence
  Synthesized
  misc_feature (61): n=a or g
tgcagtattagctctgtcatgggaaaccaaagggtttctgccgcagtctgaacaaagcctntgcacaaagtaatccaagtttctgatccttccccatgctgcaggttagacatcagaaaca

SEQ ID NO: 37365 - DNA, 121 bp, Artificial Sequence
  Synthesized
  misc_feature (61): n=c or g
ctttcagattgctacaagcaatatccacgcaatcctacagaatactacaaagccagattgnaaaaccagacaagataaagctctgctaacacattagtaaggaagtggatatctagcacca

SEQ ID NO: 37366 - DNA, 121 bp, Artificial Sequence
  Synthesized
  misc_feature (61): n=t or c
aacccagaccagcaaccgcccttttccccagtatattctgggagtgtactctgcacatagnggagctgacattgcaacaagttttgcatggttccaaaataatcactctctgcttttttag

SEQ ID NO: 37367 - DNA, 121 bp, Artificial Sequence
  Synthesized
  misc_feature (61): n=a or c
acaaacaacccatctctctacccatcccttttcagactgacacattaccctccttcccatncagtgttgacaatcaacatcttaaaagcctgtaaggtccagcctggcaaagataactgtc

SEQ ID NO: 37368 - DNA, 121 bp, Artificial Sequence
  Synthesized
  misc_feature (61): n=a or g
agcatcattgaatgccagtgggggatattttttcttttatctagactggctgagcaatgcncccaggtgagcctcctgaggttgaacagatccaagtgcaaggtgttgcacctgggtcgtg

SEQ ID NO: 37369 - DNA, 121 bp, Artificial Sequence
  Synthesized
  misc_feature (61): n=a or g
aagtaagcttcaaaatctcatgtatttgttgtcatacttatctgttcccatgttacatatncatttaatgtggacgtctccactctttatcatcataaatcttgtagttggtcaaaactat

SEQ ID NO: 37370 - DNA, 121 bp, Artificial Sequence
  Synthesized
  misc_feature (61): n=a or g
atgttactgagtaaacaaatttccagaaatctataggtagctgggagtacatatcactttnatttttcaagaacttgaattagaaaatcccttacatctggatggttgtctatactcctag

SEQ ID NO: 37371 - DNA, 121 bp, Artificial Sequence
  Synthesized
  misc_feature (61): n=a or g
actaaggcaactgcatttgacagataactcattagtcatttttttcttgtattatggaagntgaaattatgttactatttatttctatgtgttcccagtcatgctaatttatttaaatagc

SEQ ID NO: 37372 - DNA, 121 bp, Artificial Sequence
  Synthesized
  misc_feature (61): n=t or c
agtgccatcctgtacagggacaccctgacatgcagcattgtctcctggctgcagtttttgnttctgtagcctgggcacaacttgccgatacccctgcggtgcccagctgagtctctgtgcc

SEQ ID NO: 37373 - DNA, 121 bp, Artificial Sequence
  Synthesized
  misc_feature (61): n=t or g
taatctactgggtggtagaatgggtaaccaaactctaactcgagtctgattttgtttaagntgagagaagagaagcaagagcagcaaaaagtcttggtgccataaaaatggccgttaccaa

SEQ ID NO: 37374 - DNA, 121 bp, Artificial Sequence
  Synthesized
  misc_feature (61): n=a or g
aaatgcaaagtggaagagggaggagggagaagcacctgtcaaacctgacttcagaatcctnctggagaatctttcttgttctgcaggtaatactgactttgtaggcttcatttgcatgtct

SEQ ID NO: 37375 - DNA, 121 bp, Artificial Sequence
  Synthesized
  misc_feature (61): n=a or g
accatctcatttatgcacaccactggtggtaaggtgtttgagtcctgaaagaatcccagcncagattcacctttaacttcttttttggatcaaagcagctccaagaacaaagcactgttaa

SEQ ID NO: 37376 - DNA, 121 bp, Artificial Sequence
  Synthesized
  misc_feature (61): n=a or g
aggtgatcaatcagtggttcaggccgtgactcaacagttctcatacaatccccatataaancatggggctatatatggagcagatgcacacagaattcaggagagtggattcctggtatgt

SEQ ID NO: 37377 - DNA, 121 bp, Artificial Sequence
  Synthesized
  misc_feature (61): n=a or g
attgagtgattttccaaagaaaataaacagctctgtaaatttgggtctttagccttccgtncaccggcgctcacgtgtaaaatggaagtaaggccacatcccatttcatctgcgcctcata

SEQ ID NO: 37378 - DNA, 121 bp, Artificial Sequence
  Synthesized
  misc_feature (61): n=a or t
cgatccctaaaattcacatttaagatacaaagatgacgttgtgctttaagctcatgttttnaactaacttcagaaaaggtatgggagacaatacaaagaaaacatgccaacagaaattaga

SEQ ID NO: 37379 - DNA, 121 bp, Artificial Sequence
  Synthesized
  misc_feature (61): n=t or c
ttcatttggagtgcttcttgagagtagttcaagagtccttgaatgactgtatcaccttttngatggcttaagaagttcttttttatttattgattactgcttcgggatgataatcagataa

SEQ ID NO: 37380 - DNA, 121 bp, Artificial Sequence
  Synthesized
  misc_feature (61): n=a or g
gcaaagcaatggccagagctgaaggctggatttctggatttcatcacccagacatgaaaantgctgcaaaagatgcacttatcacaataagatacttaccaaggaggaaaatgtggttcat

SEQ ID NO: 37381 - DNA, 121 bp, Artificial Sequence
  Synthesized
  misc_feature (61): n=a or g
atgcagctgatatgctaccccatagttcttttctacagctgagacttatgtttatgttaantactgattcatacagccatatttcaaagttattactgataaataaaatgttcaagtcaag

SEQ ID NO: 37382 - DNA, 121 bp, Artificial Sequence
  Synthesized
  misc_feature (61): n=t or g
atcttaaagaagtcaaaccaaatgacttcatggtgagtcctttggaagagtaaagagaatnagaacaggacagaacctgtcctggttctgtgtaagacagaagcttcctaaccaagtaaaa

SEQ ID NO: 37383 - DNA, 121 bp, Artificial Sequence
  Synthesized
  misc_feature (61): n=a or t
caaaaatcctgtgtagcctgttagtttcacagagtgccatacaccaattatgagataggtnaatcttcagagatcatataaacttatcacttccaggagatttaagaggtgaaatacagta

SEQ ID NO: 37384 - DNA, 121 bp, Artificial Sequence
  Synthesized
  misc_feature (61): n=a or t
tgtcaaaggcagcaggcggaaccaccatggagctggcttgcagcactgcagtgccttctgnccttaggaacatgacttggattaaaagttgaattacagagccattccctttgtgtcctct

SEQ ID NO: 37385 - DNA, 121 bp, Artificial Sequence
  Synthesized
  misc_feature (61): n=t or c
ataaaacctctttcagtgataaaaaaaaaatccccctaatgcacaatctgtaatgtacatnggtggagtcaccctagggccagtaaccttccaggaaattctgtctgaacacgactttctg

SEQ ID NO: 37386 - DNA, 121 bp, Artificial Sequence
  Synthesized
  misc_feature (61): n=a or g
ctttccgtgaacactgcaggaattattcctagtagaaaactaatcttcagaccaacaaatntaggtttttccttgctccatctaaaattctgcaccttaaaatagctactaccttcttcac

SEQ ID NO: 37387 - DNA, 121 bp, Artificial Sequence
  Synthesized
  misc_feature (61): n=a or g
ggccattacagtcactggtctcatagatataccagtatgtgtttccatatgtgtttccatntgtgtaaatatgcacaagttgctcgttggtaggtggggggaggtctggttttgctctggt

SEQ ID NO: 37388 - DNA, 121 bp, Artificial Sequence
  Synthesized
  misc_feature (61): n=a or g
agtccttccccagacatgagcttctcacttaaccgcaggtcagcagttggtgctggtttcntggcagggagccagcgctgttggtgtgctcccatgggtgcagagcagaaagcctccctgc

SEQ ID NO: 37389 - DNA, 121 bp, Artificial Sequence
  Synthesized
  misc_feature (61): n=t or c
tggcagcatgtgcagctcagtcccatttcaacttgaacgtttttgcactaggaaagccctncaagtacattaagctcaccaagcacaatgcatgcacgctctaagtgtgactatttgattt

SEQ ID NO: 37390 - DNA, 121 bp, Artificial Sequence
  Synthesized
  misc_feature (61): n=a or g
ctcactaccagccaaccaatgccccagccagctccccccaggttttattgttctgcagatntcacatgtttctgtggtcagtttgggtcagcagctccgcttatgttcccttccagctcct

SEQ ID NO: 37391 - DNA, 121 bp, Artificial Sequence
  Synthesized
  misc_feature (61): n=a or t
cacagtggtcaaagatactttcgtatgaatatcctgaactggaaattttccactgatgtgnttttctttcccagagaaatgtacaattttgtaaaaataattctaatggcaaaaagattaa

SEQ ID NO: 37392 - DNA, 121 bp, Artificial Sequence
  Synthesized
  misc_feature (61): n=t or c
ttgatctgggctccctacaggcagtcaggctcaactcaggtgtctcacattaggcaaatanctgaacatctggctgatgtgtatagcttgcacagtgctggtgtgagtgaatggaactctt

SEQ ID NO: 37393 - DNA, 121 bp, Artificial Sequence
  Synthesized
  misc_feature (61): n=a or c
ggaccttttcttcccctgaagtttccttaaaatttctctgtatcttgattttcaaaaaganaaaacagagttgaagttctgttaagagtcacactgccagctccaggcaccaggctccagg

SEQ ID NO: 37394 - DNA, 121 bp, Artificial Sequence
  Synthesized
  misc_feature (61): n=a or c
ccctgtcacagtcttgagcatcagtgcagtgagaggttgttttcatgcagctatgcaggcnggaactctgctctgtattaatcctttagctgaagtttttcaagtttccacgtgtggtagt

SEQ ID NO: 37395 - DNA, 121 bp, Artificial Sequence
  Synthesized
  misc_feature (61): n=t or g
ggctcagggaagcatgatgacggtcatcccatgaacattcagtgaacacaggctagcactncttactcctgaaaatgcatcccatgatttcacatgaccaaagcaggtttatccaagaggg

SEQ ID NO: 37396 - DNA, 121 bp, Artificial Sequence
  Synthesized
  misc_feature (61): n=t or c
ctggttattagtcgatgagcgtattattttgtgcttgcagtccaagctctgcaggatgtanccagaaccaccaggttctaaagaagattccttgtgaattatgtgtaatatacgtatctgc

SEQ ID NO: 37397 - DNA, 121 bp, Artificial Sequence
  Synthesized
  misc_feature (61): n=a or g
aaaacccacaggtaggcaaaacaggtaaacttgtgtgttttacgttacagctacagctttntatgtgtttaaggccgggccaactcagaggttatattttaattgcatgtcatgcaaaatc

SEQ ID NO: 37398 - DNA, 121 bp, Artificial Sequence
  Synthesized
  misc_feature (61): n=t or c
ttttaccttctcagttgaacagaaattatgacaataatgcatttattaatgcattagtcanggtgtaaacctgtagccgccttataaaatagaaatacttgttttgtgctccaaggttgtg

SEQ ID NO: 37399 - DNA, 121 bp, Artificial Sequence
  Synthesized
  misc_feature (61): n=a or g
atttctgtggtaggcagacaagttggatactcttcactttgtgtgcagcgtattaccttancggtaatgaagataagaggtttcacttactgtttcaactagtcttttttgtgctaaaaat

SEQ ID NO: 37400 - DNA, 121 bp, Artificial Sequence
  Synthesized
  misc_feature (61): n=a or c
ctatttcacatccttgctctacagtcaagaaaacagggtttgattcacaccagctattaanagaagaatgtttaaggaatattaccactctctaagtaaacgtctagtgagaggtataggc

SEQ ID NO: 37401 - DNA, 121 bp, Artificial Sequence
  Synthesized
  misc_feature (61): n=a or c
aaggagcagggcaggctgcctgcatcgcatacagctagcactggagctaaataccagtaantacaccttgttctgtgtcacacgaggctgcagcgccaactccagctggaggagcacagat

SEQ ID NO: 37402 - DNA, 121 bp, Artificial Sequence
  Synthesized
  misc_feature (61): n=a or t
tggagggggcacaattttatcctaccaaaaataaataagtggatctaaaaacatactaaanttttttttaaaaggcaggagaatctatgaaacccataaggattttagtcatacctcagtt

SEQ ID NO: 37403 - DNA, 121 bp, Artificial Sequence
  Synthesized
  misc_feature (61): n=t or c
agatcaggtttactgcttaggtgcgtaccactgcagcaagattattggtcaagtcacattnacaaacgtaagagaatttaacataataattagtagttatttcaatactaaaacgattaag

SEQ ID NO: 37404 - DNA, 121 bp, Artificial Sequence
  Synthesized
  misc_feature (61): n=a or g
agaggcacagctgccaacatccccaccataacatcctatggccaacgcttctcctctacanccaccaccaaccccatcacggccccaaagggctccagccccgactcccccatcccatgtg

SEQ ID NO: 37405 - DNA, 121 bp, Artificial Sequence
  Synthesized
  misc_feature (61): n=t or g
gggagcacagtttggtctttagcaccctccaaattagagataatgggggaagtctaagtanggcctcaataacgaacggctggaagagaaccacacactcaaagcgctgtttgtagccatc

SEQ ID NO: 37406 - DNA, 121 bp, Artificial Sequence
  Synthesized
  misc_feature (61): n=a or g
caggaggacaaaggaggcaagtttaaacgaggatttctcgtttgttattgtactgctggcngccaccaagcaggaaaggagcatcgcccagcaatgcttctattgctgggccattagagtg

SEQ ID NO: 37407 - DNA, 121 bp, Artificial Sequence
  Synthesized
  misc_feature (61): n=a or g
ttaatggacagatgacaagaggacagagcaaacctcttccttccatcaagctgcctgatcnggctgctgcacatcactttcttccagtatctatatgctgtcctcagtctcacagcagttt

SEQ ID NO: 37408 - DNA, 121 bp, Artificial Sequence
  Synthesized
  misc_feature (61): n=a or c
gtttgtgcagcagaaccatttgctgtatggtaattcagcattttcttctcactggcaaaantgtgctagccttcatcatagattcgtaccacattaagttagcaaacctgtgctcagtttc

SEQ ID NO: 37409 - DNA, 121 bp, Artificial Sequence
  Synthesized
  misc_feature (61): n=t or c
ggtttgactcatacctttctggcagcactctcattcctaggaaaggcactgcacatctttncctgtcttgtccttgaggaagtgtgcaaggcgattctttatcttcctcatgggtcatgcc

SEQ ID NO: 37410 - DNA, 121 bp, Artificial Sequence
  Synthesized
  misc_feature (61): n=t or c
tcttgatattgtctttcaacacagatcttgaggaagactgtttctaatgatggtttacagncattccctgtactccacgtcatttcattaaaaaattgacaaaaaaattagaaaaatattt

SEQ ID NO: 37411 - DNA, 121 bp, Artificial Sequence
  Synthesized
  misc_feature (61): n=t or c
agacaaacaaaaagagagagagagagaaaagaagggtctgcttcataatatcaagttttcntgactgtcaatcaatgccagaaccagcaggatcaactagtcgtgacctctccttatagca

SEQ ID NO: 37412 - DNA, 121 bp, Artificial Sequence
  Synthesized
  misc_feature (61): n=a or g
ttagagaagtcaatgttttacagataggattaaaatggaagatatctatgagtcttgatgnaatctgcttatgaagactattctccccaataggctctccagctccataaaaactatacag

SEQ ID NO: 37413 - DNA, 121 bp, Artificial Sequence
  Synthesized
  misc_feature (61): n=t or c
gaatatttgggcatctcgggcttttgctgtttctaggcactgccctcatcagctctccttntgcaaagggcagctgagtataaaatagtataaatgggtgaacatcctccttgtttcacag

SEQ ID NO: 37414 - DNA, 121 bp, Artificial Sequence
  Synthesized
  misc_feature (61): n=t or c
ttgcagctcagctgcctgtcgtaagagatgatccaccttgtgcagctacttgccttatcantaggaggaggttcgaggcagtgggtggaatggactgcctgaaccaaaatctcctcttttt

SEQ ID NO: 37415 - DNA, 121 bp, Artificial Sequence
  Synthesized
  misc_feature (61): n=t or c
aggggtaagggttttaaacttaaaaggggagatttagattaaacatttctaagaaatgttnaatgtttatactctccacccaggagggtggtgaagcaatggaaaatgctgcccagataat

SEQ ID NO: 37416 - DNA, 121 bp, Artificial Sequence
  Synthesized
  misc_feature (61): n=a or g
tacaactgtggggacacaaagtgatagtaagaaaaaaaattgcagagttagcttttgcagngctaaaaactaaactaggagtttctcaggctgtatctaatttcttcataggaagaaataa

SEQ ID NO: 37417 - DNA, 121 bp, Artificial Sequence
  Synthesized
  misc_feature (61): n=a or g
gaaaatagtgggttttaacatataccacagttttagccttcagtgcctttaaacgttaatnccaacgacttaaaaataaactaataacatttgacatgagttgtctccaaaatattcaata

SEQ ID NO: 37418 - DNA, 121 bp, Artificial Sequence
  Synthesized
  misc_feature (61): n=t or c
ccagagcagcatctgcaagcccaaaaacaccacttgacacaaaaaatctacagtgcaacantatggcgtttgattcttcctcactgcctgaagtttgtaaatactatatggaaatatagga

SEQ ID NO: 37419 - DNA, 121 bp, Artificial Sequence
  Synthesized
  misc_feature (61): n=t or c
atatttgagtagaagagcactataaaaatccccagtagtccattagtaacagtcttaaaancctaatttgaaactcatggggtgttcaaccaaaaaacacttactggtggttctgaaaggt

SEQ ID NO: 37420 - DNA, 121 bp, Artificial Sequence
  Synthesized
  misc_feature (61): n=t or c
ttactgaagagcacgttggatggttaagagggctctttcattagggagatctctatattgngtgtatttcaatttcctttactgtatgaaatagaagttgagatttttttattcaaataac

SEQ ID NO: 37421 - DNA, 121 bp, Artificial Sequence
  Synthesized
  misc_feature (61): n=a or g
cccacgttgtcgcgctaaagggttttcatttgtttgtgtctctcaaagggatattttccantgcatacccagtagttgtttctcaacaatgtgtttttcaaacatgaggttttatccacaa

SEQ ID NO: 37422 - DNA, 121 bp, Artificial Sequence
  Synthesized
  misc_feature (61): n=c or g
ataagttcctctttgttgaagaaacatcacaagctcagcccaagccagtttcattcagaantggcatcaagaactggaatctcagcctcgatctgcacagccagtttaagaagcctgcact

SEQ ID NO: 37423 - DNA, 121 bp, Artificial Sequence
  Synthesized
  misc_feature (61): n=a or c
tgcttaaattgatcattctctccatggaagtaataagtgctaatgttcagcccagtcaagnttgtattggcaatttggcatcttaagatactccagatcattattttctctttcatttcaa

SEQ ID NO: 37424 - DNA, 121 bp, Artificial Sequence
  Synthesized
  misc_feature (61): n=c or g
gaacaatgtgaaagcaaagtttattaaggagaggacagcaaacactgtcccggagttgtgnccagacagctacaacaaagcctagcaaagtgaatataaagcttatcatcagaggaccgac

SEQ ID NO: 37425 - DNA, 121 bp, Artificial Sequence
  Synthesized
  misc_feature (61): n=a or t
cctttatcaacagtctcactcgcttgagtcatcaagaggagttcaaaatccagctttacanaaagagttggactcaactgttagtctccagaggtgtcttgcagtaacagataaagagact

SEQ ID NO: 37426 - DNA, 121 bp, Artificial Sequence
  Synthesized
  misc_feature (61): n=a or c
agtctgtgtttacatttatgttgtgcctttttgagttccttttgatattgcaatttgaaantttatctccttgtggaatgcctgataactttgattcctttctaattctagagagtatctc

SEQ ID NO: 37427 - DNA, 121 bp, Artificial Sequence
  Synthesized
  misc_feature (61): n=c or g
agcacattggacaattgactcagtgatggcctttaatgctgtgccctgctggtgtggtgtntgtggttaccatttctcattggagaaacgtttgtcaggctcacaagctgtttgacataac

SEQ ID NO: 37428 - DNA, 121 bp, Artificial Sequence
  Synthesized
  misc_feature (61): n=t or c
actttaaacgagaaggctttcagtagcaaaccaaggtagcagccaggctgtgaggtggcantcatccagccatggatttcatgcactttatgttcaccctgacctctaaggtgggctcaca

SEQ ID NO: 37429 - DNA, 121 bp, Artificial Sequence
  Synthesized
  misc_feature (61): n=t or c
ggattgtaaaagttatccattccattttgctgatagtaagtattcagatgcgtcctcttgnctgaatcttactgcccacgtaagcttttcttaccagtgacacagtcccagctgctgtaat

SEQ ID NO: 37430 - DNA, 121 bp, Artificial Sequence
  Synthesized
  misc_feature (61): n=a or g
tcattctgcctgtgagggcaaaagtcagcatcaggagctcagcctttagactcgtcctgangccagagggctcaggaatactattgctgaacccgaggagtctttctgctgattcattggg

SEQ ID NO: 37431 - DNA, 121 bp, Artificial Sequence
  Synthesized
  misc_feature (61): n=a or g
tcaatatggaaaagttagatcaaatctggagggatggtcctccattattatagataaaaanctccactcatatcattgaaaggtattggcatattatctaaagctatcttgggtcaatttt

SEQ ID NO: 37432 - DNA, 121 bp, Artificial Sequence
  Synthesized
  misc_feature (61): n=a or g
gatcagtgccacacgaaagcatcctggccaaacacatccctcttctgacaaagtggctccntcccaaggttttcatcatactgagagatcttggtgtagaaattatccttgaggcatatga

SEQ ID NO: 37433 - DNA, 121 bp, Artificial Sequence
  Synthesized
  misc_feature (61): n=a or g
tatgcctcttaggagggaaatggtcggaacttggctaaagctgggaactttatggcactcntgcagcattgaagcagtgaggccaaggttcccgaccacccccctgctaccatgctttatg

SEQ ID NO: 37434 - DNA, 121 bp, Artificial Sequence
  Synthesized
  misc_feature (61): n=t or g
ttaagttctgatagacttagatcttcccaggtactcaggccctcatcctagccctcccaanattagcctcaaatttcaaatggattagccccatcaaggtggaaaaaagcatgtcaagtgc

SEQ ID NO: 37435 - DNA, 121 bp, Artificial Sequence
  Synthesized
  misc_feature (61): n=a or g
tattcagaaggaaaaggaaaaaggaaaagaaaaaatgaagcctactgaaatgtggaagtcnggtccattgcagtgatcctttgggatcactgttcgtcactgtttcaagaagttaataaaa

SEQ ID NO: 37436 - DNA, 121 bp, Artificial Sequence
  Synthesized
  misc_feature (61): n=t or c
aagatctgaagagatggaaagcactccactagtaatgtttgctttccacccaggtggtaanttacaaggcagttttaccagccggtcagaatcaaaatacatatttttcttaaagtttgtg

SEQ ID NO: 37437 - DNA, 121 bp, Artificial Sequence
  Synthesized
  misc_feature (61): n=a or c
agatttactttttttatgaacaagaacctgaagcatgcataaacctccccttactcttacntttcagataaaaaaaatctggaacatccaacttcttctctacgtgccagtggatcattct

SEQ ID NO: 37438 - DNA, 121 bp, Artificial Sequence
  Synthesized
  misc_feature (61): n=a or g
ccaggtagctgaactgtcagtcaaagaagttatgtttttaacttcctgatttacagcacanctacgaggtatttcagaataataatcaccggctacataactggcaggcacaaggtaaagt

SEQ ID NO: 37439 - DNA, 121 bp, Artificial Sequence
  Synthesized
  misc_feature (61): n=a or g
tttgaactcagactggaatcatattaagaaataacagcaattcatcagagattattgtttnttaatttgaatttcactatgctcccattgacatttgtttttggagtccagaaaacacctg

SEQ ID NO: 37440 - DNA, 121 bp, Artificial Sequence
  Synthesized
  misc_feature (61): n=a or c
gtgctgtgtcgttttattttaaaaaatacaggaagatataagtataaacagtcaaaaaaanccatccaatttgaaaaaaggccttgttcattggtactggcaagactgaatgatttgtgta

SEQ ID NO: 37441 - DNA, 121 bp, Artificial Sequence
  Synthesized
  misc_feature (61): n=t or c
tgcaatatatctgattggctgtgaatcaagtttgacagaaaaaatgtgtgtgagataagcngcatgttaacatcaaaataattttgcaactactcctttgaagccttgtactgtggctgtt

SEQ ID NO: 37442 - DNA, 121 bp, Artificial Sequence
  Synthesized
  misc_feature (61): n=t or c
agtgatgggcagcttgggcaggctggccttctatgggctgctcaaacggaagcacgtgttntacgagcaggacatgaaggcgtatggcatagacctctccttgctgcacagcagtttgtgc

SEQ ID NO: 37443 - DNA, 121 bp, Artificial Sequence
  Synthesized
  misc_feature (61): n=t or c
tgctatgcagtgcatcagtatataccatataccaaatataattgcactgggactgaatcanaatggggctatactctactcagtagaacacaaactatgaatccaacaaatcaaacaaata

SEQ ID NO: 37444 - DNA, 121 bp, Artificial Sequence
  Synthesized
  misc_feature (61): n=a or g
atctttttactagcagtgtgtgccctcaaaacttacatttatgctgactttacagctaaanaatgccacaaagaaaactgaacccaatgttcaatccaaagccacagtgataattctgcca

SEQ ID NO: 37445 - DNA, 121 bp, Artificial Sequence
  Synthesized
  misc_feature (61): n=a or g
gtaacaatggttggtcaatatttgaaaattagaaacctagaaagactactcattaaatatnaagctccacatgaaactttctctgaagagagctgtctaaggaagtcaaatgtaattgcaa

SEQ ID NO: 37446 - DNA, 121 bp, Artificial Sequence
  Synthesized
  misc_feature (61): n=a or g
agacaaggagaccccagtgtggggatgaacgggctcacactgcgggttctctcctgcacanctctcagagccatctgctctgaattaggtgggattaaaggcacagcatgggcaaatccct

SEQ ID NO: 37447 - DNA, 121 bp, Artificial Sequence
  Synthesized
  misc_feature (61): n=a or g
atgatttaataggttataagagaaatgtagtcagcttttacatgaaaattctgaaacatgnggttttcaaaagtacaaaatgtcatcttcagcatctgtttctactgaagaaaataataga

SEQ ID NO: 37448 - DNA, 121 bp, Artificial Sequence
  Synthesized
  misc_feature (61): n=t or g
gaacagcatgttaaagtcatggagtcattcctaatcaagtctgtgaattagcggctgttcnccgggtccaaacttcaggtagtattcttagctgttgcaacaaagtggaaaagtgacaaga

SEQ ID NO: 37449 - DNA, 121 bp, Artificial Sequence
  Synthesized
  misc_feature (61): n=a or g
gtgaattctgggttagaagcactcagacgttggagaaccccgattagcattgcgacttatngacagcctcatcctgcaggaggcaaacgccaaacctgagagcgaagggaagaaccactgc

SEQ ID NO: 37450 - DNA, 121 bp, Artificial Sequence
  Synthesized
  misc_feature (61): n=t or c
aacaacaatttcaaagtgaagggagaaaacagtcggtaatgttatttctggctagttggantcgtagtgactcaagttgtatcatgtagttgcattctgacctctatattaaatatcattc

SEQ ID NO: 37451 - DNA, 121 bp, Artificial Sequence
  Synthesized
  misc_feature (61): n=a or g
gcgcacttcatcggaagggtcctcagcaccacagaacttttcagcctgctcagcagttacntggctcttacagcaagtcagtttcttcacccatctactggggaaagcgtatccttctggt

SEQ ID NO: 37452 - DNA, 121 bp, Artificial Sequence
  Synthesized
  misc_feature (61): n=a or g
gggctgcctgcaacttgctttcctgcagagtgacttcaacctgcccacagcaccttgcacntgatccttgtatgtggagctttgccttccagactgcactgtgcccttcaatattgtggtg

SEQ ID NO: 37453 - DNA, 121 bp, Artificial Sequence
  Synthesized
  misc_feature (61): n=t or c
tatccctgctgcacagagcatcttcccctgagcacaaggatgggctgcaggcttgtgggangtccactgcatcttatgccctggtgccccttctcacacatctgctatatgattataagcc

SEQ ID NO: 37454 - DNA, 121 bp, Artificial Sequence
  Synthesized
  misc_feature (61): n=a or g
tttggctgtaaatccatcaacattcaggaagtgtgaagtctgcagtgggattatttgcaantccctttggaagcaattttctcctcccacagtcagagcagcaatcccacctcgtatgcct

SEQ ID NO: 37455 - DNA, 121 bp, Artificial Sequence
  Synthesized
  misc_feature (61): n=t or g
aataatccaaggaatgaatttccattgttttgtagtccagtagtcaccatctgaccacccnttggaaacagatcttgctgaaactagttatgattaactaaataacaaagtgaagagagag

SEQ ID NO: 37456 - DNA, 121 bp, Artificial Sequence
  Synthesized
  misc_feature (61): n=t or c
ccttcctgtctcatttgctatatcggcttcctcagctgtaccaattatattggtatttccntgtctcactgggtatagccaatcacttttacaaggatactgagatccagttatcaatgat

SEQ ID NO: 37457 - DNA, 121 bp, Artificial Sequence
  Synthesized
  misc_feature (61): n=t or g
tagacaccttggatatacagttttccatataaaaagctgctattaaggacatgaagagatntttagggattaacaagtgcagtctgggatgttctgcatttcttaatacactgtatttcag

SEQ ID NO: 37458 - DNA, 121 bp, Artificial Sequence
  Synthesized
  misc_feature (61): n=t or c
gggggacggggagctgctaactcacggaatggcaaacgtgcttatcccaggcaacattttnccactagaaatgggccaacatgggttccatgtccctggtcaggtgcagtcacatccagga

SEQ ID NO: 37459 - DNA, 121 bp, Artificial Sequence
  Synthesized
  misc_feature (61): n=t or c
gctaatgtttcagtaaagtcaagtgcaacaaggggcaccaaatgttagctgtaatccaacntcctctaattaacaccgtaagacttgctgagatacctatcagcacaaggcaaatgactca

SEQ ID NO: 37460 - DNA, 121 bp, Artificial Sequence
  Synthesized
  misc_feature (61): n=t or c
catatgaattgcaataactactacagaagtagctgcaagtaatttataccagttggtcacntggcctctaactatagcatcttctgaggtagtggaaaagtgctagacaggctcctttttt

SEQ ID NO: 37461 - DNA, 121 bp, Artificial Sequence
  Synthesized
  misc_feature (61): n=a or g
acacatggcagctccagcctgtcatctcgtccgtgtcggctgtgctttcacacgaggcacncaggtaggcttccagcactacactggcttacagacgtttgaaacttgagagactttcctg

SEQ ID NO: 37462 - DNA, 121 bp, Artificial Sequence
  Synthesized
  misc_feature (61): n=t or c
gcttatcatacagcaaaatttcactgtaccccatggctgagttgggggtgagctgcattgnggtaacagaattctgtaaagcaaacaaaatgcagagatgttttgtaatgcttctagaggg

SEQ ID NO: 37463 - DNA, 121 bp, Artificial Sequence
  Synthesized
  misc_feature (61): n=a or g
ccaagggaaaattacattcagttcactgtgaccatagggtgggctcttagcattagtcaantgggctcatatcctacctgcagagtgagggctgaggaaacactgtggaggtaccaaagta

SEQ ID NO: 37464 - DNA, 121 bp, Artificial Sequence
  Synthesized
  misc_feature (61): n=c or g
acacagcgacttgggaatacaagaacatgaggcacacgtaaggatacaagtgcaggtgatntagactggagctgatgtccaaggacacaacttacggtccctgcagtaactacaaattgaa

SEQ ID NO: 37465 - DNA, 121 bp, Artificial Sequence
  Synthesized
  misc_feature (61): n=t or g
cataccgcttatggagcttttcagttaaacgcaaactgttagtgctaatttaagcaaaatnaaggtactttatgtatgctcagatcgtgcagttccttattccaccctaaaaattttagga

SEQ ID NO: 37466 - DNA, 121 bp, Artificial Sequence
  Synthesized
  misc_feature (61): n=t or g
gaagaagaggtgatgggaaagtaaatgactggtgtaagtaatgcaaattgaaggagagaanagttattcactattttaaatatttaaagaagtagaaggaggagaaggggacagagattga

SEQ ID NO: 37467 - DNA, 121 bp, Artificial Sequence
  Synthesized
  misc_feature (61): n=a or t
ttaggaaacagaaatgcagtgcagaaagcaacaaggttcatgtgctttacataagttaacnagtattgccactgctgaaaattattattggtctaaacagggtacttcttgcatttttaga

SEQ ID NO: 37468 - DNA, 121 bp, Artificial Sequence
  Synthesized
  misc_feature (61): n=a or c
taacctttaagaccattcatttacaggcaaaggcagcaatttcaaagttacagggccagcngcaatcagaatttagactcgacaagaatttctattcgcaccaatcagtcctgtatccccc

SEQ ID NO: 37469 - DNA, 121 bp, Artificial Sequence
  Synthesized
  misc_feature (61): n=a or g
cagctagcccccactgaccagtgtttgatagcttttgatcaagtcttcaaataggtcaggngatctaagcaggatgggctcactaacagtcggataccagctatataaaaaccctgcacta

SEQ ID NO: 37470 - DNA, 121 bp, Artificial Sequence
  Synthesized
  misc_feature (61): n=t or g
ggaagaatgtggagggaattaacttgtgtgttacagagattcagtggctgaggtattagangaaaccttggtaccattgcagtgaacatcaatagttctgctcatcctacatcagtcactt

SEQ ID NO: 37471 - DNA, 121 bp, Artificial Sequence
  Synthesized
  misc_feature (61): n=t or c
tgtgtcactgcatggctggatctgggggtgggaaggtgccctgtctcacccactgcactgnggtgagctaaggtgatgggaagagggttaatctgagcagcagctactgcctggagcagtg

SEQ ID NO: 37472 - DNA, 121 bp, Artificial Sequence
  Synthesized
  misc_feature (61): n=t or c
cttatgaatctgtgattccatttcttctttaaacagttctgaagacttctattaataatgntggcaaacagcagtaagctctagaaccgttaaaaattatgatgtctccagtgtaatttga

SEQ ID NO: 37473 - DNA, 121 bp, Artificial Sequence
  Synthesized
  misc_feature (61): n=a or c
cagtgatactacaaacagaaatgttagatggctctcaacacgtttgtttctacatctcagnacaccattttgcttttggcaaaatgcctattctgaatatttcatatagcatcattagcag

SEQ ID NO: 37474 - DNA, 121 bp, Artificial Sequence
  Synthesized
  misc_feature (61): n=a or c
acagggtactcaaagaagagaagaaaatattcagataacagaaaataataaaaccttaatncagtggtcacactataaaactggaaaaaggaaaatggcacaatacacctcagccagtttg

SEQ ID NO: 37475 - DNA, 121 bp, Artificial Sequence
  Synthesized
  misc_feature (61): n=t or g
actttatcccatcatatttatctggtgtcagaggcctactcatttgcaaagtacacagtantcagggcctgggcccttgacttgcctgatattttatcttttctatcttttagaaagggat

SEQ ID NO: 37476 - DNA, 121 bp, Artificial Sequence
  Synthesized
  misc_feature (61): n=a or g
ggagctacatgagctagtattgtactcgaggaaaatgaagtttgtgctcctttaagtagcnaccacagttacagaagggtcatttctccactatgacacatatgattggaggtctgtgtga

SEQ ID NO: 37477 - DNA, 121 bp, Artificial Sequence
  Synthesized
  misc_feature (61): n=a or g
aaaaacatttgccacaaactaagagatgcagcaaggtcttcactcacttttgaaagcctgntaaatcttcaggtggtgcttcagcaaagatttgtgccttaggtatacaaaaaagtaagat

SEQ ID NO: 37478 - DNA, 121 bp, Artificial Sequence
  Synthesized
  misc_feature (61): n=t or c
ttgggggaaaaaagaaaacaacaaaccattctggagtcctggggctcatgctcacagtaangtggcttgggaaataaatcatggagttcgcctgctgcgacctcttactctccaggtctgg

SEQ ID NO: 37479 - DNA, 121 bp, Artificial Sequence
  Synthesized
  misc_feature (61): n=t or c
tatttaaggagatgtttcattgatctgctttctttctcatcagatatacacagtgcaaaanattgaaacatacctgggtaatcacaagggttacaaaaacggggtgtaaatatctgggtcg

SEQ ID NO: 37480 - DNA, 121 bp, Artificial Sequence
  Synthesized
  misc_feature (61): n=a or t
gaataattaaaaagaaacttaatttcttccagttatctgtggggaatgagcacaaaaaaanattaatgtctcacgtaaagaattagcaaaacattaactgcacttgctatgggggcagtaa

SEQ ID NO: 37481 - DNA, 121 bp, Artificial Sequence
  Synthesized
  misc_feature (61): n=a or c
tcgtgcaatgagaagagctccctgttgtttttgtaagaaaggaactcttccaagttgtggnagtccggagctgactggggaactccatcccttaataaactcagccatgggaggctcacag

SEQ ID NO: 37482 - DNA, 121 bp, Artificial Sequence
  Synthesized
  misc_feature (61): n=a or g
agaataggactgcttaggaggagactgtgtgtgtgctcaaattcagcttatttcagtgcanatttccagtgctaacaagtgaactgatttgttatagaaaagctgctggaaataatcatca

SEQ ID NO: 37483 - DNA, 121 bp, Artificial Sequence
  Synthesized
  misc_feature (61): n=a or c
aaagtcaataactttatctctgtttgaccttttcacatcatgcctccatgaaccttaaganaggggagtgacttcaggcttgtaagacttcctgaatcagagaagttctcctcacacatga

SEQ ID NO: 37484 - DNA, 121 bp, Artificial Sequence
  Synthesized
  misc_feature (61): n=a or g
cccacctcctgctcccctcacacccacccccatacaaggcacagatcctccctatactccnaaacggatgccctttctgaaaaacagatcctctttccgagctgggaatgctcctttccaa

SEQ ID NO: 37485 - DNA, 121 bp, Artificial Sequence
  Synthesized
  misc_feature (61): n=a or t
aagcattaatttttctaaaaataggtttaatactctttcctcttatttatccttctctgcngctacttagattgatgcttgtttcactaactagctggcaaagcagaccagccagctagaa

SEQ ID NO: 37486 - DNA, 121 bp, Artificial Sequence
  Synthesized
  misc_feature (61): n=a or g
tgctgggctgctccagcaatgagtcctcgttcccagatgctgctgttcaggctcacttgtntcctcagcacacagggaccttgtggaccagggggcacccggggtcaggtgcaatgggggg

SEQ ID NO: 37487 - DNA, 121 bp, Artificial Sequence
  Synthesized
  misc_feature (61): n=a or g
ggtggagtttagtttactttgactttagctatctcaattctattttacaactttctgtaantattagccatgtgtctattgaaattctgagcttaagcattaagagaagcagagacatttt

SEQ ID NO: 37488 - DNA, 121 bp, Artificial Sequence
  Synthesized
  misc_feature (61): n=t or c
atactacacattgattaaagcatcatcagctctggaaattataaagatgctatcagataanttcctagcaattttccactctaggtgtgagaactaactggagattaaagtacattaatta

SEQ ID NO: 37489 - DNA, 121 bp, Artificial Sequence
  Synthesized
  misc_feature (61): n=t or c
catgttggagcctgtgctcagctggccttggaaagctggcttctaacagagaactgaaaangttacgtgacgaactggcatatctcggttaatacttgggtatctttcctagggttgcact

SEQ ID NO: 37490 - DNA, 121 bp, Artificial Sequence
  Synthesized
  misc_feature (61): n=a or g
tttacttcccaattcaggtgccattgtctgttccccttaggacagaattacaagttcaaangtgaccaataacaaggagttagaattcactacatcattccccagggaacgtaagtacaac

SEQ ID NO: 37491 - DNA, 121 bp, Artificial Sequence
  Synthesized
  misc_feature (61): n=a or g
ttgtactgcatcagagataacaggcagctggttgggttgggttgagtgctcctcagctacncgagggcttgtgccctgcagggctgttgtctgtgcaaagggagaggtgcctgttcataca

SEQ ID NO: 37492 - DNA, 121 bp, Artificial Sequence
  Synthesized
  misc_feature (61): n=t or c
cggcggccacggccggggcgcgacaggcagcatgccctggcccttgtgcggctccgcggcngaagcgttgttgggggcctccatgcacaagtaattggggtcgttcttgttgggcagcttg

SEQ ID NO: 37493 - DNA, 121 bp, Artificial Sequence
  Synthesized
  misc_feature (61): n=a or g
tcttgatagaaacactcaggaaagtcagagaactaaaaagtccagcgtttgacagatgtgntcagtaaaagtggcacttctcttttgaccatgcaaaggagctacagaccttgaaatactc

SEQ ID NO: 37494 - DNA, 121 bp, Artificial Sequence
  Synthesized
  misc_feature (61): n=a or t
catgatactgtgcaagttcaaccaagagtctgtagtagttgcaattactgtcaaaattctnttttcctaaaaaatccatagagaccggtattttccctaaaaagaaatttcgaaagtacaa

SEQ ID NO: 37495 - DNA, 121 bp, Artificial Sequence
  Synthesized
  misc_feature (61): n=t or c
ccttttagtctaataaatacagatttgtattacgtaaagtgtgtacatagatttgtactangtatattaatataactgctatcagatagagcagtattaccaactggctgtttgcctccaa

SEQ ID NO: 37496 - DNA, 121 bp, Artificial Sequence
  Synthesized
  misc_feature (61): n=a or g
gaccaacagagtaggagaacgaggccctgacctttagggaggcgaaggtggaagaaagaangatgctgcagtctgagaggatggagaagtggggctgaaagaggagggaacagccccttgg

SEQ ID NO: 37497 - DNA, 121 bp, Artificial Sequence
  Synthesized
  misc_feature (61): n=t or g
tgcccagagaggctgtggaaggccccagaacttcagatttaaattggaagctctgagcaanggttggactagataaatccaacggactggtcccttccaactgaatttttttagtcatgtt

SEQ ID NO: 37498 - DNA, 121 bp, Artificial Sequence
  Synthesized
  misc_feature (61): n=t or c
ggtgcctattttctgatgaaggaactgcctgacagcgcttctgcagcaggccagggctcgnggccctgtaactagcacagccccctcagacatcataatagatggcttttaattacagggc

SEQ ID NO: 37499 - DNA, 121 bp, Artificial Sequence
  Synthesized
  misc_feature (61): n=a or g
gggtccctcaaggtttcctgacatcccacagtgctctcagccattctgcactgccctcccnggctctgacaagggcagcagagctgtatgcagcaaacaatcaggcccagcctgtgatcac

SEQ ID NO: 37500 - DNA, 121 bp, Artificial Sequence
  Synthesized
  misc_feature (61): n=t or c
aaaacattttaacagcatgtgtgtttagatttggcaaaaaacagcaaaataaaggcttccnaaatgcaatttatataattgcacagtaagagggcaaggcgttttaaggatttctttctgt

SEQ ID NO: 37501 - DNA, 121 bp, Artificial Sequence
  Synthesized
  misc_feature (61): n=t or c
gaatatttggcagctgcaaaaaaatttaagaaagttgaaataaataatgaatctaaaaaanagagctggatgatcttctaaacctctggcagaacatgcatggtgtgcagccgtctgcttc

SEQ ID NO: 37502 - DNA, 121 bp, Artificial Sequence
  Synthesized
  misc_feature (61): n=t or c
aaatgtgtgttgtcctttcagcagcagtttggcaactgctgctctttcattaatcatccanaccgtgtggcagtgacctgatttctcacagccgtgggtttgggtattataggaggcagca

SEQ ID NO: 37503 - DNA, 121 bp, Artificial Sequence
  Synthesized
  misc_feature (61): n=a or g
cctttattaggctaaatgatactgaaatcagtctttactataattgtatgtgaggctatanatatctcacatgaaaattgctcacaaatgggaatccttaggttttcccagtttgttttct

SEQ ID NO: 37504 - DNA, 121 bp, Artificial Sequence
  Synthesized
  misc_feature (61): n=t or g
ccgttaataaaaccacaggtgaaggggaagtttttgagcaaagataagcttaaatatcctncattaactttgcaaggagtcacaataagagaagtaattagaaaataaagcgaaaatacat

SEQ ID NO: 37505 - DNA, 121 bp, Artificial Sequence
  Synthesized
  misc_feature (61): n=t or c
aactcagttccctgctttggtcttctaagagcccaactgcgttcttcagaattttttctangtagaatctataacaacctccacaacagagatgaagctttctgtataataaaggtttcat

SEQ ID NO: 37506 - DNA, 121 bp, Artificial Sequence
  Synthesized
  misc_feature (61): n=a or t
cagggtgtttcgtaagtatctcctgtgtgcatggatgtatgtgtatctcacaaaccccatntgaaacaaaaccgacttgtttcaaagcatcggagaacattgttaaatctgtagtttgggc

SEQ ID NO: 37507 - DNA, 121 bp, Artificial Sequence
  Synthesized
  misc_feature (61): n=t or c
tgttatctttgtgttccttgctagtaaacagtacagattttaacatccttaactcaggggntccttgggcagatttaaaaaaacaggaaggctttaaaatgtaatatgttttccaagaaga

SEQ ID NO: 37508 - DNA, 121 bp, Artificial Sequence
  Synthesized
  misc_feature (61): n=a or g
ctttctgagaaaacaggtagagtacaaaaagtggcactgggtgcgttgatccaaagcttcntttattgaagccaacaaagctgtggcttgccctgctcagttttatatgggtgttttgtgt

SEQ ID NO: 37509 - DNA, 121 bp, Artificial Sequence
  Synthesized
  misc_feature (61): n=t or g
tattaaaactgccagaagatccaagatgtagaaaggagtccaaaatcttgtccagctgtgnctaacaaggaatctagaaatgtggccgtaacattcctgttatgcacacacttctgataag

SEQ ID NO: 37510 - DNA, 121 bp, Artificial Sequence
  Synthesized
  misc_feature (61): n=a or g
agtggtgagctggctgtgtgaaattaatttataacaaaatcgaaatattctgtgagttgcngccgatctgtagtgaaacagtttgcaaccagatggtcagactatcacgaccattcagcct

SEQ ID NO: 37511 - DNA, 121 bp, Artificial Sequence
  Synthesized
  misc_feature (61): n=a or g
gtgagagaaaggagaaatataatggcaatgaataataaagccaccaaatgaaaatacaaangaagaacagtatcaagaaggaaaaaaggggaaaaatgatggaaatgtagtttagggagac

SEQ ID NO: 37512 - DNA, 121 bp, Artificial Sequence
  Synthesized
  misc_feature (61): n=a or g
ggattaggtgggacacagactaagggacaaatacagctctcagatctccacttgttctgantagagcaagtcaaccagcatggtaggagacagctgcttaccaacagataacccataatat

SEQ ID NO: 37513 - DNA, 121 bp, Artificial Sequence
  Synthesized
  misc_feature (61): n=t or c
taccaaattcagcaataagttactgtctcccaaggtgatgtggctgtataaatgaactccngcacacagttgtgagcatcttagaaacacagaagtcagcatgctgtaccttcagagtgca

SEQ ID NO: 37514 - DNA, 121 bp, Artificial Sequence
  Synthesized
  misc_feature (61): n=t or c
ctgttctggtaaaattacctgctacaaaagtaggttttcttctctggcaaatgttgtcttntttagaacgctttctgcagcagtaaggatatgattatttgaacacaagaagtgaaaaatt

SEQ ID NO: 37515 - DNA, 121 bp, Artificial Sequence
  Synthesized
  misc_feature (61): n=t or c
aagagctattttttaaggatctctttccattcgttgatattcatatatttataagcttaanttggtaagcttataagacagacattctgttttcagttcagaattgcgcagtgttcctgaa

SEQ ID NO: 37516 - DNA, 121 bp, Artificial Sequence
  Synthesized
  misc_feature (61): n=t or c
gtgaaaacagttttttccccccacaggtaccacaaggctggtgtatttaccatccagatgnggtaaaagaacaaccagacgacacactaccttcaaacagtgcacaacaatctggccttct

SEQ ID NO: 37517 - DNA, 121 bp, Artificial Sequence
  Synthesized
  misc_feature (61): n=t or c
gtggcgggtttcttctgagttatatctgaggatatctgtgctcttgggtacctaacgtccncccgcagtcgctacaagcgtgagctattaggcaggaggcttcttctgacctgcctgcctt

SEQ ID NO: 37518 - DNA, 121 bp, Artificial Sequence
  Synthesized
  misc_feature (61): n=a or t
aaatagattgatggacttcaaagaagtaatataagggatgtctctctcatatcctgttctngcaagatattttttctaatcccaggtgctagtgctatgttggaaagaaaacacagtagtt

SEQ ID NO: 37519 - DNA, 121 bp, Artificial Sequence
  Synthesized
  misc_feature (61): n=a or g
aaaataaaggaattaatttaatttaaaaaggaactttgagaaacgagcttcagggagtctnctgtggcaattcaaagtgttcctgctttcagatgacatggacacaagttaccaggagaga

SEQ ID NO: 37520 - DNA, 121 bp, Artificial Sequence
  Synthesized
  misc_feature (61): n=a or g
ctgcctggccccagctgggaggagctgcagctttgttcccatacctgtggcagtggtggtnaagaagcctccgctgctgtagtaggacaggtgctgattcaccccctcggagggttctgat

SEQ ID NO: 37521 - DNA, 121 bp, Artificial Sequence
  Synthesized
  misc_feature (61): n=a or t
cctaaagactgagtggctcagagaaaggaagtactggagggttttatgaacaacaaaaaantctgtgaagccctctggaaaatcgtggccctcctgctgtagcttcttgagaggcagagat

SEQ ID NO: 37522 - DNA, 121 bp, Artificial Sequence
  Synthesized
  misc_feature (61): n=a or g
ttgacagagctttgaaaatctaaagcatgggtccttgcagtgttacctgcatggctgacancccttctctgcccttaccaccagtttcctttcagtcacacatatcatcagtcttctgcct

SEQ ID NO: 37523 - DNA, 121 bp, Artificial Sequence
  Synthesized
  misc_feature (61): n=a or g
tatctgtaaaagctgaatttccattttgcttcggggaaagttttcaacctgaacacaatcngaaatgaaaacgttactatctcagctcaaccgattcattatagttacctatcatacttaa

SEQ ID NO: 37524 - DNA, 121 bp, Artificial Sequence
  Synthesized
  misc_feature (61): n=c or g
tgaattttagatcacgggccatgactattttcctctgtgtttctgcatagatgtctactcntacgatgaggatgacatggtgttggatcccaacctggcagaacacctcgctcactttggg

SEQ ID NO: 37525 - DNA, 121 bp, Artificial Sequence
  Synthesized
  misc_feature (61): n=a or g
agagcttttttggttccttctagagctgtaggaggaagtgctgaggtaagcatgtaccagntgtagaagtcattacagactttgaatcacagaatcacggaatcagaggtgttggaaggga

SEQ ID NO: 37526 - DNA, 121 bp, Artificial Sequence
  Synthesized
  misc_feature (61): n=t or c
atatgcctgttcctgcagtgctcgacaggatgtcagatttatcatcttgagcatgtcctcnctcccattttctctagcataaatatatttcccacagaaatcttcttcagtaacagcagct

SEQ ID NO: 37527 - DNA, 121 bp, Artificial Sequence
  Synthesized
  misc_feature (61): n=a or c
aaatgcttggtctattaaagcctataatgaatgattaatgatctgagagctgctgattgtnggtgaaagactcagcagaattcgcccaatagcttttgcagatttatgatttgcacattag

SEQ ID NO: 37528 - DNA, 121 bp, Artificial Sequence
  Synthesized
  misc_feature (61): n=t or g
ttgcatttgcagttgctggaagctgatggctgttgggtattttgtaaatctgctctgatanaatttgagaacagcttcttgattcactgctacctgccaggggcttttctttttctttctt

SEQ ID NO: 37529 - DNA, 121 bp, Artificial Sequence
  Synthesized
  misc_feature (61): n=a or g
taacccataaatgcaaggtggccatgcctccgtagctcagttaacagtagctcaggtacanatgtcaatcccatttgtcaaaactaagcagactaagatgagatagaatctatcagccagc

SEQ ID NO: 37530 - DNA, 121 bp, Artificial Sequence
  Synthesized
  misc_feature (61): n=a or c
acgggaaaatctttacccctcactgatgtttgctgtgagcagttgtctgtgctctgtcatnatttgttttctatctgcagtgctgtttgtggaagctaatggagaaagttcttgtaaagac

SEQ ID NO: 37531 - DNA, 121 bp, Artificial Sequence
  Synthesized
  misc_feature (61): n=a or g
ttccatactttcctatgcatgtcttcagaagtctgaccaaattctcttttagctaatgagnataatagaagttgtaaaacaaagtttaaaaaagacataattgaatcttatatctgatata

SEQ ID NO: 37532 - DNA, 121 bp, Artificial Sequence
  Synthesized
  misc_feature (61): n=a or g
ctccccttaccacatcttattaattcatgctgctgacccgaggctcccagatgtccacacnccgtgtgccagcttcctgatcaagttggcccagcctccattgggaggaaggattcaatat

SEQ ID NO: 37533 - DNA, 121 bp, Artificial Sequence
  Synthesized
  misc_feature (61): n=a or g
tcattggtgtctgtgcttgggtgccgcatgcctgattggtgatgcacttcccaagtcttcntatacccattcctgctctggaaatcaccgtggggctgccgggcatctctcctcttgcccc

SEQ ID NO: 37534 - DNA, 121 bp, Artificial Sequence
  Synthesized
  misc_feature (61): n=t or c
taagcatcactgcaataaataactccattaataatggctgataaacttgcaaattactctntccagtcagtttggatttattcagcaaacaaggatggtatcagtactgctggtatttaat

SEQ ID NO: 37535 - DNA, 121 bp, Artificial Sequence
  Synthesized
  misc_feature (61): n=a or g
tttgtttatttattctggccaagcaattgaggatatacgacaccattctggaacatttatnaacagaaatatccatcatattataggaagcacagatgagaaagaggaaggtgaaaatcat

SEQ ID NO: 37536 - DNA, 121 bp, Artificial Sequence
  Synthesized
  misc_feature (61): n=t or c
ctctctgcttcaaaaccttagaaacatcttgactatgcgcagctgggttgttagatggggntgcaacgccactagcagctgtaccctaagcctgcttaaggagagaaaggaaaaattaaag

SEQ ID NO: 37537 - DNA, 121 bp, Artificial Sequence
  Synthesized
  misc_feature (61): n=t or c
tcagaggttcagaccgtgactcagcagctcccatacacagctgtaggcaggttccaaaggnaggacagcctctgtgggctcccagaaaatccaaccaacctgcaggtctcagtgagagtcc

SEQ ID NO: 37538 - DNA, 121 bp, Artificial Sequence
  Synthesized
  misc_feature (61): n=t or g
gcaacagtctaactgccgaggagcggtgcgatagaaggataccccccagccttgctttgcncttggtggcgattaatcttcgctgcttagaattgaaacgaggctgtagagatacacgaga

SEQ ID NO: 37539 - DNA, 121 bp, Artificial Sequence
  Synthesized
  misc_feature (61): n=a or g
atctttccacatacgtaccacattagaaagttctgctttaaaaagggagcagaaagtatanacatttttttttactaatcagatggtattttctttagtatttaaaacacaggttgatggt

SEQ ID NO: 37540 - DNA, 121 bp, Artificial Sequence
  Synthesized
  misc_feature (61): n=a or g
aggttacctccgctctcccatggccaatggctgcgtggcactcctctgcctgtcatctgtntgggtaaaaagggaagggagaggtctggaaatgaagatgagtgaacctctggagcgcggg

SEQ ID NO: 37541 - DNA, 121 bp, Artificial Sequence
  Synthesized
  misc_feature (61): n=a or g
aaatacagtttggttgttcctgtaagaacagcataatatgaattctaaaatacttgttttnatttcctatatctcacacatttctctgttgcaatcagctgatcatacatcttgtcaaatt

SEQ ID NO: 37542 - DNA, 121 bp, Artificial Sequence
  Synthesized
  misc_feature (61): n=t or c
gctatgctggagagaacgtagagcagagctggagggaaagaacaccccaggcaatgactangaacagcatgttcagtgagcttacggatagaaaaggaagtggcagccataaaacacatga

SEQ ID NO: 37543 - DNA, 121 bp, Artificial Sequence
  Synthesized
  misc_feature (61): n=t or c
ttgctgctgttaatagcagggcaaaattcagctgacattacgaagaagatgaagatttcangggtgaaaagagaaatcttttttttcttggttgctttttcctcccaagagcccatttagg

SEQ ID NO: 37544 - DNA, 121 bp, Artificial Sequence
  Synthesized
  misc_feature (61): n=t or g
cggcggggggagcggctgcggtacagcacgctttgcttactgcagactccgcgtctttacnatggacgccggctgggcagcgtgcgtaccggtattaaacgtttgtgaattccggaggtga

SEQ ID NO: 37545 - DNA, 121 bp, Artificial Sequence
  Synthesized
  misc_feature (61): n=a or g
gcctctcagaaggttgtgagagtctgtctcacccttttgcttcagtcaggccagcaagaantgacgtcccactggatcttatacagcaatatgttttaaaatggttttattgggttgttta

SEQ ID NO: 37546 - DNA, 121 bp, Artificial Sequence
  Synthesized
  misc_feature (61): n=a or g
actttcccagtccattcacaagcttctttaggcgtcccccctcattaaagaatcactgccntcttctgctttacctttaccaagcactacagaagggactgttatgccgtatggaatttct

SEQ ID NO: 37547 - DNA, 121 bp, Artificial Sequence
  Synthesized
  misc_feature (61): n=a or g
taataccctaggataacaatatttgcagaaatatcccaatctgtggtattgcaaacacatngattgattttaccaaaacattttctgatgatgattagtctatggacttcacaaacaacag

SEQ ID NO: 37548 - DNA, 121 bp, Artificial Sequence
  Synthesized
  misc_feature (61): n=t or c
atgctaaagtgaaggtgggacttcagtgtgaatggagtgcagtgcattttctttgtcaaanatgtgaaaatattttatgggaacataaaacataaaggtacaaagtatgagaaagtgacaa

SEQ ID NO: 37549 - DNA, 121 bp, Artificial Sequence
  Synthesized
  misc_feature (61): n=a or g
accagcccggacagcccaagtgcaaggggaaaaggaaagcacaaagattcacaaatggctngacggcagctcattaataacaagacagaactgtatccaagactgactgattagtaagcaa

SEQ ID NO: 37550 - DNA, 121 bp, Artificial Sequence
  Synthesized
  misc_feature (61): n=a or g
tgaaaactgtacagtacaaatgttgattattttttgtggaacagttacaaaagcaattganaaaggaaagagaatatcatctgggttttggtatagcaatgtctgacgaaatcttactctt

SEQ ID NO: 37551 - DNA, 121 bp, Artificial Sequence
  Synthesized
  misc_feature (61): n=a or c
tttctaagcagagctttagaagggctgtatcagagttttagaatgagagctccttgtactngagagtcattgtaacttactgtgttaggcactatggtctgcatcacatttatacatatat

SEQ ID NO: 37552 - DNA, 121 bp, Artificial Sequence
  Synthesized
  misc_feature (61): n=t or c
ttaagcagcttcttagatctttccttcttcatccaaggcatagttttggcaactctcaggnccttattctgcaaaatgtttaacatgtataaattttggctgttgagcagtcccatttgca

SEQ ID NO: 37553 - DNA, 121 bp, Artificial Sequence
  Synthesized
  misc_feature (61): n=a or t
catatcgtctggaggagctacctataaggatatcaacaattatttaaccacatcatctagngaatccagttaaatctgagctcttttgaatttgtaactgtagtttctggagaactggtaa

SEQ ID NO: 37554 - DNA, 121 bp, Artificial Sequence
  Synthesized
  misc_feature (61): n=a or g
gagttacggacttatcttattcccaaagagttctgtgtagatgtcgattccactggcacancaatctgtaacataactgttgaaatctgtagggtttgtaagcatatgttgtacgtgtagc

SEQ ID NO: 37555 - DNA, 121 bp, Artificial Sequence
  Synthesized
  misc_feature (61): n=c or g
ggtatttgtgtaggatgcaaaaaagctgaagatcacagtcagtttaagatagtgaagacanctgaatacccagtgcctgtagggtctgaaatgtaggcttctggaatgggaactccctgtg

SEQ ID NO: 37556 - DNA, 121 bp, Artificial Sequence
  Synthesized
  misc_feature (61): n=t or g
tatagcaaagagaagagatgtatgaactaaatagattcctcagtagaagtagtagatgttnccagttttgatttctatggctttgtaacaagttatcattactttgcagtattaataaaat

SEQ ID NO: 37557 - DNA, 121 bp, Artificial Sequence
  Synthesized
  misc_feature (61): n=t or c
tgagcaaactacatagtccctctagtactctttactaaagccaatctgctgccaatcctanctgtttaacaggttaacctatttaacctgttaacatcagttaacacctaaactgaaaaca

SEQ ID NO: 37558 - DNA, 121 bp, Artificial Sequence
  Synthesized
  misc_feature (61): n=t or c
gcttttggtgctccgtaacaaatcacttctctgctcccatccctcttttccagatgagggnttcccctgtgagaagtgctgccagtcggtttggtggcagattggccacccggtgcttcag

SEQ ID NO: 37559 - DNA, 121 bp, Artificial Sequence
  Synthesized
  misc_feature (61): n=t or c
cttttaccctcagtataaagtaacttttctccatccactctgatgtctttgagtcataccnggcatgcatgcatgcttttcattgctgaactctgtcgtggtttcataggatataccgtac

SEQ ID NO: 37560 - DNA, 121 bp, Artificial Sequence
  Synthesized
  misc_feature (61): n=c or g
cacgtgcacttctcactcagtataacttgttaaggttggatccccttacatatgaaaatgngtaagttaaattagcatgtctggaaggagttaaacttctccctcgatccactcaactatc

SEQ ID NO: 37561 - DNA, 121 bp, Artificial Sequence
  Synthesized
  misc_feature (61): n=t or c
tgcctttcctcctttgaatgcattggctttttaaactcctcattttattgctgcatgttangcattccatatcctttgggcacactttaatctcattacacacgtttcagtttctctccct

SEQ ID NO: 37562 - DNA, 121 bp, Artificial Sequence
  Synthesized
  misc_feature (61): n=a or g
tagaaaagacatcattaaagcaatgaaaatcaagcctccaataaaagaagatatttgggantatctttttgggagcagcttgggagtgttgtatacgttctgctctgttcacttcttgatg

SEQ ID NO: 37563 - DNA, 121 bp, Artificial Sequence
  Synthesized
  misc_feature (61): n=c or g
gtcagggtggacagacctgtcctgggaatgccaaccctacaaggacccacagagacatttngtgaatccagctcaagcttatgaaggtactaagggcagaaatattcaaccttctcatgca

SEQ ID NO: 37564 - DNA, 121 bp, Artificial Sequence
  Synthesized
  misc_feature (61): n=t or c
gcagcttttccctttcccagcaaaatctgcacttttcctgctacaatgggaatgggcaaanggaagcatccgagctgtctgcagagcccttccttgctgatacgttcagagctgcgcttcc

SEQ ID NO: 37565 - DNA, 121 bp, Artificial Sequence
  Synthesized
  misc_feature (61): n=a or g
aaaagattttgctgacactagaaaaactatttaaatcacaatagaatacaaagaagcacantacaactctaaggcactgagctttaaagtaatgtttcaacttcaaagtaacaaatctcct

SEQ ID NO: 37566 - DNA, 121 bp, Artificial Sequence
  Synthesized
  misc_feature (61): n=t or c
tttggccttcggtattttgctttcctgggtattgtgcctttggatattgagcctctggatngtgtgcttccttgggtatggtgtgtcttgatgtgcctcgactctgggcatcgtgtctcct

SEQ ID NO: 37567 - DNA, 121 bp, Artificial Sequence
  Synthesized
  misc_feature (61): n=t or c
ttgcatcaggctgacattggtgattctgaatatccttctttacattgcctttatgatcacngctaggactataaatgaaagtgtggttgtcactttcctttgtacagtttagtcaggagtt

SEQ ID NO: 37568 - DNA, 121 bp, Artificial Sequence
  Synthesized
  misc_feature (61): n=c or g
gtctggtgatggcactctgcggctggcactgtgcagtcaagaggtcacactgcaccaggantgtgaagctgcttcacaattctttacactagcaacatgcttgcatgcacacagcaagtca

SEQ ID NO: 37569 - DNA, 121 bp, Artificial Sequence
  Synthesized
  misc_feature (61): n=t or c
cccccctgtgcccccgcacaggacggcctgtccctgccctgtcttacagggaaggagaaangcatggcctttagcaccgtctctggtgtccaacccatttcttcaaggacagacatcgtgt

SEQ ID NO: 37570 - DNA, 121 bp, Artificial Sequence
  Synthesized
  misc_feature (61): n=c or g
ctcccataattaagtgttagtagttattttctgtatgtactttctcttagttttaactctnatgttgaatttctctttcccacgtttatttaaattgctgttgtagaattgtgtttgtgta

SEQ ID NO: 37571 - DNA, 121 bp, Artificial Sequence
  Synthesized
  misc_feature (61): n=a or c
aaggctgctgaataaaatggaattcttgcaaattaagtttccttttgaagaatctggctgnctttcccaaaaattaaacttgaattaatgttaaattgggcatatatggtaatattacaaa

SEQ ID NO: 37572 - DNA, 121 bp, Artificial Sequence
  Synthesized
  misc_feature (61): n=a or c
cctttctgcatgcatgggatcaagctgaagcaaagtcccagctctagggcctgggacatgnttctgagggtcaccatttggaaagcctctctgaaccaccagcatgtctacactgcaccac

SEQ ID NO: 37573 - DNA, 121 bp, Artificial Sequence
  Synthesized
  misc_feature (61): n=a or g
ttgccagaatttcagaggtttttcaggtcttattaaaatttaataagttcaaaattgctcngtacttatgaagaagtcaaactgcacagtgagataacagaatggcttccagttcctagtt

SEQ ID NO: 37574 - DNA, 121 bp, Artificial Sequence
  Synthesized
  misc_feature (61): n=t or c
ccaaaaagttctccaaaatgtctaaatccagctactacacttgcaatttacagttctagangtttccaagactcatgtggaacctataaagatgccactagtcacattcagttgttcagtt

SEQ ID NO: 37575 - DNA, 121 bp, Artificial Sequence
  Synthesized
  misc_feature (61): n=t or c
aacactccagacatctttcccttccagtttccttaccccagttttattgtcagaactatgncatatggtataggatattcctttggacattttgggtcagctgtcctggttctgtcccacc

SEQ ID NO: 37576 - DNA, 121 bp, Artificial Sequence
  Synthesized
  misc_feature (61): n=c or g
tttctcttctgaaggtagcactggtgcaagtaaagaacgtggcttttaggagaaacagganccccagtttgctgaaatctgaggaaaacggaggcccaaatgctgttcaagcccctgaaaa

SEQ ID NO: 37577 - DNA, 121 bp, Artificial Sequence
  Synthesized
  misc_feature (61): n=t or c
ttgataaaataagaggctgtgatagccacagctcatcagcttaacttgaatagaaaagcantgaaaaaataagcagtctggaggaatcaagaagataatgaagtactgagaaacagctcca

SEQ ID NO: 37578 - DNA, 121 bp, Artificial Sequence
  Synthesized
  misc_feature (61): n=t or c
ttgcactcaagtcagcaggtgtgagtgggtatgtgctgtcgttatcagaataaaactatgntcagtttctgtgaaaaataatgtagggttttgcagcaaaatcgtgttgttgctagcccta

SEQ ID NO: 37579 - DNA, 121 bp, Artificial Sequence
  Synthesized
  misc_feature (61): n=a or t
gctcattgtgattagttagccagaggaggtgaaatcaggtaacattttggctggtaatttngtctaatagtggtttctgtgcatttgtttctcttcactgagcagatgttaacctgcagaa

SEQ ID NO: 37580 - DNA, 121 bp, Artificial Sequence
  Synthesized
  misc_feature (61): n=a or g
cctcagaagaaacccatgcagtgaaacttactgtgtttctcagcccttttaaataaaagcnatcaagtttcagccactgagaggataaacttcttttctttattcactgctttctgtgaga

SEQ ID NO: 37581 - DNA, 121 bp, Artificial Sequence
  Synthesized
  misc_feature (61): n=t or g
tctgcaagagctgtatacgcctctggtctataagcctttggctgtgttagttgatgtgtangctgggaagttggcaggctacttttttgtttcaactatactggatctgaaaccaccatag

SEQ ID NO: 37582 - DNA, 121 bp, Artificial Sequence
  Synthesized
  misc_feature (61): n=t or c
ctacaaacccaccctgcagcttacgaaggcttcttcatacatcattcaaagcccctcaaanccttgagctgcaaagcagcttctcagcatgaaagcagattgtggggggtggggaggaaag

SEQ ID NO: 37583 - DNA, 121 bp, Artificial Sequence
  Synthesized
  misc_feature (61): n=a or g
gacccccgtgccatcactggggtcccaaggatgagacacaagcactgggcacatttggagnctcccatgccacccctgaggtctcagggacaaggtgcagctggggacccccataatgtta

SEQ ID NO: 37584 - DNA, 121 bp, Artificial Sequence
  Synthesized
  misc_feature (61): n=t or g
gcagaggtggacttgggcatccataaacagggctgtgtgtttgtgtagctgtgtgtttccnagtacaacattgtcttcttgacctgtttgtcccacagagataaaatatggggagaatgac

SEQ ID NO: 37585 - DNA, 121 bp, Artificial Sequence
  Synthesized
  misc_feature (61): n=t or c
catgaaccagtttatctttgtctttgcagaggagcagatgtggtaccagtctcaggggcangcaggccctttgcatggaaaacatcagcaaaaggagctgtgagcatggaaatcttcagcc

SEQ ID NO: 37586 - DNA, 121 bp, Artificial Sequence
  Synthesized
  misc_feature (61): n=t or c
cattgttcagagtctgtctctgttctggtgactcaagatcagcgtcttgtggagtatgaanagggatgttacatagaccattgtcattactgaaactctaagacgttcacatatgagcagg

SEQ ID NO: 37587 - DNA, 121 bp, Artificial Sequence
  Synthesized
  misc_feature (61): n=a or g
attttaaccaggtggctgttgtcttttttgctaacaaaccatctcaaagaaaaaaccatgncattccaaaagagacaagaagatcccctgtgattccttttcagcacaagaacttgcactc

SEQ ID NO: 37588 - DNA, 121 bp, Artificial Sequence
  Synthesized
  misc_feature (61): n=t or g
ctcatattcttgaaatatttcactcaaaacgtcatcctcttccttagcttttcttgcctgnaaaaatttgcaatgttgaagctaagaatgtttttcaaggtgttttcactgacatggcttt

SEQ ID NO: 37589 - DNA, 121 bp, Artificial Sequence
  Synthesized
  misc_feature (61): n=a or g
gtttcttttagaaataaatgaagacaaagaaactacaagtattttacatacaagcagcacnttttacctttactgaccataacagtgtaagtggacctgtaaaagtataaaggggaaaaaa

SEQ ID NO: 37590 - DNA, 121 bp, Artificial Sequence
  Synthesized
  misc_feature (61): n=t or c
cacggatctcctggagagagtccaacagagcaccacaatgatgatgaagctcccagatgcnatggtgctggcatccaacgctgtgtctaaggcctttgcttgcagctcattctctatgctt

SEQ ID NO: 37591 - DNA, 121 bp, Artificial Sequence
  Synthesized
  misc_feature (61): n=c or g
tcaggtatgtcagtgaggtttaacctcctactgagcatgcagcttcccactgcaaggtcanctgcacattcagatatccgctgcaggctaaaaaatcaaacaaactcaactacctcatggg

SEQ ID NO: 37592 - DNA, 121 bp, Artificial Sequence
  Synthesized
  misc_feature (61): n=a or g
taggctgtaatttacagaaaatgaacgtacaggagttataacagaagaagtcatttgtatnataaagcaggcatagcatatacagtgcaaaacacagcaatcatttattttgattaaatgg

SEQ ID NO: 37593 - DNA, 121 bp, Artificial Sequence
  Synthesized
  misc_feature (61): n=c or g
tggatcggacgctgtcagatggagatggtgtgacggccctaatgggccgctattaaaaacncggttcggttctccctccgttggctgcagacgccccgcgggagcgatcccatcaccgcgg

SEQ ID NO: 37594 - DNA, 121 bp, Artificial Sequence
  Synthesized
  misc_feature (61): n=a or c
catattgtgatatactggcagcctttactgttagtatcactccttattctcaagagatacncagagggcaccctttggattttcacatttcaggatgacggaaatctactttcagcttcca

SEQ ID NO: 37595 - DNA, 121 bp, Artificial Sequence
  Synthesized
  misc_feature (61): n=a or c
ttctgacctgcccgtgttcaccaaaagcctgcctcctactccatatggaagggagtaaaantgggaagttcttttccatatggacaaagcagatgcggctatagaatccgtattataaaac

SEQ ID NO: 37596 - DNA, 121 bp, Artificial Sequence
  Synthesized
  misc_feature (61): n=t or c
ttgaaactttcaatccatcagtactgagacaacacggggcacttctgaaaatcaaaccttngtttgcataagcccattcttctgtaatgcgatctctgaagatttgaacttctgtgaatac

SEQ ID NO: 37597 - DNA, 121 bp, Artificial Sequence
  Synthesized
  misc_feature (61): n=a or g
gacatcatggagtaacacaggggtgacattgttggggtgatgctggggagtgacactgggntgacactgagaaatgatgttggggtatcacttgggcagtgacatgagggagagatgcagg

SEQ ID NO: 37598 - DNA, 121 bp, Artificial Sequence
  Synthesized
  misc_feature (61): n=t or c
gcagtggaaattaatgaattttgctactgaagttgccagcagaaagaaaagggcaggatcngtgaccttttaatactctgctgtaatttaatttgtttatacatttgtcattcatgagtac

SEQ ID NO: 37599 - DNA, 121 bp, Artificial Sequence
  Synthesized
  misc_feature (61): n=t or c
acggcacacggtgagaattcacagcggtgaagttagatggcaagatttcatatgtcaatangctatcacagaaataaattaggactaaagaaagtataaaagttctctaattgctgtattt

SEQ ID NO: 37600 - DNA, 121 bp, Artificial Sequence
  Synthesized
  misc_feature (61): n=t or c
agagaaaaaagaaaatgccattaagttcaaactgtggatgggtggattggtgggtggtgtnggttggtgttggtgtgtgggtggaggaggtgatttgagaagatcaaagtggctgatattt

SEQ ID NO: 37601 - DNA, 121 bp, Artificial Sequence
  Synthesized
  misc_feature (61): n=t or c
ttaaatgagagagaatttctttcttgttgacagatgaggcctagaaacattggtcattgtnttgacatctcttaattagcaataattttaaagacttccatactaggattaatatcaaagt

SEQ ID NO: 37602 - DNA, 121 bp, Artificial Sequence
  Synthesized
  misc_feature (61): n=a or g
tatcctacttccagtgtgatttggttcctcatgctttaccatgtctaattagggttttacnggatgctgccaaaccccatctctctccactccctgtgaagcccctgctgcaatggtcacc

SEQ ID NO: 37603 - DNA, 121 bp, Artificial Sequence
  Synthesized
  misc_feature (61): n=a or t
ctttgccagacatagtatcctatgtatttcaaaggctgtcatgatttctttttctaatttntcaagtacttttttccctaaatccttcaagaagtttagcagtcacatcacagctaggaat

SEQ ID NO: 37604 - DNA, 121 bp, Artificial Sequence
  Synthesized
  misc_feature (61): n=t or c
actagattagagacctgtttgccatcagatacccctttcataatggtgtttgtgagtcacnttttatctgctcttgaataagctagcaacaaagactttgttggccttttactatacagac

SEQ ID NO: 37605 - DNA, 121 bp, Artificial Sequence
  Synthesized
  misc_feature (61): n=t or c
ttataacactcgataaaccatttattgtcttgctacacaaattttcctgctgctttaaagnaaaggtccatgagttgaaatgcagagtgcctgcttccaaccaggccatgctgccagatac

SEQ ID NO: 37606 - DNA, 121 bp, Artificial Sequence
  Synthesized
  misc_feature (61): n=t or c
agtcctgagtaatgttaggcaacgagttagttgatgtaagacttgttggctaccaaaattntggagaagtcatcttggagaagttgtgggacaagaaactgtcttgatttggagatctgtt

SEQ ID NO: 37607 - DNA, 121 bp, Artificial Sequence
  Synthesized
  misc_feature (61): n=a or g
tcactgctctcaggtgtaatatgaatgaaatcctgttctgtgttaatttgccatttactgntgctggccttagcaagggtgttgctgccttcctgcaagtaatctgtgcaagccggaagcg

SEQ ID NO: 37608 - DNA, 121 bp, Artificial Sequence
  Synthesized
  misc_feature (61): n=t or c
atgtattaactgcacatctcccacatgtgctgagaaagaacacgccatatttggagcaaangcagagaggaaaagaaagtttttaattaagctgccatcgcagtacaatttcatgagaagt

SEQ ID NO: 37609 - DNA, 121 bp, Artificial Sequence
  Synthesized
  misc_feature (61): n=t or g
aaatactgagttcaagtatttgccagacaagtagtccaaatttctctcaaaatgttgtctnctagctaaactgaacagtaacaaacctaggaatctcaataaacttagtttacactgaaat

SEQ ID NO: 37610 - DNA, 121 bp, Artificial Sequence
  Synthesized
  misc_feature (61): n=t or g
caggaatactgacatctgccttcagggtgatcaactcaagacaaatgaagttccccttccnaaagtgttgattttgttctaatagtgtccaacttgacttcctggctccagtgcttcatcc

SEQ ID NO: 37611 - DNA, 121 bp, Artificial Sequence
  Synthesized
  misc_feature (61): n=a or c
tcacggcgcccgcagcggggctgcaccaggggctccgggcacatctggtgacctcagaagnaaggctgtttaactctgctaatggagagccggcagaagcctgcagggctgctcacacggt

SEQ ID NO: 37612 - DNA, 121 bp, Artificial Sequence
  Synthesized
  misc_feature (61): n=c or g
aaattctgtttttggtgattttttttgtttgtttgtttggagccaacctcttggtttcccntgttgtgccaggcatacagtggtatcgagatgaagactgataaagaaaatacaaaggcag

SEQ ID NO: 37613 - DNA, 121 bp, Artificial Sequence
  Synthesized
  misc_feature (61): n=t or c
gctgtgggtgcaaggagcattttggggtggcggtcagagcattttggggtgtgctgtgccncaaagtggggaagggttggactgccccatttggcttactgttggccaggatgctgtcagg

SEQ ID NO: 37614 - DNA, 121 bp, Artificial Sequence
  Synthesized
  misc_feature (61): n=a or g
gctggtggctgtcactgtctattgcctgtggggacacagccaggccattgaatagaagccngatgctcagacctggctcctgctcaaggtaccctcctgctccccatgcgccaggctggtg

SEQ ID NO: 37615 - DNA, 121 bp, Artificial Sequence
  Synthesized
  misc_feature (61): n=a or g
ttcctgaagagctgtgaggatttggaggtctggtggccttgcagatccccactgaggcttngcacctgcagctctgaagccagcgggggcacaacagggcctgacctgctcagtacagggg

SEQ ID NO: 37616 - DNA, 121 bp, Artificial Sequence
  Synthesized
  misc_feature (61): n=a or c
tatagatgaaaatgagtgagtaggggggtgtgacacgggtgagtagatgtgtggatcttcnatgtatagtttggctgatgggcaggtatagacctgaaatgaccattataaatacgcataa

SEQ ID NO: 37617 - DNA, 121 bp, Artificial Sequence
  Synthesized
  misc_feature (61): n=t or c
tagtctcttttctgtagtaatttgatgctctgaggctggcatgctcaataagaccagggtnatcagagcttctaagagcctgggtaaagtgctgaaatataatttttctttgtgaagttgt

SEQ ID NO: 37618 - DNA, 121 bp, Artificial Sequence
  Synthesized
  misc_feature (61): n=a or g
aatacagatagaacagtgagacaaccattaacacttctccttcagagaaccctctgggcantgacaaagatcacaatgggttttgaagcacaacttcatggatttaccaacattttgatat

SEQ ID NO: 37619 - DNA, 121 bp, Artificial Sequence
  Synthesized
  misc_feature (61): n=c or g
ccactgatttcaactttttagagcacagctctgcctaagccaatatatagttgtgcagagngaaaagacagttccattagcataattctgcttcttagcaatgggcaaaggacataatgtt

SEQ ID NO: 37620 - DNA, 121 bp, Artificial Sequence
  Synthesized
  misc_feature (61): n=a or g
ttaaccatcatcttttaattgttaatgaaatttaagaagtctggtccccttagaagatgtntgctgccatgcaaaataatcaaagcagtgtttagtcataggtatatcttttaagacttga

SEQ ID NO: 37621 - DNA, 121 bp, Artificial Sequence
  Synthesized
  misc_feature (61): n=a or g
ccaggcaaagtgctttgtgttcagcacgtgtgtgaacacctgcagtttggtgtcttaatcnggggctgaaataatggaaaaatagcagaagtgggagtgaacacagaggccaacagcagag

SEQ ID NO: 37622 - DNA, 121 bp, Artificial Sequence
  Synthesized
  misc_feature (61): n=a or t
gctgtaagaacaggcatatttatgtgaggggaaggaaaaaatatgaggaaacatgacatcngtttcctcaaatataagaggttgccaggaagactgaagtagggcctactagaaaggcttt

SEQ ID NO: 37623 - DNA, 121 bp, Artificial Sequence
  Synthesized
  misc_feature (61): n=t or c
ttgtatggggaaacccatccgtgcagcacactggctctgccagaactcacatctaacaggntgaagatgagcataaggaactcctcgtccctgagataaatcccaaaagcagttgggagag

SEQ ID NO: 37624 - DNA, 121 bp, Artificial Sequence
  Synthesized
  misc_feature (61): n=t or c
tgaagtgattttttttggctgatatttatcagattgcttaagaaacattttgattattttnccattcaattttcttgttccttctgttcaccctggagttcattgccagatgatgctggtt

SEQ ID NO: 37625 - DNA, 121 bp, Artificial Sequence
  Synthesized
  misc_feature (61): n=t or g
gcgtggttcaactggagaaagaaaatgtacaaatctcagtgggtgaactgaaaataaagcntttattcccccacagaggccatttctaaaattcatggcattcatctgaaggcaccacttc

SEQ ID NO: 37626 - DNA, 121 bp, Artificial Sequence
  Synthesized
  misc_feature (61): n=t or c
tgccatctccagaatcttttagttgttcttcctctcagtgttttcccagactaagtcctanttattttctctaacagataaacaacagaaaagctgcttttcatgctcaacacctagattt

SEQ ID NO: 37627 - DNA, 121 bp, Artificial Sequence
  Synthesized
  misc_feature (61): n=t or c
aggaatccagaacttacctgttcttttattttatttttacaggtacaattcatatttatangatatgcagacatttgatgatgataggtcagtctgctaaggtatggaaaataaacagaaa

SEQ ID NO: 37628 - DNA, 121 bp, Artificial Sequence
  Synthesized
  misc_feature (61): n=a or t
tcctttcctgaagaagcatcaacagaagaagttgctagggaaggagtgagagcagtgtctntatttagtttaacaatctcacagtgctactctaaacaagagattttagtggccatcataa

SEQ ID NO: 37629 - DNA, 121 bp, Artificial Sequence
  Synthesized
  misc_feature (61): n=a or g
gagagcactcccagcaacagtgttagatatgatgctccagctcatatcactgtacttaaancactaactttccagtgactggcacaactgaatatatcactgtattcattcaccacgctct

SEQ ID NO: 37630 - DNA, 121 bp, Artificial Sequence
  Synthesized
  misc_feature (61): n=a or t
ctctaatactctttctttttggaagacgaggattgttcacacttaggcatgctgcccgtangatttctcttacaaatatgtgattgaattatccggttgcatccctgacccttgttcaagc

SEQ ID NO: 37631 - DNA, 121 bp, Artificial Sequence
  Synthesized
  misc_feature (61): n=t or c
atccgaccacagacctgaactcacggtgaaaaacagccttgatcaaatggggtaaccaacnggtccagagtggtgaacatccctataatcaccaccaccaacagctgctgttcaacctgag

SEQ ID NO: 37632 - DNA, 121 bp, Artificial Sequence
  Synthesized
  misc_feature (61): n=a or c
aacagtcatctccctgaattagaatatgtacttattcttcttgagtcttgtctcaagaagnatcttgactccagtcatactcagaattaaaaacaacactgtccgtgcaattcataactca

SEQ ID NO: 37633 - DNA, 121 bp, Artificial Sequence
  Synthesized
  misc_feature (61): n=a or g
gaacggccttctataaaatatttactacagaaaccttcaaaaattaaaggaaaaaagcatncattgtctgattctggtgaaacttactcccacctcaagtgtctcacctgaactttttaga

SEQ ID NO: 37634 - DNA, 121 bp, Artificial Sequence
  Synthesized
  misc_feature (61): n=t or g
gctattgaggcgggacaaaaaaaaaaaagaatgtggctgtaggacaaaagactttctcagngttgattcctggtgggcctcaataatggggacaaatactaatttctgaacaaagaaacaa

SEQ ID NO: 37635 - DNA, 121 bp, Artificial Sequence
  Synthesized
  misc_feature (61): n=a or t
ctgtgctatctcagtaaataaagcttaactaacgcacatcctcacacctcttaacatctanttttgaactcttctgaattcatttgttatatccaatcacttcacattctgtggggaaaaa

SEQ ID NO: 37636 - DNA, 121 bp, Artificial Sequence
  Synthesized
  misc_feature (61): n=t or c
atatcaccccatgtaagactatctttgtatatattaatacctttaaaaggatttatctttnattagaagtattaagtggctcagaatttatttatttaccctgctaaaccactaatactaa

SEQ ID NO: 37637 - DNA, 121 bp, Artificial Sequence
  Synthesized
  misc_feature (61): n=t or g
taaacctcatctataatgtatagtacctgcataacctctttctcaagggcgtctttctgcngatgactcattcctctaggaattcatcaactcttacgctttccaacaactaaatcatgtt

SEQ ID NO: 37638 - DNA, 121 bp, Artificial Sequence
  Synthesized
  misc_feature (61): n=t or c
gtttgtcacagtctctacgagatagatgtcacagcctagtgaaggcttgcttatcattcangtggtcacttccattacctctcctcagacagtgttgacctgctattagtgactctaattt

SEQ ID NO: 37639 - DNA, 121 bp, Artificial Sequence
  Synthesized
  misc_feature (61): n=t or c
gtaacttaaaataatgaataaggcaggtatatttatctgtatactcatccttataaaatcnacccaggactagattaagatgaactacagagtcagaatatatgacagcgtaatacaactt

SEQ ID NO: 37640 - DNA, 121 bp, Artificial Sequence
  Synthesized
  misc_feature (61): n=a or g
tgcagctgcgggctgggatggactgggaaatcctgcgagttaggtaaagctgctccacacncacagcccagcctgctccgtggctcagtgcctgctgagctgccccactgtgccccacaga

SEQ ID NO: 37641 - DNA, 121 bp, Artificial Sequence
  Synthesized
  misc_feature (61): n=a or c
ttattttttctgtgatatctttttttttttaaatgccattagaggatgtgtttctgcctcntgcatccttgctgagaagctacctgtgctgggccaggaaaagaacctttattgatctttg

SEQ ID NO: 37642 - DNA, 121 bp, Artificial Sequence
  Synthesized
  misc_feature (61): n=t or c
cagagaacagcacagccatgacatgcactgaccaggactccttttatactcaagattcttntgggccacatcaattccaagctgacaggcaactgtatatatgctttggaccaaggtagat

SEQ ID NO: 37643 - DNA, 121 bp, Artificial Sequence
  Synthesized
  misc_feature (61): n=c or g
gatttcccagagaaatggtggaatgttcatccctggagatattaaaattcagttggaaaangccatggacaactcaggtaactttggagctagccccacttttagcagggtataagggaag

SEQ ID NO: 37644 - DNA, 121 bp, Artificial Sequence
  Synthesized
  misc_feature (61): n=a or g
gctgagagtatttcttgatgttttatagcccaaactcacttcttagattaatggctgctgnattaaactattcagcttggtaaatcctgaaataagagttcctaatccacgtttcttttcc

SEQ ID NO: 37645 - DNA, 121 bp, Artificial Sequence
  Synthesized
  misc_feature (61): n=c or g
tgtttaaacaagagcttttctttcattaaatgataacatacactcacaaaggtacatttanctttgctgcaggcagtttttgtgataattatctagggctaacagcactccattaggtaga

SEQ ID NO: 37646 - DNA, 121 bp, Artificial Sequence
  Synthesized
  misc_feature (61): n=a or t
gtgtgtacattaaacaaatactttacagtaagactccaaagagcttactatttttctattnccctgaaagatgctgaggttttcacaaaccaaaaataaaatttatcatcaaagaactgtg

SEQ ID NO: 37647 - DNA, 121 bp, Artificial Sequence
  Synthesized
  misc_feature (61): n=t or c
taggtgtgattttcaccattttgttgtcttgctaccttctctctgctacagtgtttttcangggagaaaaacacacattcaaggaccaagcttggttcatgagagtccttattattcataa

SEQ ID NO: 37648 - DNA, 121 bp, Artificial Sequence
  Synthesized
  misc_feature (61): n=a or g
agaaagaagaggaaacaaatagaaaaagataacaaagcatgtgaatatatctgtctgtacnttttcacatacatagaataacacaatcagaagaggacatgattaaggatgttatgtttga

SEQ ID NO: 37649 - DNA, 121 bp, Artificial Sequence
  Synthesized
  misc_feature (61): n=a or g
tgttgcagacacagagcaggaatggagctctgtttggctgctgtgcaacgacgtgggcaancatgtgtatgatcagtgctcattttctgaatggaatctgacagagctgctgacaatacta

SEQ ID NO: 37650 - DNA, 121 bp, Artificial Sequence
  Synthesized
  misc_feature (61): n=t or c
gtgcactgcacaaggtcactttgccatacgaattcttcaaacgatcctctgaagaatatangttggaaggagttctttttctttcagagctgttgcgtttagcttctaattatcccacagt

SEQ ID NO: 37651 - DNA, 121 bp, Artificial Sequence
  Synthesized
  misc_feature (61): n=a or g
gaaactgaactcactgaacatctggccccaccttctcacctcccagtatttaagaagcaangaagttaaaagggagcccactagtgataccgttaattgacctttgatacaactgcagatg

SEQ ID NO: 37652 - DNA, 121 bp, Artificial Sequence
  Synthesized
  misc_feature (61): n=t or c
tgttctgctgtttggcctctcgatggctacagtacaaaatgccaagaatctccaacagcangaggtctgaaagagatcccagcatgcttctaagaatgcatttggaaatgataagcagagg

SEQ ID NO: 37653 - DNA, 121 bp, Artificial Sequence
  Synthesized
  misc_feature (61): n=t or c
tggcttcagagtcagctgtagcactgctatgttatataagatgcaaaatgcctgaaatagnactatcacaagcactcagtgaaactggtgtatagaaaaagctatataaagatatggcatt

SEQ ID NO: 37654 - DNA, 121 bp, Artificial Sequence
  Synthesized
  misc_feature (61): n=t or g
tcaccactgcaccgagttgatctttctgactgttacaacccccttatgctgagaggtgggngagaactttctctgtgccccgagccttgacatttgtggctttgccacgtaacagagggat

SEQ ID NO: 37655 - DNA, 121 bp, Artificial Sequence
  Synthesized
  misc_feature (61): n=a or g
aggagacaaagaaaccagcaggggaaaaagcgatatggacaacttcacctgaaatattttnaagttctttacattcttctgtaaccctgtgttccaaagtgatctgattttcaagaaacag

SEQ ID NO: 37656 - DNA, 121 bp, Artificial Sequence
  Synthesized
  misc_feature (61): n=t or c
cttcatggtgatctgggcctggaaaaggaaaacagtgcagctcagctacctgttaaaacancccttctttcggccttttgggataagagatcttctccactccaagcaataccttttacac

SEQ ID NO: 37657 - DNA, 121 bp, Artificial Sequence
  Synthesized
  misc_feature (61): n=a or g
aatcagaaggtttgttaagatatccatagagaaaatattattttgatgtcaactaatacanttgaaggaggttcatagaacagaactgaaaaggagaaacaggaaaagggacaggtttgtg

SEQ ID NO: 37658 - DNA, 121 bp, Artificial Sequence
  Synthesized
  misc_feature (61): n=a or g
gtcatgtatcgtgtgtcaatattgctgagagtttcaaagcctgctgtctcatttttggaanctcttcagctaaactgatgggcaaggatgctcctggggtactctgcaccccacgcttcta

SEQ ID NO: 37659 - DNA, 121 bp, Artificial Sequence
  Synthesized
  misc_feature (61): n=t or c
tgcctctaaccctatagcacagcattatgggggggatggaaacaggtgattctcctctggntgtgggcctgcttaaaacgtggacctctttttccctgcgagatacagaataaatgtaatt

SEQ ID NO: 37660 - DNA, 121 bp, Artificial Sequence
  Synthesized
  misc_feature (61): n=a or t
cattccatgtcttgtctctcctggaagatagttgaagcttgtgaaacctcccttcttttcnaaagctctttgtaccaacaacagagaagtgagtggttgttggttttcaaagttgtctgag

SEQ ID NO: 37661 - DNA, 121 bp, Artificial Sequence
  Synthesized
  misc_feature (61): n=t or c
ccttctattcctttaagcgtgtatttagcagtcattaagcggctctgctacagcctctganggcctcaccgacagggcttggacggctgtgtgggacgggactccctcacactgcctcaaa

SEQ ID NO: 37662 - DNA, 121 bp, Artificial Sequence
  Synthesized
  misc_feature (61): n=a or c
atctgtcccatctgaaactggtgttgacttgtttcacctaaaatttctacccgctataagnaattgccacttgagggcagcagtgcaagtagcaataccttttaagatgtgttatcatagg

SEQ ID NO: 37663 - DNA, 121 bp, Artificial Sequence
  Synthesized
  misc_feature (61): n=c or g
aataccactgcattatgcatgggcagaccaacaaaaattaaatccaggagaaataataaantttggtactctgacatttcaggtgaaaaaaggctgctttcacaaagccactgcgaccatt

SEQ ID NO: 37664 - DNA, 121 bp, Artificial Sequence
  Synthesized
  misc_feature (61): n=a or t
tagtgctaccaaaaatatcatcaagaattcccaaattggatgcttcattggaaatgaaccnatagttgtaatgaactggtgtttgattcatcacagcttcttctcaaattctctgaagcta

SEQ ID NO: 37665 - DNA, 121 bp, Artificial Sequence
  Synthesized
  misc_feature (61): n=a or g
gatagaaaagtagtgttaacatgcttcctgataatgatccttgagaatgagatgaaagcantagtgctggggatataaattaagcagagactggaatatacttgagactgtagacagcatt

SEQ ID NO: 37666 - DNA, 121 bp, Artificial Sequence
  Synthesized
  misc_feature (61): n=t or c
tccaggcgcactatggcaaaagaaacgccagatgctccttcatgaaggagaaggcagttcngtgtgagagacccatgccgtagggcaagtgtcctggctgggatggttgcagggcaaagat

SEQ ID NO: 37667 - DNA, 121 bp, Artificial Sequence
  Synthesized
  misc_feature (61): n=a or c
ctttgttgctggtaacaaatactggggtgatatgaaggatatgaaggactatactgtcccnaaaaaatcttcagagaaaaactcaatgccaccagtgggtacaagtgagatatccaaaaag

SEQ ID NO: 37668 - DNA, 121 bp, Artificial Sequence
  Synthesized
  misc_feature (61): n=t or c
tagacgttgctgtgtttgaggctgtgacaaacatatagcatttgtatggtaggtttttttncctctagtaaaaagcatgaaccaaaaaagcaagttgggatttaaatatttcatgttacaa

SEQ ID NO: 37669 - DNA, 121 bp, Artificial Sequence
  Synthesized
  misc_feature (61): n=t or c
ggtacaaagctagaacaaggttagcagtagaagagtcatttcagcagagtgtaaaaagtangtaagacagcacaaatactggttaataaagtgctgaatattctgaaaataataaatggca

SEQ ID NO: 37670 - DNA, 121 bp, Artificial Sequence
  Synthesized
  misc_feature (61): n=a or g
ttgaaaaactatttttaaatttagcctgttcagttacatctccagtaaattatgctgctantatctagtcatgtaaactgaaataaactagcatagtactgtaaaatactatagaatagta

SEQ ID NO: 37671 - DNA, 121 bp, Artificial Sequence
  Synthesized
  misc_feature (61): n=a or t
ttagctgtgtagggactaaatgcattcattgatgggagctaatgaaaccttcctaataaanaaaatatattctagtaaatgagctaaacaagtaaatttgtggcacatccaaaggagaaat

SEQ ID NO: 37672 - DNA, 121 bp, Artificial Sequence
  Synthesized
  misc_feature (61): n=a or g
ctctttggggtatacaaatacttaaattattgtgctcatttaattttttgttctcccacanggagttacattaaaaattgcttctttgtcttatgcctttgcatttcgcagcctcactgaa

SEQ ID NO: 37673 - DNA, 121 bp, Artificial Sequence
  Synthesized
  misc_feature (61): n=a or t
tagaggaacagctattcagaatgcgagtcgacaggacaaaactcaaagaggaaagctttcnctgtgcaaacagcttcaagtagctgttttgtagtctgcgtagcaagctatatgagttaca

SEQ ID NO: 37674 - DNA, 121 bp, Artificial Sequence
  Synthesized
  misc_feature (61): n=a or g
gcttctatcctctattttcttgctttcgtgagatgtctggatcaaggcagaacatcatatntagttcctgtagatccaccgaaggaactagatatgaaagacctgtgtgagtcactctcag

SEQ ID NO: 37675 - DNA, 121 bp, Artificial Sequence
  Synthesized
  misc_feature (61): n=t or c
ttcatatctatgtggtaggccaaatccacacacgaaacccagctccacatccacccatatntgagcagcagatgttactcctccccacgaagttatcaaggactcagctcacaccaccact

SEQ ID NO: 37676 - DNA, 121 bp, Artificial Sequence
  Synthesized
  misc_feature (61): n=t or c
aacacaaatgggagaccccaaagggctgccctcactgctttaggaagcagccataagccanggcatggcatggtgaaacaccccctgggtgtggagctgagctggtgggcattgggtggaa

SEQ ID NO: 37677 - DNA, 121 bp, Artificial Sequence
  Synthesized
  misc_feature (61): n=t or c
catacagagtggtttcaaagctttggaatttgggagaagactttctgtccttgatatcacnattcaccaaacaccaaggcaaacaaacctgcaaaaaactgctggtgggaaaaccttccct

SEQ ID NO: 37678 - DNA, 121 bp, Artificial Sequence
  Synthesized
  misc_feature (61): n=t or c
acactgcatgattaggagtgttctgaattttgtcttcatttgaatcttcatttgaaggacnttgtgtccttgttattccctttttggatttatcccaagttctttggtatgaaattaatca

SEQ ID NO: 37679 - DNA, 121 bp, Artificial Sequence
  Synthesized
  misc_feature (61): n=t or c
aaagtctacttttccacattgagaaaatattagacaagctaaaaaagatgctttgaagaangcaccagtaaaatgtcaaaccttaggtcagaatatgtgctaggatgtcagaggttgtttt

SEQ ID NO: 37680 - DNA, 121 bp, Artificial Sequence
  Synthesized
  misc_feature (61): n=t or c
catccattggcttgtatgcttgaatctgaataaagaaataaactaccttcccaggagaacngtgactttcattaggatttaattataagacttttatacgatacatacatattaaaagtcc

SEQ ID NO: 37681 - DNA, 121 bp, Artificial Sequence
  Synthesized
  misc_feature (61): n=a or g
tcggactgagaactcttggggcgcctactctctgctttgttctccgtgcagtcagctatcngcaaagcgtgggtactggatccctggcagggatgataggtgctacattaatgtacgtgat

SEQ ID NO: 37682 - DNA, 121 bp, Artificial Sequence
  Synthesized
  misc_feature (61): n=a or g
caaaatcaaaacttttttgacaaatcaagtaaagtaactaaaataatgtgtctttgcagtncaggtgaaggtgcctctgctttgatttcagtattactcttacctttccatatacagcctt

SEQ ID NO: 37683 - DNA, 121 bp, Artificial Sequence
  Synthesized
  misc_feature (61): n=t or c
tgcagtttctctaacagccatctgacttttaaatcataaaatgcttgtgagaagataatangagatttacagtagtaatcaggcacaaagattaattcttggaagataatatagccagtca

SEQ ID NO: 37684 - DNA, 121 bp, Artificial Sequence
  Synthesized
  misc_feature (61): n=t or c
tgcaagtatgcattaactctggctgatagagatgaaaccacgtgcttcttttagagttatnttctttactctgtacagtagttaagttcatatggcgaaaatgacttaaccatgtgtaaaa

SEQ ID NO: 37685 - DNA, 121 bp, Artificial Sequence
  Synthesized
  misc_feature (61): n=a or g
tatcagaagtaaaactctgaaatgaacaggaaatatatttttataattacaacaaatactnaaaagagtaaaagtacactgagaatgccacctgcatgtctctggctagactccaaacatt

SEQ ID NO: 37686 - DNA, 121 bp, Artificial Sequence
  Synthesized
  misc_feature (61): n=a or g
tgggaactgtctggttgattgtctaggggaaaaagaggcatgctgagggacttggaggatnggagacaactcatctactgcacacttctgaagggatgtgaggggaggggaggccttattg

SEQ ID NO: 37687 - DNA, 121 bp, Artificial Sequence
  Synthesized
  misc_feature (61): n=t or c
aatgaaaacactgaagacaactggggaattctattcactataatattctgagcctgcaacngaaatttggctgggactttgctgtgatgctgtaattatacttttgaccattctccataga

SEQ ID NO: 37688 - DNA, 121 bp, Artificial Sequence
  Synthesized
  misc_feature (61): n=a or g
aaacactgcgtgcagtgggaccctgcttacagagcagggtgcgccagggcacagagcttcngatgcaagggaaacgaccgtgcttgtttccttgctgtacagcaccattcggggtctggag

SEQ ID NO: 37689 - DNA, 121 bp, Artificial Sequence
  Synthesized
  misc_feature (61): n=t or c
agagcttggggcacgtctgcagctgttgcagaacctcttcacttctaagtcctccttgaanaaagagccgcagtgtgcaacgacttccccttccttttgtcagcaatgagcacccttctcc

SEQ ID NO: 37690 - DNA, 121 bp, Artificial Sequence
  Synthesized
  misc_feature (61): n=a or c
ggaaaaaaaagataattaccaaaagaaaaggaaaaattatggtatgtagtataaagagtcntgacctgatcataattatgacatgttttacaacacctgaggaaaaagtactttgaaacca

SEQ ID NO: 37691 - DNA, 121 bp, Artificial Sequence
  Synthesized
  misc_feature (61): n=t or c
cattcctgcttacatgtctgaaacttcccatccactgcatttagacagtgaacatggcagnacaatccctttatacagcacagcgatttttaaataggtttacagtcttcaccaaatacaa

SEQ ID NO: 37692 - DNA, 121 bp, Artificial Sequence
  Synthesized
  misc_feature (61): n=t or c
ttaccaatttcaacagcagtcagcaaaacattgagcctcaccccactttaagcactgttgnccctaccttctcaaaggtaattgttttaatcagcattgaattacttgggtctgcagagcc

SEQ ID NO: 37693 - DNA, 121 bp, Artificial Sequence
  Synthesized
  misc_feature (61): n=a or g
ccaaaacactcaattttgaagcagaagtcctgggaaaagttgccaaggacccagtggcatnaaatgacttgggaagatctttacctgtcagtactggtggtcctcgttttacattgcattg

SEQ ID NO: 37694 - DNA, 121 bp, Artificial Sequence
  Synthesized
  misc_feature (61): n=a or g
ttctctcattgttctgtggctatggttgtgtttaggaaagagcaaaatgtacgtgtatgcnctactcttatctgtgagaaggtagcaacaagttcattagtgcaggtggacttgcagaagt

SEQ ID NO: 37695 - DNA, 121 bp, Artificial Sequence
  Synthesized
  misc_feature (61): n=t or c
caaagtggcacagttcctgggaacaaaaacaccaataaagccttttgttaatgtctggctnctcacaaacagcattgcagtatttggacacatgctctgaaaaatgtctgggactggaaaa

SEQ ID NO: 37696 - DNA, 121 bp, Artificial Sequence
  Synthesized
  misc_feature (61): n=a or g
tgattctaagaccaaccctgaagatcagtggggccaatgctttgagacctttggcctgaantttggcaatgcatcagtgctgctgtatctgttagcacaaaggagatttcctgccaactgt

SEQ ID NO: 37697 - DNA, 121 bp, Artificial Sequence
  Synthesized
  misc_feature (61): n=a or g
aatggtgtccaagtgattgtccctagcaaaagaaaagtatgtaatctttaaaagtactacntgccttttaccaatgaagaaaacgtgctgtgatgatgagcaaaagaattccacggttttt

SEQ ID NO: 37698 - DNA, 121 bp, Artificial Sequence
  Synthesized
  misc_feature (61): n=a or g
acaatgtattgtagaatggagccagacagcatgtactcagttttctgtcagcatttcgagnccttaatatataaagaagatatacaaggcaaattggcctcaaagtccaaaacattgagct

SEQ ID NO: 37699 - DNA, 121 bp, Artificial Sequence
  Synthesized
  misc_feature (61): n=a or g
acttcatttccagactagcttttatttcttccttttggagaagacttgaacatgtggaagngaccttaccaagcagacttctgtgttcattgggaagcacagctctgccacctgccttaca

SEQ ID NO: 37700 - DNA, 121 bp, Artificial Sequence
  Synthesized
  misc_feature (61): n=t or g
taatggagtgtctaaatccagctagatgaagttggattgttttctttctttgctgcacatntgttctgctttccactgagatctctgtgacttcagaaaccatattttttcctctattgct

SEQ ID NO: 37701 - DNA, 121 bp, Artificial Sequence
  Synthesized
  misc_feature (61): n=a or c
ctatacttcaggatagcacaagcagtctcttagtttgagttgcctagtctacttgcactgnggagcagctcacctgcgtttgcattggtgatctcaccttccccagacatttgtctgagcc

SEQ ID NO: 37702 - DNA, 121 bp, Artificial Sequence
  Synthesized
  misc_feature (61): n=a or g
ctctctaaatgaagtgacatggcaaataggaagcaagttaggatctttaatttgcaagaanccatcactcaaaaaaagaagggagcggggtggggagaaagaaaaaatcatgtagtgtgtg

SEQ ID NO: 37703 - DNA, 121 bp, Artificial Sequence
  Synthesized
  misc_feature (61): n=a or g
cagaaatgaaagagctagaatcaaattctctctctccaggagccagagaaaggacctcacncatttgtagtagatgaaggggccaggggaatcacccatagttatcttctactttggtaaa

SEQ ID NO: 37704 - DNA, 121 bp, Artificial Sequence
  Synthesized
  misc_feature (61): n=t or c
tatacattagccatttctatctttacttggacatattatggatttgacccgatgcttcacnacctctctataacagaactaacacgcagcctccgttcatgttacatgactgcagtagtca

SEQ ID NO: 37705 - DNA, 121 bp, Artificial Sequence
  Synthesized
  misc_feature (61): n=a or g
tcagaaatataagaataaccatactgaatttgaccacagggtcaatatccattcatggctncagtggatgctctggggacagtgtaagaagaaggtgtacgtatagaagctggtgttagaa

SEQ ID NO: 37706 - DNA, 121 bp, Artificial Sequence
  Synthesized
  misc_feature (61): n=a or g
agtaccctctgtgggtgcatgagaaagaggcaatctaatgttttttgaagtggtggatgancagtctgctatttttaatcagacagttttcgtgttccatttcaggagtggactaacgcat

SEQ ID NO: 37707 - DNA, 121 bp, Artificial Sequence
  Synthesized
  misc_feature (61): n=a or g
ctgccctgaaatatctacaccaagatattgtttccacattttgcaattgctttatgccccntcccagagattagaggctgagcgaagacacatttcagcctggcagttaaagcattcaggc

SEQ ID NO: 37708 - DNA, 121 bp, Artificial Sequence
  Synthesized
  misc_feature (61): n=a or g
gtgaagatcaaatatctatttaaatgtgcagtatatgtgcatttctagaaaactgtatgcnttgtagaagtccttagttactttttggaaacaagtagttgcttgtagttgaagatctcaa

SEQ ID NO: 37709 - DNA, 121 bp, Artificial Sequence
  Synthesized
  misc_feature (61): n=a or g
gatatggctccaggttggagtcacattcctcagctcttcctaaggaatgcagttagggacntttcctctcaggttcatgtatggacaatagcatgcttactgtctgtgaggatgcaatctg

SEQ ID NO: 37710 - DNA, 121 bp, Artificial Sequence
  Synthesized
  misc_feature (61): n=t or c
taggaccacaaattaagactcaacttctagctacttcttttgttgaaaccatctggaagtnagtgctacttttttcttctgcataataagcataagatatacggagttgggattttatatt

SEQ ID NO: 37711 - DNA, 121 bp, Artificial Sequence
  Synthesized
  misc_feature (61): n=t or g
gaagaacaatacagaacagtttattttcctgtaaacctctcaaaacagcttaacgattttnagatttttttagaatttatttaaatggcatgaaccctatgaaagcatacctggtgctctt

SEQ ID NO: 37712 - DNA, 121 bp, Artificial Sequence
  Synthesized
  misc_feature (61): n=a or c
cgatacccaggggttctttgcaattgcaatcatttttccttctcatcgtgtggagggacancacaatcttgttaacattgggaagagaagggacacagcagtgctttcctcccagtaagtc

SEQ ID NO: 37713 - DNA, 121 bp, Artificial Sequence
  Synthesized
  misc_feature (61): n=t or g
gttatctatttctttgatttacagttatggaaacagtcttcattggtttagtatgcaatcntagtttagcttgtgaaaaagacattgatttaaaaatattaactgtgcattatgagagaga

SEQ ID NO: 37714 - DNA, 121 bp, Artificial Sequence
  Synthesized
  misc_feature (61): n=t or c
agtcatgtgagattgcagccccgtggaggagaggctctgtggtgggtgaattgctctcttnggggctgcacaagctgcgtaggaccttctgcacacccagcctcgagtgacatagaggcac

SEQ ID NO: 37715 - DNA, 121 bp, Artificial Sequence
  Synthesized
  misc_feature (61): n=a or g
aaatttcacagccatacttaactatgatttcatcttgcgttatatttccagataccatttncatttatatcaggataaagccagtgaatgaattttttccagtcttcagtagtctatcata

SEQ ID NO: 37716 - DNA, 121 bp, Artificial Sequence
  Synthesized
  misc_feature (61): n=a or g
aacaactgaagtcagaaaacgaaccagctgaggtagggactcactgtatgctaaggtcacntccttttgctgtgcctcgacttggataccgtgccagaactgaggataatgccttcaattt

SEQ ID NO: 37717 - DNA, 121 bp, Artificial Sequence
  Synthesized
  misc_feature (61): n=t or c
catgcttctgttaggctacttccgtcattgtgcctctgctctactgatctcccagagaaanattcgtgaaaacattcatatctttagaggaagtaatgagaactgatatttgaaacaattt

SEQ ID NO: 37718 - DNA, 121 bp, Artificial Sequence
  Synthesized
  misc_feature (61): n=a or g
gaaggatggggacattggtaagaggaaatagtgtttccagtgtgagcacatgaaagtgacngtaactcttggtgcttgcgatgttaagtgctgttgtattaaacatacaggatcatggctt

SEQ ID NO: 37719 - DNA, 121 bp, Artificial Sequence
  Synthesized
  misc_feature (61): n=c or g
cttctcgtggattgataaaatatgaattaatataaattttatgttacaagtgagaagggtnccttcgtcgtggacagaaaaacagaaaaaataacttctagttgcaaagataaagaaagcc

SEQ ID NO: 37720 - DNA, 121 bp, Artificial Sequence
  Synthesized
  misc_feature (61): n=t or c
tgggctcagttcctactattgtttacaagccaaatgtgaggttagatagtaatgggtcagnccttcgtagtcatggcacaggcatctcttagcagtgacatgcctgtgtgttaggacaaag

SEQ ID NO: 37721 - DNA, 121 bp, Artificial Sequence
  Synthesized
  misc_feature (61): n=a or g
aaaaaaatcaacagttgtaattatcctaaaaaacatactaaaaatacttttcttaactgancagttcaagagtggttagtgccaagtgaggtccattagttctcagtaacagaaagtctgg

SEQ ID NO: 37722 - DNA, 121 bp, Artificial Sequence
  Synthesized
  misc_feature (61): n=c or g
tttcaatctatttgcaggtacagtagaacctctggtaagttgaggatatcaattgtcattngaaacaatagttcttagtttctaataattttgattagagatcaaaacgtacttagaatca

SEQ ID NO: 37723 - DNA, 121 bp, Artificial Sequence
  Synthesized
  misc_feature (61): n=a or g
agagactgccagaaagcagctgggctatgtgaaggtttcaagcgaggcagaagaatacatngtctaggagaatacatagccaagagcaggaaatttgatgatggtttgtagatccgcatgt

SEQ ID NO: 37724 - DNA, 121 bp, Artificial Sequence
  Synthesized
  misc_feature (61): n=c or g
ttaagctcttcagaagtgagagaaactgcttataagaggaagggaacactgaagcacacantctacaagccagttgtctgcaaagcctaacgtacacctatccgttacgatttggaatggc

SEQ ID NO: 37725 - DNA, 121 bp, Artificial Sequence
  Synthesized
  misc_feature (61): n=t or c
atctacgtactgaaattttccaagtcttgcctggctgttgtagcaggactatcaaagcagnggcgattgcatttcacaagcaacgtacacagtacactgcttgcctctgaagtggtcagag

SEQ ID NO: 37726 - DNA, 121 bp, Artificial Sequence
  Synthesized
  misc_feature (61): n=t or c
tatttgctgaattttgcgtgtgtgcttttcagtttctcagagaaattgtactatgtgctanccgtaacgttctgaagttggaatcagatttctgacaaacagtaatcagctttctgaaaaa

SEQ ID NO: 37727 - DNA, 121 bp, Artificial Sequence
  Synthesized
  misc_feature (61): n=a or g
tggcgtggccaatctgcagcctgaaggcgctttgttgccatctcaaagtcttgtgggaccntgcagccacggccagatacccacagcgttgctaccgcattgatacttctgtaataaatat

SEQ ID NO: 37728 - DNA, 121 bp, Artificial Sequence
  Synthesized
  misc_feature (61): n=a or g
tgcagggctgggggaagggagtcgaagaagggtcaactgcagagagtctgaggagaagggnagcattgtaaaaccaaaggttttgaagagaaaccatattttcaaaatgtagcagagattt

SEQ ID NO: 37729 - DNA, 121 bp, Artificial Sequence
  Synthesized
  misc_feature (61): n=t or c
ttcccttttgtaattccctttagttcatcagtgcttgtatattgtcaagcccactggggcncagattctgtttagaagcatgtagaccttagcaatatctcagtgattatagttaagatgt

SEQ ID NO: 37730 - DNA, 121 bp, Artificial Sequence
  Synthesized
  misc_feature (61): n=t or c
tgaaggagccctcagggatatctgctgccctttgcagcaaggggagcgggctcccttgttntgtcctagtcagactgggactgtagaaggcaatgggacttctggtgctgccctgttaggt

SEQ ID NO: 37731 - DNA, 121 bp, Artificial Sequence
  Synthesized
  misc_feature (61): n=c or g
acatagctgcttttcagagctatgccaagctcctgggcagagcccttaaatggtctctttnagctgccataagtgaatgcagttcaactcagggctcagacgagcaagtaatgagctgtgt

SEQ ID NO: 37732 - DNA, 121 bp, Artificial Sequence
  Synthesized
  misc_feature (61): n=t or c
ggtcatattggtaagtgtagaactgagagttcaggctccctgctcaacacagcatctccgnaaacatctctgttagctttgtagtgatgctcatccctttttaaattgcctgaatttcttc

SEQ ID NO: 37733 - DNA, 121 bp, Artificial Sequence
  Synthesized
  misc_feature (61): n=c or g
catcagcaaatggattctgttctgtggttcagcttgttcagattttactcatggctctggnccctaattcatagaattcctctggaacgagtaatgttagtagcatatttccttaatgtgt

SEQ ID NO: 37734 - DNA, 121 bp, Artificial Sequence
  Synthesized
  misc_feature (61): n=a or g
tatgaactctgaaaactattttctaatggataaacacaggtttaacctgttgcctctttgnatgcttcataaaaactatttatgttcttgctttgctgacagatggtatgaatttctattg

SEQ ID NO: 37735 - DNA, 121 bp, Artificial Sequence
  Synthesized
  misc_feature (61): n=c or g
gctttggccactatgtctgtgcaaacaggttgtctaactgttcaaattagaataggagaanaacaaaatatctcctttacacgatgtcggtatggttaattctgatttctgtgtcagctga

SEQ ID NO: 37736 - DNA, 121 bp, Artificial Sequence
  Synthesized
  misc_feature (61): n=a or g
tcccttttttcagtgaatcactttagggatcacctcaaccattatggggtcaaaccaaccntgatggagtgattccataatggggttcatggacttttatagcatgaacccaaccatgatg

SEQ ID NO: 37737 - DNA, 121 bp, Artificial Sequence
  Synthesized
  misc_feature (61): n=t or c
tgatgtgaaagctaccgattgagaatccagcgtctatgtgaagctgctttccatttcctanaacgatattaatttgtaatttttcctcctgtctctgcaattactttttaagctcctctat

SEQ ID NO: 37738 - DNA, 121 bp, Artificial Sequence
  Synthesized
  misc_feature (61): n=a or g
tgttgctcaatacttttcttccttaagaagcatgatgaggatgtctgctccaggaaagggntgttccatccactatcatcatcacacagtagcatttccctcctttaattttgtccttagt

SEQ ID NO: 37739 - DNA, 121 bp, Artificial Sequence
  Synthesized
  misc_feature (61): n=t or g
caaaaatcataatttggtttcaaatgtaaacctcttatctttaatttttgttgagagatgncacacttaatctcttcagagttgaaggataaagaatgcccctgtcagggcaactgtaggc

SEQ ID NO: 37740 - DNA, 121 bp, Artificial Sequence
  Synthesized
  misc_feature (61): n=a or g
aggagtccagggcacagttcagactccaccatccacctaaagtcattcctcatgcacgatntgaacaagacttggccaagcttgtcgttctttacctcacacagtcttccaaagctgacct

SEQ ID NO: 37741 - DNA, 121 bp, Artificial Sequence
  Synthesized
  misc_feature (61): n=a or c
acatcctcagagaggtgtgaacctctgttcctgcgcaggacaccaggctgctcataggacncgcgtgacgcacacaacgttcacccccagcagatgatgccctgtaaggccatccaccgtc

SEQ ID NO: 37742 - DNA, 121 bp, Artificial Sequence
  Synthesized
  misc_feature (61): n=a or g
aaaatgaaaactaacagacaactttgtccacattttgtccacattttcccagaataaggcngcatctgtgccagcgtgcaacagttacgctgcagcctgggagtgctcccactctcagatt

SEQ ID NO: 37743 - DNA, 121 bp, Artificial Sequence
  Synthesized
  misc_feature (61): n=a or c
tccccaggctcctaacatgacaaaacaataattaatgagatagaaaagcgaacccgagttncagtaagcgcagagaaagacccacgaggaagcctacgagcagggcagtttgcaacccatg

SEQ ID NO: 37744 - DNA, 121 bp, Artificial Sequence
  Synthesized
  misc_feature (61): n=a or g
cactggggagctgctgatgtgtcccctcctggcacccaaacaccacccgcagcaggtaacntttgaaatagtttattaggaccaagtgcagggtgcgtgcagccacgccgtggccacaacc

SEQ ID NO: 37745 - DNA, 121 bp, Artificial Sequence
  Synthesized
  misc_feature (61): n=t or c
atgtcacttggaggcccagcacgttctttgatgagttccgttttcgtgggttgcacacgangttgcctttccatttgttagtgtcaggttaagatacaggtagaattaataacgcacattt

SEQ ID NO: 37746 - DNA, 121 bp, Artificial Sequence
  Synthesized
  misc_feature (61): n=t or c
ccatctccccacctccagctgttgctggggccacccattaatcaatcataattaattaggntcgcccgtgggagctttctgtgataatcacagctcggagtgaaggtcccggctccggccc

SEQ ID NO: 37747 - DNA, 121 bp, Artificial Sequence
  Synthesized
  misc_feature (61): n=c or g
gtgatgtggcactctgatctgcatgcccaatgggaaaacttctatctgttcatttatcatngtcttagaaaagtgggttattctgaatgaaaacaattcaccgcttgtgatggtcaaacct

SEQ ID NO: 37748 - DNA, 121 bp, Artificial Sequence
  Synthesized
  misc_feature (61): n=a or g
tgtactaaagaaagttggcagcacatgaagtcatggtctgtaatgcttaacatggattatnttccataggctctgcaaacaatgcacagatatactatatgatatagcagaacttcactaa

SEQ ID NO: 37749 - DNA, 121 bp, Artificial Sequence
  Synthesized
  misc_feature (61): n=a or t
atgacatttggtggacatcacccgccagctcgttacgttccctgcttcctgcagcagagangtatcgagcaggtcagtgacagccgcgtgggggaccctgtaattgtcgagtgcttggcaa

SEQ ID NO: 37750 - DNA, 121 bp, Artificial Sequence
  Synthesized
  misc_feature (61): n=t or c
gcataatgccacttcttaaagaatacaggttagtaatgttacaggcagcacattccaaaantgccttccagagagattagttcagctaccctgagccacctagtactggtacaagatatca

SEQ ID NO: 37751 - DNA, 121 bp, Artificial Sequence
  Synthesized
  misc_feature (61): n=a or c
gatcagaggagactcatcaggagggatttggatctctgcaactagagcactgcccatattncctcattattctgctggttagggcatatgatgatgtcaagtctacagtccacgcacttgg

SEQ ID NO: 37752 - DNA, 121 bp, Artificial Sequence
  Synthesized
  misc_feature (61): n=a or g
acagttcgtgttgtccatttaaccccatcctgacaaattcaccacatttatttttgaggcnattggaaaaagccgggatgaacttctgacatcataaacattgctgataaaatactatgca

SEQ ID NO: 37753 - DNA, 121 bp, Artificial Sequence
  Synthesized
  misc_feature (61): n=a or g
gttcagtgcgtcaccaccctctgagtttggttttaggggcctttgttttggaggggaagcnagctcctctctacagcatatatcaaatctttggggttttatttttatttctgattcagca

SEQ ID NO: 37754 - DNA, 121 bp, Artificial Sequence
  Synthesized
  misc_feature (61): n=t or c
ctaagctattaaccttcaagagattaggaaggcacagtgctgttatttctagtgctgaaancttccccaagtgttttacaaacccattctgtgatttaggaactgaaaaactttcatattt

SEQ ID NO: 37755 - DNA, 121 bp, Artificial Sequence
  Synthesized
  misc_feature (61): n=t or c
tacgctcatgtatgggcttcagtttgtgacttttttcaaagctgtcggcagccaggcccgntgttagctcagatatgcaactaaacgttaagagagggggggaaataagctactaaatagg

SEQ ID NO: 37756 - DNA, 121 bp, Artificial Sequence
  Synthesized
  misc_feature (61): n=c or g
tatcatatcatacagaatctatgctgtctaacactagaatctaccttagatcaaatgtcanatggagccagaccacacccagtgatggtctgctatcagacacttcagcattcatggtact

SEQ ID NO: 37757 - DNA, 121 bp, Artificial Sequence
  Synthesized
  misc_feature (61): n=a or c
tttggggtgctgaattcttctgaaaagtgcttacaaggattatttctcgctgagggagatnagtgattcagacttgtttaactgaatgaaatatttctatcataattagtgctaattggca

SEQ ID NO: 37758 - DNA, 121 bp, Artificial Sequence
  Synthesized
  misc_feature (61): n=a or g
caattgttctcactaatttcctgaggtgtatacatgatgtaattattaccttgaacctgtngtccaaaataaatgaaattggtgacccagtggttcaagttagcgtgacatttgattccat

SEQ ID NO: 37759 - DNA, 121 bp, Artificial Sequence
  Synthesized
  misc_feature (61): n=t or c
tttattacagataggactaccgactctccttttgatagatctgcactacacaaggcacttncacaatttcctgccaaaattaaagatatttttctccaaaaatcaaatcaggaataacttg

SEQ ID NO: 37760 - DNA, 121 bp, Artificial Sequence
  Synthesized
  misc_feature (61): n=t or c
tggacagatccagtatctgagcactgaaatgcctcatctcttgctaacagaagccagttcnagagtccacctattcaggtgctgccagtggcacactcagaggctgcttggctggctagga

SEQ ID NO: 37761 - DNA, 121 bp, Artificial Sequence
  Synthesized
  misc_feature (61): n=t or c
aaattggctttgaagcactcctttaattttcaatacaaagcatcatcatcgctggctggangactgtgacacgcggggagataaaagcaataagcctttctccacacaacctccctcattg

SEQ ID NO: 37762 - DNA, 121 bp, Artificial Sequence
  Synthesized
  misc_feature (61): n=c or g
gagtatagtttgttatttaagagcattttttaaacaaagttgggagggaaatgaaggaaantagaaaggaaactaatgtatttgcaatacccagcacttttcagtgtgtttttaatgttat

SEQ ID NO: 37763 - DNA, 121 bp, Artificial Sequence
  Synthesized
  misc_feature (61): n=c or g
ggcctaggcctaagctgctaaagtttcacttgagagagtctgtattgcagccaacaccttntaacaggaaaaagcagcccatccaataatctggttagcttctgcatccctatttgtgtca

SEQ ID NO: 37764 - DNA, 121 bp, Artificial Sequence
  Synthesized
  misc_feature (61): n=a or t
tctatcccttctgccctctgtggcaagccaaactgcacttcccaggaaagagcctcttccnccctagcctcagttacttcagtggatctcttctgcattcctgcacctccttcttttcccc

SEQ ID NO: 37765 - DNA, 121 bp, Artificial Sequence
  Synthesized
  misc_feature (61): n=a or g
agtaataacagataatatggctgttggatacaccaacgcattcctaaaagagccagccgtntttacgatgctgacgtctacatcttcacataagctgtggatatgagggaaacactaaata

SEQ ID NO: 37766 - DNA, 121 bp, Artificial Sequence
  Synthesized
  misc_feature (61): n=a or g
cctccagctctaggcttccaagctttagaaaccaaagagcagtgtgtactgtcaagagacnttacagcttccttatctatcacataggttagataggccaaattattcatttattcctttc

SEQ ID NO: 37767 - DNA, 121 bp, Artificial Sequence
  Synthesized
  misc_feature (61): n=t or c
tattcttctgtggaatagtcagcttaccaaaggaatttctaattatgttcataatgttcanaggtcacataatgttaagacatccgcattattgttcctttatagtttcaaccacctaaca

SEQ ID NO: 37768 - DNA, 121 bp, Artificial Sequence
  Synthesized
  misc_feature (61): n=t or c
aacatcccagcctttcccagtcacatcttttcttagggatctgtgagattttcacccacangtgtcaccttttgccccactggctgtgtcattcccctgagaactgtacttttccaccgga

SEQ ID NO: 37769 - DNA, 121 bp, Artificial Sequence
  Synthesized
  misc_feature (61): n=t or g
atcattgctcccagtgctcatagcaaaggtattgattttgactcttgagccttttttcctntatcttggtggataaaccttgttagttcttcctgtgcatgttgcttgtttacattcctgc

SEQ ID NO: 37770 - DNA, 121 bp, Artificial Sequence
  Synthesized
  misc_feature (61): n=t or c
gtgtatatatatatttcaattgtgtttctcctggattttcagtggctcgatccttgggagnggtgctggagtgtttaaaaagatcatatgtagcattatatttttagtttggtggtggatg

SEQ ID NO: 37771 - DNA, 121 bp, Artificial Sequence
  Synthesized
  misc_feature (61): n=a or g
ggcagaaggcgccacatgcaaaccaggggggaaagataatgaatagaggatagcacaaccngagcgaaacaccaggatttctaacgtaatggctacggcacttctacttcagaaaaacact

SEQ ID NO: 37772 - DNA, 121 bp, Artificial Sequence
  Synthesized
  misc_feature (61): n=a or g
agagtacactatcgggcccctctccctcagtaaatgtcacatccctgtttttcattctatntgcaggaagccccatactctagctttaccgaacagagagtatcacatattatatatgaaa

SEQ ID NO: 37773 - DNA, 121 bp, Artificial Sequence
  Synthesized
  misc_feature (61): n=a or g
caaattatgtcaaactctgactaattcaaggaaacattttaagatgaattgatgcaagagncatgctccagcctgagcattgcatgtcatttgttttgtgacattcaaggctgaagataaa

SEQ ID NO: 37774 - DNA, 121 bp, Artificial Sequence
  Synthesized
  misc_feature (61): n=t or c
tgaactcatgttttattactccacttaaggaaagatcccttctgaaactcccctcataccnggagacacaacactgtaattactttgcttccagctgtttttaccattgttacttctattt

SEQ ID NO: 37775 - DNA, 121 bp, Artificial Sequence
  Synthesized
  misc_feature (61): n=a or g
gagttgccttttgctagaccatgtacaagcacgtagtaaagaatgggcagttacagtaatngggctttaagtgcagtgttctcattaaatttaacagtaatcaagcttaatttcacacaca

SEQ ID NO: 37776 - DNA, 121 bp, Artificial Sequence
  Synthesized
  misc_feature (61): n=t or c
attaaaattgtatttctttctataatttaaacaaaaatatacaaatctttaaagtgtgcangccatttaaaatgtgtccatttacagagtgaagttacgtcagcaagctcatgtatctgtg

SEQ ID NO: 37777 - DNA, 121 bp, Artificial Sequence
  Synthesized
  misc_feature (61): n=a or g
cctgagcttcctctcctccaggctgaacagtcccagctctcttagccttctctcatagganggatgcttcggtcccttgataatttctgtagccctattctagaccggtcacagtccagca

SEQ ID NO: 37778 - DNA, 121 bp, Artificial Sequence
  Synthesized
  misc_feature (61): n=t or c
cgcaggagaacgcagcagccagctggacttcctacacctcacgagagctccagtaaagaangcgtcatgggaaaagcaccgcagcctacggggagctgcgatgagcactgatgggcaggag

SEQ ID NO: 37779 - DNA, 121 bp, Artificial Sequence
  Synthesized
  misc_feature (61): n=a or g
ccactgcagggactctgcagctcccagatatgggtccactgactctcaagggacaaagacngtgctcagataggttcactccagattacctgttaggcttcacagggagcatcaaaacctt

SEQ ID NO: 37780 - DNA, 121 bp, Artificial Sequence
  Synthesized
  misc_feature (61): n=a or g
taaacaataatgctttcatcaacacaaataaatgttggctaatgtttagctatgcctttgnaaatatgcctgtaatgtttggtgtagaagaatgtcattttacacttggacacatgagatg

SEQ ID NO: 37781 - DNA, 121 bp, Artificial Sequence
  Synthesized
  misc_feature (61): n=t or c
ctgagatgggcaagtctcaggatgcactaatctgcttctaagggacaagaaatgaaactanggaaatttgtaatattttccaaaggcaagtacagattctgctgtccttaatcacacctca

SEQ ID NO: 37782 - DNA, 121 bp, Artificial Sequence
  Synthesized
  misc_feature (61): n=c or g
tgaagatgaaacagagaaaggtcttgattacacctataaataggtaaacattttatgtttntacagtgggaaaataaaacacagattttaactaactctcttcactaacacaataaattag

SEQ ID NO: 37783 - DNA, 121 bp, Artificial Sequence
  Synthesized
  misc_feature (61): n=t or c
gactagatgacctccagaggccccttcaactcctgcacctctgtcactgtgattccatgangtttgcttactgccgaagcaacacagtggttgaagagagctaggttttcaaaaacaagat

SEQ ID NO: 37784 - DNA, 121 bp, Artificial Sequence
  Synthesized
  misc_feature (61): n=t or c
aggtctctgaaacctgttaaatagcaatgcaaacacatttcactccctgttcattaactgntaatttcttgttattccttatttgtggccagcaaagatacatggcattattcctttgtca

SEQ ID NO: 37785 - DNA, 121 bp, Artificial Sequence
  Synthesized
  misc_feature (61): n=a or g
ttggattaatttttttgaatgaatctgaagattgccccaaacaactctacagctgccatcnccagggcagcgtgagccaaaaaacggactcaggtgccactttccaggggctggtcactgg

SEQ ID NO: 37786 - DNA, 121 bp, Artificial Sequence
  Synthesized
  misc_feature (61): n=t or c
aaacccaaatcagagtcacctcaccccaggcaacattgccctttctcaaaaccttgaggangggctcagcagcaataacaaaatataaatatatatgtatactccttaggaagaaaaaaaa

SEQ ID NO: 37787 - DNA, 121 bp, Artificial Sequence
  Synthesized
  misc_feature (61): n=a or g
tctactatgaagccttggagtgaggcaaaaaggacttgaacctctttctcttgtagcactnggtctagttgaaaggaattgctctgacctcaaaataagtaaaagaaaataatttcttgtt

SEQ ID NO: 37788 - DNA, 121 bp, Artificial Sequence
  Synthesized
  misc_feature (61): n=t or g
caattaaaataacagcactgataagataaattgcagaagacaaaatgaatgctacaaggtntatttttacctgttatcatttgctattttcaaaaggcataggtacaagcaaatgaaattc

SEQ ID NO: 37789 - DNA, 121 bp, Artificial Sequence
  Synthesized
  misc_feature (61): n=a or g
tgggcttgggttgctgtgagcaaagtcagcgctaaactcagctaaccgctctgggtgaaanctgttgtaggttagggccctatccacagcttagtgatgtccaatggagacaagaaagcaa

SEQ ID NO: 37790 - DNA, 121 bp, Artificial Sequence
  Synthesized
  misc_feature (61): n=t or c
ggtggggaggagcagagcccccagatggccgcgtttcccagcctggatgctttgccctggnactttgtgggcttcggcccacgactgctttgctggagataccgttccccatgggctggcg

SEQ ID NO: 37791 - DNA, 121 bp, Artificial Sequence
  Synthesized
  misc_feature (61): n=t or c
agctcataaaaggcacaatcctttaggaattaaacttttatgaaacgcattttactgttcngagtaaagaactgttgccagtgtaactctcaaaccacacccaagcctacccatgtcaggt

SEQ ID NO: 37792 - DNA, 121 bp, Artificial Sequence
  Synthesized
  misc_feature (61): n=t or c
attcataatctatgaacctgcaatacatccttataagttgcaccatgatccaaggagatcnatctattttagaagaaaatggttcttataaaaggcattgccatctccaaagacacacaca

SEQ ID NO: 37793 - DNA, 121 bp, Artificial Sequence
  Synthesized
  misc_feature (61): n=a or g
tcgtgaaacctgagctccatggagccatatgcatctggtgttcttctgagtcccatccgcntgcatctgaccatggactttgtcaggcaattagtcagcatcctgtgcttttttctcagtg

SEQ ID NO: 37794 - DNA, 121 bp, Artificial Sequence
  Synthesized
  misc_feature (61): n=a or g
acactgagccatggcggtgtcagcctgtgcctgtctgcagtgccagactaacagggcagcnagtcacctgcatgctgatcacaccttggctgaggagttaagccctctcaccaggtacaac

SEQ ID NO: 37795 - DNA, 121 bp, Artificial Sequence
  Synthesized
  misc_feature (61): n=t or c
ttcaatgtagatatactttgcagtaccttgatattttctgcaagtataatatacaatatanataatgtacacgtacatctgatcagagaaataagtatattctcgtggttaaactatgtat

SEQ ID NO: 37796 - DNA, 121 bp, Artificial Sequence
  Synthesized
  misc_feature (61): n=a or g
tcctgggcccagaactggctctggctttagtccactttggtcgcttctatagacagatagntggctaccatcaaacagatgctgcagtagatgcatgaccacagagcattgggttccagtg

SEQ ID NO: 37797 - DNA, 121 bp, Artificial Sequence
  Synthesized
  misc_feature (61): n=t or c
atcgcaggacttcggccgcaggcctgccgcaagtgagtcacagctgagcacatcagtgtgngttttcgatgattggatgttctattttctttctaacattgccccaaatacagtccttttc

SEQ ID NO: 37798 - DNA, 121 bp, Artificial Sequence
  Synthesized
  misc_feature (61): n=a or g
ttgctggggaaggaagcctaccgtcattggatcgtgaagagccacagattgcacctctacngatcctaaaagcagcacccgaggatttacgaatgccttttgctgtcttcccctttttctg

SEQ ID NO: 37799 - DNA, 121 bp, Artificial Sequence
  Synthesized
  misc_feature (61): n=a or c
cttccctccaacatctggccatcttggcttgcccagatataaggacccatttcacagaagnaccataaatcttaattaagatctgtaaaccacagatgaaaaggatggtatgagtacacaa

SEQ ID NO: 37800 - DNA, 121 bp, Artificial Sequence
  Synthesized
  misc_feature (61): n=t or c
ttaatatggaaaattgaacaacctgatcctctgttgtcacctatagccagtctctcggacngggcaatgatagcaaaaccaaccacatattgcagtgtactgggagaagacccaaagggtg

SEQ ID NO: 37801 - DNA, 121 bp, Artificial Sequence
  Synthesized
  misc_feature (61): n=a or g
cacctgccttgaataaccttattcctgacctatgctggagcaattactgggcacggtctanttttcacttgtcatcttgcaccttgtttcccatcaggagaaaatatgattatatctgttc

SEQ ID NO: 37802 - DNA, 121 bp, Artificial Sequence
  Synthesized
  misc_feature (61): n=t or c
aaaaaaaattggcagaagtaaatactaaaacaggacaaaggcagtggcaagtccttccatnttcaagaaatgtaggtcatcgccaccttgctgctaacataccttgccaggtatacacaga

SEQ ID NO: 37803 - DNA, 121 bp, Artificial Sequence
  Synthesized
  misc_feature (61): n=t or g
gaactctctgctttattggaacagaatcagtcattcccatctgtatgactttggatacatncccatgaatcacaggacatagtaaaaatctgagaatactttgatactgcaaagtgaggga

SEQ ID NO: 37804 - DNA, 121 bp, Artificial Sequence
  Synthesized
  misc_feature (61): n=a or t
atcccgatgctcacagtgactgcaatgcgctcctctggctttctaaagaagttttcttttncccataaaatgtgttttctgaggatggaatggggacaaggtgcagcacggtgtcgattcc

SEQ ID NO: 37805 - DNA, 121 bp, Artificial Sequence
  Synthesized
  misc_feature (61): n=a or t
ttggtggcactgagagcttcatgcaaacctccgtaaaagggaagggggagcagtcctgcanacgcagccgaaataacatgcaaatcaagcattaatttttcatctcccatcaaaccagtaa

SEQ ID NO: 37806 - DNA, 121 bp, Artificial Sequence
  Synthesized
  misc_feature (61): n=t or c
ggggcccttttaagtaccaggagtgcaagtgggaccctgcttaacactttaagcatcctcngcactttagccctcctctggatacaggcatccctaaaaccagagggtatcagaatcccag

SEQ ID NO: 37807 - DNA, 121 bp, Artificial Sequence
  Synthesized
  misc_feature (61): n=t or c
caagtggcttcactagagtgatactaaacttccttgtatggcctggctacacaaagactgntgcgccagaactgagaaatattaacactcctacaaaagcaaaagtcttcaacagcagata

SEQ ID NO: 37808 - DNA, 121 bp, Artificial Sequence
  Synthesized
  misc_feature (61): n=t or c
tttctgtgttaagaaacaagatgaaaactgtgatgcctttgttagtggggaactcagcaanagcaaggcctaatgccttgagttcatacacgtgttgttctgcatggcagagctcctgtaa

SEQ ID NO: 37809 - DNA, 121 bp, Artificial Sequence
  Synthesized
  misc_feature (61): n=t or g
taaatgtacacttcaaagaaattaaaagttttaggcacatgagtgcacatttaaaataatnaaccatagttttgtcctttagtgatgctgtgtagttcctgcataattgtgattgaggcat

SEQ ID NO: 37810 - DNA, 121 bp, Artificial Sequence
  Synthesized
  misc_feature (61): n=a or g
atttccaagctgtttaaggttgcagaagtttatcacagaccaccttctaaagtttaatctntcacaaactaccaatcaacagcaggtatcattctgagaaacaagagctgccccaccagca

SEQ ID NO: 37811 - DNA, 121 bp, Artificial Sequence
  Synthesized
  misc_feature (61): n=t or c
ttgggcgttcctacagctgaaataactttagacctttactttcctccattttataattggnctaacagatctttacagtgctgaaatacagcagtattatagaaaagatccttcatgtatg

SEQ ID NO: 37812 - DNA, 121 bp, Artificial Sequence
  Synthesized
  misc_feature (61): n=a or g
gacataatctgtaatgcagtgtgatattttatttaattttggatcttgaatcttaattatnttgcacacaacagcaacttaaacatatatattgggccaacatatataacaaggtccagca

SEQ ID NO: 37813 - DNA, 121 bp, Artificial Sequence
  Synthesized
  misc_feature (61): n=t or c
cagaatgaatttgcaatctcactctctgtgtcactcagacattctcgatgtacaacacaangctaccgtaaagcagagaagttttccagaaagggcgcttcaaattgttgctgtgctatgg

SEQ ID NO: 37814 - DNA, 121 bp, Artificial Sequence
  Synthesized
  misc_feature (61): n=a or t
gcagtacgatgcctcacagtgtttttttaggaagttgttataccagaaccttctgtgaccnactgtttgatttccttggatcgtagaatcataggatcataggatggcctgggttgaaaag

SEQ ID NO: 37815 - DNA, 121 bp, Artificial Sequence
  Synthesized
  misc_feature (61): n=a or c
ctgctgggcaaaactgtgtgcacttaggcggaacagaactccagacagttctactggaaanaagaggcagtctgtatgatctcttgtggtatctaatctatgtatgtattatatatataaa

SEQ ID NO: 37816 - DNA, 121 bp, Artificial Sequence
  Synthesized
  misc_feature (61): n=a or g
gcacagagcagtctgtgtgcggctgtatggcccaaatggtgcagctgcacccagatttccnttctgatccaaacaagcaatgttgctgggggtgggtgcaggtacagattggaagcatgag

SEQ ID NO: 37817 - DNA, 121 bp, Artificial Sequence
  Synthesized
  misc_feature (61): n=a or g
ttatggatgaaattcagtctgcttgttttgcacctagaattttcagtgtgcatattttccncccacaggtgacaagagctatggtattgacttgatgagaacttccaaatttcctcaggtg

SEQ ID NO: 37818 - DNA, 121 bp, Artificial Sequence
  Synthesized
  misc_feature (61): n=t or c
aaatgcactgtaggaggaaatgctctaaaaaacatgagtttagtttatgagaatgggatcntcgcattttattcctttttttattatcgtttatgattttgctgtgagttgtgcatccctc

SEQ ID NO: 37819 - DNA, 121 bp, Artificial Sequence
  Synthesized
  misc_feature (61): n=t or c
acactgaggggaaccactcctgttttcagctggtggcttttcaggaaggaagtttcataantacctgtggattttctgcttttaggtgagggctaggcagacaaattgataacggaggcaa

SEQ ID NO: 37820 - DNA, 121 bp, Artificial Sequence
  Synthesized
  misc_feature (61): n=t or c
tcaaggcatatgcttcttcttcacctaaaaactacactggtttatctcagttgtagtttgnagcagtcttaagtagcaacattatgtgaatcatggcaatgtttaatttgtgatgaagtac

SEQ ID NO: 37821 - DNA, 121 bp, Artificial Sequence
  Synthesized
  misc_feature (61): n=t or c
gattacttttgataccacaaaaagaagctgggtaccttctgttactttgacagcagtaaanagaaacttgaagatttgtttctttatgtttcaggtctcaatttttagagtatcacttcct

SEQ ID NO: 37822 - DNA, 121 bp, Artificial Sequence
  Synthesized
  misc_feature (61): n=t or c
tgctagataaagtgacgcaatttctttaggagtttgatatcacccaaacaaagcatagtanaaacctgtatacagttatagcatctatatgagaaaaggaataattttcaaagccattctg

SEQ ID NO: 37823 - DNA, 121 bp, Artificial Sequence
  Synthesized
  misc_feature (61): n=c or g
tgtggaagtttggctactggtagccctggccagtcactcgtgttacctaaagattcttctntgtagtcttttgaggtgcagtgagatggtgaatgaatttgtacatccctgctctgaatta

SEQ ID NO: 37824 - DNA, 121 bp, Artificial Sequence
  Synthesized
  misc_feature (61): n=t or c
caatcccattgtgtggggtgtgaagcatgcactgccttcattccctcctggggagccctgngtaggtacatcagaagagtgcaaaaccagggatttccaagcaaaggcttacattggcctg

SEQ ID NO: 37825 - DNA, 121 bp, Artificial Sequence
  Synthesized
  misc_feature (61): n=a or g
acaggatagcttgcagggatgggtactgtagctatgggcacaaagctccaagaagagcccngataatccttgccagacacatcacaaaatgacactgtgtttctttcgcaatctagctcca

SEQ ID NO: 37826 - DNA, 121 bp, Artificial Sequence
  Synthesized
  misc_feature (61): n=t or c
gctttgagtctcagcctttctttcaaatggtttgaaatctgatcatagattttaaaatcancaggtaggaattgccagcacaggcaccatacgccctgatcacacaagctttgcttccagg

SEQ ID NO: 37827 - DNA, 121 bp, Artificial Sequence
  Synthesized
  misc_feature (61): n=c or g
ctgtgaagcttcatagtattgtttgatgacatttcaggaagtcttagtccccagtccttgnttttcagaagaagaaccaacaaaacccagaaatgcaacaaactcttcctttcttatccag

SEQ ID NO: 37828 - DNA, 121 bp, Artificial Sequence
  Synthesized
  misc_feature (61): n=t or c
tgctgtaggttttcttttcacttcatgacactcttctgcttttcatgttgtttgtgatgcnggatgatagaattacctgaaatattttgagattgactgaaaaatgtcttccttggtttgc

SEQ ID NO: 37829 - DNA, 121 bp, Artificial Sequence
  Synthesized
  misc_feature (61): n=a or t
ctgttctgaaagttccatcctttggaagagatttgctccttactgcccaaaggcagcattnaagccaaactgtgttattcctcctcaagtgaatcctggctaaataaatagataacatggt

SEQ ID NO: 37830 - DNA, 121 bp, Artificial Sequence
  Synthesized
  misc_feature (61): n=a or g
tttgtgtgctcatacaggggaagagcctcagctaccaaagtatatttgcaggactgggagngggcctgcaaattatttagaaacactgtgatgattttgtcgtatgaaaattaaatcttcc

SEQ ID NO: 37831 - DNA, 121 bp, Artificial Sequence
  Synthesized
  misc_feature (61): n=c or g
tgagtttttggggtactgtatgcacgttctgtggtcagcactacaagttcactgcactccnaagtcatgcagttcctgacttctcttttttacgtagattttatattactgtactatatgt

SEQ ID NO: 37832 - DNA, 121 bp, Artificial Sequence
  Synthesized
  misc_feature (61): n=t or c
actccctgtctcctttccccctttacttgaagctaattcactgctaggcttgttctctgtntgcaggcagaagggaaatggctcagaagaggattcaatgggacaactgtatctgcacagt

SEQ ID NO: 37833 - DNA, 121 bp, Artificial Sequence
  Synthesized
  misc_feature (61): n=a or g
caccccccagtatttcatcagcccccattaagcgtgttactgaatctcaattagctcccantcagagagggctatgtttggacacatgtggctggagccatcatctcattgcacaccagaa

SEQ ID NO: 37834 - DNA, 121 bp, Artificial Sequence
  Synthesized
  misc_feature (61): n=a or g
catcagaagtccctttaggaactctttggaccttgcatgctgtggaatattcaagcagcanaactaccgactgaaatggaaaccaaaaggaaaactctgtacttctctgacctttccaatg

SEQ ID NO: 37835 - DNA, 121 bp, Artificial Sequence
  Synthesized
  misc_feature (61): n=a or g
taatcaggatgctgattctcacccctctccccaggcattttatattgagtactgtcattanctcaaattaagtggattatattgattaaaaattaatacgaagaatgtgtatgtgacaatc

SEQ ID NO: 37836 - DNA, 121 bp, Artificial Sequence
  Synthesized
  misc_feature (61): n=t or g
ggggaaaggaggcaaggggatgtcatttctagctctctcctcctgcaggatacctgggcgnccctgtcttccaacaccacagtcagacatggatctggcaggtgtggaaatataatttcat

SEQ ID NO: 37837 - DNA, 121 bp, Artificial Sequence
  Synthesized
  misc_feature (61): n=t or c
agcatttctcagtgtacagtatgctttgattctgttttggacatttgctaaaaagaaatgntgaaaaagctgttgttgaatctaactctacgattttcccagctctgggatagaaagagaa

SEQ ID NO: 37838 - DNA, 121 bp, Artificial Sequence
  Synthesized
  misc_feature (61): n=t or c
tagtaacaaagatccatgcttctttcacttactctgtgtttctgcgtaccttcaagtgtgnacattcagttcttcagatctctgactcttttgcgcgtagcaaaaagactgacaggtcaaa

SEQ ID NO: 37839 - DNA, 121 bp, Artificial Sequence
  Synthesized
  misc_feature (61): n=a or g
atctagctgttaaaagactcttaagaccaggaaataggtctcttcttagtgatgtgtgctntcaagtactacagcatcttatccaggagcacagtagatctgtcaccatctgagctatact

SEQ ID NO: 37840 - DNA, 121 bp, Artificial Sequence
  Synthesized
  misc_feature (61): n=t or c
ctcacactgacatagattcccacatgcatttgacatgaagcattgtagcagttacagtganacctacctcaaagtcaagcacagacagagtttgtttaatctttgatgtatactgatatgg

SEQ ID NO: 37841 - DNA, 121 bp, Artificial Sequence
  Synthesized
  misc_feature (61): n=t or c
aaaaagttttaagaaatagttattctgagataagtggcattcaaggtgtcttgtttctaanaggggaagaataaagcagtagtatttaaatgaatgaaaagtgctattcagatgatctaag

SEQ ID NO: 37842 - DNA, 121 bp, Artificial Sequence
  Synthesized
  misc_feature (61): n=t or c
attattaatttctttctaacccgaaactctccccaaaagtctttaaaacaaattctccccngatcgtttccccgctaccagcatcaatgcgcatcactttccgcgcctcacccgctccaaa

SEQ ID NO: 37843 - DNA, 121 bp, Artificial Sequence
  Synthesized
  misc_feature (61): n=t or c
cttgataaatgattgcgtatttttacactggctgcagctgcaaattcagtatcatgaggangtgtttctatacattaaacactagtctgacatagatctcacgcctaaagttcagcatcac

SEQ ID NO: 37844 - DNA, 121 bp, Artificial Sequence
  Synthesized
  misc_feature (61): n=a or g
gaccagcaacgcacaccatcaacacggggcatggcaaacagcaaagaccacactgataccnaaacaatgacactcataaaatttctagaaagaagacaacaagcaggcagaagcttgtttc

SEQ ID NO: 37845 - DNA, 121 bp, Artificial Sequence
  Synthesized
  misc_feature (61): n=t or c
cgcggtgcagaagcaggcacttgcttgcagcagtgaatgaatgcgatttcctctagccggnctgtttccttccataagatcagcagaacactatttgctgcaccgtgtttttgaaatcttc

SEQ ID NO: 37846 - DNA, 121 bp, Artificial Sequence
  Synthesized
  misc_feature (61): n=t or c
atgcttctcttggatttagtaactcttagcaaatatcaatatggaaatagttccctcctcngacaggtaatttagcaagtaacaaacttttaaaataagaactgagggaaaaaaatgatct

SEQ ID NO: 37847 - DNA, 121 bp, Artificial Sequence
  Synthesized
  misc_feature (61): n=a or g
gtaaatatataaaacaataaagcatggaggaaatagtctatctatctgcggatgtcaagtngggaggaagcagggatcacctcaccactgaaaatggtggctttgatgattgttcattaac

SEQ ID NO: 37848 - DNA, 121 bp, Artificial Sequence
  Synthesized
  misc_feature (61): n=a or g
aaacaaccacttccctcagctcctaaatgactaaattagagaatacttggcagctttttcnttcacatgcaattaaaaggttttttcctacctgaattgtaggggttttttttctccccaa

SEQ ID NO: 37849 - DNA, 121 bp, Artificial Sequence
  Synthesized
  misc_feature (61): n=a or g
ccatgaggcagagtgataggttctgatgaggactagggcatgggcagtgcccagggagaanctctgcagcctgcggtatgatgtgcatagacctacagagcttctgggatgcaccaccttg

SEQ ID NO: 37850 - DNA, 121 bp, Artificial Sequence
  Synthesized
  misc_feature (61): n=t or c
aagaaggtcacaaggctttcagttaaaacaggtctgaaaatacaaactagtttattatccngtatttacagaaacagcaatcactttttatacctttggtcctcgtggacctgggtttcca

SEQ ID NO: 37851 - DNA, 121 bp, Artificial Sequence
  Synthesized
  misc_feature (61): n=a or g
ccacaaagacctgccctttctttcagaagcaaacaaaaatagacaacaagttacacaattncctaaattgtttgagccacactctacttcttcaagaacataacgggaaggaaaaaaattc

SEQ ID NO: 37852 - DNA, 121 bp, Artificial Sequence
  Synthesized
  misc_feature (61): n=t or c
aatacccatactataaattatggaaatatctctttctgatgcaaccttttattgagggggnggggcggcgaaagaaatagtttgcaaggctttgaaatttggcctgtcattaagatggtgc

SEQ ID NO: 37853 - DNA, 121 bp, Artificial Sequence
  Synthesized
  misc_feature (61): n=t or c
ttggactatgcatctcaaaaattccctttaactttcccttggttttttccatagggataanaattgaaatggatatccattcagtgagaaaaaacaagtaataccaaagattcacatttat

SEQ ID NO: 37854 - DNA, 121 bp, Artificial Sequence
  Synthesized
  misc_feature (61): n=a or g
atgttatcgtacagttttaaagcaggcatattctcctctggttatactgcagtatacagcngtacaaattctcacagctctaagccttcagcacagaagaaaattaacaagtatacagtga

SEQ ID NO: 37855 - DNA, 121 bp, Artificial Sequence
  Synthesized
  misc_feature (61): n=t or g
ttgtggagtggctgctaagggctctgatgcaaagaagaaatgcgaggtgatagtgcaaggntgaatattgttagcacaaatctgttcagacagaaacatggtcaatggtttgcttttcaca

SEQ ID NO: 37856 - DNA, 121 bp, Artificial Sequence
  Synthesized
  misc_feature (61): n=a or g
tgaatttcaactttactacattctcagcagaaagcaatggagggtactaaacctagatttngggccattctatgtttagaaatctttcatagatcagggctttgggataaggaattttcat

SEQ ID NO: 37857 - DNA, 121 bp, Artificial Sequence
  Synthesized
  misc_feature (61): n=t or c
cagatacataggttaatgttatcacatcctgctgaaggatgtacagagatgtccaattatntgcacattaactcacaatggaacacgaggtccctctgtgctgtacaccagcccgggtagc

SEQ ID NO: 37858 - DNA, 121 bp, Artificial Sequence
  Synthesized
  misc_feature (61): n=a or c
atatttaaacaataatggcccctatttggtgcagtcacttctgctttagatgagtacagtntaatatgtaacagactcagagtttacagaatggctttggtttatggcatattttctcccc

SEQ ID NO: 37859 - DNA, 121 bp, Artificial Sequence
  Synthesized
  misc_feature (61): n=t or g
actaaccaagacttgataaagtacttagttactgggaagtgcttacttcctaattcagtgnaggtgccatttgtttgacacttgatcctcttaaacgctgaggagagaatgaaattgaaat

SEQ ID NO: 37860 - DNA, 121 bp, Artificial Sequence
  Synthesized
  misc_feature (61): n=a or g
acctgctccctgtggcagcatccctggctatgcagtggctgtgtgtttctccattttgaancaggaaattgctgcttgaaaaaggttagtggtcttgtacagaaatatttcaactgggtaa

SEQ ID NO: 37861 - DNA, 121 bp, Artificial Sequence
  Synthesized
  misc_feature (61): n=c or g
gaatcacagaaaaattaagcctgggagacatctttggagtcaattggcccaagctctgatntaataagggccaactccaaggtggtcactcagggcctcccacaaatgggtttggaacatc

SEQ ID NO: 37862 - DNA, 121 bp, Artificial Sequence
  Synthesized
  misc_feature (61): n=a or g
aatgctaaatgctgcgagaataataaatacagtgtaccttaatgtggattgaggtgcatcnccactgtcagataaaggttgaattcacaaatttcaagctttccaagcttgtacgttgaca

SEQ ID NO: 37863 - DNA, 121 bp, Artificial Sequence
  Synthesized
  misc_feature (61): n=a or g
gtatggattggcatgttctgctattaaatcttaatcaactgaatactggttttgttatacnaaatgggctaaaaattactattcatacgagacatagtagttatttttacgaaattggaaa

SEQ ID NO: 37864 - DNA, 121 bp, Artificial Sequence
  Synthesized
  misc_feature (61): n=c or g
agaaatactctgggctttgtggaaatacacagatgggtaacagtttattacttgcagcatnagaagaccggggactggaaatagtatccttaaatattctacatgtacactaaaaagatag

SEQ ID NO: 37865 - DNA, 121 bp, Artificial Sequence
  Synthesized
  misc_feature (61): n=a or g
gaagatgggcctttctgccaccatcttacaacacatctgtgagtacctgcaggggagaagnaagaatacaggcatgcccattcaatcaagggaaaggtgtagctgtaaatgcaaggcctat

SEQ ID NO: 37866 - DNA, 121 bp, Artificial Sequence
  Synthesized
  misc_feature (61): n=a or t
gaaaggagccgagcgaccaaacagctgaaagcaggaacagaacgcctgcaaagaagtcctnatggtttcttttaaaccttcgtggaggttcctgactcatccttctccacagcctgggctg

SEQ ID NO: 37867 - DNA, 121 bp, Artificial Sequence
  Synthesized
  misc_feature (61): n=a or g
tttaataacataatcttagctaggcctctagatggtagtctaatatcactgataataaaangaaagtactgtagtggagcatgaacgttttcccttttatcgctggacagtagccagctca

SEQ ID NO: 37868 - DNA, 121 bp, Artificial Sequence
  Synthesized
  misc_feature (61): n=t or c
ttctgttgggtaatttatccctggagtctgcgtgctgtgttattctcaaggctgtgcattngtatgggaaaatcacgtatgcattttgccacggagcagctttgcatggctgggccagcat

SEQ ID NO: 37869 - DNA, 121 bp, Artificial Sequence
  Synthesized
  misc_feature (61): n=a or g
gtaggtacccggggatcattcttttagttgttgctgcattacagtgtacaaagaaatggantctacagccaacttcacacacctggtattaattctggcacgacaataaagttttgacact

SEQ ID NO: 37870 - DNA, 121 bp, Artificial Sequence
  Synthesized
  misc_feature (61): n=t or g
gggactgtggaggggctgctcaggctggcaggttcacatgcgtagtcctcaacatctggancccctggcacttggatctcaaggagttggcattcaggattcacagtgatgggaactggag

SEQ ID NO: 37871 - DNA, 121 bp, Artificial Sequence
  Synthesized
  misc_feature (61): n=t or c
gaaacatagtactcgagaaatatgctccaaagggtcatgcaggcttctgttaaggtccttntctccccaactacagcactgagacacaaacataatttacattaaataacttagagaaaag

SEQ ID NO: 37872 - DNA, 121 bp, Artificial Sequence
  Synthesized
  misc_feature (61): n=a or g
gtgcttctatgttatagaattaagtaatgtttttttaaaatgcttttcttactatctgagnaaatccttgttaagagcctgagtctcttcgcgatgggtatttggcttcattgtcacccat

SEQ ID NO: 37873 - DNA, 121 bp, Artificial Sequence
  Synthesized
  misc_feature (61): n=t or c
acagtacacaaatactactcaggatattgataattcaactgtgcaactgtagatagttatngataacttggtactaatttcccttttccagggagaaataaattcactggattaatgccag

SEQ ID NO: 37874 - DNA, 121 bp, Artificial Sequence
  Synthesized
  misc_feature (61): n=t or c
accatgactctgcactacttcacaaatcatctactgatatcactgtcacagcaagatgctntccaacaaaggtccctgcaaatggagatagatcaacattgcttcacttgtatctgtgctt

SEQ ID NO: 37875 - DNA, 121 bp, Artificial Sequence
  Synthesized
  misc_feature (61): n=t or c
atttgctcttaggaaaggcaagcaggggaaaaacatatgaccccccccccaacagaattanatatccagcttactgcatcactatcattctacccaccctttacgtatagggttgcacact

SEQ ID NO: 37876 - DNA, 121 bp, Artificial Sequence
  Synthesized
  misc_feature (61): n=t or c
tgtgaattcagctccaacttcagctttctgtataattatttcagaaaaatctgcctacatngtatggataatcatccatgcatcagttgtatgaagaagcaatccatttggatacagtaga

SEQ ID NO: 37877 - DNA, 121 bp, Artificial Sequence
  Synthesized
  misc_feature (61): n=t or c
ttctgtcttagatataaaaagtgtagaattactgaaatcatgagacgtctggaaaactctntccatatatatcaaggcatcagtattaatcttaggacattctataaagtttctcctttct

SEQ ID NO: 37878 - DNA, 121 bp, Artificial Sequence
  Synthesized
  misc_feature (61): n=t or c
tagttcttgtaaatgctgggtaaaagatgcatttgctaagtatctttctatttgcttaaanacaaagtaagcgttctattttaacttcttgtttataatctgcagctggtcctcgtcagag

SEQ ID NO: 37879 - DNA, 121 bp, Artificial Sequence
  Synthesized
  misc_feature (61): n=t or c
atatacatgtttaattttcactctattacctgggtgcagttagttttattctccaggtacnttgtccatagtaactccccagcctgatcactctatgcaaacctttttcagactactactt

SEQ ID NO: 37880 - DNA, 121 bp, Artificial Sequence
  Synthesized
  misc_feature (61): n=t or c
attggaactttccaagcagcaacgtggagaataagcagagccatggggcagcatagctctnagctgaagagggaattgcaggtaatgttacgttgttccatgttggaaagagcttggagtc

SEQ ID NO: 37881 - DNA, 121 bp, Artificial Sequence
  Synthesized
  misc_feature (61): n=t or c
gtcgccccacttttaccagtgaccgtgcaccaggatgggcagcgcttccctgctgcaaacncagccatgatgcctgtccccaagctgccagcaagccgcagcatttgtgcaacaagccact

SEQ ID NO: 37882 - DNA, 121 bp, Artificial Sequence
  Synthesized
  misc_feature (61): n=a or g
gaggaggtagcttgctgtgacccaggactgaaccaggaacctttagatcttcagtctaacnctctcccacctgagctatttcagctcatgacagaccaggccaatactcccagatcttttc

SEQ ID NO: 37883 - DNA, 121 bp, Artificial Sequence
  Synthesized
  misc_feature (61): n=t or c
aattatatgttatggcttaagtttggtccttgagtagtgaccgaaactgtgggattttaanatgttatatacaccaatgttccactctgaacaggcatgtgtggatgtaatttacagtaca

SEQ ID NO: 37884 - DNA, 121 bp, Artificial Sequence
  Synthesized
  misc_feature (61): n=t or c
taaagactggaaaagaccaaaactggttttctaaggaatcataaacaagaagctcctagtntgatttctggcaatgaatagttatgatttatatctcaatatactgcaaatatatctcaaa

SEQ ID NO: 37885 - DNA, 121 bp, Artificial Sequence
  Synthesized
  misc_feature (61): n=t or c
cccatcactcttttctctgaatcaccccatacttcaacatactgacttcagcatggtaagngaaggcctatcagtccatgtggccactttgtttcctcacttatacagatgcttagatttt

SEQ ID NO: 37886 - DNA, 121 bp, Artificial Sequence
  Synthesized
  misc_feature (61): n=t or c
aataccagaagagattttgggggggggggggagggaaaaaagaagaagacttaacctattnggaggattttgcatgccaaagtatggatcattagataatttcatgcatagcatatgtctt

SEQ ID NO: 37887 - DNA, 121 bp, Artificial Sequence
  Synthesized
  misc_feature (61): n=a or g
tgttataactgtatgaggaaccataacaatgtgttgacaattcatgaatttttagccaaangaagattgccagcatgcaaactgttttttctattcaatcttctagaatcctgtagttaat

SEQ ID NO: 37888 - DNA, 121 bp, Artificial Sequence
  Synthesized
  misc_feature (61): n=a or g
gtatgtaaacggtgctgtcaggttgaacagaatattatgtaattacctcggcaagaagatnctgttagtttctgttaagcagctataagaatgcttcagctctgttgtaatagaagaaaaa

SEQ ID NO: 37889 - DNA, 121 bp, Artificial Sequence
  Synthesized
  misc_feature (61): n=t or c
tcttctctctgtctacaagacaaagacctcaccatagcccttaactacctccattctgtcngcatcccgcatttggggtggctttttgtagaccctactgaaacaagccatttggagccag

SEQ ID NO: 37890 - DNA, 121 bp, Artificial Sequence
  Synthesized
  misc_feature (61): n=a or g
ctggggtgggatgagaggtagtgcaccagaccttgccttagcaagcatccaacatggagcntgtctgggtccattcattaatgtattgtgaatggacagcatctgatgctaactttgagct

SEQ ID NO: 37891 - DNA, 121 bp, Artificial Sequence
  Synthesized
  misc_feature (61): n=t or c
cacagaggccagtctcttcttacccagcaattctctcccaaagatggataagagagaggcnttttctgttctactgcttggagacatatacaactttcttggtgacatgctgggctgggtg

SEQ ID NO: 37892 - DNA, 121 bp, Artificial Sequence
  Synthesized
  misc_feature (61): n=t or c
attttgtcacaaagactgggccacatctaaagctgaaagaggaagatgacaattagtcccnattaattagtggagtttgactgggcttgagccagacagacttttgcaaagtgaatttaca

SEQ ID NO: 37893 - DNA, 121 bp, Artificial Sequence
  Synthesized
  misc_feature (61): n=a or t
atctagactacttctagactgaacagtgagtacactgttgagtggatgggccacagctggnatcccttgtctttttctacttctctccatcttcatgtagactacacaaagaataacaaaa

SEQ ID NO: 37894 - DNA, 121 bp, Artificial Sequence
  Synthesized
  misc_feature (61): n=t or c
gaatccctgctgaaattaaaagttatacagaagcagtacacgtttctagttgtgctgttangtgtattgtgttgtggaacacaagagcattaaggtaatgcaactagagtctatgcttgct

SEQ ID NO: 37895 - DNA, 121 bp, Artificial Sequence
  Synthesized
  misc_feature (61): n=a or g
atgttgtctcatctttgagaacaagcctggtctcgttagtctaattttgcagctctgcaanaagatctcatgttacatatataaacttcctggtgtaggagtaagcaaggtttcctttaaa

SEQ ID NO: 37896 - DNA, 121 bp, Artificial Sequence
  Synthesized
  misc_feature (61): n=a or g
tttcccatacagtctctgtgtttttaggaacgcgcatccagccatgggaacagcctccacngatcaggatgcttgggggcacaaagcactgggctctggaggaatagaaacacattcagat

SEQ ID NO: 37897 - DNA, 121 bp, Artificial Sequence
  Synthesized
  misc_feature (61): n=t or g
ggttctaaaccagttgtttgaggtgattggaaatgttgaaacattatagacatggaaatgntttctttactgtttagcaaaagcagtgttgttatgctgaaattaatatatctgcatgtgt

SEQ ID NO: 37898 - DNA, 121 bp, Artificial Sequence
  Synthesized
  misc_feature (61): n=a or g
tctatccctgtcccatttcactctttgtgagcattaattttccccctggtaactgatactnaaagcagttctggctgcttttgcttcagaatcacactgttggggtttgggtgggttgagc

SEQ ID NO: 37899 - DNA, 121 bp, Artificial Sequence
  Synthesized
  misc_feature (61): n=t or c
actgctctattcattttcatgtatgtatatatataataaaagcacaatggatgatgttttntcatttttcataacttctgaaggtctggattgtgctactgagcacatccagatgttgcag

SEQ ID NO: 37900 - DNA, 121 bp, Artificial Sequence
  Synthesized
  misc_feature (61): n=t or c
taattctctaccatccaccagctcttttgccacccagctacgctgagctttcagcaagggngtcagagctttccccttaatggcctgcaggtacttctatctgcttacacaccttgttcaa

SEQ ID NO: 37901 - DNA, 121 bp, Artificial Sequence
  Synthesized
  misc_feature (61): n=t or c
tcagattttaatctctgatgcccagaaagtctggattgtgaaagccttatatgggcaaaantccctttaatgagatttctcccattgataggactcttgctccaaagaagcaacaaaatca

SEQ ID NO: 37902 - DNA, 121 bp, Artificial Sequence
  Synthesized
  misc_feature (61): n=a or g
cctccgcaaccattttagacctccatttttcagatagcatatacatgtcgtagaacacaancaggcaatcagtcttcacaagaacacaaaagaagaacgatccttcactataggcaatttt

SEQ ID NO: 37903 - DNA, 121 bp, Artificial Sequence
  Synthesized
  misc_feature (61): n=a or t
acagccagaagttaatgactgtattagtatcaggatcacactgccaggccttggggtgaangaaagtattatgaccgcattcaatatccttttagactgcctgttcacaagggcagagaaa

SEQ ID NO: 37904 - DNA, 121 bp, Artificial Sequence
  Synthesized
  misc_feature (61): n=t or c
atgagctgctcgatataggggatgtctatcagcaacatttccacagctgtaagtgtagctntacgaatggtcatggagtggccactctactgacgctgatttcatgcctacatgtgggctt

SEQ ID NO: 37905 - DNA, 121 bp, Artificial Sequence
  Synthesized
  misc_feature (61): n=a or c
gattctgtgatttatttttttttttaaatcaaattcttcactccattgattttatgtatgnactcccagagaaggtatcaaaagttcttgcttgccaagctgaagctgaacatagataagg

SEQ ID NO: 37906 - DNA, 121 bp, Artificial Sequence
  Synthesized
  misc_feature (61): n=a or g
aactgagttttgccaggtttgcagcagatcagaatatttgaatattttagagatcaagctnatctcagcactgtaacttaagggactcttccttaaatacgggctgctaacatataataca

SEQ ID NO: 37907 - DNA, 121 bp, Artificial Sequence
  Synthesized
  misc_feature (61): n=t or c
gctggtatatcagtataagggatcctgtaatgaacaactgcactcagaacatatgtgatangcgtgtgtttatgagagctgctttgaaagtaatgcctcctattttattactctggcccat

SEQ ID NO: 37908 - DNA, 121 bp, Artificial Sequence
  Synthesized
  misc_feature (61): n=a or t
agaataagaaatcgaaagttggcattaaaaatagcgatacattttttgtaactttttatcntttgcactgaggatttggaaaatatattagtggtgatacgtgtctttgggagcatttagc

SEQ ID NO: 37909 - DNA, 121 bp, Artificial Sequence
  Synthesized
  misc_feature (61): n=t or c
cctacacccaggcatctgctgccattttagactcctgtccaaaaatgtatttcagggttcngataataaaaacggcatagaagagccacacacaccctgcattgccattcccactgcctgg

SEQ ID NO: 37910 - DNA, 121 bp, Artificial Sequence
  Synthesized
  misc_feature (61): n=a or g
ttgattatgtttaatgaaccattctgaattcttagtgaaaaacttggaaaggcctttctcnacagggtacaaatctagggacttctctattaagaaggcaccaagaaattttattacagaa

SEQ ID NO: 37911 - DNA, 121 bp, Artificial Sequence
  Synthesized
  misc_feature (61): n=a or g
aaaatgcatggctgccttgggctccctctgccctgcattcacaagggaagtcacacagctnggttgcactttggccgcctgctcatgtgctgatgtttgatgatgagtatacttgggaact

SEQ ID NO: 37912 - DNA, 121 bp, Artificial Sequence
  Synthesized
  misc_feature (61): n=t or g
gtccctatctgattcttgggatctgccagcttaactgggtgaccagaatttggaccgacanatatgttactatatttaccctactggttttccactaccaacccaaacaatttaggtcttc

SEQ ID NO: 37913 - DNA, 121 bp, Artificial Sequence
  Synthesized
  misc_feature (61): n=a or g
gagctctctgagctgtgaagtactgtgctagaacactaaccttagcaagggataacccctnaagtatcccttgcttctttggaagtagttcagatgggtaaagaatatatacattgaatta

SEQ ID NO: 37914 - DNA, 121 bp, Artificial Sequence
  Synthesized
  misc_feature (61): n=a or g
taaccctgaaaatatatgcattccctccaagcagagggcttaggaaggggctgagaaccantatttctcccaggcttcttcccccactgtgcacagctactcatctgtgactgctgtgtat

SEQ ID NO: 37915 - DNA, 121 bp, Artificial Sequence
  Synthesized
  misc_feature (61): n=t or c
gccatgggagcttctggtgtgctggaaaactgaatggaaaaatcatagaattatatggccngggttgaaaaagaccagaattatcattgagtttcaacccccctgctatatgcagggacac

SEQ ID NO: 37916 - DNA, 121 bp, Artificial Sequence
  Synthesized
  misc_feature (61): n=a or g
aagctaaggaggctgagaatgttttacagccatgatgcataggatgccatgggataaaacngccctgtcctacttgagctgtccagttgagagtagttatccctgagccctgggaggaata

SEQ ID NO: 37917 - DNA, 121 bp, Artificial Sequence
  Synthesized
  misc_feature (61): n=a or g
ttttttgctatcgttcttgttacctgtgtatttatttacagtcaattgttccctattttcnctccatttacgtaccatcttgtttatgatgctgcttaaacgcctgccgttgaggtaatta

SEQ ID NO: 37918 - DNA, 121 bp, Artificial Sequence
  Synthesized
  misc_feature (61): n=a or g
accgatgcccgcgggtggggtctgcacctttgggtgggggtgtttgcagctccctgtcccnaaaaagggggaactgaccccaatcaactgacccccattgacacccccctggatgtggctg

SEQ ID NO: 37919 - DNA, 121 bp, Artificial Sequence
  Synthesized
  misc_feature (61): n=a or g
atgggacgaatccccagaagcacatcctgaggcttctgggtcatgcaggagcaaaaagtcngatctgggactttttttcccgctcgctgctatccgttccctcgagcactcataaatcctg

SEQ ID NO: 37920 - DNA, 121 bp, Artificial Sequence
  Synthesized
  misc_feature (61): n=t or c
aattattttttcagccttttatggcttaatgtttttccctgtctacaattcctcagtatanaatttttatcattcgtttggaaacttcagacattttctttgattaaaaacaaaagaaaaa

SEQ ID NO: 37921 - DNA, 121 bp, Artificial Sequence
  Synthesized
  misc_feature (61): n=t or c
tttctttttcctagttgttttgaaggatgtggctaaaaagaagtcactgctcagcaacagngatgtagctgtgaagagagagtttgtactgataatctttcttgcttggtagaacagtttt

SEQ ID NO: 37922 - DNA, 121 bp, Artificial Sequence
  Synthesized
  misc_feature (61): n=t or c
ccaagcagcttgtgccaggcccccacaccagccacacaaggaagatagtaaattcagatanttaaaggaagcacgtgctgttgtcatatatagctggttctcttccaggtttattttggtg

SEQ ID NO: 37923 - DNA, 121 bp, Artificial Sequence
  Synthesized
  misc_feature (61): n=a or t
agatgcatacatttgtgtatgtgtgtccatagagaagatacaaaatgaagacaatggtacntatgtattgtcagaaataaagcatcttagtgttggagctaggaaatgcttttattttctg

SEQ ID NO: 37924 - DNA, 121 bp, Artificial Sequence
  Synthesized
  misc_feature (61): n=a or g
taacaccttcggagggctggcacatatcattgctgattcttatctcataatctgccatccnagacactgcttcccactgtacaggtatgattaatccttgtccttcccctactatatgggc

SEQ ID NO: 37925 - DNA, 121 bp, Artificial Sequence
  Synthesized
  misc_feature (61): n=a or g
taaatacctgcataggaaaatgagtcttcagtgaccagtctagatcatgaccttataaaancagctcctgtgcaagagtccacttgacaatttcctatgctctaaccacctcctttcattg

SEQ ID NO: 37926 - DNA, 121 bp, Artificial Sequence
  Synthesized
  misc_feature (61): n=a or g
caacacatcttcaactatagagtaggaaaacaaatgcacagctctattgagcttacagacnctgagggcctggctattctgtgtctagaacaatttttaacgtacctgtgagtctaagacc

SEQ ID NO: 37927 - DNA, 121 bp, Artificial Sequence
  Synthesized
  misc_feature (61): n=t or c
cttgctgggtaccctgacagggcaccaccgcatcccaatggcctcatagagaagagagtgntcccatggttccagtgacctctccttagcaaagtccttaccaggtgtattttaatcaata

SEQ ID NO: 37928 - DNA, 121 bp, Artificial Sequence
  Synthesized
  misc_feature (61): n=t or c
cactcatgtcactgtcactcatactgacagctgtgagtgaatcagcaatttgggtatgaangatgccacttcactggctggcatgtatcgcaacactttcttctcttgaatagtaacagtt

SEQ ID NO: 37929 - DNA, 121 bp, Artificial Sequence
  Synthesized
  misc_feature (61): n=t or c
cagacaggtgtgtagtaaaatcttcaaaaaacgcataggaagtgaattcctatcaaaatantttccagctcaatcaagtgtctgcaacacaacacagtttcctttaaatgaacccagccaa

SEQ ID NO: 37930 - DNA, 121 bp, Artificial Sequence
  Synthesized
  misc_feature (61): n=a or g
aataaatcattctatgaatttcacagagatattcaatatttggaggtcttcattataattnatgcagtagttgaaaaaatactcatttgcagtgcagagaaaaaagtgtgggccaaagaag

SEQ ID NO: 37931 - DNA, 121 bp, Artificial Sequence
  Synthesized
  misc_feature (61): n=t or c
atgtcttcagtagtgcctgcagagtaattattgagtttcccagcatggctgataatgtaanatgacaaaagagtcacgctggaaatctgttctttgactacaaggaaacattcagttatat

SEQ ID NO: 37932 - DNA, 121 bp, Artificial Sequence
  Synthesized
  misc_feature (61): n=a or t
gccaaaagcaaactgctttgcttaaagctagataagagagttctggtgaatgcacaatgcngtcgtatctttggttttaaaggaaagatgggcaacttaatactggaaatgatgcagagat

SEQ ID NO: 37933 - DNA, 121 bp, Artificial Sequence
  Synthesized
  misc_feature (61): n=a or g
tgtgaatatctctacagtagctgggaggagataatgcaatttagtcttaaaaataccatgnaaatctagaaagctgctgtgctgcacacaagtcattgaaacacaccagaactgtgtggag

SEQ ID NO: 37934 - DNA, 121 bp, Artificial Sequence
  Synthesized
  misc_feature (61): n=a or g
gcattgggctcagagaagagaaactggcactttcaagcctaaacccatccgacctaatttnggtctctgctgcaggatgtgtcatgccttcagtgctcctgtttctccccattgacagtgt

SEQ ID NO: 37935 - DNA, 121 bp, Artificial Sequence
  Synthesized
  misc_feature (61): n=c or g
gctgagcccgtcctgggggtgcctccatctcttcctccgagctgtgggggtctctgaacanttttcaggatcccaaatccttcctggcgtctctggggggtccccagatccttttgtggcg

SEQ ID NO: 37936 - DNA, 121 bp, Artificial Sequence
  Synthesized
  misc_feature (61): n=a or g
ttggaaatcatttacaggtttacaagccttaaccagaagtcagactgccacaatctcttcngtgcccagcagcactgtttggtagcagcaggtgaacagccctacacttggacatagacag

SEQ ID NO: 37937 - DNA, 121 bp, Artificial Sequence
  Synthesized
  misc_feature (61): n=t or c
ctctgtcacttgaacccattgaatctgcatcccaggaaaacagatgatcctgcaaattgangacaggcggtgttcgaagatttttattttattttttccccagaggaaataatcattttgg

SEQ ID NO: 37938 - DNA, 121 bp, Artificial Sequence
  Synthesized
  misc_feature (61): n=t or g
actgtgctcccagttggagcatctcaacgaggtaagccttactggtaagcagcttttacanatcaatctcgctttctgagtcaaaatctgtgccacggtaccaaaaaaagtaactctgatg

SEQ ID NO: 37939 - DNA, 121 bp, Artificial Sequence
  Synthesized
  misc_feature (61): n=t or c
gctccatattcaagtcatcttgaagtgcaactcaaaagttaagcagagaataataacacangtgcataagctgtttgggatgaaaacagacaggctgagcatttgtgttctgaagtgtatc

SEQ ID NO: 37940 - DNA, 121 bp, Artificial Sequence
  Synthesized
  misc_feature (61): n=t or c
atataaggaagcttgctttcaaaacttattcctatacttttgtaaacttagatgaagtttntcaaacagttatttgtaaataactttctgtttggccttactgtaatgcaagcagatgact

SEQ ID NO: 37941 - DNA, 121 bp, Artificial Sequence
  Synthesized
  misc_feature (61): n=t or c
tgcatgtagaacagaattaagtcgttctgttttgatggcacacaatgtgagagagctctcnaacagggcagagcacccgacaacggcctggatatctagatatctagaaagactggctaaa

SEQ ID NO: 37942 - DNA, 121 bp, Artificial Sequence
  Synthesized
  misc_feature (61): n=t or g
gaataagaagactcaaatacctgacagtgggtgcccatcactccaaaacagtcccacagcnctgcagagcttgtgggctttggtggccccaaacttgctgtgaggtctcaaaatgcagctc

SEQ ID NO: 37943 - DNA, 121 bp, Artificial Sequence
  Synthesized
  misc_feature (61): n=t or c
agagtaactatggattcatctagctttaaacaccaggaaaagtttgaacaatttaagctgncaacagtagaccagttgcacataagacttcacagtagcactataagaaatcactcaaaca

SEQ ID NO: 37944 - DNA, 121 bp, Artificial Sequence
  Synthesized
  misc_feature (61): n=a or g
gactccaaattctagcaattagtcatgcacatgtgctctgtagttaatgactattttaggngtgagccataagcataaagagctgttggcttgggctgcaaatgctgcactcctgctgtca

SEQ ID NO: 37945 - DNA, 121 bp, Artificial Sequence
  Synthesized
  misc_feature (61): n=t or g
ccaaatgctctggaactactcgtacaatgctcttctcctcatcaagaatgtcagcttcggncccactggaaacagatttttattgtacctctggaaacaatgcactactttttccattcag

SEQ ID NO: 37946 - DNA, 121 bp, Artificial Sequence
  Synthesized
  misc_feature (61): n=t or c
cagtatttcctaatgtcctgagcttaattcgaagcagaagtgcttttgcaccacattttanggggccagctgtggccaatctgtgctccaacgtcagagcagctgggagcgttcttcaacc

SEQ ID NO: 37947 - DNA, 121 bp, Artificial Sequence
  Synthesized
  misc_feature (61): n=c or g
ctactagcactgaacttttagaacctgaggcatttggggggtctcctgtttacagactttncaggtgaattttaaattccttagttaaaaacagcttcatctggaaaaaaaaaaatagcaa

SEQ ID NO: 37948 - DNA, 121 bp, Artificial Sequence
  Synthesized
  misc_feature (61): n=t or c
gcttgacttttcagggaggtactttagaagaaatagtctgacaaggtttttagaaagtgtntttaaatattttctgttttgttgctccactgcataacaccagtgaggcaggggttgactg

SEQ ID NO: 37949 - DNA, 121 bp, Artificial Sequence
  Synthesized
  misc_feature (61): n=a or c
gaagagctggatccatccaagggcagcagcaccccatctctcatcccaaagaaactgatanctatctggggaccctggtcttactaggtgccctcagttattccagacaccagtgagaaac

SEQ ID NO: 37950 - DNA, 121 bp, Artificial Sequence
  Synthesized
  misc_feature (61): n=t or c
agcctcatttgttttctcttccttcaccttgtgagtcttgcttttaacaaatcacagttcncaacggctttacctaaatgcccaaagactcagggctttgttgggctttgtttgcaagcag

SEQ ID NO: 37951 - DNA, 121 bp, Artificial Sequence
  Synthesized
  misc_feature (61): n=t or c
acataaacagaaaaagctgatttactaaattaatatattgtagtggaagagaattcaaaantgggtatcacaaccatagttgtagtgtgaaaaagctttcgctccatgtcctctgctttct

SEQ ID NO: 37952 - DNA, 121 bp, Artificial Sequence
  Synthesized
  misc_feature (61): n=a or g
gggaaagaaagcaactgtccttcccaaataatgcttcaaagtagacacataattataaaanggaagacattttaaagagcaaacagaaaactatgaagatttttgttatccttgctgattt

SEQ ID NO: 37953 - DNA, 121 bp, Artificial Sequence
  Synthesized
  misc_feature (61): n=a or g
tcgaggaacatgtatagagggtggagcacttgagctaaaagcctccatttagctgaacacngtgatatcaaccttgacttaaggtttgctggactatcagtcctgaagtgatgttgctgca

SEQ ID NO: 37954 - DNA, 121 bp, Artificial Sequence
  Synthesized
  misc_feature (61): n=a or g
gattttaagaggtatatcttattttcaagttactggaaaactaaatgaaaccatcacctcnctaagtacagcatgtgcgctccaaatgcccagaaagatgaaacgccataatacaaaacta

SEQ ID NO: 37955 - DNA, 121 bp, Artificial Sequence
  Synthesized
  misc_feature (61): n=t or g
atgcaaaggtctattgaaattcaaatgttagacatgcccatctgtcagcgcctctttggangggtataaacccgtgggtaaccctggtcggcagagcacgcacatgggagggggtctggga

SEQ ID NO: 37956 - DNA, 121 bp, Artificial Sequence
  Synthesized
  misc_feature (61): n=t or c
gtgaaaaattggaatgacttatttccatatgactacaatgtcaagacattactgtgataanttagacctgatcctttgcctaggacagcctttagatcaagtaaaaagccacaatctgaag

SEQ ID NO: 37957 - DNA, 121 bp, Artificial Sequence
  Synthesized
  misc_feature (61): n=c or g
ctttttttcttacagactctatcccatatgccattgtctggggtcactgaaagcacctcangtgtcactgatttggtgctcactgggctgtgctctcatggtagctcagaaagattttttt

SEQ ID NO: 37958 - DNA, 121 bp, Artificial Sequence
  Synthesized
  misc_feature (61): n=a or g
cttcaagcctctcctgcagagaaatatctaggacattagaagtcaaagcaaaatcaggtgnctggagtcctcttaactttttctcttaaggaagacaatgtgagagccttatctttaccac

SEQ ID NO: 37959 - DNA, 121 bp, Artificial Sequence
  Synthesized
  misc_feature (61): n=t or c
ctgcctctgtacacgctgtgcttggttttccttaggttttagaaaaattgtatcagttttntttcctgtccattccattatggtggtatattggtctaactggtttagtataaatagttca

SEQ ID NO: 37960 - DNA, 121 bp, Artificial Sequence
  Synthesized
  misc_feature (61): n=t or c
aaatgcagcagaaaaatgaataaatacatactatgagaaacaatagcatctcacacattcnatgtccgctctccttcacgcagcttgacagaggatgcagtctcaggatcaagcaacataa

SEQ ID NO: 37961 - DNA, 121 bp, Artificial Sequence
  Synthesized
  misc_feature (61): n=t or c
ggggtggggagggcacggagcagcttctgctgaggctgcaggggatgatgttttcccagcngggagcaaaatggtgctgggtggcagcaaagtcacctttgtgcattgcccacagcacatg

SEQ ID NO: 37962 - DNA, 121 bp, Artificial Sequence
  Synthesized
  misc_feature (61): n=t or g
ctgaaaccagcatcttggtcatcaatactgaaatataatagaaaatattcaagagaacttnatcccaagtctggaagccagaatgctatgattaagggggacaaaaaaaaaaaaaaaaaag

SEQ ID NO: 37963 - DNA, 121 bp, Artificial Sequence
  Synthesized
  misc_feature (61): n=a or c
atttttctgtattatcatcacaggaaaaacagaagcaaatgcacagctgtcttggggaacntaaaagtgattgatttcaggcaacttgaatcatgcaacagatcttcaagtattgcaagca

SEQ ID NO: 37964 - DNA, 121 bp, Artificial Sequence
  Synthesized
  misc_feature (61): n=a or c
caggtgggactgtgctgactgctaatatgcagtgctgggatctgttcttcctctgcaggcnaggtgtaattcttatttctaatcctctagttgtattaaatccctgtaatccctttcatat

SEQ ID NO: 37965 - DNA, 121 bp, Artificial Sequence
  Synthesized
  misc_feature (61): n=t or c
tctgagtttgactccttcctgtcttaaagagcaattgcaagtaagagtctgaatgtttatntggtttacaaacagaggaatttcagtatccacagttagtatgaatatatatgttccacaa

SEQ ID NO: 37966 - DNA, 121 bp, Artificial Sequence
  Synthesized
  misc_feature (61): n=t or c
actctccgcacaagacattcgatgcagcagatttttgggcatttccaccccctttcttttncccccctaaacgaattcctggttttgttatttgcaaaaccatgtcaagttgtgagcatgc

SEQ ID NO: 37967 - DNA, 121 bp, Artificial Sequence
  Synthesized
  misc_feature (61): n=t or c
aataactggcctcatttctctatgctttgctttctgcgttgctgcaggcacagcactgagngaggcagcactgagtgcaagcagaggtggcaggagagcacctaggaattacagacctcgg

SEQ ID NO: 37968 - DNA, 121 bp, Artificial Sequence
  Synthesized
  misc_feature (61): n=a or g
ccctgaacctcccagtctaaaaccattccacaacaggagatagaaacagcaagacaagagngatgctaattaaggtgtaaatgcccacagacagttccatttattttgttgattcaaattt

SEQ ID NO: 37969 - DNA, 121 bp, Artificial Sequence
  Synthesized
  misc_feature (61): n=a or c
ctagagcccattttatagtgaaatattcttttaatttttccctattgttgcaaagctttancccctccagaatgatttcccagtgacatatagtgttaggtgctcttagatgctctttacc

SEQ ID NO: 37970 - DNA, 121 bp, Artificial Sequence
  Synthesized
  misc_feature (61): n=a or t
tttacagatgaaatgcatacccaggtaattccttcataccatttattttaatataaaagcngctttcagggtcaaattatttctaaacattgctgcttagacaaatcaaccaacttcccag

SEQ ID NO: 37971 - DNA, 121 bp, Artificial Sequence
  Synthesized
  misc_feature (61): n=a or t
gacagtgagatgccatgtttaaatcgttacatgaggattgattatggaaacatggtcctgngaaaattttggatagtgagaagttgtcagatggaaaacggtcatcagtcgccacagggat

SEQ ID NO: 37972 - DNA, 121 bp, Artificial Sequence
  Synthesized
  misc_feature (61): n=a or g
ttttttttcttttcttttctttttttttttttttttttgtaagtttatttttgaggatctncaccatttcagaaagctgcaatctaatttatgtagactttcacagtaactcagttatcca

SEQ ID NO: 37973 - DNA, 121 bp, Artificial Sequence
  Synthesized
  misc_feature (61): n=a or g
tgttgtattaacaaatagatgggtagatatattaagtaaaaacccgaactcctcttttatnaagtaaatgaaagacgtgtcaatgaaaaatggaatgtcagattggtgcaagtctaatgct

SEQ ID NO: 37974 - DNA, 121 bp, Artificial Sequence
  Synthesized
  misc_feature (61): n=a or g
ttatgatcctaaattgcctttaagtatgccaagtgacatcctacagataatgttactgacntacttggatgtagttataagatggagaaataactcctcttatattttataccaaggataa

SEQ ID NO: 37975 - DNA, 121 bp, Artificial Sequence
  Synthesized
  misc_feature (61): n=a or c
ggtttctggactcacaaactgctctctaaatcccatataacagattttcctccttactacnaatgttgtatcaacacttctaggtttagtggcccaaaggtggcttgtcacatcaaaagct

SEQ ID NO: 37976 - DNA, 121 bp, Artificial Sequence
  Synthesized
  misc_feature (61): n=a or g
aatgtccggcgggggcagcaggaacccaacgccacccatcgtcagacccacctccactccnaccccacctcaggtaacagtgtgactgtgtggctttgccctttgttagagctgcttcttt

SEQ ID NO: 37977 - DNA, 121 bp, Artificial Sequence
  Synthesized
  misc_feature (61): n=a or t
gggtagatggatgtccaaaatagagcaagcaaaaaacctgttaccttcccctgcagaaacngctttgttctctgctacagacccgctgcagggctgggcaggaggtgacctgctgctcctt

SEQ ID NO: 37978 - DNA, 121 bp, Artificial Sequence
  Synthesized
  misc_feature (61): n=a or g
gcaatcggatgggatcagcaaagtgctgcctttaatactggctttgtgatggcagcgtgcntcagctcaaggatctgatggaactctccatttcacaccagttgctacagtgcagtgtgaa

SEQ ID NO: 37979 - DNA, 121 bp, Artificial Sequence
  Synthesized
  misc_feature (61): n=a or g
tcacacgcacagtgtgtccccaggttgtgtattgtgacaaaacctcaccagaacggggccngtagtgccctgcaggtactgtcaatgggcacactcaggtgcagcacacagacctccagct

SEQ ID NO: 37980 - DNA, 121 bp, Artificial Sequence
  Synthesized
  misc_feature (61): n=t or c
tttacaacttttttcacacttttcctcagctggaaatagattttcctagtgtttgattaanaaggagtgagttgttcctaactaggttgagggcaagaagagctgtgtggcattggattag

SEQ ID NO: 37981 - DNA, 121 bp, Artificial Sequence
  Synthesized
  misc_feature (61): n=a or g
atggagctgcagcacaggtgtcaccaacaccaaatgctgctctccgccacaccaaaggacnttctttggtgtcccaaccaaagaggacattccttggtattcgtgcacactgtcccacagg

SEQ ID NO: 37982 - DNA, 121 bp, Artificial Sequence
  Synthesized
  misc_feature (61): n=t or c
tgcttccctttcttgacgctgtttttgcaggaggatcgtgctttcctgcagcattttatanatggtcacattaatcaggcgtcacacggaattgtggcataattttggatagaatcacaga

SEQ ID NO: 37983 - DNA, 121 bp, Artificial Sequence
  Synthesized
  misc_feature (61): n=t or c
caaacagaaatttaggcaggcaactcgtcaaagaacaagtaaattgtttgtagctaaaatngaacaggacaattcctatcagaaaacgtctttcaaagtcctttgtacagaatcaaatgag

SEQ ID NO: 37984 - DNA, 121 bp, Artificial Sequence
  Synthesized
  misc_feature (61): n=a or g
gtagatgactttttatatggagtagatttacagcattgaaactcaattgaacaaaactatntgctcctcgctgatagaaatacagaaagcaaataggcacaccagaaaatctcagctaatt

SEQ ID NO: 37985 - DNA, 121 bp, Artificial Sequence
  Synthesized
  misc_feature (61): n=a or g
gttatagatcatttctttcttctgaaaacatcatttattcagaactctaatttaccaattnaattgaggtaaattagggtaaggattttaaataggagcaatcctttgataggctgttctc

SEQ ID NO: 37986 - DNA, 121 bp, Artificial Sequence
  Synthesized
  misc_feature (61): n=a or g
aaatgggaaaccaggaatgtgatctgctcctgtcactcagcatcgcctcattctcaaagtncagtccagttgagctacagctgagtgcacgtagtggcattaaggccccaattagaaaagt

SEQ ID NO: 37987 - DNA, 121 bp, Artificial Sequence
  Synthesized
  misc_feature (61): n=t or c
tgcaggagcataggatcaaaccctttgtgaattgcactgccccttaaaagttgtagctcanagaataaaaactgcagattttcggaaattggaagaatgacacaggaaagctgctcaagtt

SEQ ID NO: 37988 - DNA, 121 bp, Artificial Sequence
  Synthesized
  misc_feature (61): n=a or g
taaagtgctgctgatgcgctggggacacgaggagccaggctttgagtctgcagatcaaatnctaggtccatctgccctcagatgtcctcagggctgctctgctttgcccggctccgcagcg

SEQ ID NO: 37989 - DNA, 121 bp, Artificial Sequence
  Synthesized
  misc_feature (61): n=c or g
ggagcagcacaacctttccctataatcctaaggtcacacaacccagtttagtacttaactnttagatggtgtgtctttgagctgtctacaccctagcaatgaagttgccttatctttagag

SEQ ID NO: 37990 - DNA, 121 bp, Artificial Sequence
  Synthesized
  misc_feature (61): n=t or g
aaattaaagtgaaactttaggtactgttaacttcatcaggtaaaaatcctttttttctagnttgattcccatcatgaaaaaacatccagaaatccaagggtgacaatcactagcccacagg

SEQ ID NO: 37991 - DNA, 121 bp, Artificial Sequence
  Synthesized
  misc_feature (61): n=a or g
ctgcaatggggaatcagggaatgcccctgctccaccttcatactgtgcagcaaattgaganaaaggattttgtgataatgaagaaaaacagtttggtctacagaatatataatatacaatg

SEQ ID NO: 37992 - DNA, 121 bp, Artificial Sequence
  Synthesized
  misc_feature (61): n=t or c
aaaccaagcaatcagtacgtgcaaggctttgtaaggaactgctgcctcattcaactggcanggcaaacaagggtaaggcacagcacgtgcccaggggacatggaacgagcacgtaagcact

SEQ ID NO: 37993 - DNA, 121 bp, Artificial Sequence
  Synthesized
  misc_feature (61): n=a or g
ccagcatactcaagtactgcaaactgatagcttaatgcgtttctaatgtatagatatattntatgaatgcttttttgtatatacatagaataaaaatgtatagcaccaatctgtttctaca

SEQ ID NO: 37994 - DNA, 121 bp, Artificial Sequence
  Synthesized
  misc_feature (61): n=t or c
tctcagccctttgacttgcttagctgatgcggatgttcatttttggagcttgacgtgagcngtggagagaggttgatccctgttgagaggctttagcctcagccgcggtgctcattccttg

SEQ ID NO: 37995 - DNA, 121 bp, Artificial Sequence
  Synthesized
  misc_feature (61): n=t or c
ggggggaataatgtctgttcctgaaaagctgaagttcagtgcctgcactgctcctctcccnggggaggtggcagtccttcctgtgctgatggcacatcctccatctcttttgcatggtgcc

SEQ ID NO: 37996 - DNA, 121 bp, Artificial Sequence
  Synthesized
  misc_feature (61): n=a or g
aagcattcggggaactgttctatcaaaaatgagtatgagtgatttttcaaaggcagtgaanctagctgttcaatatttggtcagaaatttagctagatttcagcaattgacttcaaagaca

SEQ ID NO: 37997 - DNA, 121 bp, Artificial Sequence
  Synthesized
  misc_feature (61): n=t or c
cgcagcccctgggtgtggggtgctccccctgcacccttccagcgatttcttgcttcctgcngggggtaagaagatttactctctacccacccctccctgtatatatggaggtggttctccc

SEQ ID NO: 37998 - DNA, 121 bp, Artificial Sequence
  Synthesized
  misc_feature (61): n=a or g
gtaaaggtattctttcttctgtgtgcatctccagcctttcttgacaggcagtcaagaaatntgtctctaaaaagccaggttagatcctcagagacaagcagtgatgcagttcttagtaacg

SEQ ID NO: 37999 - DNA, 121 bp, Artificial Sequence
  Synthesized
  misc_feature (61): n=a or g
cctcactccttgtaccatctgtagcacaactgggtcctgtgtggtccttttttcacttgcnatactttgccaggagcctatcgttaacattcaatcaggaattagggaagaggtaggtaac

SEQ ID NO: 38000 - DNA, 121 bp, Artificial Sequence
  Synthesized
  misc_feature (61): n=a or c
gataaagatacaatagtagatgagtacattagggactatatttacacatcttccttgctgngaatattcgtgacttagtttgctgtttgaaattaaaaccccaaacagaaattaatgagta

SEQ ID NO: 38001 - DNA, 121 bp, Artificial Sequence
  Synthesized
  misc_feature (61): n=a or g
ttttgaagtagatcagactaatttaaagtagtttaatagattcttactgccgatattgtcnttacctattgcaagtatcagcaaaataaacagttttccttttgtgtgtgtgtgctatctt

SEQ ID NO: 38002 - DNA, 121 bp, Artificial Sequence
  Synthesized
  misc_feature (61): n=a or g
taaagcctgccaacacagggtgcaaagatgcaggacttctgtgtgaaacaaactctggcancaaactaagctcagtatcttgattttcttcagaaaatcttgtaaaactggtacaacaagc

SEQ ID NO: 38003 - DNA, 121 bp, Artificial Sequence
  Synthesized
  misc_feature (61): n=t or c
ttttttataaggacatcactgaaataaaggcagtaaatattgagtgcataacagctgatanaattaacaccttgagagcaaattaaacttttcttttaatcacataggacattgttcctat

SEQ ID NO: 38004 - DNA, 121 bp, Artificial Sequence
  Synthesized
  misc_feature (61): n=a or c
aatgggttatttgaagattttgaattctggtaatacttcatgagtaagcccatttattccntccagaaatctacccaaggaataatttcagaagagaaatataaatttcaaacaaattagg

SEQ ID NO: 38005 - DNA, 121 bp, Artificial Sequence
  Synthesized
  misc_feature (61): n=t or c
cagtcgctttagctgcctctctcgtctgtaatttcactgttgattgggtgatttaaaacanaagcaaaattgctgcttaatattatggctttatctaaaattctgcaagtagacaaaacaa

SEQ ID NO: 38006 - DNA, 121 bp, Artificial Sequence
  Synthesized
  misc_feature (61): n=t or c
ttcaacagataacagcactgatacttcagttgggtgtatgtattttgtaacatacatcctnagccagcactgtgcaggcaaatattgtttcaaaactccagatcttggagttttatctctg

SEQ ID NO: 38007 - DNA, 121 bp, Artificial Sequence
  Synthesized
  misc_feature (61): n=t or c
cttgtattcactggatcgatatctttaaacagggagtttgtcagttttcagacaaacattntctctgacatgagcgcatattggaaactggaacagttttaaaccatatctgagcacagtg

SEQ ID NO: 38008 - DNA, 121 bp, Artificial Sequence
  Synthesized
  misc_feature (61): n=t or c
aaggatctgtgtgaggcctgagcagccttttccaaaagagcttcttgcaagaactattgcntctccaggccaggcgcattcattttttcaacagaaagggaaatgaccctctggtaaaggg

SEQ ID NO: 38009 - DNA, 121 bp, Artificial Sequence
  Synthesized
  misc_feature (61): n=t or c
attaacagtctttttgctattactgtgaatttaacagttttctagcccctgaattctggtngctgaacggcactgtctttattttcatagaatcatggaatggtttaggttggaagatacc

SEQ ID NO: 38010 - DNA, 121 bp, Artificial Sequence
  Synthesized
  misc_feature (61): n=t or g
gcagcagggattgcccaaacctgcacactcagtggctctgcagtggatgagatgttggcantctgtgctggcagagccctgggatgctccctgcaatgggaagcacaggcaggcagtgtgc

SEQ ID NO: 38011 - DNA, 121 bp, Artificial Sequence
  Synthesized
  misc_feature (61): n=a or c
taggacttctttctgatgagaaaggtgctaggctattgttgatatttctgcatgccataancttgcagtccctagtgtatgccatgtatggaattgcaagctgctctgttcagtttatact

SEQ ID NO: 38012 - DNA, 121 bp, Artificial Sequence
  Synthesized
  misc_feature (61): n=a or g
atttattaagttatttgtgaaagttgctgacactaaatagtagagaggaagttcacattanttcttctcttacaagcctgttcatagtccattgctaggaactgacctctgaaataagaga

SEQ ID NO: 38013 - DNA, 121 bp, Artificial Sequence
  Synthesized
  misc_feature (61): n=t or c
tcttggaaaaagtcagtattgcatttatttctattttttaaattctaataaaactcattgntgtgggagcagtcatcacagtaaagatgaaaagctaaccacaaggaaatatggacctctt

SEQ ID NO: 38014 - DNA, 121 bp, Artificial Sequence
  Synthesized
  misc_feature (61): n=t or c
attaaataatgagcactactacagcacctctgctttcaaaactggttctatggccaaaaangttaacaaaatcagggctactggagctgtttgaaaatcagttgaaatagatgacttccac

SEQ ID NO: 38015 - DNA, 121 bp, Artificial Sequence
  Synthesized
  misc_feature (61): n=a or c
taggttcagtcagagaacacgtcatgtaattactttcaatatgcaatgaaaagaaacttantatcatagttgtagacaagaaggaatgcttaaatagtggaggtaagctgtgaagaccttc

SEQ ID NO: 38016 - DNA, 121 bp, Artificial Sequence
  Synthesized
  misc_feature (61): n=t or c
ctcctcatttgacttcagtcacatctctgtcatttctcagacattcttgggcatcatgacngccatacatgcatctggccatgcttgttcctccccaaaacacttcacgtgacttggaagg

SEQ ID NO: 38017 - DNA, 121 bp, Artificial Sequence
  Synthesized
  misc_feature (61): n=t or c
tgctggctgggcagtggtggatggtggtggcggaaaggaggacggttttgaagcattaaangcaggtggaaaggacagctgcttgttttctccagtagaggaaaaaaggtccaagtctgct

SEQ ID NO: 38018 - DNA, 121 bp, Artificial Sequence
  Synthesized
  misc_feature (61): n=a or g
accattatttcacagaatcatattagtcctttttgcaactatatattgttacatacttatnttgacatctgtagggaattattcggggaactattactgtacatctttgttcagaaatctg

SEQ ID NO: 38019 - DNA, 121 bp, Artificial Sequence
  Synthesized
  misc_feature (61): n=t or c
atcatttatctctgggtaagaatgcattctcacagacattgattaatctctccccctaaangctcctgcaagacaggtgctattgatgcacagtgctaggcacgacttagaatcaagcatg

SEQ ID NO: 38020 - DNA, 121 bp, Artificial Sequence
  Synthesized
  misc_feature (61): n=a or g
acgtaggacagatttcatgggtgaggagaagagttttgcaggaaggatgaggatctaaganaagttaattctgcagccccaggaagagctttgtgagggaaataagaacagaatagggtgt

SEQ ID NO: 38021 - DNA, 121 bp, Artificial Sequence
  Synthesized
  misc_feature (61): n=a or t
aagctgccaagagtgcttgaattagtctttggtattgataaacactgcaaaacaggtcttngtctttcagaatgttcaccaggtggcacagcagatttgcttgtattaacataaaacttca

SEQ ID NO: 38022 - DNA, 121 bp, Artificial Sequence
  Synthesized
  misc_feature (61): n=a or g
attatttttgatatagaataccattttacctcccatttagtactaagcaggtaataagttnagactttaatattctagtcaggcagatcttctcaccaggctttattctttcccagaagaa

SEQ ID NO: 38023 - DNA, 121 bp, Artificial Sequence
  Synthesized
  misc_feature (61): n=t or c
ctttaatcctccttcctgtcctgacagagagagcatgtgcacacataggcatagctcttangtatttgcctacctcctcttcttagtgaaaaacttaacaatgcctggctatatttgtttg

SEQ ID NO: 38024 - DNA, 121 bp, Artificial Sequence
  Synthesized
  misc_feature (61): n=a or g
atagatccccttctttctcacagaatctaacgcaagctgctcgtgcatccagccttccctngattagctccagctttttcaggtcaacacttacatctctgagtcactaataacagagtgg

SEQ ID NO: 38025 - DNA, 121 bp, Artificial Sequence
  Synthesized
  misc_feature (61): n=a or g
cttatagccattagggtaacattcgccctagaagaagtcccacatcatattccaaaagcantgcacaacactgtaacattaatgaattagcagtaggagaaaactactcatttggaagaaa

SEQ ID NO: 38026 - DNA, 121 bp, Artificial Sequence
  Synthesized
  misc_feature (61): n=a or g
acctccagctgtggcagtgggtagagttgtcaggtgttccgtttcattcagttctgaagtnttcaaatgactgttgtttttgctataggttgctagcaggctgagagacttgaaggtcaaa

SEQ ID NO: 38027 - DNA, 121 bp, Artificial Sequence
  Synthesized
  misc_feature (61): n=t or c
gaggaaaatgcttaaggtagtaacttttttcagttcagtaagagatttcttgatgcacccngtttagaagttcaatattgaaaaaacacagattaatatttatttacataattatgtttgg

SEQ ID NO: 38028 - DNA, 121 bp, Artificial Sequence
  Synthesized
  misc_feature (61): n=a or g
gcaggagttgtcttcaggagaaaatggtgaaaattcccatgctaaaacaatgtttctattnttcaaaagagtaaactacaaagaaatgctaagtgttgtcatagctttttattgtactgtc

SEQ ID NO: 38029 - DNA, 121 bp, Artificial Sequence
  Synthesized
  misc_feature (61): n=a or g
cctgtagcaaagtgcccaggtgggtagcaaaggggaggctgttctaacagctcctcctgcngagatgctgcgatttacggaatggttcagagataacacggggtgcagcgctctcccttgt

SEQ ID NO: 38030 - DNA, 121 bp, Artificial Sequence
  Synthesized
  misc_feature (61): n=t or c
tgaatttcacttgagtactaattcctaatgatacatgagtgatgccaatgcgtgcaaaaanggtgtggcaaagatgccccagaaatcatggtattagccagtaggacatgtcaaaatagga

SEQ ID NO: 38031 - DNA, 121 bp, Artificial Sequence
  Synthesized
  misc_feature (61): n=t or c
tgtattatatggtactgttgtaaaaagagtcatttctcttgcatcatactgtgaggataangatggtatctcaagccttatatgtataagaaagtttacgtggcctgatagcaataggatg

SEQ ID NO: 38032 - DNA, 121 bp, Artificial Sequence
  Synthesized
  misc_feature (61): n=t or c
atgaaatccaaacatcatcattttatatatacaataaagtactggaaattagacttagaantagacttcacccttccttcactcatcctaagcagaaatgtccacatacctataaatgaca

SEQ ID NO: 38033 - DNA, 121 bp, Artificial Sequence
  Synthesized
  misc_feature (61): n=a or g
cagagtatgtagaaatttacagaacctggaccttggcatctcttattgtctgactgacagngctgaggtgatgaaacaaaagccagtccttgtcttggaagattgtacccagggaaggggg

SEQ ID NO: 38034 - DNA, 121 bp, Artificial Sequence
  Synthesized
  misc_feature (61): n=a or g
gaccaatttgcattggttaaattgttcatttatggccaagtggtaacagtagcaaatgctngtcaagatgtcaccttcaaaccatgaaaatgcactactgtgacaattatttacaagttga

SEQ ID NO: 38035 - DNA, 121 bp, Artificial Sequence
  Synthesized
  misc_feature (61): n=a or g
caaatctgaggcttcaatgttgtgtgtgagaaggttcaaagcagggggaaaccgagtcctngtggtgggctttgacaaatccaggcccatgttagcactgaaggggtggtggtgaggaacc

SEQ ID NO: 38036 - DNA, 121 bp, Artificial Sequence
  Synthesized
  misc_feature (61): n=a or g
ttcttacacaagcttccttaagtgttacttcttgattgagtaactacagacatcactgttncaatgtcgtgctcagattgggaatttcaaaaaatccaataggaactggaggcctttgaac

SEQ ID NO: 38037 - DNA, 121 bp, Artificial Sequence
  Synthesized
  misc_feature (61): n=t or c
ttgcttgtcattttccattggcaacaggcaattaatcctgttcagcaacttgagcttccangaaagtgtaaaggactgtgatgatcatataaccttttttaataggctcaacattacaatg

SEQ ID NO: 38038 - DNA, 121 bp, Artificial Sequence
  Synthesized
  misc_feature (61): n=t or c
tgctctgatacaagaatgtctgccttcagaggcttatggtgttatcatgtacgataaactnagagaaactcaacttagctgacagaaacttccatatgcttggagaagcaagtaaaatgac

SEQ ID NO: 38039 - DNA, 121 bp, Artificial Sequence
  Synthesized
  misc_feature (61): n=a or t
acctgggtattggataagaaagtccttataagcaaaaagctgcataaattgagtgatatgntcaactttggatggtgggtgactgtgtacaaagttatagtttacagtggctcatagagaa

SEQ ID NO: 38040 - DNA, 121 bp, Artificial Sequence
  Synthesized
  misc_feature (61): n=t or c
cgtggaagtaatgacaataaaaagaatgaagaaactaactggaaatgggctgctaacagcngcctgatggctagtaccagtggctggaaaaaataaatctattaatgactagatatcagaa

SEQ ID NO: 38041 - DNA, 121 bp, Artificial Sequence
  Synthesized
  misc_feature (61): n=a or g
ttgaaagaaaaataaggatgttaaaaaataaaccaaaaaaacacgcttcagctaaaagtangaagtccaaagggaaaatatgaacttaacacctgctactgatcctctctaaatcctatga

SEQ ID NO: 38042 - DNA, 121 bp, Artificial Sequence
  Synthesized
  misc_feature (61): n=a or g
ttgaaagagaattaagaagaattaattagcagtgggccttctgagcagttttttttgcacnaaaaagttaaagagatgcgaggcacctcaagaagtggagacagggatgcccacagctggg

SEQ ID NO: 38043 - DNA, 121 bp, Artificial Sequence
  Synthesized
  misc_feature (61): n=a or g
aaataaggaaaggggcacaaattcattttggttctaagtgcatttaagtgtatggattaantccaagagcacatttgtccctgtgtccagaaaggtacttactttattgaataagaagaag

SEQ ID NO: 38044 - DNA, 121 bp, Artificial Sequence
  Synthesized
  misc_feature (61): n=t or c
tggaggtgaaggctgctaagtatttaaaggtattaagagccttttaaagcaaagaataacngtgtgttctcacacagccacttcagttaactgaccagatattaaagagtaagatggcttt

SEQ ID NO: 38045 - DNA, 121 bp, Artificial Sequence
  Synthesized
  misc_feature (61): n=a or g
tgattagagctcctttaaagccaccaaggactaccagtttcagaatatatagactgaaaancttgcagttacaggctgtatttacatttagtaatgacaaaataagacctcagctgtgtat

SEQ ID NO: 38046 - DNA, 121 bp, Artificial Sequence
  Synthesized
  misc_feature (61): n=a or t
actcattaacataaccaatttgtttcccgcagcttatgtaatgttcttttcaaaactagancaaactcttatttggcagatgcatccttttcacctgtcatttttttaatgcaagttattc

SEQ ID NO: 38047 - DNA, 121 bp, Artificial Sequence
  Synthesized
  misc_feature (61): n=a or g
gcagggaagccttgggaaacccatgccaggctctttaaattgaaaacaaagcattgttgtntttgaaaactgggagcacagacagagccagacccagtgctctgcacctttgcactttcaa

SEQ ID NO: 38048 - DNA, 121 bp, Artificial Sequence
  Synthesized
  misc_feature (61): n=a or g
caaatgagaatgctgacacagccttaagtacagtgtcaagaaaggagagaaaggagtgctntaatgcacgtaacttttttctcgtatttgctctttttctcattattgctttaaaagaagc

SEQ ID NO: 38049 - DNA, 121 bp, Artificial Sequence
  Synthesized
  misc_feature (61): n=a or g
aataggagaatatcagtcagctgtggctaaactgcttctgctcagttcactcactcaagcntcatgctagatgagggttctgtataaaggatttgctacaacatctgctacttgtattgtg

SEQ ID NO: 38050 - DNA, 121 bp, Artificial Sequence
  Synthesized
  misc_feature (61): n=a or t
atgtctcatactagccataggtatgtaaaatgcattccaaacagaagtatagatattgtcngtcacttgctcatatcagaatgctttaatttttccctgcttttctcccagtgagttggga

SEQ ID NO: 38051 - DNA, 121 bp, Artificial Sequence
  Synthesized
  misc_feature (61): n=c or g
tgatctttttttgtccatctaactccatccgtttctgtacagtactagcacagtctctttntttcctagagataactgtaactttcttcctattgccctcatctcttcttttgtctgccca

SEQ ID NO: 38052 - DNA, 121 bp, Artificial Sequence
  Synthesized
  misc_feature (61): n=t or c
acaaattaatacaagacaagaatcagacatatgtgtctaaaatacacactgcataattaanctgagaatgaaaacaaatcaaaagtatatatgttcaaatagtatttattgttcctttaca

SEQ ID NO: 38053 - DNA, 121 bp, Artificial Sequence
  Synthesized
  misc_feature (61): n=t or c
catgaccctaccgggcatcacatcttttcagtacttgagataagaatgcatctttttttcntcttctaattcagcatctaggcaaaaaatatcaaatattacttatgaatgatcagccaga

SEQ ID NO: 38054 - DNA, 121 bp, Artificial Sequence
  Synthesized
  misc_feature (61): n=a or g
ccacaggttcaaccctgttagcttccccgagaaggccaaagcttcatcgaaccctcctccnacacagcagccgttcttctcttggccgacctgcagaattcctccatcgggaacgatgtgt

SEQ ID NO: 38055 - DNA, 121 bp, Artificial Sequence
  Synthesized
  misc_feature (61): n=t or c
agcatcttcatgtatccttacagtctgccaataattatgctgcaagaacttgctaagtaanagaagattgttcctcgttttgaattcaccatggaattgaacctaattttctttcgaactg

SEQ ID NO: 38056 - DNA, 121 bp, Artificial Sequence
  Synthesized
  misc_feature (61): n=a or g
aaagcattcactgaagtggaaatgcagctaaagaagaaggccttttctcttttagcagacnttcaaacctctaaggaaacccctgcattttacaataagaagaacactataattaacataa

SEQ ID NO: 38057 - DNA, 121 bp, Artificial Sequence
  Synthesized
  misc_feature (61): n=c or g
acgtgattaataaaatagaaagcattggttgattttatttccagcacaaacatgagagctnttgatgcaattagccaaaaaaaacaccaaccccgaagcaccaaacagacaaacaaaaacc

SEQ ID NO: 38058 - DNA, 121 bp, Artificial Sequence
  Synthesized
  misc_feature (61): n=a or g
aacagtaagacccaaggcagtttccctgaatgatttcgtagaatgttatctatatggaggntgccaatgtatggatcactttttccagtgatcaacattctttctaattattttttataaa

SEQ ID NO: 38059 - DNA, 121 bp, Artificial Sequence
  Synthesized
  misc_feature (61): n=t or c
caatccctctgcctccagaacccaagttcccttgagctcatgccagaaaaaactcagaacngggctctttcctgttttggtaacagaactattactcatgctggagcagatggagctcagc

SEQ ID NO: 38060 - DNA, 121 bp, Artificial Sequence
  Synthesized
  misc_feature (61): n=t or c
cacaagggccaaatcagttccggatatgacaaagtgaaaggcaatagtgtaagatctggantttatactaaatattttttcaccatcatttaaacagaagtctgggcattgtattagtgca

SEQ ID NO: 38061 - DNA, 121 bp, Artificial Sequence
  Synthesized
  misc_feature (61): n=a or t
ttcgcttcattaattcatttttgcaaatcctcctggttgggaataaaaagccacaagtccntgtggcaagtttttatctcatcagaaaaagccattagagaaaaataattctcctgtttcg

SEQ ID NO: 38062 - DNA, 121 bp, Artificial Sequence
  Synthesized
  misc_feature (61): n=a or g
aatttagaagatatttggacatgaaaggctatttagtaaggctattgtcccccagactagntaaatattaaacaaactagtatgcatatgttacttgtatattggttaatacactaacaac

SEQ ID NO: 38063 - DNA, 121 bp, Artificial Sequence
  Synthesized
  misc_feature (61): n=t or g
taggggagcacactggagtagtgcacactgccatgctgcagggggtgcaggcagcttttanagccaccctcatctggggttttatggggagagggcctgcaggagttcccttcttgcagag

SEQ ID NO: 38064 - DNA, 121 bp, Artificial Sequence
  Synthesized
  misc_feature (61): n=a or t
ggttcatgcaaccagttataccttacagtaacatgcagaggattcagacaaacctatcctnacgatccataggcatgtgcatatgcatactgagataaattgtagaattggaaatctgata

SEQ ID NO: 38065 - DNA, 121 bp, Artificial Sequence
  Synthesized
  misc_feature (61): n=t or g
ctataagcagtcactgcaggtggatgtgatgcttctgtcgcacaaaaaagaaagcaggctngctcttcaacatacattatcattagcgttcaatcaagtgttagtctctcaatcgctgctg

SEQ ID NO: 38066 - DNA, 121 bp, Artificial Sequence
  Synthesized
  misc_feature (61): n=a or g
cctcccctgcagtgtattgtaagacagagcctcaggaataatcagtactacaatggaaaantcttcttcatatacattacctacaaataactataggtaacagaagtatgtgcaactatta

SEQ ID NO: 38067 - DNA, 121 bp, Artificial Sequence
  Synthesized
  misc_feature (61): n=a or g
attacacaggggacaaaaagcttatcactgcaataaattactttttgctgatggattgctnaggaggtcttttcacctgggaactctttcattcattaattggctgagttcctaacttctg

SEQ ID NO: 38068 - DNA, 121 bp, Artificial Sequence
  Synthesized
  misc_feature (61): n=t or c
gtaggctagttaaagatctgaagctgaaaagaatgagaaagatgtatgaagaggcaacttnctgtagtaaactggaaaagatagagaaggtgaaaagccctttgtttgatagtagctacag

SEQ ID NO: 38069 - DNA, 121 bp, Artificial Sequence
  Synthesized
  misc_feature (61): n=t or g
cagtcccatacgctgcagcacagctcaaggcaaaccagtacagcccagtacaagccagtanaactcagtgtgaaccagcacaactcaacacaattcatcatggcccagcacagctcaaggc

SEQ ID NO: 38070 - DNA, 121 bp, Artificial Sequence
  Synthesized
  misc_feature (61): n=a or c
atgtcatgtttttcacatccaggcacagatgtaccaaagggtctaatggatctattgaccncatctgcagaaaccactgaagaaaatatgaagcaaggcagcactgaagcagctgcctgta

SEQ ID NO: 38071 - DNA, 121 bp, Artificial Sequence
  Synthesized
  misc_feature (61): n=a or g
ctttcctgatccttaaatactgatttaattctctttcccagattcttacacatttgcaaantccattaacagtttgtgttaggaagaacttgaattgtcaactttttatcaattaccacga

SEQ ID NO: 38072 - DNA, 121 bp, Artificial Sequence
  Synthesized
  misc_feature (61): n=t or c
ccacagctaacaaaatgagaagcaaacccagagggcttctcttgcctcttactcaaatagncacacgcttaccagaacacacacccccattgtacagtcctgctacccatacctacaaaga

SEQ ID NO: 38073 - DNA, 121 bp, Artificial Sequence
  Synthesized
  misc_feature (61): n=t or c
aagaattaaaaatagttgtgtagtactcggaatactgacagtatgaattcattctttctcntgttttaattttccttatttacttgtttcacatacaaagagtttttaatggcatgaatga

SEQ ID NO: 38074 - DNA, 121 bp, Artificial Sequence
  Synthesized
  misc_feature (61): n=t or g
tgggctcctggctgggagcagtcaaacttgcagccaccagaaggcactgctccagtgcccnggtaaaagaaaacactcagagagaggagaggaacaaacagcacttactattataaattaa

SEQ ID NO: 38075 - DNA, 121 bp, Artificial Sequence
  Synthesized
  misc_feature (61): n=a or g
ctctggctactcttctcaggtactgcacagcaagtataatggattcattctgtggactgtnttgtatggaagttcttgttactggctgaccatagtctgacaaaaaaaaaaaaagaagcgc

SEQ ID NO: 38076 - DNA, 121 bp, Artificial Sequence
  Synthesized
  misc_feature (61): n=c or g
agaaaaatttcctatgcaatatacctcggttaggatcctcagcagctgcaaattgtgcagnactgtactcagaggagctgtgaccaatttgctcagagatctgtttcttgggacccatcag

SEQ ID NO: 38077 - DNA, 121 bp, Artificial Sequence
  Synthesized
  misc_feature (61): n=a or g
caaggggaatttgacagacctacaactgagcccttggcaatttgaacttgcaacactatcnttgccactaatgacacctaaaaaatattggtacatacataaattcatccatattgaagga

SEQ ID NO: 38078 - DNA, 121 bp, Artificial Sequence
  Synthesized
  misc_feature (61): n=t or g
gcagatcaatgcttcctcccaacatggtctttaaagccttcatccttttgggttatgcatntgaaatttgggaattcagagaggcacagattggtggtaggattaaagtgaagctgggctg

SEQ ID NO: 38079 - DNA, 121 bp, Artificial Sequence
  Synthesized
  misc_feature (61): n=a or g
aatgttagcaaatggcagggtctcttttgcctatgaagccaaatctctgagattggattancagagattgtgtttcagacaaatgtattttagaagtaatgaggaattgtcaaggatagca

SEQ ID NO: 38080 - DNA, 121 bp, Artificial Sequence
  Synthesized
  misc_feature (61): n=a or c
ggggagaagaaggagctaaagcaaatctggaactgcttccccagatgtgcttttcccaagncctgtagagaaaggccttggatttaaaaaatgttctgaactatgctttccagccggtgtc

SEQ ID NO: 38081 - DNA, 121 bp, Artificial Sequence
  Synthesized
  misc_feature (61): n=t or c
ttagcatgtatcagttaaatagcttaaacagtactgaaacatgtggtgaatactttcactngggaaggcattattcaggttcaaatctctatagcatccgttgatggagactgccttttct

SEQ ID NO: 38082 - DNA, 121 bp, Artificial Sequence
  Synthesized
  misc_feature (61): n=a or g
gctgtgcacatttaacacacaatctaaatagtatatcagaggtggattgtagaagagctgntttttgaaagcattaggtgaccttggatagtaaattctgccctgtagctgtgctatattc

SEQ ID NO: 38083 - DNA, 121 bp, Artificial Sequence
  Synthesized
  misc_feature (61): n=t or c
ttgcaaactcactgggatcaataccatcacccaggttgttaatcctgatgttgaacagcgntggcctcagtaccaagtcttgtcacagcaggaatgtgtgcgaatcagaacattccactgg

SEQ ID NO: 38084 - DNA, 121 bp, Artificial Sequence
  Synthesized
  misc_feature (61): n=t or c
ccaatggttttgtttaaaaaaaaaaaagcctaaaagttcttaagttgttgttgccagctgnaggcgagagacctccacagctattggtaaacatccaaacactgactgatctctgcagtgg

SEQ ID NO: 38085 - DNA, 121 bp, Artificial Sequence
  Synthesized
  misc_feature (61): n=a or t
gctaaagaataaaaaaaagagagggattttgagcaaaacattgaaggtgccaaccagctantgaggagtgtgggatgtccgagtatatctgtcccaaaatctctgtgcaaagagattaaat

SEQ ID NO: 38086 - DNA, 121 bp, Artificial Sequence
  Synthesized
  misc_feature (61): n=a or g
tgtctacatcctgcagaatattcgtgccatcggtgcagtgaaaagagtcattaaaaatctncgaggtaaagaatcctgaggtgcctaagctcccactttcagtacacactgaatccactct

SEQ ID NO: 38087 - DNA, 121 bp, Artificial Sequence
  Synthesized
  misc_feature (61): n=a or c
acctaaaagtgacaccgtgtgtcagagagcattgcctgaagtgctgctggcaaagcagaantctgcatcaaagctgtccataggaatatcccatttcagagtgctgaaggttttcagccca

SEQ ID NO: 38088 - DNA, 121 bp, Artificial Sequence
  Synthesized
  misc_feature (61): n=a or c
tgttttgtgtgacagtacactctacatacccagaatgcacaaaaacaccacagaacaccgncctgcccaccagtattttaaaatgcaaatgctttgtggacgctgaactcacttaagtctt

SEQ ID NO: 38089 - DNA, 121 bp, Artificial Sequence
  Synthesized
  misc_feature (61): n=a or g
caagcaccaggagattttttgctcccgctttctgtatgtgccacacaagcgtgtgcgtgcntgcacgtgcaactacggtttggaaggtaaagaggacaaagagatcagggacagcagctgg

SEQ ID NO: 38090 - DNA, 121 bp, Artificial Sequence
  Synthesized
  misc_feature (61): n=t or c
ttcattctgcaccatgtcccttagaaggttttccactgatatctgctcacggggcttgaantcagcctacagtcagcgtatctcagcatggctttactgatgtcagtagagcatcttcact

SEQ ID NO: 38091 - DNA, 121 bp, Artificial Sequence
  Synthesized
  misc_feature (61): n=a or c
attattaatttaggaaagaaatgaactatggtagggcaaggacttgccatgcagaaatgangtatcagaaactattttgaaataaggcaggttgtaaagttctgtgtttcctgcacttctg

SEQ ID NO: 38092 - DNA, 121 bp, Artificial Sequence
  Synthesized
  misc_feature (61): n=a or c
tgtgcagcactgagtaaagccctctttgagcctatcctgagctgcagccatcgggtcccangcctacagggctcgagggctgaaggtgaatctttctgtggtttagggctgaaaagctaca

SEQ ID NO: 38093 - DNA, 121 bp, Artificial Sequence
  Synthesized
  misc_feature (61): n=t or c
tttacatgcacatcagggtgccctgcttagtttagacactaagcttggaatgagccagtanggagtttgttgactctggctggtacctggcttgatcattagccataatttctgtttgtct

SEQ ID NO: 38094 - DNA, 121 bp, Artificial Sequence
  Synthesized
  misc_feature (61): n=a or g
ccaactgttaaattgaagaatcaagttttccttcccaggggaactgcgatcagaaatctangggaaaaaaatacttcccgatttgcaaatacaaagttctaattaatcttttcatttattc

SEQ ID NO: 38095 - DNA, 121 bp, Artificial Sequence
  Synthesized
  misc_feature (61): n=a or g
cttagtggcgccatccatccatagactatggtgactgcaccataggggaaaccattgttcncccagcacacgctgccagaacaacagctctctgccttttcccattgtattcctgagctgc

SEQ ID NO: 38096 - DNA, 121 bp, Artificial Sequence
  Synthesized
  misc_feature (61): n=a or g
taaggaaaaggcagatgaaagaggaggggaagcttcgttagacccaacctggagagctggncagctgaccataaatccctgttgtttgtacagaaaggggccgcggggttttccactctcc

SEQ ID NO: 38097 - DNA, 121 bp, Artificial Sequence
  Synthesized
  misc_feature (61): n=a or t
ctacaaagtgtgaatgggggtatctggctgctcagtaaacatttctgtaacattttaatanaactattaatctcagccaaaaaaaaaacacattcttcactagaatggagtatcacatctg

SEQ ID NO: 38098 - DNA, 121 bp, Artificial Sequence
  Synthesized
  misc_feature (61): n=t or c
gcttgtgaagtgctcaggcattatgtcaactactgcatgtctgcattcattatactagagngggcccacatctattctataaaggcagactatgcaatgcttagattattctctctctcag

SEQ ID NO: 38099 - DNA, 121 bp, Artificial Sequence
  Synthesized
  misc_feature (61): n=a or g
gaaacatggccagcctccagcaagaacattaattatctaccacatatctagcacctctcanctggtcttttcttttattccaaaatagtcgttgctatcttcagtccagcatcatgattag

SEQ ID NO: 38100 - DNA, 121 bp, Artificial Sequence
  Synthesized
  misc_feature (61): n=a or g
ctgaagtctgttattggtttgaggaataaggcacagatcaggcatattgctagactgtacntgtggagggatgtaagaacttctccttacctgctccaggataatgttcttacctctctgc

SEQ ID NO: 38101 - DNA, 121 bp, Artificial Sequence
  Synthesized
  misc_feature (61): n=a or g
ttgagaataaagactttatttcataaaacacttgttaattacgtatggataaatatatccnaggagtgtgtagcggtttggtctttatcccgagatgacttatttatttattcttagctgg

SEQ ID NO: 38102 - DNA, 121 bp, Artificial Sequence
  Synthesized
  misc_feature (61): n=a or g
gtcgctgccactgggcacatggtgaagatcattgactttgggctggctcgaaggtgctgtnctccccttcttccctcgactccttcctccttccatgcctgctcccacccttcagggtggg

SEQ ID NO: 38103 - DNA, 121 bp, Artificial Sequence
  Synthesized
  misc_feature (61): n=a or g
aaaggagcctgattgaagcgctagccttagtgtaatcccagtttcagtgaaaagtcaccantactgaatttcctctggaaatatacaaagagcttactcattgccatacaattgtcttaaa

SEQ ID NO: 38104 - DNA, 121 bp, Artificial Sequence
  Synthesized
  misc_feature (61): n=a or t
tttagtttagaggggattttttttctctgcaagaatagacctttgaaaagaggtcttcggngaagaatgttaatgttacttatgtctatggagctcaggataaggaaagagaagatgaagg

SEQ ID NO: 38105 - DNA, 121 bp, Artificial Sequence
  Synthesized
  misc_feature (61): n=a or g
gaaaagggcaggaagcagagatgattaaactgctggctacatgcacaccagaggaagtgtngggtgcagatgggcatgtgactttctttttctgggagttttccttttgttgctttctttc

SEQ ID NO: 38106 - DNA, 121 bp, Artificial Sequence
  Synthesized
  misc_feature (61): n=t or c
gctccatccaacctgctcttgagcacctccaggtgctggattcccaccccacagtgtgtgnacaacggatgtcctcactgagtatcaattaattctaacaaattacggtgcacaacgagga

SEQ ID NO: 38107 - DNA, 121 bp, Artificial Sequence
  Synthesized
  misc_feature (61): n=a or g
gtctgcatctcctttccaagctgccaggtgaagggggtagcagcccttacagtctgccacnttggtgagagcatcattcctcaagaggacttccaccacatccctgcaagagaaggagact

SEQ ID NO: 38108 - DNA, 121 bp, Artificial Sequence
  Synthesized
  misc_feature (61): n=t or g
accagagctgctctcgtttgctcaaacatccacatctctgcgtatgagcaacagagcaggnaaaggaacggggctctgtagatatggcttacgaagtaaaggtacagaactgggcttcact

SEQ ID NO: 38109 - DNA, 121 bp, Artificial Sequence
  Synthesized
  misc_feature (61): n=t or c
aaatcaaaacagatgtttctacatgtctactatacctttcagcacattatgctaaaatttntaaaactcctatgccatgtgtaacatttcctcttggaaataaaaagaaaactaaacagga

SEQ ID NO: 38110 - DNA, 121 bp, Artificial Sequence
  Synthesized
  misc_feature (61): n=c or g
agccattgctaatggctaatgatgagatactcatcagaagcatgactgctcttaattaaancttgccccatgttctcagagatactgctgcgaacagaggaggtagaaacctcctgtggaa

SEQ ID NO: 38111 - DNA, 121 bp, Artificial Sequence
  Synthesized
  misc_feature (61): n=a or g
aagttatttcagattaattcttttgtgtggctgtgacaaatcactaacaataacatgagtnaaaccaaacactgcagtttcacactgaagttacacaaacacaatgcaactgcagcaagaa

SEQ ID NO: 38112 - DNA, 121 bp, Artificial Sequence
  Synthesized
  misc_feature (61): n=a or g
aagtgagtagtggaattgtggggaaaaaaaaacggcaaaagggttaaggaaaaacagtgantttgagatattagagcttgtgatctctgccagctaaggcagataggtgctggcatgagaa

SEQ ID NO: 38113 - DNA, 121 bp, Artificial Sequence
  Synthesized
  misc_feature (61): n=t or c
acttgggagctacctctagtatggttcaattagcagtgctgttactcatggaatgaggcantttcaccacaatcaattcacttctttttcgtagctgttggtaagggatgagctctcagca

SEQ ID NO: 38114 - DNA, 121 bp, Artificial Sequence
  Synthesized
  misc_feature (61): n=t or g
taatatctgtgatggttcttcactttcatggcaattagtcagaaatgcttaaggttgtaanatacaacctaaaaactaggaaagaaacagaattacagtcactttctaagtattttaacta

SEQ ID NO: 38115 - DNA, 121 bp, Artificial Sequence
  Synthesized
  misc_feature (61): n=t or c
ggacgtcataggactggctttccccacggatgcggagctgtcagtaatgctgacacgtaanaacctgagtagtgtttggttccagggccttctactcggctcgaatggtatcttcccttga

SEQ ID NO: 38116 - DNA, 121 bp, Artificial Sequence
  Synthesized
  misc_feature (61): n=t or c
ttgtacaacatggtgaaaaaaagactacgacccaactggctctgcttcctgcactttgcanagtcaaagtgctaaggaaaggtaaggtcagtatatgataagaccagctggagtgtaacag

SEQ ID NO: 38117 - DNA, 121 bp, Artificial Sequence
  Synthesized
  misc_feature (61): n=t or c
atgcagagaatttgcagcagttttgaaatgaggtattggagctcctgtctgaactggcagnaaggctgggaatgggagatccagggaccagacacttcttgagcttcggggctggcttctg

SEQ ID NO: 38118 - DNA, 121 bp, Artificial Sequence
  Synthesized
  misc_feature (61): n=a or g
ctaaaattggttttgattatgactgaatcctgtgtacaaggatggtctcctttaaagagcntcttctgtctggctgcatgcttggtctggccttaatttttaagtgcttttttttgattct

SEQ ID NO: 38119 - DNA, 121 bp, Artificial Sequence
  Synthesized
  misc_feature (61): n=a or g
attagatcttgtaaaaacagctgggaagccttccactggccatcataggctgagtatcagncactctgtcttaaaaatgattattttctgtactagagctgcttctaaaaccccgcagtga

SEQ ID NO: 38120 - DNA, 121 bp, Artificial Sequence
  Synthesized
  misc_feature (61): n=t or c
tatcaccttacccctctgccaaaatattactgctctctagaaaggtggctgcaacaaacantggcttttcattcccttgtagttgacatcctggcatactaagccagaatggatcactgag

SEQ ID NO: 38121 - DNA, 121 bp, Artificial Sequence
  Synthesized
  misc_feature (61): n=a or g
cactgctgttgtgctctttgtatttgttgtagtttcgatggaagcgttacttttggaaccncttatatattattggtgcaacacatgtaatttccctttcatcaaccagttatagaaaaag

SEQ ID NO: 38122 - DNA, 121 bp, Artificial Sequence
  Synthesized
  misc_feature (61): n=a or g
atactcccatttctatatctattcagtacgttcacagaactgctcatcagtctgtattctncccaatgtggcctagacagtttattaccctacagccttcatgtataaaaggaatctctct

SEQ ID NO: 38123 - DNA, 121 bp, Artificial Sequence
  Synthesized
  misc_feature (61): n=a or g
ggtttagaaaatcctaccaagatctgtcatttgtgagttttactagcaattattttaccantagttttaagctactaagctaagaaataacaggctgaaaatgtatttctgattagcctga

SEQ ID NO: 38124 - DNA, 121 bp, Artificial Sequence
  Synthesized
  misc_feature (61): n=a or g
agagacatcctgcagaggtgaccacatttgcccacaagccctgtgctcaactttggacttngaaagaaaattgtaaaatttaagcatcttgttaaagaacatatacaaaaaaagattatat

SEQ ID NO: 38125 - DNA, 121 bp, Artificial Sequence
  Synthesized
  misc_feature (61): n=a or g
gactgagtagtggggtaacatttgttgactgagcagtgtggtaacacttggaaattacacnggcatagacaagatagtccaagtgaaatatgtctatgaggaacctctcttggagtatgga

SEQ ID NO: 38126 - DNA, 121 bp, Artificial Sequence
  Synthesized
  misc_feature (61): n=a or t
acgtgcagaagggctagagttcggaggagatattattatttcatatacaactccaagggtngctgtgtgtatttatcagcttcaaagactcactgctgctataacctttacaaaaactctt

SEQ ID NO: 38127 - DNA, 121 bp, Artificial Sequence
  Synthesized
  misc_feature (61): n=t or c
ggttacagaaacattgtgctgggagatccaggcttattctcggggcagtaccatgcatttnaagtgctgctgagcctaagcaaataaactcagcctactaaactgaccatgcaaagaacca

SEQ ID NO: 38128 - DNA, 121 bp, Artificial Sequence
  Synthesized
  misc_feature (61): n=a or g
tttaattttttctctatttaagatcatttaagatctagactccttttgttttcaacattcngaagtcatataggtagcttttacatatctagatgtacatatctacatatctagtagcaac

SEQ ID NO: 38129 - DNA, 121 bp, Artificial Sequence
  Synthesized
  misc_feature (61): n=c or g
tcccgagagtgcaaggtggtgtccataatccaagacttctcagttaattcaggcatccacncttccataccgacggtaaggcatttccaggtctcccacggagcacaccagctcacccccc

SEQ ID NO: 38130 - DNA, 121 bp, Artificial Sequence
  Synthesized
  misc_feature (61): n=t or c
gtcttccctagattttttatgggttctcctcaccagacatttccctcccaaagatgccagnatcatgtctaacctctgtcaactcacatctttgatgagcagtgcaaacttccttcattaa

SEQ ID NO: 38131 - DNA, 121 bp, Artificial Sequence
  Synthesized
  misc_feature (61): n=t or c
agatttctacctccacgagctaccccagccccctacttcctattcctcttagcactgaacngctgatacagtccactgcagctgcagtgagacctgtgccacccaaagagcaaccatttta

SEQ ID NO: 38132 - DNA, 121 bp, Artificial Sequence
  Synthesized
  misc_feature (61): n=a or g
tcacacaactgtccaaagaagccacgtgaaatacaaaaacgacactaagagtaaaaccaangacttctgagtaaagcagaaaatgtttatttgaaaattctatatttcctgacataaaact

SEQ ID NO: 38133 - DNA, 121 bp, Artificial Sequence
  Synthesized
  misc_feature (61): n=a or g
taggggacttggaatgttaatttatttattaggtcattcaagggtcagatatagaaataangaatgcctcttatattaacttgataattctgaaatgcctttcactttgtttacagcatat

SEQ ID NO: 38134 - DNA, 121 bp, Artificial Sequence
  Synthesized
  misc_feature (61): n=c or g
gttgtagctgattttgttgtttttatgagtataaagagattttcctaagtttatatgccanaacaacaggcaaaaaattactctgtgatgcattttatggcaagtatccaacaaaaagaag

SEQ ID NO: 38135 - DNA, 121 bp, Artificial Sequence
  Synthesized
  misc_feature (61): n=a or g
gtgccactgtaatattgtctgccaccccatcttgcccaatgtatacatcacatggtctgcntgatcactttgcttactgatcttgggaggcacagtgcaaacgtgaccaggttgccttgct

SEQ ID NO: 38136 - DNA, 121 bp, Artificial Sequence
  Synthesized
  misc_feature (61): n=a or t
tcatgaaacttgtccatggagtcagtcttacacaaacagaagtctaagaattccagaaaangtccattttcaggtagaaataaatagtcataggctaaagaccaagagacaagaaacagag

SEQ ID NO: 38137 - DNA, 121 bp, Artificial Sequence
  Synthesized
  misc_feature (61): n=a or g
aacaaagccacaacttatccacatccttcagaataacacacgttcaattttagtacaaggnacgttcccactgcatgtacaagtctttgaaggaccagaggtaactaacagtgcaaggcag

SEQ ID NO: 38138 - DNA, 121 bp, Artificial Sequence
  Synthesized
  misc_feature (61): n=t or c
cacctaaatacagtgaaaccatccaacacagccattgctttcccttccaaactgcccgggncacacacagctgtaccagcctgaaagatgccccactattgccattactactacttcgtca

SEQ ID NO: 38139 - DNA, 121 bp, Artificial Sequence
  Synthesized
  misc_feature (61): n=a or g
ctgggctccataaacacaaggcagggctcaggggcaggtggtttttaagctgctgccatcntaagctcttgttttaacaggtgagcaatggatctggctggcatttttttttttcagattt

SEQ ID NO: 38140 - DNA, 121 bp, Artificial Sequence
  Synthesized
  misc_feature (61): n=t or c
atctcagccccctaaagcacaagcaacctgcacacccagtgagctcgctgcagccatggcnggaccacagagatgcccacatctccagccatattcccatcagtatttacatacagtccag

SEQ ID NO: 38141 - DNA, 121 bp, Artificial Sequence
  Synthesized
  misc_feature (61): n=a or g
tgatttttttctaatttatttagcattgccataatttgttcaaagcagttattggaaggcnttctactttgttattatttattagcttgtggcatcacatattgatgcctggaacgattgc

SEQ ID NO: 38142 - DNA, 121 bp, Artificial Sequence
  Synthesized
  misc_feature (61): n=t or c
ttttagcctaaaacagtgtcctgaaagatacgcaaggactttgtgcagttcatattgagcnctggaaacttttggctcattatcagccagcgccagcttttggggtgacaatttcccgtgc

SEQ ID NO: 38143 - DNA, 121 bp, Artificial Sequence
  Synthesized
  misc_feature (61): n=t or c
gctgagcaagaacttcataagggaacctgtgacttagtctaccttatggcccttagaaaancagccaaggaagaggaggcagagttagcaactgcctcaggcagatgtctccagctggaca

SEQ ID NO: 38144 - DNA, 121 bp, Artificial Sequence
  Synthesized
  misc_feature (61): n=t or g
aatgaaattgaagcatgaaaagtgaaaaataaaaggaaatgaaattcgtactggtaagacntgctgcacaaagattagttgtctttcttctcagttgcattctgagtagtgctttatataa

SEQ ID NO: 38145 - DNA, 121 bp, Artificial Sequence
  Synthesized
  misc_feature (61): n=a or g
caatttcaataaaagttgccacttgttggcaggtagctcagactttcaggcaacaagagcntgcttttcccacagttgcgtgttctcaatttatatctaaacagtacagtagcacgagcac

SEQ ID NO: 38146 - DNA, 121 bp, Artificial Sequence
  Synthesized
  misc_feature (61): n=t or c
caccttcaaacctcacagatgtgaagctcaaaagcagacctgtattgctgttttatattcncagctcttcacactctaattcgctttttgtagcttctgtcacctttgcacatctaggaag

SEQ ID NO: 38147 - DNA, 121 bp, Artificial Sequence
  Synthesized
  misc_feature (61): n=a or t
tattttgctttgcacaactgatgttattttggacaaagaccacttcatcatctattttgtncagtacccaaatctttacattttaaacatttaccatactggctcaaaattaaactcccat

SEQ ID NO: 38148 - DNA, 121 bp, Artificial Sequence
  Synthesized
  misc_feature (61): n=a or t
agatcttcagcagggctgtcagagagctgctgggctgtctcagcagagaaggagaaagggnttttcacttcttgcactcctaccttgcctcttccgaggctttcctgcatggcttgatcct

SEQ ID NO: 38149 - DNA, 121 bp, Artificial Sequence
  Synthesized
  misc_feature (61): n=t or g
ttgatataaggcactatatgaaaagctgaaagagtgatcacatctccacaaaatttgttgntttctcatatatgaatggaaaagttatggctgatttcaggagaaacagcctatgacatag

SEQ ID NO: 38150 - DNA, 121 bp, Artificial Sequence
  Synthesized
  misc_feature (61): n=a or g
agaaagggaacactgcgacaaaaaacacaccaagacacaacaaagactttccaagcctggnaagtctttgagctttagctgtgttcctttgagtagagggctgctctcttctatacaagga

SEQ ID NO: 38151 - DNA, 121 bp, Artificial Sequence
  Synthesized
  misc_feature (61): n=t or c
agagaggtcaaaaacaagcctgccggagctcaggacactgcacctatactgtcctcatctnccatctccactttgaagcaccaaatattcccctctgaaatggctgagtggattcacacag

SEQ ID NO: 38152 - DNA, 121 bp, Artificial Sequence
  Synthesized
  misc_feature (61): n=t or c
gtgtgacagaaatatatcgatgttgagatggtttcgtttgttgatcaagcaagttcacttntatatttttattatcttagcttttcctgggagtcttctaggctctgagttttgtgattta

SEQ ID NO: 38153 - DNA, 121 bp, Artificial Sequence
  Synthesized
  misc_feature (61): n=a or g
tgcagctcaagtctattttatcattctaagactaatcactttctagtagcactgtgtactntaagtttgtgcaccctcagctgtcttcatcctctgcactgatggtagggaaagggttgct

SEQ ID NO: 38154 - DNA, 121 bp, Artificial Sequence
  Synthesized
  misc_feature (61): n=t or c
gagctcagtataggcaacaaataaaagacccataagcacataaagtccagtgcccatcccngttccattttacatcctcactattcacctttgtgccctttgggaaaggacagtgctacga

SEQ ID NO: 38155 - DNA, 121 bp, Artificial Sequence
  Synthesized
  misc_feature (61): n=t or c
tttctgtggaaggtctcataatgtgttgataccatccgtcccactgctggagttacagaantctgtcacagccttgccttttggtttaaaaatacattccatcactcatctttctagaaag

SEQ ID NO: 38156 - DNA, 121 bp, Artificial Sequence
  Synthesized
  misc_feature (61): n=t or g
ttctttgtgaaagctatctgttatgtgaaagatgcttatttccagcccatctgtaggtatngagctatacttctctgaagggtgcataatgctgggagtagttacctattaaaacagttca

SEQ ID NO: 38157 - DNA, 121 bp, Artificial Sequence
  Synthesized
  misc_feature (61): n=t or c
tttcctctgggtcctttccgtatcagctctgctcttctcaatattttgacagcccaagcancccctgtttacttctgctcctcccaaccctatcttcactctgagcatgagtcatcacagc

SEQ ID NO: 38158 - DNA, 121 bp, Artificial Sequence
  Synthesized
  misc_feature (61): n=a or g
tgcagggaacgcagtgctgcagcagccctgtgcagaacagcccatccttgtcccatgcacnaggcccagctctgccttgcagctgcttctcacctaatcccaccattcctgttttccagcc

SEQ ID NO: 38159 - DNA, 121 bp, Artificial Sequence
  Synthesized
  misc_feature (61): n=t or c
acgaggatgtctgcctccataataactcttctttcctttcctctcccttgcagaaatccgngaagctttccgggtgctggacagggatgggaatggctttatctccaagcaggagctgggc

SEQ ID NO: 38160 - DNA, 121 bp, Artificial Sequence
  Synthesized
  misc_feature (61): n=t or c
accattcatttctgtttaaatttgctcacagcagattcaggaggactattttcatccttcngaaaaggcctttttaaagcactttgcatttatagggctactcagattatttcccatatgc

SEQ ID NO: 38161 - DNA, 121 bp, Artificial Sequence
  Synthesized
  misc_feature (61): n=t or c
acttaggtggaaaggcaggttaagcgtttaccacttctgctgtaagtaataaaattttatncacttatatggcccaagggcctggaactgtttgtatttactcattattattatgtctacc

SEQ ID NO: 38162 - DNA, 121 bp, Artificial Sequence
  Synthesized
  misc_feature (61): n=a or g
agtcttctgtaattcttgatttgggttgtttttgtcaacactgtggtgctgcaaatcatcntgatttggctttatcctggcaggagagagttgtctggtttgtatgggcatgtttgggctc

SEQ ID NO: 38163 - DNA, 121 bp, Artificial Sequence
  Synthesized
  misc_feature (61): n=a or g
atacctttttccaggcattatcttcatgatacgcaggcacactttgtcttgataacatcangttatcaaaaaaataagtgatgcctttcttttcccatcgagatgacatcaaatcacagat

SEQ ID NO: 38164 - DNA, 121 bp, Artificial Sequence
  Synthesized
  misc_feature (61): n=a or g
tcagcatttatcattacaggtttggacacagtgctgagattattgattaaccacttaaatnatttccaaatctcatattggatctcaatctggaatacaaaatgaattctccagttcttag

SEQ ID NO: 38165 - DNA, 121 bp, Artificial Sequence
  Synthesized
  misc_feature (61): n=t or c
aaataaaggtgtgttgttaaatgtcttgattaatgattcctcagcctccttcatgtcctcnttgcctgcttaccaaaactctcacaaagttaccagcactgaaaaagacacagctccaaag

SEQ ID NO: 38166 - DNA, 121 bp, Artificial Sequence
  Synthesized
  misc_feature (61): n=t or c
catgctttgccctactcacgtcaggatttaaatctacagttttactgcagacatataaaanatggctgaggcttttccaaaactatacatttaacacatagaacattatgtacaaaatcat

SEQ ID NO: 38167 - DNA, 121 bp, Artificial Sequence
  Synthesized
  misc_feature (61): n=a or g
agtgtggtgcagatcaaaactgtgccaaatggaaaaaattcagtttgaaattaccggaaancataaaacagttgaataaataagaatctaattgaaatatgaactctggaagttgtcgtct

SEQ ID NO: 38168 - DNA, 121 bp, Artificial Sequence
  Synthesized
  misc_feature (61): n=a or g
tccactgagatatgttttaaaatttgtttatgcttgtgccttctacagagctcggcagcantgagttctgcagttggtgcactgaatgaaaaattacttcttactgagtgctaattttatt

SEQ ID NO: 38169 - DNA, 121 bp, Artificial Sequence
  Synthesized
  misc_feature (61): n=t or c
aggaagtaatatccaaatgatgagtgggaagttaaactgtagttttcttcgagtaaaatgnttgagaacaaatgttttctgcaaaatgttttctagctgctcaattttaagagcaaagtct

SEQ ID NO: 38170 - DNA, 121 bp, Artificial Sequence
  Synthesized
  misc_feature (61): n=t or c
actatggagtgactgctattaagagaggaagcaaaaagttaaccctttgtacctcctgacnggctgattcctcagtagctacaaacctcctcagccaccacttatctggctcaacggtgca

SEQ ID NO: 38171 - DNA, 121 bp, Artificial Sequence
  Synthesized
  misc_feature (61): n=t or c
tggggccaggatggagactgacagctccctctgtaatgacagagctgtgtatttcatcacngtgattttaattacagtgcactcggggtaaacacagtcagactgtagctctgagggcact

SEQ ID NO: 38172 - DNA, 121 bp, Artificial Sequence
  Synthesized
  misc_feature (61): n=t or c
aatattttcatctgtcatttggtttgataggatgaaaagaccatgaaataaattataatcngttacagctggggaacaaataaataacatatactaatatactttggccttcttataactg

SEQ ID NO: 38173 - DNA, 121 bp, Artificial Sequence
  Synthesized
  misc_feature (61): n=a or c
tacatgaatctcttcctctctcctgtgtccccttctcccatgagtcatcacattcactganacagttgaggaatctaaggtgggaaagtgttttctgatggacactgaggaacagacaagt

SEQ ID NO: 38174 - DNA, 121 bp, Artificial Sequence
  Synthesized
  misc_feature (61): n=t or c
gcacaacaagcaggtattccaggacatgagctcatacagccactgcactggcgagcagctngtgccatttgtgctccagtaaataaacaaacgctatattcctattgcattaacaccagtt

SEQ ID NO: 38175 - DNA, 121 bp, Artificial Sequence
  Synthesized
  misc_feature (61): n=a or g
tgtttttcttttgcccttccccttcatatcaagggatcacttatgaaggaaaccaatgaanttacttgatatgtcaacatctacagtgtaggaaagtaggggaaaaatgttgcatatattg

SEQ ID NO: 38176 - DNA, 121 bp, Artificial Sequence
  Synthesized
  misc_feature (61): n=a or g
tcattagagatgaatttgaatggttgccccctccagcagtgactgtttctaagactagaantgccagggtaaaaaatttgccaaagggatattttcagatattttaagatcaggcaggctg

SEQ ID NO: 38177 - DNA, 121 bp, Artificial Sequence
  Synthesized
  misc_feature (61): n=a or t
aattcaggacacattgtactaaactttaacataacagtcaccaggaaagtcttcctgatgnttgtgatgatctgcctaagtctgaatatattattatgcttaaaagggtttctttttgtct

SEQ ID NO: 38178 - DNA, 121 bp, Artificial Sequence
  Synthesized
  misc_feature (61): n=t or c
aggcctaatttagctccatcctgcaggaaaggtgactccttccacagtctgtccaactccngcacatcccacgaggggagcactgcactgcagcaggagctgcgcagggcccagcgtcagt

SEQ ID NO: 38179 - DNA, 121 bp, Artificial Sequence
  Synthesized
  misc_feature (61): n=t or c
gaatctgcggagtttgtaaattctcgaggtgctctcgtatgcaatgagatgctcaaacaangaagttccagttaaaaaatcatgactaatcagtagtaatgttcctaagtactgctagctt

SEQ ID NO: 38180 - DNA, 121 bp, Artificial Sequence
  Synthesized
  misc_feature (61): n=a or g
aggtgagacctgatacagacagcccgattttcatacttaagggacagaaaaggcaacggtngttatttggtccaattagctaaaacgaagaaacaaaaaggaagaaacttcagcaaaagca

SEQ ID NO: 38181 - DNA, 121 bp, Artificial Sequence
  Synthesized
  misc_feature (61): n=t or c
aaaaacatctgtcaacataatgctgctatgtctgattttctatagggacagaaaatgctgnaaccagctgatgtgttccttgccttattttctgtgactttaaattgtgcacgatcttgtg

SEQ ID NO: 38182 - DNA, 121 bp, Artificial Sequence
  Synthesized
  misc_feature (61): n=a or g
ttcttgctgaacacggggataaataggaaaggaagatccaagtatctttcaagcaacaaantcctcaaacgacgtaaaatgtaccgctccaggtgatgaagcactacgctgctttacagag

SEQ ID NO: 38183 - DNA, 121 bp, Artificial Sequence
  Synthesized
  misc_feature (61): n=a or t
atgctagaaaattttaatactatttctgtgccagttcactcaaggtcaccctgcttgttantggttttacatggaatttgtagatgctgcccataaatttaatgccttttaataggctttt

SEQ ID NO: 38184 - DNA, 121 bp, Artificial Sequence
  Synthesized
  misc_feature (61): n=t or c
tagcttcttcatatttcaatgtctaggatggggtttgtaaccaaacaacactgccaaaaangaagaagaaccctgactaacctgtaagtttacgagggagcaccaggatgactgtcctggt

SEQ ID NO: 38185 - DNA, 121 bp, Artificial Sequence
  Synthesized
  misc_feature (61): n=t or g
cagatgctagagcctaaagaaggatgtgcaaactgtgaaacataagaaaacctgactgtcntgagggaaccgtgtgctaatgtgtcattcttgggaaaggaatttctaggttttaattttt

SEQ ID NO: 38186 - DNA, 121 bp, Artificial Sequence
  Synthesized
  misc_feature (61): n=t or c
agtctgttgctgcgagcatcccaatagaaatatatggctcgtgcctgaccacttcaccttnctatctgatttctgtgcagtgtatttccatcatttcagcactgatctggctggcccaagc

SEQ ID NO: 38187 - DNA, 121 bp, Artificial Sequence
  Synthesized
  misc_feature (61): n=a or g
tttcaggaacatcctctgttcctgtccctggctgggatgtgagccatgtgcctgtgcacanggttagttctaggacagtgagcaggtgggagaggggtggatttgggattgtggcagcaag

SEQ ID NO: 38188 - DNA, 121 bp, Artificial Sequence
  Synthesized
  misc_feature (61): n=c or g
ccacaccaaggagctaaattgcagctacactgcagctgtgcctgtgcccatgtctgtagtncagaccttgcccttcacacactctattggctttctgacttgaccttggatctgcctcatt

SEQ ID NO: 38189 - DNA, 121 bp, Artificial Sequence
  Synthesized
  misc_feature (61): n=a or g
ctgtatagagaaatcacagtcttgagaagagcttcatccactctgatcttgaaagcacccngggtgggaatctgctcctccagggagcagcttgctctgctgcctgctatctatttaatcc

SEQ ID NO: 38190 - DNA, 121 bp, Artificial Sequence
  Synthesized
  misc_feature (61): n=a or g
aacacattcagaggatcttttacagctcctggtgatgaggagggttgtgggcagcaaagtntgtcacctacatgtttaccagctgcaaagctgaaactgatagtagggtacaaatggagat

SEQ ID NO: 38191 - DNA, 121 bp, Artificial Sequence
  Synthesized
  misc_feature (61): n=t or c
ctaatagacatcgatgtaatttgttttctgagcagcattggggaaatgtgcattgctcgcngaacctcccatttgcattgaaggaagtcataatttgagcgaagcgtgaaacactcacggc

SEQ ID NO: 38192 - DNA, 121 bp, Artificial Sequence
  Synthesized
  misc_feature (61): n=t or c
ctgttaaatgatttttttttacatggaaatttcattgatgagatgaagaactttctgagcnaaagggatgggaagatgtgtatcaaatctatggggagatttgaaatcagaggaacgttta

SEQ ID NO: 38193 - DNA, 121 bp, Artificial Sequence
  Synthesized
  misc_feature (61): n=a or t
ttctgtatacaagctgacaagtcccaaccctagtataattatttgccctgtcaaagtacanaagtggcaaggaagcactacactgatgggctacaactgctaagaaaattctagattggag

SEQ ID NO: 38194 - DNA, 121 bp, Artificial Sequence
  Synthesized
  misc_feature (61): n=a or g
ttgagcaatgaacagtccctttaaataacgaggtgtacagaaacactgatgtgtagagaantaaaaaatccagccttttcagtttatcatattggcttataacttgggagaaacctatgct

SEQ ID NO: 38195 - DNA, 121 bp, Artificial Sequence
  Synthesized
  misc_feature (61): n=a or g
ttgtccttttgagctggaccctatgaccaaaagggattcctcggtgatgcaggtatgtaantattagctaaaagatactgaggctagcaaggatagagacactgactttacgtaaagttag

SEQ ID NO: 38196 - DNA, 121 bp, Artificial Sequence
  Synthesized
  misc_feature (61): n=t or g
aatacatagttaccagaagtacacatttaggaacgttttcaaccaatagttattttctccnctcggaagaaaccccaaggtctgtttctaaatggccaaaaagtattggcttcctacactg

SEQ ID NO: 38197 - DNA, 121 bp, Artificial Sequence
  Synthesized
  misc_feature (61): n=t or g
ttaaaaccttgggaattctgtttatggagcagaactttcctgctatgggggcacagccacnctgtgggcaccactctgagctccactccagcactgctcccacctcagtttccccaacgtc

SEQ ID NO: 38198 - DNA, 121 bp, Artificial Sequence
  Synthesized
  misc_feature (61): n=a or c
agttgtattgactttcagtctattgagagctatgcttttactcccaaatgagaagttagangctgcagacctcacaagaccaaggtgtacctacagttcctacatttatttacgaaccatc

SEQ ID NO: 38199 - DNA, 121 bp, Artificial Sequence
  Synthesized
  misc_feature (61): n=t or c
tatacaaaggggtattctgaatataggaagaaaaaactataggtagggaaggtagagcagnaatgagttaaaacactgtaactggagcagtgagagagaatatatgaactgaagtgaaata

SEQ ID NO: 38200 - DNA, 121 bp, Artificial Sequence
  Synthesized
  misc_feature (61): n=t or c
aggggttgagaggagaaacataacagactggatggactcgcagaagtaccaggagatgganaggtgcaaacatatgctctccaatgactttactctctgagaaaagcagcacgcactgctt

SEQ ID NO: 38201 - DNA, 121 bp, Artificial Sequence
  Synthesized
  misc_feature (61): n=t or c
actctgttttggggtaggcgatcagtcatgaatttgggtctggattaatgggcagaccaangcagctgacattgctgcatttgcctgctgtaacagaggccttcttcagcttacttcatcc

SEQ ID NO: 38202 - DNA, 121 bp, Artificial Sequence
  Synthesized
  misc_feature (61): n=a or g
aaaaacagcatcctaacctgaactccttctctaaatgctgtattgtgaggctgttgaaacnatggctaaatgatttgaaattatatcttgtactctgggtttatacttttccagcatcctt

SEQ ID NO: 38203 - DNA, 121 bp, Artificial Sequence
  Synthesized
  misc_feature (61): n=t or g
cttgcaggtaattaaaaagtgcacacgtaaaagggaaatctaacaaaatccagcaacgagncctcacagtctttgaacggatgaagacctgatttaaaggaaaaaggaaagcacccacaaa

SEQ ID NO: 38204 - DNA, 121 bp, Artificial Sequence
  Synthesized
  misc_feature (61): n=a or g
cacgtagcaaaaataccagagattgagagactgaaacttgactaaaaacttgagtaaaccntagtctcaaatgctcatgacttaagtcaaagttcatgaagataccactaaatatgacgca

SEQ ID NO: 38205 - DNA, 121 bp, Artificial Sequence
  Synthesized
  misc_feature (61): n=t or c
tgctctacagaggatttaaatgatagccttaacatttgtttgggataaatactttcaacantgcggagttttcctacatgtaggaggaattaaaagtggcctctgctgtataaactgactt

SEQ ID NO: 38206 - DNA, 121 bp, Artificial Sequence
  Synthesized
  misc_feature (61): n=t or c
gaatttctttgatgacctcagaattgccttcattctgaaaactaagctacatttattattngtctagttttaggactctggctctgataattttcctttgcaaattttgagaaatgggaaa

SEQ ID NO: 38207 - DNA, 121 bp, Artificial Sequence
  Synthesized
  misc_feature (61): n=t or c
agaacagttattgcagcaaggcgtggaatctgaaacacttttttcttgcacagacttatgngctataagggatggaaaactattttttttgtgtagcaacgttttattcccctttagttct

SEQ ID NO: 38208 - DNA, 121 bp, Artificial Sequence
  Synthesized
  misc_feature (61): n=c or g
taattatacgtttgcatttctgtccacttaaaatctatgaattaattacatcagacttctnaaagctaaggagtggtagatgtggccatgtaaacttaaaccaaaatttattcactgaaca

SEQ ID NO: 38209 - DNA, 121 bp, Artificial Sequence
  Synthesized
  misc_feature (61): n=t or c
gcatagtgcttgttttcagtgaagaccagcaaaaccataactagagttaatgactgaccanctatgcaaatctcacctaatcttgatttctactcccggaagtgtgctgatggccacctgt

SEQ ID NO: 38210 - DNA, 121 bp, Artificial Sequence
  Synthesized
  misc_feature (61): n=t or c
ttgtcatttctgcacaagctgtacaagtagtgatttttgtttctgtgacagataagcctcnagagctcctcagctgtgtgttgccatttaactgacttttatgcttgtttgtttataagca

SEQ ID NO: 38211 - DNA, 121 bp, Artificial Sequence
  Synthesized
  misc_feature (61): n=t or c
tgtagattgctagtgaccagggggccacactgaacactacattttcaggtctaaccaacangagcctgactaatggagaaactgttgcaacctttcaggtaaattctataaatattaatat

SEQ ID NO: 38212 - DNA, 121 bp, Artificial Sequence
  Synthesized
  misc_feature (61): n=a or g
acccgcagagcggagccctgggagtactttgagctgtgatcttaaacacaagagctcgatnaactgggggtcattgtcctcagttcccagatcccaacttataggggactggtgtgttaac

SEQ ID NO: 38213 - DNA, 121 bp, Artificial Sequence
  Synthesized
  misc_feature (61): n=a or g
cacaatccagaggccagcattcatcctgtaatccaaaccaaaggagaatgtaaactctgcngagttaaacacagcgtcttgcctgcttcctctctcacacgttcccatctccagcagacaa

SEQ ID NO: 38214 - DNA, 121 bp, Artificial Sequence
  Synthesized
  misc_feature (61): n=t or c
agggctgtggggtcaccaggcaggtgtgatgctgtgagccacgccaggcctatttcttgcncagagaacccagcagtttctgtggaaaaacattccccagtgaaacttcttgggttggaaa

SEQ ID NO: 38215 - DNA, 121 bp, Artificial Sequence
  Synthesized
  misc_feature (61): n=t or c
aacacagtgtgtataagtggggggactgcatgaagactgaccactgagctcctggagagcngtagggttgggaggggagaaactgttgtctccacactgtggggctgcttatgggatttta

SEQ ID NO: 38216 - DNA, 121 bp, Artificial Sequence
  Synthesized
  misc_feature (61): n=a or g
cacaaaatatctacaaatatcagacgttttttcatggcttcaatgaaagatttttgggagntagattattatgaattcatgtattttgctccatatttgtattcatatattcatattgtat

SEQ ID NO: 38217 - DNA, 121 bp, Artificial Sequence
  Synthesized
  misc_feature (61): n=t or c
agttttgaatcatttgttaaagtaaggctaatggaaaaaaaacttatatcttctttaccgnagtaaaatgttttaatgtggtgctgatgtcattaaattgacagacttctttataatcttt

SEQ ID NO: 38218 - DNA, 121 bp, Artificial Sequence
  Synthesized
  misc_feature (61): n=a or t
caatggaaatccacccgttctacaccatcctgggtatcaccttagagagcaaccagagagnggccctgattttggtggagtccatcatggctctgctggaatccaggagctgtgaagccac

SEQ ID NO: 38219 - DNA, 121 bp, Artificial Sequence
  Synthesized
  misc_feature (61): n=t or c
tttccccctcttcaaaccagggctcaacaggaagctgggctagaacatggatcctcctccngagtccccagtctgctctccatggtaataccaggtagagggaggaaatgcatgggattct

SEQ ID NO: 38220 - DNA, 121 bp, Artificial Sequence
  Synthesized
  misc_feature (61): n=t or c
ccccaccatcccccattctcattacatttcaaggactttaatatctgtgctgattttgtgntctcaagtagcatattttcataaaaattaaattatttctactatggaatgcttaattgtt

SEQ ID NO: 38221 - DNA, 121 bp, Artificial Sequence
  Synthesized
  misc_feature (61): n=t or c
caagactattacccaattgccagttcaactgcataaatttatttggaagctcatagctccngaagagatcaatatagaaatcacttctccatcactgaaactgcggcaacacctcccagag

SEQ ID NO: 38222 - DNA, 121 bp, Artificial Sequence
  Synthesized
  misc_feature (61): n=a or g
tctgtttttatgactattcagggacattcaatgcaacttaattaagttatattctagagcncttgcataagtgtcctgctggcattgctttttaatattttgtaagtgattttttcttttt

SEQ ID NO: 38223 - DNA, 121 bp, Artificial Sequence
  Synthesized
  misc_feature (61): n=t or c
accaatatttcatcctcattcaatcgctggttctctctatataccctatgggcctatctangcctatttgtaaaagtggaagtgactgcaaatgtgctccttccccacagtcctcactcag

SEQ ID NO: 38224 - DNA, 121 bp, Artificial Sequence
  Synthesized
  misc_feature (61): n=a or g
tagagcaggaaactggaaatagtagtagatatataggagttagtaatggctgtgactcacnctttggtctgttcatgaccctttctctcctgtggagggctcccaaattcactgaagcctc

SEQ ID NO: 38225 - DNA, 121 bp, Artificial Sequence
  Synthesized
  misc_feature (61): n=a or c
ttcattctgggaatctatgcacaagacttttttctctttggctttttcaaggggggaaganggaataaagttttgcacctgcgggttcaaagacaaaggtctccatctgtcacacttctag

SEQ ID NO: 38226 - DNA, 121 bp, Artificial Sequence
  Synthesized
  misc_feature (61): n=a or t
tgctaccatactgacaaaaaacccagcttctacatgttaatattttctaaaaccaaaccantgctgaacaactactgcttttctttacaactgatgcaacaactaaaacacattaattact

SEQ ID NO: 38227 - DNA, 121 bp, Artificial Sequence
  Synthesized
  misc_feature (61): n=t or c
catggttacccatgaggttgtcattgtcaagtagtgaaactcttattgcttcttacaccanatgcattatttaccaatagcctgatttcatcccatgtttttcttccaagcaatgaaggct

SEQ ID NO: 38228 - DNA, 121 bp, Artificial Sequence
  Synthesized
  misc_feature (61): n=a or c
ctctgaactgtttacatctttcctatctgtaggatattaactcaaatataggaaataaggnagcacaaagattgcacagtgatagcacacagcttagttccttcactaacctgaacacgtg

SEQ ID NO: 38229 - DNA, 121 bp, Artificial Sequence
  Synthesized
  misc_feature (61): n=t or c
aagatgctctcgcagctctggggatctgacatacaaaatatcgcctctaaccaaagcaacnaattcagatgtgagcaatgtctattgaagcacagaaatagcaacagctgatgtcattaac

SEQ ID NO: 38230 - DNA, 121 bp, Artificial Sequence
  Synthesized
  misc_feature (61): n=a or t
agcagaaagtttgatatctgaatttatgttacagaaggaattctttctggtaggtacttgnataaatttttcctatttgaaacatgagagcctttaaaaagtcagctttaaaaactgtttt

SEQ ID NO: 38231 - DNA, 121 bp, Artificial Sequence
  Synthesized
  misc_feature (61): n=a or t
gtttcgcagtttcaagcaggaaatactgttttgcttctaaacagcacaaacaaaatatacngcccttagaacagatggagtttttccctcattgtagctgctgctgattttaggttggcat

SEQ ID NO: 38232 - DNA, 121 bp, Artificial Sequence
  Synthesized
  misc_feature (61): n=t or c
gtcagccccagcaggtttgcccagcacctggcactgtgctgcctgagcttgttcggagatnttggggctctaccatagaataagtgcaggtttgtaaggctgggattgcaggcaaggaagg

SEQ ID NO: 38233 - DNA, 121 bp, Artificial Sequence
  Synthesized
  misc_feature (61): n=t or c
cccgttcctggccatcaggcatttcctcctgccttccaaaacagcctccatgttcatgtcnggctctcgggaagggatcgttattggtaattacctaatgacaggcacctgtgtcgagcac

SEQ ID NO: 38234 - DNA, 121 bp, Artificial Sequence
  Synthesized
  misc_feature (61): n=a or t
tatctagttctgattttccttgctgcgactaatatgctgtgatagctgaagtcatgtcacntctctgttcttttttcactatttcagtatctgggaaagcattaaaaacaaatatgctacc

SEQ ID NO: 38235 - DNA, 121 bp, Artificial Sequence
  Synthesized
  misc_feature (61): n=t or c
ggtattttgggactggtcctagagcaagtgatctttcaccatggccaaaatagtctcttcnggtggtttgcagccactgggcaggaatgtaccgcatttgtgctgtgtgagaaggttcttc

SEQ ID NO: 38236 - DNA, 121 bp, Artificial Sequence
  Synthesized
  misc_feature (61): n=a or g
aatattaattactactctgtaacgcatgacaagatttttttcactctttttaattaaactnaaaacttccacatttgaacaatatgctgctttcctcgcttgcttgatagcatactctttt

SEQ ID NO: 38237 - DNA, 121 bp, Artificial Sequence
  Synthesized
  misc_feature (61): n=t or c
ccaagttaaaacattctttccccctgaaggagaggataaaaattattctttgacatctacnaaagcagattaacttaaagaataaggattctttccccccccctcagtcaaaacattttaa

SEQ ID NO: 38238 - DNA, 121 bp, Artificial Sequence
  Synthesized
  misc_feature (61): n=t or c
caattaaattatggttgctcaacaagtaactgcctttcaactgaagcaacatcaccgctgnatacatgctgatgcctgctgaactaatctaaaccagccagggctcctgagcctctgcttg

SEQ ID NO: 38239 - DNA, 121 bp, Artificial Sequence
  Synthesized
  misc_feature (61): n=a or g
ttgtaaaggaagaacgctattctcaccttgtttttaaatacatcctatgtgaaaatgcaanagtaaggagtacactgtgggtaaagcaaggacaacactgcctgtttcagctctgattgtt

SEQ ID NO: 38240 - DNA, 121 bp, Artificial Sequence
  Synthesized
  misc_feature (61): n=a or g
gcagacagaaagggttgtgtaatggcaagcctcgtgtgctgcccgtcctggccctggggtnggggtacttcatgctgtccttcctgtgctagcaggaaacataacatctctgtgggctgct

SEQ ID NO: 38241 - DNA, 121 bp, Artificial Sequence
  Synthesized
  misc_feature (61): n=t or c
ttcttcagctaccaatactgcctttgtagagcatttcctttcatccttgaccccttcaggntgggtttgaggactggtggtagggaacaaaatgggacctgagggtgtgcccttctccttc

SEQ ID NO: 38242 - DNA, 121 bp, Artificial Sequence
  Synthesized
  misc_feature (61): n=t or c
tggctggagaaggggcagattttaggagagaagaacaagcaaacaagagacagccaaaaanaagttttgatctcttatgtgactgagcataactgagaaatcaaagagtcagacacagagg

SEQ ID NO: 38243 - DNA, 121 bp, Artificial Sequence
  Synthesized
  misc_feature (61): n=t or c
tgcagcgctcacatcagaagtctgctctccagttagacggagatcatcaccagtttgtttncaccgggtttatgttttccatgtcaaggtcaattgcagatatgttccaatgaggaatgtg

SEQ ID NO: 38244 - DNA, 121 bp, Artificial Sequence
  Synthesized
  misc_feature (61): n=t or c
aaattaaccccacactagtcttaattacatttagtttcatttggctgatcaagcaattaangtgccactgtattttggaagtaaaaaccaagttgttacggtctgtcttcaaaaaacatgt

SEQ ID NO: 38245 - DNA, 121 bp, Artificial Sequence
  Synthesized
  misc_feature (61): n=t or c
ctaattatagtagcaatctgaaggcatgttaataacaacagaatcatctgccaaaaagcanataaattaaaggtctaacatgtccatgcattgtatacatgatcaaacgtgtataaatgca

SEQ ID NO: 38246 - DNA, 121 bp, Artificial Sequence
  Synthesized
  misc_feature (61): n=c or g
tggtgagcctcagctctctcgcttgaaaatggagctgatactgatggctgctcagtttggnattggacgcaataataaatgggaatttagcatcctgaagtagaaggaggcattttttaac

SEQ ID NO: 38247 - DNA, 121 bp, Artificial Sequence
  Synthesized
  misc_feature (61): n=a or t
ctcttttggaacatattttactgttataatacttacgttagggagcaaaagcaccattatnttttggaaattcagaaatactcaattcatatatgactgccatttcagtgcaatgctgccg

SEQ ID NO: 38248 - DNA, 121 bp, Artificial Sequence
  Synthesized
  misc_feature (61): n=t or g
actggggaccactggggggctgggggggctcttctgcccgtgctgggtgggtgcctgcagnctgtgtaggtacatgaggtcatgctgcaaggacccaccatgcacctgctgctggggagca

SEQ ID NO: 38249 - DNA, 121 bp, Artificial Sequence
  Synthesized
  misc_feature (61): n=t or c
tttgggatatgaaaagcaagtagggagacaacatatgttgcacaatgtgtaggattaaatnactcaaacatatggacacctaataatatttaacacagcatcaaaaagagaatggagccat

SEQ ID NO: 38250 - DNA, 121 bp, Artificial Sequence
  Synthesized
  misc_feature (61): n=t or c
attggcagatttggggtgctggagcagcgcatggctcagtgctggaaaccaggctgcaaanctctcaactgcatttgttaagagttggttttatttcaacccaaatgctctctttagaaat

SEQ ID NO: 38251 - DNA, 121 bp, Artificial Sequence
  Synthesized
  misc_feature (61): n=a or g
gagagttctcatttgaagaatcaggtgaagatgtctaaaattggtatggaaaatatttganatactgtctatgcctgtgtgccacttattttggctttttcattcagattatatttcaaat

SEQ ID NO: 38252 - DNA, 121 bp, Artificial Sequence
  Synthesized
  misc_feature (61): n=t or c
gttagtacactgctccttggtcataatttatgaattcgtgaggatgaactgattgaggtantcttcgttttgtggtgtggcagctgttcatggtcatctgaaatgtggtttgtctttcatg

SEQ ID NO: 38253 - DNA, 121 bp, Artificial Sequence
  Synthesized
  misc_feature (61): n=a or g
ggcagtctgggccaaactgatccttgccaaaaagccatttgtgtgtacaagtccatccagnctgctgtgggtctgttggtactacttgggccaccaccactggtgacccaagtacatgcaa

SEQ ID NO: 38254 - DNA, 121 bp, Artificial Sequence
  Synthesized
  misc_feature (61): n=a or g
atttttaaatgtgctgctatgactttaatgtgaattatgtaaaaaaaaggtcagaaggaangtgttgaaggaagtggtatgcttggttcttatttgtattttggatgaaaaaaataataat

SEQ ID NO: 38255 - DNA, 121 bp, Artificial Sequence
  Synthesized
  misc_feature (61): n=t or c
tttcaagctctcgtgtcagacacgcagtggctcaggatggactcaggcaccattcagagcntgctgtgattgtatgaggacaccacacgcactgctgcatgctctcgtgtgcattggaatc

SEQ ID NO: 38256 - DNA, 121 bp, Artificial Sequence
  Synthesized
  misc_feature (61): n=a or g
cacaggcctactgaatatcacctttttgatgggctctgctgttcttgttctgcctgacagncaggcagtgctcggcagccataagcctggtggcttcactgcgtgcacccacatgttcgtg

SEQ ID NO: 38257 - DNA, 121 bp, Artificial Sequence
  Synthesized
  misc_feature (61): n=a or g
tgttctgctgcagtctgcacactcatatacttgagatacacaatgggaaaacacggtaccnagaaagtgctgaaccttttacatagcaatagtgtattgaagatgggcagtaaaaacaaga

SEQ ID NO: 38258 - DNA, 121 bp, Artificial Sequence
  Synthesized
  misc_feature (61): n=t or c
tcagctcagctctgcacgccaaacccagggcatgctgaggctgatgtgtgccaaacaccangcagggacgtgctgctgaaaggtctgccagtgtcacctcccccttgagcccaggcccagg

SEQ ID NO: 38259 - DNA, 121 bp, Artificial Sequence
  Synthesized
  misc_feature (61): n=t or c
tgttgctgttgtgccaaagatttgatggagcttctacactgtgtcttatttttgccttaangttaaatccttgagccaaagagaagtcagagacaccgttcagattgcagcaagtgggcca

SEQ ID NO: 38260 - DNA, 121 bp, Artificial Sequence
  Synthesized
  misc_feature (61): n=t or c
acagcccacagggcctggcctcctgagcatgtggaaacagcatttctctgtgtcccaattnacacggccccaatagtaaatgcctggagctgcacgggagcttcagagaaacacagttact

SEQ ID NO: 38261 - DNA, 121 bp, Artificial Sequence
  Synthesized
  misc_feature (61): n=a or g
gtatttcttaaaaattctatgtactggtagaagtcactgcaagtttggctgagtttgtgtnaaataagaaaggaagtatcactacgtctggacaaggtttatcatggtattcaggtttttg

SEQ ID NO: 38262 - DNA, 121 bp, Artificial Sequence
  Synthesized
  misc_feature (61): n=a or t
cttgattagttttgcagttaaagattctttcatactatctgttatacttttttattatttnttttctaaacatatttctgtttatcatcacagggaaaactctctctctttctctctctcc

SEQ ID NO: 38263 - DNA, 121 bp, Artificial Sequence
  Synthesized
  misc_feature (61): n=t or c
ccctgttgtggtgggacctctcctgccagaggctctggttcagcatgtccatttgcgttcngatttgacttttgtttctgtacgtgcaaagaggcaaaaccctgagtgctgtgctgactcg

SEQ ID NO: 38264 - DNA, 121 bp, Artificial Sequence
  Synthesized
  misc_feature (61): n=a or g
tagctatcacctgactcctctatccaaatgccccttttccccttgtaggagtagtcttctngcttctaaattcttatctagctagcagcagcttgactgtgctcaagggagcctgccaagg

SEQ ID NO: 38265 - DNA, 121 bp, Artificial Sequence
  Synthesized
  misc_feature (61): n=t or g
ctctcagacaccgttctttggagtttatcagcccagtagaatatgctgcatacatgcacanggaggttctgcaagtacctgcaccaatgtctggggcaattcagctcccctgaccacatca

SEQ ID NO: 38266 - DNA, 121 bp, Artificial Sequence
  Synthesized
  misc_feature (61): n=t or c
cacatccttaccaaggaggcaggggaaggggaaggtttgctggagccgggggtgggcacanggggtaatgctgctggaaggaaggggttataagacacgttatggctcacagcatctccca

SEQ ID NO: 38267 - DNA, 121 bp, Artificial Sequence
  Synthesized
  misc_feature (61): n=a or t
cataaagtcaagtttaaaagaagaaaggcagtttggacagtaatatcagcacctgttcctnttctggaaatcagttatttctttaagtcttttctcccccaccacccaccccctcctcttt

SEQ ID NO: 38268 - DNA, 121 bp, Artificial Sequence
  Synthesized
  misc_feature (61): n=a or t
tggcctcctcacgaaaaaaatattgctgtacgtctcattgcttttatccaaccaaagtganaacagggtttaaatctttcatttgctctaattccttgctttaatttatgactggctttga

SEQ ID NO: 38269 - DNA, 121 bp, Artificial Sequence
  Synthesized
  misc_feature (61): n=c or g
gatattaaaggcaattaaggctgtaaggactagaatgagcttattaggggtgagaatgttntgtatcatgaatcagttctgaagtgactaatcctatagtacagaatatgacaactatgaa

SEQ ID NO: 38270 - DNA, 121 bp, Artificial Sequence
  Synthesized
  misc_feature (61): n=t or c
tacaaatagagctgaatccatgactgattcagtctctcacctatcctccaaaatgggtacnctgacctacatttcaactatatctcagctacaaaagcattcgctctgcttcagccagcct

SEQ ID NO: 38271 - DNA, 121 bp, Artificial Sequence
  Synthesized
  misc_feature (61): n=t or c
tactgagccagtttggtgctcattaggtaatgaataataaagagaagtcaacctaagatantttaaaagtaaaactcatttaatgtaaatgaaacaaatgtaatgagttactaacaactgt

SEQ ID NO: 38272 - DNA, 121 bp, Artificial Sequence
  Synthesized
  misc_feature (61): n=t or g
tgccactcacgacgatggaaatgtatactgtcacctttgataacactgatacaaccatatntgtgcagcagcatttgcatcaacataaattacaccactggacattcaaatacattctgaa

SEQ ID NO: 38273 - DNA, 121 bp, Artificial Sequence
  Synthesized
  misc_feature (61): n=t or c
aaaaactaaatgccattaaaagtgagaaaaaagcaaaactcaggaaattgtgcaaaatagnttttggaataacacagcacagctggataaaattgaaatgatttttatatgtttgtttttg

SEQ ID NO: 38274 - DNA, 121 bp, Artificial Sequence
  Synthesized
  misc_feature (61): n=t or c
ctgagagcagttcatcagctgctacgattgactctatctcagtaaaatgaggggctcagcnttctgtactcatggagtaaatccaacaatcggtggcatgctagtgctatgagcatgttac

SEQ ID NO: 38275 - DNA, 121 bp, Artificial Sequence
  Synthesized
  misc_feature (61): n=a or g
ctttgctgacagctccccacccagggaaccacactacttcacatcgaacaaatgcctttanaacacagcaaaaaacagacttctctttgaaaggaaaagaaggtgaagagagtctaaaata

SEQ ID NO: 38276 - DNA, 121 bp, Artificial Sequence
  Synthesized
  misc_feature (61): n=a or g
aaccatccttcagctaggtcagtgagtaggaggacaataggctggattgggataaagaccnaaaggtcttcagatgcctcagagaaaaaagaacgaaaatgctccattttttgaagtgcta

SEQ ID NO: 38277 - DNA, 121 bp, Artificial Sequence
  Synthesized
  misc_feature (61): n=t or c
gggcccacctggacaaaagagacgtggaacaaatggaacaagtctagtgaaggagcatganatcattaagggactgcagtgccagtcatacaacaaaaggctgaaataattgtggtttttt

SEQ ID NO: 38278 - DNA, 121 bp, Artificial Sequence
  Synthesized
  misc_feature (61): n=c or g
atgactaatcttggcatatatggtactggaacagcaatcacagagtacaaatgaaagcagngttgaaccctgtcctatttatatcagatgaaggtcacaaacctagccatgcttctgctta

SEQ ID NO: 38279 - DNA, 121 bp, Artificial Sequence
  Synthesized
  misc_feature (61): n=a or g
cgtgcttggtcaagttaggtgaaaagtggtgttgctgtaagaggtcaaatcatttaaaacntgagcatttgaagtttacccaacagcccaattatttgctggcatttcaacacaagatagc

SEQ ID NO: 38280 - DNA, 121 bp, Artificial Sequence
  Synthesized
  misc_feature (61): n=t or c
aaccaaatggatcacaaaaactgtaaattcccttcatgatggataagggtcaaaatatcantggcagcgatagagcagtataacttacaggcttggtggatagctgtctagtgcatgagag

SEQ ID NO: 38281 - DNA, 121 bp, Artificial Sequence
  Synthesized
  misc_feature (61): n=t or c
ataagggatggaaaatctaaaaatgctaaaatgattaggtatcaaggagttggacagcttngatctgtgataaatcaacaaggttcaagatgaaccttgcaaaatcattagctccaaaacc

SEQ ID NO: 38282 - DNA, 121 bp, Artificial Sequence
  Synthesized
  misc_feature (61): n=a or g
agcttctgctgtggtatctatatgacggtcaccccaggaacatttaggaggatcccctaantccccagttgcatactgatgtgaacatgggtcaggtttagcctcagcccacatctcctct

SEQ ID NO: 38283 - DNA, 121 bp, Artificial Sequence
  Synthesized
  misc_feature (61): n=t or c
attagaaagatgactgtatgaagctgttcagaaggcaaaaagtgactgatgagcaccatanatttgaatcacacaacagaataaaaccttgataataccttatttgttgctatttaaaata

SEQ ID NO: 38284 - DNA, 121 bp, Artificial Sequence
  Synthesized
  misc_feature (61): n=t or c
agagctctttactttcagcttatctaggaattggcaaagggcagcaggcagggggatgctnagcacgcgtgcccaaagctgtcacgcatcttagcagctggagggataagatcctgctggg

SEQ ID NO: 38285 - DNA, 121 bp, Artificial Sequence
  Synthesized
  misc_feature (61): n=t or g
tttttttctaatccctgcaaaaatccaatgaaaactatgaagatttcataaactcgattangacatagtgaaattaaataagcatcataacagctcagacttgtgagatgtaccttgcttc

SEQ ID NO: 38286 - DNA, 121 bp, Artificial Sequence
  Synthesized
  misc_feature (61): n=t or c
aatgtgagataaacattctcacaggatctcaggatctgttggaagagatgcaataggaagngtaactgcacaccgaaaagggacagttagaatggaaggcctaacgactgtcccctttcct

SEQ ID NO: 38287 - DNA, 121 bp, Artificial Sequence
  Synthesized
  misc_feature (61): n=t or g
agatgggattattagcacacgtggctgtatgctgtgctctctggtaacaggaaaaatatgngaattcttccctttccagcattaaaagaaagagttctcgggattatctatggtttctgct

SEQ ID NO: 38288 - DNA, 121 bp, Artificial Sequence
  Synthesized
  misc_feature (61): n=a or g
atatatatatatatatatatatatatatatatctatacatctatacatgcatgttagttgngttagagctagtcattccataaaatggatgaaacaggaaaatatctagttatatattaga

SEQ ID NO: 38289 - DNA, 121 bp, Artificial Sequence
  Synthesized
  misc_feature (61): n=a or g
tctatacagaaagtaagcaatatcaatacgagtagcaatgcaagaaacatgaaaaataccntatccagctgatgtcagctactgatgtagctggggttcaaaataggaaggaaacttaagg

SEQ ID NO: 38290 - DNA, 121 bp, Artificial Sequence
  Synthesized
  misc_feature (61): n=t or c
acttccagtcttccttcacctggcaacacagagatgaaaggccagttagtaatacttaatngagattaaagtgtatgaagacttctttgtgctttattctaaacatgatggcaatttttac

SEQ ID NO: 38291 - DNA, 121 bp, Artificial Sequence
  Synthesized
  misc_feature (61): n=c or g
tccaagttgacagtaaggctgcctcagagggagtgtaggtgaatttaacatagtgtggagnaatgcatcatcaacagaatttcctgtaccttctaagaaactatattaaatatccatttac

SEQ ID NO: 38292 - DNA, 121 bp, Artificial Sequence
  Synthesized
  misc_feature (61): n=a or g
tctacataatgaggacatatcaggtaagtctcaataccattgccatatctgcttttgatcntgtgatgaattatttaatttactaatataattaaacaagtaaaaaacaaactcaagatat

SEQ ID NO: 38293 - DNA, 121 bp, Artificial Sequence
  Synthesized
  misc_feature (61): n=t or c
ctttggaatgcattatgctcttttttttttttaattgcaagtggaaacgagttaaatgaanggtacattaaggcatggcagtgttcacgtagatgcagctttataaataatacacattaga

SEQ ID NO: 38294 - DNA, 121 bp, Artificial Sequence
  Synthesized
  misc_feature (61): n=a or t
tgagtctatgtgtgctattgttattgtactacctacaaaatcaaatttgcagaaagccgtnaatccggaaaaaggatttatatccaaacttcatgatatactgcagtaaattatcttgaac

SEQ ID NO: 38295 - DNA, 121 bp, Artificial Sequence
  Synthesized
  misc_feature (61): n=a or c
tttaagaatgaaaagcaaaaagagttggcagattgggaattatctatactattgtaattanaagggagaaattctacatcttcatgcaagaacaaaaggaaagaaaagttaagcaaatgaa

SEQ ID NO: 38296 - DNA, 121 bp, Artificial Sequence
  Synthesized
  misc_feature (61): n=a or g
gttttacagtaacttggctgctaggttgtgaatgtaatttcagaagtatttctgaaatagntcatacatattatgatcccattgggcatgtttgtgtgaggggatgtagtcaatggtttga

SEQ ID NO: 38297 - DNA, 121 bp, Artificial Sequence
  Synthesized
  misc_feature (61): n=t or c
acagaatctggcagcttatgctatagaaatgaatgttttgttctagggctgctgtgaaaanagccctcagatgttgctgtggtgaactctttccatcactttctaatggtaattttttttt

SEQ ID NO: 38298 - DNA, 121 bp, Artificial Sequence
  Synthesized
  misc_feature (61): n=t or g
cttctgcccacagtggccaaatgcttttggaattaaatcttagggtttttttcttgtttgnttgtggatttcccatccatagacttgtgcttttgtttagttttaaacaaacttggtactt

SEQ ID NO: 38299 - DNA, 121 bp, Artificial Sequence
  Synthesized
  misc_feature (61): n=a or g
aaagtctgtgagcagaggcactactgactgtgcagtgggactggactcgtggcacaggcantggatcatccagtgtcattgcacttttggtgtagtcttcagtcttcccctctaaacagtg

SEQ ID NO: 38300 - DNA, 121 bp, Artificial Sequence
  Synthesized
  misc_feature (61): n=a or g
ttttattaatgtgatgagaagagataaaccagaacacctataaccactcaatttgcctcantgttgctgtcaccagcacaccccaattgtctacctcaagttagacattgaagaggttctg

SEQ ID NO: 38301 - DNA, 121 bp, Artificial Sequence
  Synthesized
  misc_feature (61): n=t or c
agaggaagcatctgataagagacaacagcaggttatctagcacagcaaagcaggtgttaangttaaatgccattcccaaaggagccaaaaaaatttagtgtaataaaaaggtaaatgcacc

SEQ ID NO: 38302 - DNA, 121 bp, Artificial Sequence
  Synthesized
  misc_feature (61): n=t or c
gtgagcaaaataataacatccactgaacacaaaaagggtgactgcatcccatgggtcgtgngctttgagaactgcagtgggtgagtgctcatccaatgcagccattttttggagggggtga

SEQ ID NO: 38303 - DNA, 121 bp, Artificial Sequence
  Synthesized
  misc_feature (61): n=a or g
ataatcagtgtatttctatagtccaagaaataattgccagctttcaaggcatgccatactnttgccattattggagacagtaaaattttgcgtagcttttatgaaacattcttctctcaca

SEQ ID NO: 38304 - DNA, 121 bp, Artificial Sequence
  Synthesized
  misc_feature (61): n=t or c
accttatcagccaggatctgagcagtggcagtaatgtaattcttaccatttagcactttgnggtatgttgaaaaggaataggatattagaccatttaaactttctgaaatataacacaaag

SEQ ID NO: 38305 - DNA, 121 bp, Artificial Sequence
  Synthesized
  misc_feature (61): n=a or c
aaacagctgttcttgctgctgttaaaaggagattccaaatgaaaattatactgacaaaagntcacaaacactaaaaatcttatttcaaaatacctagataagtatcctgaagctatcctca

SEQ ID NO: 38306 - DNA, 121 bp, Artificial Sequence
  Synthesized
  misc_feature (61): n=t or c
ctgtttgatggacatggaagtggttgtgagatcatacccagggagcggtggtcaatggctnagtgtctggttggagacaggtgacaagttcctcaggtgtcagtactgggactgatgctct

SEQ ID NO: 38307 - DNA, 121 bp, Artificial Sequence
  Synthesized
  misc_feature (61): n=a or g
gagcttcacacagctatgaaacatgctgaaggttagatggtaggtatcctactggctttgnatagtattcaatcagctctagtggaagagagtgttgtaacagttagctagtgggcatcct

SEQ ID NO: 38308 - DNA, 121 bp, Artificial Sequence
  Synthesized
  misc_feature (61): n=a or g
aacagttaattgacccaacttgtacataattactggatacaagtagtcataatgaatatcnttagtaatattagtaacatttcctatctcagccattgagtttttactgttactcttcagc

SEQ ID NO: 38309 - DNA, 121 bp, Artificial Sequence
  Synthesized
  misc_feature (61): n=a or c
gtgccatgatcactgctctggggaggttgctccagtgccttacttccctcagtgaagaacntcctgaaatctgacctgagcctccactatcacagcttcatgctgaatgcaggaattatct

SEQ ID NO: 38310 - DNA, 121 bp, Artificial Sequence
  Synthesized
  misc_feature (61): n=a or t
aatacttaatttatttccatgcaatagttttatctgtgtcttcagaccttgcactgtgttntttttatttagaaaacttttctgtttgattgataagagagaacaatacaatgggaaggct

SEQ ID NO: 38311 - DNA, 121 bp, Artificial Sequence
  Synthesized
  misc_feature (61): n=t or g
agcctaactagtattatactaagaagccttcgaagaatacatgcgcctgtcattttggaancttgctgccaatcaacagtctgacattctgtctgtaacatgtctactattgtaagcagat

SEQ ID NO: 38312 - DNA, 121 bp, Artificial Sequence
  Synthesized
  misc_feature (61): n=a or g
tgagctgtcccactgaatatagataccaattagttttaggagttatcacaattaacttggnttcttaaatgttactgatctggatcatgccccatatatttttacattgtgcctaccatca

SEQ ID NO: 38313 - DNA, 121 bp, Artificial Sequence
  Synthesized
  misc_feature (61): n=t or g
gagcctcatcagtatggaacttgtataacatttctgtatgttatgctagtcactagccaancttgacagctcctcattgctgggtcattagacaaaaacgtgaaaaaatgcaaaaggtgtt

SEQ ID NO: 38314 - DNA, 121 bp, Artificial Sequence
  Synthesized
  misc_feature (61): n=a or g
tgcctgagcaaacaacccaaatgcagggggccttcacatgtgctgtgctccactttcagtngccaacctgctgcttatgaaacctatgaaaccacataaccccaactgccttgcagcaccc

SEQ ID NO: 38315 - DNA, 121 bp, Artificial Sequence
  Synthesized
  misc_feature (61): n=t or g
tggacatcatctctggaacgctcggtatgcacagcctggcagctcccacagaagcttacanagtctaaggcagcaaagcttctgagcagccaaattaagtgggttaactcaaaatctgtct

SEQ ID NO: 38316 - DNA, 121 bp, Artificial Sequence
  Synthesized
  misc_feature (61): n=t or c
taccccaaactactggagctaaagccaggtgaggtgccagttctgcaatgcttactgatgnataacttcatattgcttcttcctcttccttctccttttcagtaacaggctatacttatga

SEQ ID NO: 38317 - DNA, 121 bp, Artificial Sequence
  Synthesized
  misc_feature (61): n=t or g
gctatcactatattccaatgacttaatcctgagaggcgttgtatactgtatgatagctganatggagcatccgtctgcatgaaaggatgcaaaatcctttgcttttttggactgaccaaat

SEQ ID NO: 38318 - DNA, 121 bp, Artificial Sequence
  Synthesized
  misc_feature (61): n=a or c
ggggataaacaatggcccctttgagagtctgttaaagcagcagcaagccagaacacgcagnctttactcaaaggtgagtgtgctggaagctgagctgcccattcctccccgctgctagagc

SEQ ID NO: 38319 - DNA, 121 bp, Artificial Sequence
  Synthesized
  misc_feature (61): n=a or g
gttgggttgaatcccatcggcgtcgctgagatgctctcatgtgcccatagcgaacactgcngcactcagttctgttttgcagccttaacagcagttttacatcacaggaagggaaactctg

SEQ ID NO: 38320 - DNA, 121 bp, Artificial Sequence
  Synthesized
  misc_feature (61): n=a or g
actttaatgacactttctaaaactaaaataattcaaagctattagtgaatactgaaacttnctattactgaaatattgccatacctgaccaacaccgatcagtagcaaacaacctgctgta

SEQ ID NO: 38321 - DNA, 121 bp, Artificial Sequence
  Synthesized
  misc_feature (61): n=t or c
cagtatgaaatgcttacctttacttggtgtgactttacttaatggaacttgatctctaagnactcactgttgtttaatacagcatcagtgttatcttgactagactgaacttagagcccca

SEQ ID NO: 38322 - DNA, 121 bp, Artificial Sequence
  Synthesized
  misc_feature (61): n=a or g
tgaaaacctgctcctgtttgcagccaagcccatcacttcacctgctgacacgaggaggccnctccagaaaggcacgccctgctctgtaccagttcactatgcaaacaacctgaagcactga

SEQ ID NO: 38323 - DNA, 121 bp, Artificial Sequence
  Synthesized
  misc_feature (61): n=t or c
tggcagaacatttctctttaaacagtgcgttctattagcctttaacattaaaatgctttancacacatatgcacacagtaatttacacttcttcttgctgctcccgggaaggagaaggaca

SEQ ID NO: 38324 - DNA, 121 bp, Artificial Sequence
  Synthesized
  misc_feature (61): n=t or c
agaacttcctagtttatgaaggaaatttaaagctatctttaaggcggcagacaagataganttgaattctcagctgagatgaagaaaacaaaaaacacatcaacagtaaaataatcaagca

SEQ ID NO: 38325 - DNA, 121 bp, Artificial Sequence
  Synthesized
  misc_feature (61): n=t or c
tacatgagctctctttgggctgtagaaatctttatttaacttgcaacagctcacccctgtnggacacgtccccatttgccagtttctgatcaacaaactcatttcaagttgaaagaaatat

SEQ ID NO: 38326 - DNA, 121 bp, Artificial Sequence
  Synthesized
  misc_feature (61): n=t or g
aaacacagaggtgctccttcttgcatatctaaaactatggaggagtcaaaacaatttatcnttcaacatagttgaaaagcaataataataataataataataataataatcagactgctag

SEQ ID NO: 38327 - DNA, 121 bp, Artificial Sequence
  Synthesized
  misc_feature (61): n=a or g
cgaagctgcagcacagacctgtcctgactgaagcagatgttaaaactgagagaatgctgcngaaagctttggtgatttccattcaaaagcaaacttcacctatattgcagtcgtgcctcag

SEQ ID NO: 38328 - DNA, 121 bp, Artificial Sequence
  Synthesized
  misc_feature (61): n=a or g
acaaaaggatttgctgggcatttttcttactttcttcagcttgacatataacctcactgcnaagcttagatctctccagcccaaatccatctttcttcccttgtccaaaattagtttagcc

SEQ ID NO: 38329 - DNA, 121 bp, Artificial Sequence
  Synthesized
  misc_feature (61): n=a or g
taattgatatcttcaaataaaacaatggctgaggatgccttatttggtagtgcagcctcanggagatgtcatttttttcccagtgctgctcaatagctgtgtcacattatcttggaggaaa

SEQ ID NO: 38330 - DNA, 121 bp, Artificial Sequence
  Synthesized
  misc_feature (61): n=t or c
ggagaaaaactgattttatgccagagcaaatttagatagtgaaattgactgcagagggggnagcagctacttccattcttggctgcaggtatgttaaagaatcccatcccttgttcactgg

SEQ ID NO: 38331 - DNA, 121 bp, Artificial Sequence
  Synthesized
  misc_feature (61): n=a or g
ctcagtgacatgattttttcctttcccccttcaattacatgttttaaatatttattatatnccctgtagggttacttttactctagaaagagcaagggttaagcttctgtttttcaaacaa

SEQ ID NO: 38332 - DNA, 121 bp, Artificial Sequence
  Synthesized
  misc_feature (61): n=t or c
aaaaccaagacaaatatcagaagaggagagcccagttcagctgcctgtcagcaactctgtnttgaatctattaaatgtctgtctgatttttatagttaaattaatctttgaaattaaccat

SEQ ID NO: 38333 - DNA, 121 bp, Artificial Sequence
  Synthesized
  misc_feature (61): n=a or t
gctttgctgggaacaggacagggtcacctcttgataatgggatgttctttaggactttctnagaaacaaggctacattttcagctctgacatcttagtagcctcgggcttttggaaagctc

SEQ ID NO: 38334 - DNA, 121 bp, Artificial Sequence
  Synthesized
  misc_feature (61): n=t or c
gcagggacaacaagaatgtcactctaagaatcccactatgcttaaaatcaggtgttatganaaatgctccaaaggtgcccataatgactgttactgtgaatgggtgcagacagtcattctg

SEQ ID NO: 38335 - DNA, 121 bp, Artificial Sequence
  Synthesized
  misc_feature (61): n=t or g
tggcgaataacactggtaaccatccgccacctagaggtagatccttttaccgcaacacttngagctccaccgttgagccagttcaccagcatgaacctgcttatttcacagctggacagta

SEQ ID NO: 38336 - DNA, 121 bp, Artificial Sequence
  Synthesized
  misc_feature (61): n=t or g
tacttacactcttgttctaaaacagaataaatgtgttgtttatctgctcagcatgtgattngttgctgctggtaaacaaaacttgtactatcagatgtatgcaagtactgtggaggcatat

SEQ ID NO: 38337 - DNA, 121 bp, Artificial Sequence
  Synthesized
  misc_feature (61): n=a or g
cacagacagatgtgcatgcaagaaaacacagactctctactaggtctggtttcctctctgngaagtcacttgtctttgagcataggtacagtcttatggcctgccccggccccaggctttg

SEQ ID NO: 38338 - DNA, 121 bp, Artificial Sequence
  Synthesized
  misc_feature (61): n=t or c
ggagccatcacctgctgcagttggatgggaacctgtcaccagcagatggatggggacccangggcaccctcccatggactgttgtcttcattgcttagtgagccaaaaaaaaagagagatg

SEQ ID NO: 38339 - DNA, 121 bp, Artificial Sequence
  Synthesized
  misc_feature (61): n=t or c
gcagggctgtgcaaaacctccacctgacagcaataatggaagctgggcccaaactgactgngaggaagtccattcgctttctctcaagaattaccttgcaattaccagtgcaagtggccaa

SEQ ID NO: 38340 - DNA, 121 bp, Artificial Sequence
  Synthesized
  misc_feature (61): n=a or g
gaataattttctggtaaaagaaggaaacttgtgcaagtgttagcttttagactctaagagncagagagaagtcatatgggatcagtaaagatgactcatagtttctctgatctagcttgtt

SEQ ID NO: 38341 - DNA, 121 bp, Artificial Sequence
  Synthesized
  misc_feature (61): n=t or c
atggacacatggggccccaagagaagtccttaaccagatacctagatcgttgggaagtgtncccaacccagatgcttgggtccacaagaggtgtctccagccaaccaaccacctgtgttac

SEQ ID NO: 38342 - DNA, 121 bp, Artificial Sequence
  Synthesized
  misc_feature (61): n=t or c
ctttgccttctcttgatgcatgtgtcagctactgaagctggcagctttgcatataaatggnagttctgaagagcttaggtttgcctagaaaatgagcatggtcatgtgtaaacatactgca

SEQ ID NO: 38343 - DNA, 121 bp, Artificial Sequence
  Synthesized
  misc_feature (61): n=t or c
caagtgagaatatcagccatttgcagctgccctgtaattctcggccagctcagctacaacnaccaactctcacaatttagcatgatttttcagtcttgacagcacataataaaccaataag

SEQ ID NO: 38344 - DNA, 121 bp, Artificial Sequence
  Synthesized
  misc_feature (61): n=a or g
acgcactcgcaggatgacccgcgacaaccccatttcaggcttgggtgtctctttggctgcngctgccaattagagtgggcagtgccaaattatttggcggattggtgccacggataggcag

SEQ ID NO: 38345 - DNA, 121 bp, Artificial Sequence
  Synthesized
  misc_feature (61): n=t or c
caacctctgcctggagaaaaacaaagcagatcccacccggctcagcctggcccatggtttntcaaccatgactgtatcaggtgacctggaggtttagtttggttagagcacagagctagca

SEQ ID NO: 38346 - DNA, 121 bp, Artificial Sequence
  Synthesized
  misc_feature (61): n=a or c
cttctatggtacaataacacattgtatggaaaatcttctccttcagagattattctgtcanctcctggtcgcttttcattctctaggccttgctacagaattacatacaatccaatgggtt

SEQ ID NO: 38347 - DNA, 121 bp, Artificial Sequence
  Synthesized
  misc_feature (61): n=a or g
aatttaatggtggtggattggtctgctaggatgacctcagcagatcctaaaggtatgtgcnaggactcttgctttcacacgtctgtaagcagttagtaatagcaaaatcattggggtcaat

SEQ ID NO: 38348 - DNA, 121 bp, Artificial Sequence
  Synthesized
  misc_feature (61): n=t or g
acaggagcttgggcctatctctgcaaaacagctgtttgctgcatctagaaaaacaaacctngagaaaaaatatggatatcaacaaaataaccatcagggtaatcagcagggacagagaagg

SEQ ID NO: 38349 - DNA, 121 bp, Artificial Sequence
  Synthesized
  misc_feature (61): n=t or g
cgtttcattcttggcatataggcaaagcaaacaaagggagagaatacactttaattttgtnctgttcactttttatatgtagacatttatttttttactgttgatattcagagtcacttaa

SEQ ID NO: 38350 - DNA, 121 bp, Artificial Sequence
  Synthesized
  misc_feature (61): n=t or c
tcctggcattccaagccaagccatgctatgactccatgacactgcggtgttctgtgttccngctatgagctctgcccaccaaacccttttccagcctacccgtgtttgtactgtgagtaga

SEQ ID NO: 38351 - DNA, 121 bp, Artificial Sequence
  Synthesized
  misc_feature (61): n=a or g
tcatatgattgtcattctattccttttccacaaaaatggtaaacttcatctgaatttagtnattctgttctgtcatcagggtaactgcttagtttgtttatgtcaaagaaaagtggtacaa

SEQ ID NO: 38352 - DNA, 121 bp, Artificial Sequence
  Synthesized
  misc_feature (61): n=a or c
actgaaagatggaaatgtgctcagcacctgggaagcacagcaaccaggagaattttcctcngttttcttgataaatgcagaggtcggggcatcctccatcttgttcagtatgctgttggaa

SEQ ID NO: 38353 - DNA, 121 bp, Artificial Sequence
  Synthesized
  misc_feature (61): n=a or g
ggttcctcggctggactgcggggtttgattacaaggagaggcaaaagcagctcggggttcnggggaagcatttcccctcaacttttaggttctttacatcccaactttttgttaacgccag

SEQ ID NO: 38354 - DNA, 121 bp, Artificial Sequence
  Synthesized
  misc_feature (61): n=t or c
aacaaatcctgaattctattaccaaagcattccaaaattgctgtatgttgttggaaaagtnacttaaaagaagggtagggaggagagaaggaagaaagcaaaacacaagggagtctaaagc

SEQ ID NO: 38355 - DNA, 121 bp, Artificial Sequence
  Synthesized
  misc_feature (61): n=t or c
ggtctggttccaccagagtctctagttcagattttttagaattctcttttccaataatatngtgactgtaagggtcccctacatccatgacagataaggctatgactggttgtattgcatt

SEQ ID NO: 38356 - DNA, 121 bp, Artificial Sequence
  Synthesized
  misc_feature (61): n=a or g
acacattttgcctatgacaagtaaacaaaattagggtgacactactggtttaaaggcagantaggttacaacagctgcaggatacaccaaaaaacatgcaaactttttaaactgtgataca

SEQ ID NO: 38357 - DNA, 121 bp, Artificial Sequence
  Synthesized
  misc_feature (61): n=t or c
aacctgagtgaaagttttgcctgacagttttaatgttggcagtagatgaaactgtcagttntgaattgaccaatagctctgacacaacaaagcacgagtaacccagtcttcctaaactaat

SEQ ID NO: 38358 - DNA, 121 bp, Artificial Sequence
  Synthesized
  misc_feature (61): n=t or g
ccgttggatttccagtgatttctatattagctatatttgttattagcaaatatctctgatnatagtgaaagatttgtgagagattttgtgtgagagatagtgagagatttgtatgagatta

SEQ ID NO: 38359 - DNA, 121 bp, Artificial Sequence
  Synthesized
  misc_feature (61): n=a or g
agaaaaaaaaaagaagtgtgttgaggaatatgtagcatagggtaagttctgcaccctaggnataagcataagcaatgactactgctaatcatttgcccttctgtgtgttttagtgaacaga

SEQ ID NO: 38360 - DNA, 121 bp, Artificial Sequence
  Synthesized
  misc_feature (61): n=c or g
atttatttgggcacgtacttggtatgactttgggcatgcactgggtatgaaacaccttctnaaggtgcttcttgcactacactgatgatagagggaagtcatgagtagcacagatgaggta

SEQ ID NO: 38361 - DNA, 121 bp, Artificial Sequence
  Synthesized
  misc_feature (61): n=a or t
cagagctgcggaaagggcagcccgtgttgctttcccttggacgaagtgcgatttcgagccngggaaaccactgactgagaacggccatttcgaaatgaaagcggcttttcgatagaggctg

SEQ ID NO: 38362 - DNA, 121 bp, Artificial Sequence
  Synthesized
  misc_feature (61): n=t or c
gaactgtttctagtggcctcaaaacttgtaggcactaggaaaggatcaccacatacttacngcatctccccactgctttctttgtgcatccctcgcaagctacaccagaggttagacagca

SEQ ID NO: 38363 - DNA, 121 bp, Artificial Sequence
  Synthesized
  misc_feature (61): n=t or g
tgggacgccgtgccaagggacagtcccactcaccattcgccttcaccacagtctcttcagnaagacgaggaggaacggtggagcaccctgcttaccatgccagagcacacaggcttgggga

SEQ ID NO: 38364 - DNA, 121 bp, Artificial Sequence
  Synthesized
  misc_feature (61): n=a or c
ctggggctcagttttggggggggttcctggctctttttggttgttcagagcgcagtttttncttcaggcaaagctttaggccaagaggtgtggttggggcagcgctccctgctcggctctt

SEQ ID NO: 38365 - DNA, 121 bp, Artificial Sequence
  Synthesized
  misc_feature (61): n=t or c
aaaacgagctgtgtaatctcaaatattctagattcacgtctatatcacagtggtcacagcnttatgcttcctgatagacgatgatataaaatgaggaaaggttacagtaatatgatgtttg

SEQ ID NO: 38366 - DNA, 121 bp, Artificial Sequence
  Synthesized
  misc_feature (61): n=t or g
agagcgatgggaaaagctacattccattcagaaacaatataccagttgtcacaacacactnaatccaagaaaagagacactgctgtaaataaaaagttcagaatcacactggcattttaga

SEQ ID NO: 38367 - DNA, 121 bp, Artificial Sequence
  Synthesized
  misc_feature (61): n=t or c
gaggctgcaccttgagctctgtgctcagctttgggcacctctgtcatggaagcagctgctntcactgattctgtacatatttgctgttacagcattattttgtcacctttctagacagctt

SEQ ID NO: 38368 - DNA, 121 bp, Artificial Sequence
  Synthesized
  misc_feature (61): n=t or c
ctgccaccttccaccacaaccacagagcagatttttttttatgcaagagagtgctgaagcngctgtgcgtctgtctgtccagcattgtgtaccagtagtgcagtgaaaaaatggtcagtcc

SEQ ID NO: 38369 - DNA, 121 bp, Artificial Sequence
  Synthesized
  misc_feature (61): n=a or t
gaaattaccacacttgcaaccagatgtttttaccgccttactcaaagtaggggactgtctnctgttgattgtaagacttctattaaacttttcttacaacaccactaagacacctgctcat

SEQ ID NO: 38370 - DNA, 121 bp, Artificial Sequence
  Synthesized
  misc_feature (61): n=t or c
tgtgaaggttacaggatgatcgcgggttggggttgatcagaggttcccagcctgtgtcagnacatctggggctcgccctgctccaaaaggattggtgtgatcccaaaggaaagccatccgt

SEQ ID NO: 38371 - DNA, 121 bp, Artificial Sequence
  Synthesized
  misc_feature (61): n=t or c
actgcaaatgttataagtgggtttggcccagctaaccccattccatttatctacattaganattcagtttatctaaattagctaatgacaggctgtgaagctcagctgctgcagctcctgc

SEQ ID NO: 38372 - DNA, 121 bp, Artificial Sequence
  Synthesized
  misc_feature (61): n=t or c
tatgcagatttgtcctaaatgcctgacttgtttatgttaactggaaatatttgctttcttnagtccttgcaaatttaacctgctaaattgtatttccagctaaagaactttataaagagtt

SEQ ID NO: 38373 - DNA, 121 bp, Artificial Sequence
  Synthesized
  misc_feature (61): n=a or t
aaaataaaatgaactatttgataacaagattaatgtacaggcatttttttcctaaatattncttcttctttcatgcagaaagcttgggaattttctgaggagctgcccattttatctggga

SEQ ID NO: 38374 - DNA, 121 bp, Artificial Sequence
  Synthesized
  misc_feature (61): n=t or c
aaatatactgcaattctccaacgcttattttggtttctcttgtgccaaacagcaacagcantcattacctcctttattctaagaacaaggcctgacatctatataacacacattgctctcc

SEQ ID NO: 38375 - DNA, 121 bp, Artificial Sequence
  Synthesized
  misc_feature (61): n=a or t
attggtatccatagaccacgtattccgagcaggagaaaagaggtaaaattcatcgaataanttgtttgaagtgaataattcactcggctttagcactaagcaacagagagataagtaaaca

SEQ ID NO: 38376 - DNA, 121 bp, Artificial Sequence
  Synthesized
  misc_feature (61): n=t or c
agacgttcgcttggtcctgagccaggagcagagcattagggaagcagggttatgcaaaacntccctggagattcttggtctagaagggtttcattttgagcttttggataaattcaatccc

SEQ ID NO: 38377 - DNA, 121 bp, Artificial Sequence
  Synthesized
  misc_feature (61): n=a or t
gtcaaatgccttctttgtctgtctagcttgaagattttttttcacttctgaaagtcagacncctgaatgtactgatattgtcacttacttgttgcattttgctgcagctgctgctttgatt

SEQ ID NO: 38378 - DNA, 121 bp, Artificial Sequence
  Synthesized
  misc_feature (61): n=t or g
aacaaataacattgggacacacagtatcacaattaacacgaaggacagaatacctacattngtatttagcagataccctgacttcctccttcatggtcaggatgtgggtggagcactcatt

SEQ ID NO: 38379 - DNA, 121 bp, Artificial Sequence
  Synthesized
  misc_feature (61): n=t or c
gatggtgagagatgtctataaaacagcagcgtggaaaagcaagagggaaatgactggtcantgcctctgccagtgcttaaattggaaatgagcagatgaagtgatcaggtacaaaacagat

SEQ ID NO: 38380 - DNA, 121 bp, Artificial Sequence
  Synthesized
  misc_feature (61): n=a or g
ttccctggtggcccaggagcatacctacatcttggagcagctcctcttggactgtctgctncccaagtgtgtcttctgataggcttagaacagatgcaggagataggttcctacagaagta

SEQ ID NO: 38381 - DNA, 121 bp, Artificial Sequence
  Synthesized
  misc_feature (61): n=t or g
ggtactaggcatctaattaggttagcaggcatcttcagagaagctgctataggtatggacnacagatgagtcacagagtatatcaaggatcatagctattgctgtagtgcaggttgaaagg

SEQ ID NO: 38382 - DNA, 121 bp, Artificial Sequence
  Synthesized
  misc_feature (61): n=t or c
attcccacagtgctccaagagtcagatattaaagcctaattactgacctcaacgagtacanggcctactcactctagactgactctactccagtgtctacatctactctagattggaggac

SEQ ID NO: 38383 - DNA, 121 bp, Artificial Sequence
  Synthesized
  misc_feature (61): n=t or c
acatcacaagcttcataaatcagttcctttctacgtacctaaagcctttgaacagctcatncaacagttctcacggctttaatcgttaacttgaccatggtttttaatgcctccaattttt

SEQ ID NO: 38384 - DNA, 121 bp, Artificial Sequence
  Synthesized
  misc_feature (61): n=t or c
acgagcaccaatgccaaagagaatctcatgggctcagagattcatggccattcatcccaanacagcttgacctgtaggccaagtgttgagagcaaaacacaggggaacccacctgtgaaca

SEQ ID NO: 38385 - DNA, 121 bp, Artificial Sequence
  Synthesized
  misc_feature (61): n=t or c
tggctgtatgagatgtgtgttgcaggaagccatggggatggcatgggcatgtggctctgcnaagcaaggagtccctatatgttaaagcaccccataggctttgcttgctgactgcctactg

SEQ ID NO: 38386 - DNA, 121 bp, Artificial Sequence
  Synthesized
  misc_feature (61): n=t or c
tttactgtcctgaggaaaaggatcttcttttaaagcatcaaaggattcatacagggctaancagttcaagggaacgtttctaaacttgtttcctgatcatacagtgcccagtacaaccaaa

SEQ ID NO: 38387 - DNA, 121 bp, Artificial Sequence
  Synthesized
  misc_feature (61): n=a or g
gatgtttctgctatttaaaatgcaactagctctcatctacaaggtggaacctttacctganactaatttgaactctaacttcttaaagatgttagaagtttaaaagtcatacaagaatgaa

SEQ ID NO: 38388 - DNA, 121 bp, Artificial Sequence
  Synthesized
  misc_feature (61): n=a or t
atgtattttagccaaatttaaatacttttttcaagtaagcattataagcattggaatcaangcattgattgcattgtttgaggcttcagatgttaagaatctcttattaatcacatcttca

SEQ ID NO: 38389 - DNA, 121 bp, Artificial Sequence
  Synthesized
  misc_feature (61): n=a or g
cagtatgaattaggactgcaccctgctagcaccttaataagacaaatatattagagtttcntttgaaacaagttccaacaagtttataagcaagagataataaggaaaaacctacaaaaga

SEQ ID NO: 38390 - DNA, 121 bp, Artificial Sequence
  Synthesized
  misc_feature (61): n=a or g
caacccagctaccctggggaacactcatcctcactgctttcgagagccagccagacccacnaaacacctttttgcgccttggagctggaaggaaagcacagcccgaggtgcagagcaaaca

SEQ ID NO: 38391 - DNA, 121 bp, Artificial Sequence
  Synthesized
  misc_feature (61): n=a or t
gttatcctgaggactgacagacctgtggttatatagcttttgttgtcataagaaaaaaaanaaaacacacaactatttagcaactgcacttttgagtcaatgaaaagacagatacctgaaa

SEQ ID NO: 38392 - DNA, 121 bp, Artificial Sequence
  Synthesized
  misc_feature (61): n=a or c
agagccgcaagcatgctaaggaggggaaattgtacaatgaatttcttgcccagctcttgtncccatgagcttacttttgtaactgaggttcacctcagggtaacaacatacaaggagccga

SEQ ID NO: 38393 - DNA, 121 bp, Artificial Sequence
  Synthesized
  misc_feature (61): n=t or c
ttcacagatgcaacccactttggggttttgcatttttaaaagtggatcgagtgaagtgccnggtcctgtccattcttggaatattaaatagaccctaatttcactcaggatctcaggagtt

SEQ ID NO: 38394 - DNA, 121 bp, Artificial Sequence
  Synthesized
  misc_feature (61): n=t or c
taaaatatgcttgcttgatattgcaggcatttgcattttatatacttcagttgccatctgntaatagcaatttaatcattcaataaataacactaaagagagcaacattaatgaagactgg

SEQ ID NO: 38395 - DNA, 121 bp, Artificial Sequence
  Synthesized
  misc_feature (61): n=a or g
tcctttagaaaaactgccacctcctaaataactaattgaacctcatacatcaatgtaatanagaattaaaactatcagaaaaaaacaagtactacttcagccttcttaattctgtgagggt

SEQ ID NO: 38396 - DNA, 121 bp, Artificial Sequence
  Synthesized
  misc_feature (61): n=a or t
gcaggacagggctgtgccaggtatttagtcctgaaggtgtgagttgaatgtcaggaaatangttatttccactggtgaggatgagaaggagcctgctggaggtgaagagaagctccaagca

SEQ ID NO: 38397 - DNA, 121 bp, Artificial Sequence
  Synthesized
  misc_feature (61): n=a or g
agcagtaaaggacagctggcaaaatcagaccccaccctccctgggatctgggccttttaantaagaacggagagagtgctgcaaggaattggaatgggatatttggtaggggctggaccct

SEQ ID NO: 38398 - DNA, 121 bp, Artificial Sequence
  Synthesized
  misc_feature (61): n=t or c
acagagaataaatgtaggaccaagtactctgactcaataaagtacattcaaagagttgtgnagatgatgtattttcaagtcactgagattttggaggtcaaaatgtttgttttgtccagaa

SEQ ID NO: 38399 - DNA, 121 bp, Artificial Sequence
  Synthesized
  misc_feature (61): n=a or g
tcagctaaaatgccctgaagtgttacaaatatgagaagtgtcttgaactggtgctgcagancatgtctttaagcacatatttcaggccgaacagaactccaaaaaccttaaagtggtaata

SEQ ID NO: 38400 - DNA, 121 bp, Artificial Sequence
  Synthesized
  misc_feature (61): n=t or c
gtgggctctgcatcccacacgggatcccagttaccctctgaagcttcagtgggtagaaganctgtgcctgtcctgtgcagtcacgttcatccttggcagcctcgctgagacctgaaatctg

SEQ ID NO: 38401 - DNA, 121 bp, Artificial Sequence
  Synthesized
  misc_feature (61): n=t or c
agaagtatgacagggcatgctgagtccctgtctcccatgggaagggagatggggcagtaangtctgtgcaaacgtgctcacccacctgcctccaggaacaggaatgtctgagcactgcagt

SEQ ID NO: 38402 - DNA, 121 bp, Artificial Sequence
  Synthesized
  misc_feature (61): n=a or g
aactattctgtagtagactattgatctccctttcctctttctatttaaatgcagactcaangtcttccctgaaagcctcggtctagtacataacacagactcacaagtctcccagcactcc

SEQ ID NO: 38403 - DNA, 121 bp, Artificial Sequence
  Synthesized
  misc_feature (61): n=a or g
ccaaagacagacactacagaatattattgctctattttctcacctgtgcattgctctgacnttttcacacaacagtgctctcagggagagaacaagaagcccaactcagcttcactgcact

SEQ ID NO: 38404 - DNA, 121 bp, Artificial Sequence
  Synthesized
  misc_feature (61): n=a or g
aaaacacgtaacaactgccaagttttatgtatagaggcagttcagtatatcagggaggccnttgcaaatttcatgggtcatagtaattcactgtttattgcctcatacacacagagctaac

SEQ ID NO: 38405 - DNA, 121 bp, Artificial Sequence
  Synthesized
  misc_feature (61): n=a or g
agatccctaccccaccccatatccttttggctcccttaaatacccctacattaaaaaaaantacagaaatatagcactaaagagggctgtctgattcttagatctctcaatatattgccca

SEQ ID NO: 38406 - DNA, 121 bp, Artificial Sequence
  Synthesized
  misc_feature (61): n=a or t
agggggctggacacacctccaaattgggatgtgctcaatgacatctaagcaccataaaacngttttgccttaattgcctttttgccacacctgaaattagcagtgctgctttaagagagca

SEQ ID NO: 38407 - DNA, 121 bp, Artificial Sequence
  Synthesized
  misc_feature (61): n=t or c
gttgggtgccgccattatttatcccctccctttattttctgcacccaatgcgttgctgtgngttgaggaacacgtgttcttcgtgccggtaggaaggtaggatgtgacatgtgcataaacc

SEQ ID NO: 38408 - DNA, 121 bp, Artificial Sequence
  Synthesized
  misc_feature (61): n=a or g
ttgtgtctagctgaaggaaacgttttttcataattactttacctacttttgggaagatttntttgaattgtgtagaatggccttagtaggctataaagggaataaattctcttctgtgata

SEQ ID NO: 38409 - DNA, 121 bp, Artificial Sequence
  Synthesized
  misc_feature (61): n=a or g
tgcactgcagtgtgtatttatacagcctgggtgcagcctgaattaccacgtgctatggagncagtaaggttcgtttgatttaagtcgcagacagctgttcatttgaaataaatatttgtgt

SEQ ID NO: 38410 - DNA, 121 bp, Artificial Sequence
  Synthesized
  misc_feature (61): n=t or c
aacacagactaaaccaggtgatgtgttttagtgaagcaagatcagttgtatattataccanggcgatttagaagttccgtctagtctttgcacaaagaaaaatgttgtatcacaggacagg

SEQ ID NO: 38411 - DNA, 121 bp, Artificial Sequence
  Synthesized
  misc_feature (61): n=t or g
tgcccctcactgcaggtgccagccataccagctgtcatccctggtgcaggtgatcttgacngttcctcccaggttcgctgacaccgaggccggctgagtcagcgctgcctgcaccagggaa

SEQ ID NO: 38412 - DNA, 121 bp, Artificial Sequence
  Synthesized
  misc_feature (61): n=a or g
cctcatgatattatgattctataaatacaattttcttttctgtaccattagtggaaccccnctacttgaggtactagcacactgtggtggggaggcacacacacagccaaactgcacaaca

SEQ ID NO: 38413 - DNA, 121 bp, Artificial Sequence
  Synthesized
  misc_feature (61): n=a or c
cctgggatgggctctttccatcttgtttgggtttggaggaagaacagctttggcagcgcanggcctcatcccaaaataactcggcctcccatggtaattacagagctgcccctcctgggct

SEQ ID NO: 38414 - DNA, 121 bp, Artificial Sequence
  Synthesized
  misc_feature (61): n=a or g
tgactgcacagtcttctgctatttgaggaatgagtagatgttatcaacaaagccccttgcnctctaccaaaccctattttacatactaaagaagaatacaaagcaaaaggacaacttgaca

SEQ ID NO: 38415 - DNA, 121 bp, Artificial Sequence
  Synthesized
  misc_feature (61): n=t or c
ctcagtttctccaggagatgacggaaaaagttgtcaagctctttcccttcgatgtagccgntgtctaaacacaagcaggacatcaaggacgggccttacaggctgagtgcaggggctgcag

SEQ ID NO: 38416 - DNA, 121 bp, Artificial Sequence
  Synthesized
  misc_feature (61): n=t or g
ttcagctgtactttaaacatttatgcctgtcaggattagataggttatactgcagccccanctaacaaactgccctgtgctgctccttcattcccacaccgagcaggagaaacacagaagc

SEQ ID NO: 38417 - DNA, 121 bp, Artificial Sequence
  Synthesized
  misc_feature (61): n=c or g
attttagcccggtgaatgcatcggaactgctgcttgtgccgcgggctccagcaccgagatncctgaattgtcctcggttttggccacgagctaaatctccgcttcccggtcatctatcaca

SEQ ID NO: 38418 - DNA, 121 bp, Artificial Sequence
  Synthesized
  misc_feature (61): n=t or c
catacatttactcttgaatcatcatactagatagaaataagaggcagtttcccataccccngtttagttttggccattaagcagcagaaacagtcttatatcacgatcagcttgaattcct

SEQ ID NO: 38419 - DNA, 121 bp, Artificial Sequence
  Synthesized
  misc_feature (61): n=t or c
ggagctctattctgtgactaccaacatctgcttctatcactgacctatagggtttatggantgtgagctggctcatactgtcagctcatgcctggcacacacagaccaccacccagcccag

SEQ ID NO: 38420 - DNA, 121 bp, Artificial Sequence
  Synthesized
  misc_feature (61): n=t or c
taatgaggcaacactaatgcccactcgatgctatgcgtgtgtcagagacatccagcaacangtaaggaggttgctgccttggcacagtcagggatgaggaggcagcagctgctgctgccca

SEQ ID NO: 38421 - DNA, 121 bp, Artificial Sequence
  Synthesized
  misc_feature (61): n=t or c
ctgaaatctgggaagaaaactgtcttgctccaacgtggtgttagataaactaattacacanggacagctgtgagtatcaggacctgcaccacagtgtcacaaatgaactgcttgcaactga

SEQ ID NO: 38422 - DNA, 121 bp, Artificial Sequence
  Synthesized
  misc_feature (61): n=a or g
tatccatctgataatcttcagattacgctcattttagtcacgtgcacagtatgtttgaaanaagtaaagaacgggtatataccaagatgcatttacaaatggattccttacctcttcctcc

SEQ ID NO: 38423 - DNA, 121 bp, Artificial Sequence
  Synthesized
  misc_feature (61): n=t or c
ttcatagtttccttcttatgactccatggaacaaacagagggggtcacctggcaataaacnctccatggaaatgtacttcctcttcatgaaccaagatcatggaagctcccttcaccctgc

SEQ ID NO: 38424 - DNA, 121 bp, Artificial Sequence
  Synthesized
  misc_feature (61): n=a or g
acaaaatgtaatggaatactggcaggaaggttcaacatctgccttcgatgttgtgggccantataataaaatatgaggagcagttctcatatgttttgtagggtacaacataacgttgtac

SEQ ID NO: 38425 - DNA, 121 bp, Artificial Sequence
  Synthesized
  misc_feature (61): n=a or g
gaagactctcagagcagattgcttcccagagggctgcagcccaactcgccttaaaagatgncaacttggaagtggggcagtttacctgaaacatcaaaacagggcagtagggagagcagga

SEQ ID NO: 38426 - DNA, 121 bp, Artificial Sequence
  Synthesized
  misc_feature (61): n=t or c
aaaacttttctggaggtttgctatgtaacgctatgttacacttcttgttactttttcaaangattactactttgaagtctggttggtgtgttctgaggcaggggcacaaatatgagaagaa

SEQ ID NO: 38427 - DNA, 121 bp, Artificial Sequence
  Synthesized
  misc_feature (61): n=t or c
caagtacaattgaatgttgcggctttagaccaatccaaagacttagccctaggtgcctttntaaaggtccctgatgcgggtaagccccaatgttcgtttaccaacataaagcaggggccag

SEQ ID NO: 38428 - DNA, 121 bp, Artificial Sequence
  Synthesized
  misc_feature (61): n=c or g
catgcaagggccagcagtaaaccctcagtgtaggaggagaaggtccttgttttgggctttntttacaacagttcctaacagtgggagagctgactttgggctcagacagctgtactcaact

SEQ ID NO: 38429 - DNA, 121 bp, Artificial Sequence
  Synthesized
  misc_feature (61): n=a or g
cagattgctggatgccataagctttttgttgccttctgacacagtgcttgcttcaccaagnaagggccgttgtatttgcaaaggtgcatgtcctgttctcttccccttcacccaatcctgt

SEQ ID NO: 38430 - DNA, 121 bp, Artificial Sequence
  Synthesized
  misc_feature (61): n=c or g
ctggtggctcacttacagcttgctgagctccagctctaattttagtgcctgattttagggnccttcagttccatgcagttggggctctttctggctgggtttgtactgtaggtagccccga

SEQ ID NO: 38431 - DNA, 121 bp, Artificial Sequence
  Synthesized
  misc_feature (61): n=t or c
ttatcatggcctccacgtcaaaccctatcaacaaaaaatggtagctaataatttgagcatntaaggcatctagccaaactgaagcctgtctctggatatgctatgtgtaactaacttctat

SEQ ID NO: 38432 - DNA, 121 bp, Artificial Sequence
  Synthesized
  misc_feature (61): n=a or t
gagcatgtagatccatttaaggcaatttagtaggtatgtaaaaggaacttgcaaaaaaagnagatagatactttggaaatgtacttagcaatttgataactgccttattttgataatgtat

SEQ ID NO: 38433 - DNA, 121 bp, Artificial Sequence
  Synthesized
  misc_feature (61): n=a or g
aatcagagacatgcaaagtgttttccaaatacttcaagtgctgaagggcacgtggctcaangaaattaaatagaaatgaagttatctgctgtttcagaaagaaaaaaatctagattcgtat

SEQ ID NO: 38434 - DNA, 121 bp, Artificial Sequence
  Synthesized
  misc_feature (61): n=a or g
aaaaaatatactttaagacttgctggcttttagacactatcttcctcttaacaaaatagtnctgtattgcttaaaagaggaatattttcaaatcttgtgtaaatatccaaattatataaat

SEQ ID NO: 38435 - DNA, 121 bp, Artificial Sequence
  Synthesized
  misc_feature (61): n=a or g
tctggaatggtgagttctgccaagaccagtttctgctgctgtcatctgggtatacagaggnatatgaccagctttgagttgaaatttagcgttccaagcaactggctgggggaaatgtttt

SEQ ID NO: 38436 - DNA, 121 bp, Artificial Sequence
  Synthesized
  misc_feature (61): n=a or g
ttgatagggaaaccaatgaagttgtttgaatcttaatgtgacttttttgaccttttctatnctttctcataaaagattgtagaaatgtgatttgactctcattgcattgtaagtttaagga

SEQ ID NO: 38437 - DNA, 121 bp, Artificial Sequence
  Synthesized
  misc_feature (61): n=a or g
acaccgcactcaaaaaaaaagtgctgcagtcgcactttgagatttattttaactctttagnaaaacaaaatccctgaatcaaaacaagaagagccacgaaggagtgtgggaaacttctccc

SEQ ID NO: 38438 - DNA, 121 bp, Artificial Sequence
  Synthesized
  misc_feature (61): n=t or c
atgttggtcacatttaaagatcagaaactagttcatcaaatttcagtttaaaatgttccanatttggcacaacaaagctcacaatagacctagaaatcaaggcagttggttagacctagta

SEQ ID NO: 38439 - DNA, 121 bp, Artificial Sequence
  Synthesized
  misc_feature (61): n=t or c
tctgacgtcctgtttgcttgaggtgctttgtgatgttgggattgcaggcagctctgtgcanctctgcgtggaggagatgagaagggtgagggggggctgtaagaaagaagaggacccttta

SEQ ID NO: 38440 - DNA, 121 bp, Artificial Sequence
  Synthesized
  misc_feature (61): n=a or g
tattatccatttaatccatgtaaattcaagccttggcctaaggaatgttctcgggtaagantaagggcagatgttgtctgaactttgattccttttttcattcctctgtgaaaagagatgt

SEQ ID NO: 38441 - DNA, 121 bp, Artificial Sequence
  Synthesized
  misc_feature (61): n=a or g
tccaaaggagaacgaagtggttttcaagatgttttcattgggttccctccgattttgcagngcagtgcaaaaaaaaatgcacaaagatgcttgtttggaaaggcaagcagcgggtgtatga

SEQ ID NO: 38442 - DNA, 121 bp, Artificial Sequence
  Synthesized
  misc_feature (61): n=a or t
tatacttataccagaaacttgcaatgcctcctgtatgaaaacagtttttctagactgtctnaatacttgaaggtaaagtgtagctatgtgcccaaataattacgcctcgaataaaagagaa

SEQ ID NO: 38443 - DNA, 121 bp, Artificial Sequence
  Synthesized
  misc_feature (61): n=t or c
aatttcatgaggttcctaataattcagtttcttatcctctgacatctctgaattccaacanaaatatttgttatgtaaactatttctcccaattttgtgttttatgcaaacatatttaggg

SEQ ID NO: 38444 - DNA, 121 bp, Artificial Sequence
  Synthesized
  misc_feature (61): n=a or t
aggtgcatgtacaaagatatgaactgatatcattgctgtttttcccacatttttttgaggnataaagcatctgatgttatgctcagtgtcacactgaaaactagcacagcagcagcatgct

SEQ ID NO: 38445 - DNA, 121 bp, Artificial Sequence
  Synthesized
  misc_feature (61): n=a or g
actagctcacccccatgcaacctccacctccctcaagtacattcacagacatacggaaggnctggagcagtcagaataatgggcaatatatactgaaaagagagcgccaaggcaggaataa

SEQ ID NO: 38446 - DNA, 121 bp, Artificial Sequence
  Synthesized
  misc_feature (61): n=a or g
tcaccgaacgtcctcaggtacctcagtcatttatacccagtgctgttagcttcctacattnctcctctcaggtgtctgtgaagcacgcccactgacaatcatttttcagccaacacctcca

SEQ ID NO: 38447 - DNA, 121 bp, Artificial Sequence
  Synthesized
  misc_feature (61): n=a or g
tcctgttggaaggcaaggatgagccaaggtgattccagctcatctcacacccttcctctcnttaaatgcctgcaccaggcgcttacacagggagcagcagggccccagtaaagctgctcgc

SEQ ID NO: 38448 - DNA, 121 bp, Artificial Sequence
  Synthesized
  misc_feature (61): n=a or g
caccaacctctcggggtacgggggcaaaaatgagctgcttctatttaaaacccagaaagcnactgaacatcagtgccagagtgcagcgtggctttatgagggatttgaagaacttggctcc

SEQ ID NO: 38449 - DNA, 121 bp, Artificial Sequence
  Synthesized
  misc_feature (61): n=a or g
agagcagcgtagaaataaatgggtttggtttattcaaaatgggtaaagaagatcaagcacngggtatgacaggctgctttttcatctcgaaaatcacgctgcacaaaaaagggttggagag

SEQ ID NO: 38450 - DNA, 121 bp, Artificial Sequence
  Synthesized
  misc_feature (61): n=t or c
aactggtccttcttgactagtacagctgaggcaatgatgaatgtgttagaggtccagatanaaaaaatagcagttggaaatgcgaaaaataaacctaggatatctgctattgaccgtgtca

SEQ ID NO: 38451 - DNA, 121 bp, Artificial Sequence
  Synthesized
  misc_feature (61): n=a or g
ttgcaataataacaagtctgtggtaaatcagcattttctcccaagagatgaataaacgganaaggcatcttttagttttctaactgataaactaaaaagtcctacacattcagttgcccct

SEQ ID NO: 38452 - DNA, 121 bp, Artificial Sequence
  Synthesized
  misc_feature (61): n=t or c
aatgctgcattattgtcagacattcctgaataagtggtacaaccttatgcaaaatccaaanaaacctagcatgtgaaaatggcatttaagcctgaataaagtgttaaaataaacgtattag

SEQ ID NO: 38453 - DNA, 121 bp, Artificial Sequence
  Synthesized
  misc_feature (61): n=c or g
accatgtgccctgcagctggcagtggatcctgatgtgcacttggggccagatgccccgctncaaaccatgattatctgtgatggttttacttcatctgttgataacaaaaccgattttcct

SEQ ID NO: 38454 - DNA, 121 bp, Artificial Sequence
  Synthesized
  misc_feature (61): n=t or c
taggccgtggagaaagaacagttgtgggattgctatgtgcatcatgccaggctttccaacngcctctgttctgtggtcaatttaaatcagtccacactgttccatcccaaaaaacactgat

SEQ ID NO: 38455 - DNA, 121 bp, Artificial Sequence
  Synthesized
  misc_feature (61): n=a or g
ttatatgagcacataataatttattgatgtcaaggcttacagttgaaagatcatgatgagncatgtattttaagagtaaataaatggtctccagagatcctttccaacccctacaatcctg

SEQ ID NO: 38456 - DNA, 121 bp, Artificial Sequence
  Synthesized
  misc_feature (61): n=a or g
cgggagggtctcaagccctcctccctcctcccttccatctctattgatcccattttcttcngctgctggaatcaatagcaccggcacaaagcacacggctgcctctgctccaggcctggct

SEQ ID NO: 38457 - DNA, 121 bp, Artificial Sequence
  Synthesized
  misc_feature (61): n=t or c
aggactaaagcagtatgaacgaagcttcttgcttcctgagcaaccaccagcaattcatcangttttagaagctgcagcctgcacaaattccgaatttcatgtttttctctgccttctgatt

SEQ ID NO: 38458 - DNA, 121 bp, Artificial Sequence
  Synthesized
  misc_feature (61): n=a or g
taagaaaatgcaggtgaaaacatactgtcttctaagaaataagatgctgatgtgaaatttnaggagcacttccccagtttaaaaattgagtagctttggaggacgacaatgaggaaagttg

SEQ ID NO: 38459 - DNA, 121 bp, Artificial Sequence
  Synthesized
  misc_feature (61): n=t or c
aaatatacttaatgaagcttgaaatagagaaaaattagaatgccattttcactaaattttncagcatttaattcaagtcaaataatcgcgggaggtggcacagcagagtgttaaaataaaa

SEQ ID NO: 38460 - DNA, 121 bp, Artificial Sequence
  Synthesized
  misc_feature (61): n=t or c
ttcctctaattcaacatggctgagtgctctcaatatcaatatccacagaaaggttttatanatttgctgaatcctgctgatttttggctcagtaatatctgtgaaatgagttacaccagtt

SEQ ID NO: 38461 - DNA, 121 bp, Artificial Sequence
  Synthesized
  misc_feature (61): n=t or c
gtttgcccacaccttgaccccaagctgtctgcatcctgacccaatcccagctgcatccctncccatctggatgtgtccgccctgatcctatcctggtcctataccagtagcatcccagccc

SEQ ID NO: 38462 - DNA, 121 bp, Artificial Sequence
  Synthesized
  misc_feature (61): n=a or g
cacattcacggtttccatcagagaaagggcaccaactcagcagttttcttctgataggtcngtgggaatttgaagcagcatccccatatctccagttattaccgtatgttaaagatcccag

SEQ ID NO: 38463 - DNA, 121 bp, Artificial Sequence
  Synthesized
  misc_feature (61): n=t or g
ttatatatatacacacacacacagaactgagacacttccagtgttgctgctttttctttanggaattccttgcctaaatttgctatgacaggacttacaaagattcagttctgtttttaat

SEQ ID NO: 38464 - DNA, 121 bp, Artificial Sequence
  Synthesized
  misc_feature (61): n=a or g
ccttaggacccagaggtccccttagagagaggtaaaggaaggggcctgtaagagcccatgnagggttccaccccttctggactgaaagcagtgtgcaaactgcagggaaatgagacattgg

SEQ ID NO: 38465 - DNA, 121 bp, Artificial Sequence
  Synthesized
  misc_feature (61): n=c or g
ttatccaagccagtatccagtacaaggtaaaatgatttggtgaaaaagcatacgtgcccanagctgacagactttgtggcgtacacacagaagcaaagctcccgtgcttattgatctgctt

SEQ ID NO: 38466 - DNA, 121 bp, Artificial Sequence
  Synthesized
  misc_feature (61): n=t or c
tttcatcaccttcccaaacttacgatgtctgtagagttcatactttcctcaggtacattgnctaagggatatagtctctacaatgactgatgtcaaacacaaatgtgtatgaaatagaaga

SEQ ID NO: 38467 - DNA, 121 bp, Artificial Sequence
  Synthesized
  misc_feature (61): n=a or g
ttttctttttaccttgtaagcacttctgtctcctctgaaaactgatccctttatttagtgntataaatttattctaatttgctgtttcacaaataaagtcacagcagataattgggattcc

SEQ ID NO: 38468 - DNA, 121 bp, Artificial Sequence
  Synthesized
  misc_feature (61): n=t or c
aacccgaagcagcagtttgttctggtcctcccaaaagccaagtggaaacatagggtcaggnaaatcccacatagaataaggtgtgaatccaccacagccaggcaaaaataatgcaagaggc

SEQ ID NO: 38469 - DNA, 121 bp, Artificial Sequence
  Synthesized
  misc_feature (61): n=a or g
ctttgtagtgctttctaaagctttgtgaagttgagacaaacttttcacagcacctgaaatnaaaatgacattttagaattgtattctggtttgagtacagcctaggtggaagaggacaaag

SEQ ID NO: 38470 - DNA, 121 bp, Artificial Sequence
  Synthesized
  misc_feature (61): n=t or g
ccacagttctaatgaaggtgcttctgaagcagaattacccaagcagctgttcttgtgtgangtctggacacgggaaaaattgcctttgaggagccaaatccctgcagccgggctgggtgct

SEQ ID NO: 38471 - DNA, 121 bp, Artificial Sequence
  Synthesized
  misc_feature (61): n=a or g
gcaatcatagggcctgtggagtgcaacaattgcagtctaacatttcagctgaccgactacnaacaagatcagcaaattttaatctagctgaacaagactcccaaattagagtgtcagtcca

SEQ ID NO: 38472 - DNA, 121 bp, Artificial Sequence
  Synthesized
  misc_feature (61): n=a or g
ggatcatcgatctgccagaggggaaagagggattcccatcgaactgacattttcaacaccngggcttaagagcaggcactgatgtgagccagctgagcgggatctgtcaaaacaccacatg

SEQ ID NO: 38473 - DNA, 121 bp, Artificial Sequence
  Synthesized
  misc_feature (61): n=a or g
tgaggagaggaagaagcatagcaccactattactctgcttgcagggcctctgaagcacccnatttcccagactctgccttccgttatggaaggagctgagttgtaagagctgctgctgaca

SEQ ID NO: 38474 - DNA, 121 bp, Artificial Sequence
  Synthesized
  misc_feature (61): n=t or c
tggtgccatcatcacatgctgaagtagacaacactcatatttcagcatctttctaaatttntgctgtcacatccattcatctccagacactgttattctaaagtcttccttagcacaaagc

SEQ ID NO: 38475 - DNA, 121 bp, Artificial Sequence
  Synthesized
  misc_feature (61): n=c or g
gtacagtttcatttcctgcattcaggcattatttcaaatggtttggtattattcaaattcntcatttgtgcattttaaataaaacaactgaaaagaaaattcaggtttcagtctgtttggc

SEQ ID NO: 38476 - DNA, 121 bp, Artificial Sequence
  Synthesized
  misc_feature (61): n=c or g
aataccgttcttctccatgattcttggtctttcttgagttttatctctgccctaagtaatncctgtgtctgacctcaagtgatgtctggatccagtttttaacgcagctgtttaagaattc

SEQ ID NO: 38477 - DNA, 121 bp, Artificial Sequence
  Synthesized
  misc_feature (61): n=t or g
aactactgctatatatgcttcctgccaatgcatcttacagaccaagtgtaataataatcangttctgagtatagagttttttatttgcaactgacaaaagtgattattcagcccacaagga

SEQ ID NO: 38478 - DNA, 121 bp, Artificial Sequence
  Synthesized
  misc_feature (61): n=t or c
taggctgagggagaagagtcatgactcaaggcttcctctcctagtcagatctgtctgtgtnggtgggatcaatgtggctgcacagcatgagagcagcagggccacacaggagcccctgagc

SEQ ID NO: 38479 - DNA, 121 bp, Artificial Sequence
  Synthesized
  misc_feature (61): n=a or c
tatggagggtgttcttgccaattccttccctgtctggtgattattaaagaaggcaactatncagacagaaggtagctgtcaagctgtgtctctctagtctgcctctcttctacaggatcct

SEQ ID NO: 38480 - DNA, 121 bp, Artificial Sequence
  Synthesized
  misc_feature (61): n=t or c
catatttgatagtggtagaaagtgtgaaagtctgtcaaacttgaatacaacagattactgnagctttgcaattgaaaatgacagtggacccagaaggtacacatacatgcttaaactagag

SEQ ID NO: 38481 - DNA, 121 bp, Artificial Sequence
  Synthesized
  misc_feature (61): n=t or c
ctgtccccaagactgctttttgctaagcacagcttcaggatattgataaacatgttgcaanctgattgtagaaaaagaattcatacaatttctgtagaagtagtccaaatcaaaaccaaaa

SEQ ID NO: 38482 - DNA, 121 bp, Artificial Sequence
  Synthesized
  misc_feature (61): n=t or c
aaacacgagcaagagagagagcctgtctgagcagtctttaaaaaaatcagtctagacttgntttctttaatttactttagagatggttgggaaaaaggagaagagaattagtgagacagtt

SEQ ID NO: 38483 - DNA, 121 bp, Artificial Sequence
  Synthesized
  misc_feature (61): n=a or g
caaaatgtggggatgaagtttgtgagcagtcactgtcacaaagttgtgctttactgagccncttggaagccatcttgtatcagtagaaatggcataggattcattttttaccttacattag

SEQ ID NO: 38484 - DNA, 121 bp, Artificial Sequence
  Synthesized
  misc_feature (61): n=t or c
tcctagccacaaatcacatttgcagatgcctcaaaaatatcatcacaaagcattcactacnggtggcatttggcaaaacctaaaacccagcagtgttcatgccctcagtgttctgaagagg

SEQ ID NO: 38485 - DNA, 121 bp, Artificial Sequence
  Synthesized
  misc_feature (61): n=c or g
gcatcagaatctctattaggtcgctagcacaaaacatttgatttctgaggagattttactnactgttagctttgcatgtgtccttcttttttttttttttttttttttaactgagtgcctt

SEQ ID NO: 38486 - DNA, 121 bp, Artificial Sequence
  Synthesized
  misc_feature (61): n=t or c
agtatagaaagtatagcaagtttgagttttttaccccatacttttcttcctaaataactgngctacatgtacacacagatcaggaatgttttgaaggcttcagtgatccttcaaatgatgt

SEQ ID NO: 38487 - DNA, 121 bp, Artificial Sequence
  Synthesized
  misc_feature (61): n=t or c
caagcttctctactaaaagttaaaaaataaaaatactcatgatatctgagctgatatcacncaattttggtgcccaactcaagaatttttaaggttcaaaggcttggagtctgcagcagca

SEQ ID NO: 38488 - DNA, 121 bp, Artificial Sequence
  Synthesized
  misc_feature (61): n=t or c
tatgattttaaaaccttccactcgttttttcccttgaaattacataaaggataatcacagnctggccttgcgtaaagacttcaggttctcatttgtactaggtatttctagtgttcatatt

SEQ ID NO: 38489 - DNA, 121 bp, Artificial Sequence
  Synthesized
  misc_feature (61): n=a or t
acctctgcatcatagcaggtgtatctgcctgctactgcaagcttccaagatgctgtgtgtntatacaacaccaccaattcccagcaaggtgccgtgaggtttcactggaatatcatcacta

SEQ ID NO: 38490 - DNA, 121 bp, Artificial Sequence
  Synthesized
  misc_feature (61): n=a or c
agcagactgtcttctgtatttagttatcttacctattattttcccatagaatctgtatagnttaatctgtctatactagatgttgtgcaaagcttcagagagactagtgcaaagtatagga

SEQ ID NO: 38491 - DNA, 121 bp, Artificial Sequence
  Synthesized
  misc_feature (61): n=c or g
aagtaatttggcaatatatataaaaatgaactcacttaaagcagcaggctctcatccttangttctggtaacctaactgtttgttgtctttaatgtaaattatttaccaagcatgagctta

SEQ ID NO: 38492 - DNA, 121 bp, Artificial Sequence
  Synthesized
  misc_feature (61): n=a or g
gggagatcaggaaatcagtgtttattactcaatttgttgaggagcttgctgcataaagccncatgcaaaacatgccatggacttctcttggatctttacctgcattctttgactccagttt

SEQ ID NO: 38493 - DNA, 121 bp, Artificial Sequence
  Synthesized
  misc_feature (61): n=a or c
cggagctgagttaccgacggaggatgcgaagctctctgcaggagtcagcaggctgccctgnagtgtgttggttgggtgtgagcagcactgctttcagacatttggaacgcttgcctgtggg

SEQ ID NO: 38494 - DNA, 121 bp, Artificial Sequence
  Synthesized
  misc_feature (61): n=t or g
aagcaagtccaattctccagctgttttaacttcaacttaccataggtcatcatacacctgntctgagctactttacgttgactgttacatatacacatcttatttctttcagcaataaact

SEQ ID NO: 38495 - DNA, 121 bp, Artificial Sequence
  Synthesized
  misc_feature (61): n=a or g
ggtgcaggaatagcgagtatctttaaaatacaaagttagcagcaagctgtctgtaagagcngcaaataaatgagggtcccacctttcagaagatcactgtggcaccacccctagagattct

SEQ ID NO: 38496 - DNA, 121 bp, Artificial Sequence
  Synthesized
  misc_feature (61): n=a or g
ctgcttacttatcccttggcagctgcgattagacacacgggactggggctcaaagacagcnctgtgtttaggctgtcaaatgatgaactcactgtggaccgtgggtaagcagctatagcag

SEQ ID NO: 38497 - DNA, 121 bp, Artificial Sequence
  Synthesized
  misc_feature (61): n=a or t
gaggttactttgtgggcaaatgtctttcaatatgtatatgtagccaagctctatctgcatnaatacttgtgcagggtattgggatgatgtccagctcaattatttcaataagaaggtcaga

SEQ ID NO: 38498 - DNA, 121 bp, Artificial Sequence
  Synthesized
  misc_feature (61): n=t or c
agtggcagggcagctgaaggtagttggattccatcttgcttgtgtagctacagctggtaantcacttgggtaggacagagcttttgactaaccagatgttgttctaacttaagcccagatt

SEQ ID NO: 38499 - DNA, 121 bp, Artificial Sequence
  Synthesized
  misc_feature (61): n=a or g
gaacatgacaaatagctgggctaggttctggaaaatatcaacgtggctgaaaaaaaatggnagaaaaggcattctgggtgccattgaaaactgactctttgctccaggagcttgaacaagg

SEQ ID NO: 38500 - DNA, 121 bp, Artificial Sequence
  Synthesized
  misc_feature (61): n=a or g
catgatttggggttggtatgggatgcaatggagccatgcttattgtagagctcagagcatncttttcacccatgctttgggatcagcatggtgtttggcaggatgatgctttggggtcaac

SEQ ID NO: 38501 - DNA, 121 bp, Artificial Sequence
  Synthesized
  misc_feature (61): n=t or c
aacaataagtaaaggtggctggaggctagggagaagttactatcccttgtgctactccttngctgaagtttcagtttagagcagatgatctccagaggtcctttccaacttaatccattct

SEQ ID NO: 38502 - DNA, 121 bp, Artificial Sequence
  Synthesized
  misc_feature (61): n=t or g
cttcatttgtacgcagtttcactatgggctacagccatgtgtagtctattctaccagtctncttgagtgctattatgctagcactgaatagcttgatattctacagtagtgctaacaaaaa

SEQ ID NO: 38503 - DNA, 121 bp, Artificial Sequence
  Synthesized
  misc_feature (61): n=c or g
ccggcaagaggagagcgctaagcttcagaatctgcttccttactgggtttccctgccttantgttgggagggaatgagaacgcttcttagttcatccagctcggatgtggcctatctgacc

SEQ ID NO: 38504 - DNA, 121 bp, Artificial Sequence
  Synthesized
  misc_feature (61): n=a or g
gttggttggttggttttcaagaggagaaactcagacaaatcaaataacaaaaggggctccnaggagttacaattgacatctcaaaggctgcaggttgtgtaacaaagtctgttggatcttt

SEQ ID NO: 38505 - DNA, 121 bp, Artificial Sequence
  Synthesized
  misc_feature (61): n=a or g
ggaagatagggagcaggccattcacatgacatctcagaagttagcaaatgttagctgagcngtgtgaaatacctgcctgctaatttccaaagtgtatatcttacagtagtaaggtagtata

SEQ ID NO: 38506 - DNA, 121 bp, Artificial Sequence
  Synthesized
  misc_feature (61): n=a or g
ctgttgtttcccttagaacaatatgaaagccttgaggaaaattaaactggggaaagattcngtatataaaatgcacaacgcagaatgctggagaagcctcagtttgggcacgaagaaacac

SEQ ID NO: 38507 - DNA, 121 bp, Artificial Sequence
  Synthesized
  misc_feature (61): n=a or g
cagtatgttttgaactgtaagagtccagagcttttgtctgcctcactgtgcatagcacagngaacggaaacttctccaaagcaatgagggtgaggtttgcagccccagtaaaaagccagaa

SEQ ID NO: 38508 - DNA, 121 bp, Artificial Sequence
  Synthesized
  misc_feature (61): n=t or c
cggggcacagagctgctggtgggacgggggatgcaatgaaggcagcaaaagtgcttgtggnttgggtaagaggtcggagccgggaagctgcaggcaggtctgacttctgggagttgcagga

SEQ ID NO: 38509 - DNA, 121 bp, Artificial Sequence
  Synthesized
  misc_feature (61): n=t or c
aggacagtgagttgcttgaatgttgattgttttgcacatgttcctctctggaaagtgagcntttctgactgttggtttatattaaaatgggaaaagctattaattacagtggactgactta

SEQ ID NO: 38510 - DNA, 121 bp, Artificial Sequence
  Synthesized
  misc_feature (61): n=t or g
actgtagaaggccacgtagtgggtcctgtcatccgcataggtattttcagtggtgactttngtttccagcaggttcaaggccagctggcccctctggagggatacctggcacatcccctcc

SEQ ID NO: 38511 - DNA, 121 bp, Artificial Sequence
  Synthesized
  misc_feature (61): n=t or c
ttgcatacctcttacatcttaggacgtgacagatgcaaaactagaggaagatcttcccagntgcaggcataaactatgcttttctctctctttttttacaaatccagagaatacttctctg

SEQ ID NO: 38512 - DNA, 121 bp, Artificial Sequence
  Synthesized
  misc_feature (61): n=a or g
tagcactcccagcaccagatgttacatagaggtcagccttgtggcgctgtgtgagccatangccctacgctagaccttcagcaaaccttgcaccagtgaagcttttgacatatttggagtt

SEQ ID NO: 38513 - DNA, 121 bp, Artificial Sequence
  Synthesized
  misc_feature (61): n=t or c
aacataattatctgcactaccaatagtaattatgtattatgaatcaggtgtaaagtttcantgaaagacatacatatatatggatcccaacccgcatgtcttatttgcagccccattattc

SEQ ID NO: 38514 - DNA, 121 bp, Artificial Sequence
  Synthesized
  misc_feature (61): n=t or c
tactgtaaggttccactgtaagatgttagccaggagaaaaataaaagtgatatttgtggcngtgctggccaggaaaatttttgatgtgtgaattattcttcttacagctatagttgctaat

SEQ ID NO: 38515 - DNA, 121 bp, Artificial Sequence
  Synthesized
  misc_feature (61): n=t or c
cccacttatcacacactacagtgacccctacttctgccagcaacaaagggcccatctcagngcaattattaagctttgggaaaatattccctgtagtgttacacacagtattgttcctcct

SEQ ID NO: 38516 - DNA, 121 bp, Artificial Sequence
  Synthesized
  misc_feature (61): n=a or g
aacctgttcgtcttgttatctgctgaagtcctaatctttttgaagcaggatctttctctcnttaaatgtttgtgtgatgtctagcacaatggaggcctagccttccatgaaatgtctcagt

SEQ ID NO: 38517 - DNA, 121 bp, Artificial Sequence
  Synthesized
  misc_feature (61): n=a or t
ccaccatgaactagggaatttcaggcaagttgtgggctacaatcagttgtgcccaactgcnctaatctgaccctgaagaaagacttagacaagctctcaactcagcaaggaactcagcagc

SEQ ID NO: 38518 - DNA, 121 bp, Artificial Sequence
  Synthesized
  misc_feature (61): n=a or t
ggagcgtatctgcctgggatgaacgcttctacgcgatgccgagaaaagacttcaaaccaanacccccaaaacacaaccgccggtcaaccacccgtgggtgtcgcgcgtgccgctgtccggc

SEQ ID NO: 38519 - DNA, 121 bp, Artificial Sequence
  Synthesized
  misc_feature (61): n=t or g
ctccatcccttcgacccaccctgagaaaacaacctgcagaactcaacaccgttccgctccncagggctaccgcaccggctacacctaccggtaccccttcgtgcaagagaaaagcaaaccc

SEQ ID NO: 38520 - DNA, 121 bp, Artificial Sequence
  Synthesized
  misc_feature (61): n=t or c
caagtcaacaatcaagagcaaaagggaaaaaaggtacatcagagggtacttaaagaataanatgtcacaagactactccattttggctaccatcctgttcctggacaactttactagctgt

SEQ ID NO: 38521 - DNA, 121 bp, Artificial Sequence
  Synthesized
  misc_feature (61): n=t or c
ggggccatttaagaatctacttctcagtagagacactgttgctacggttagcatatctaanctgttgctgtataaagaaaaatggttaagtataaaattagatgattttgagtgaaaaaaa

SEQ ID NO: 38522 - DNA, 121 bp, Artificial Sequence
  Synthesized
  misc_feature (61): n=t or c
aagagcaacacacgggctgggagcttcactgagtgtttttccagcagtgtccccctggagngctctgactctcaagggatgatgctctgctcgattgcataatgtgttgtttgctttgttc

SEQ ID NO: 38523 - DNA, 121 bp, Artificial Sequence
  Synthesized
  misc_feature (61): n=a or g
gtgctgatatgctgatacaagtagttttccacatccatactcttctctttcatatcaaacntatttgcggtcctttattagagttactcccattgaagcccacctgaatcccctggaagat

SEQ ID NO: 38524 - DNA, 121 bp, Artificial Sequence
  Synthesized
  misc_feature (61): n=a or g
tggtatcacacaggcagctgcacaaaggtagagctgctgcagataaaagggaatcatagcnttatttttgctctgaggctctaaaggacttgtctttcttttaatatattttttttctcat

SEQ ID NO: 38525 - DNA, 121 bp, Artificial Sequence
  Synthesized
  misc_feature (61): n=a or g
cctcccttggtgtagcttcccgggcaccacacggctcaggaattctgttgatgctgctgcnccttgcgctgacgttagatgaaatatttatttgggaaagtttcattttaccataattttt

SEQ ID NO: 38526 - DNA, 121 bp, Artificial Sequence
  Synthesized
  misc_feature (61): n=a or g
acaaaacagtgcgaatcgagagggaccctccactcctgtcagtgattttggcaccaatgcncagattaaatccatggtctttttaggagctgacacagttgctagtgactctaggtttagg

SEQ ID NO: 38527 - DNA, 121 bp, Artificial Sequence
  Synthesized
  misc_feature (61): n=t or c
acttggactaggagaggctggtgaaagaaagttgtttcttcactcagctgattctgcttantgctgagggtaactttacaggtgagcaaagcttgtggggtagacagaaatgccgatctat

SEQ ID NO: 38528 - DNA, 121 bp, Artificial Sequence
  Synthesized
  misc_feature (61): n=a or c
ctttctatgcagagaaaaaacgcagcagagctattacctagaaacatttccttaacaatgnacccacaaacaactctgaggttgttcatatgccccaggatggcccatgttcccctggtgt

SEQ ID NO: 38529 - DNA, 121 bp, Artificial Sequence
  Synthesized
  misc_feature (61): n=t or c
ccagttggattttagatatctctaaactaaatcctgaggcccctgagtatctcagagatanggctcaggatgttgaaccaattgtatgggaaacaggcagaggaaagagacggctgagaca

SEQ ID NO: 38530 - DNA, 121 bp, Artificial Sequence
  Synthesized
  misc_feature (61): n=t or c
tttttttttttaactactgtttctactcctgaaatagatcatcccctgcttttggaatgangctatgtatttatgttaaacaagtgctggagatgaccctgaaaatggggaatctcagtcc

SEQ ID NO: 38531 - DNA, 121 bp, Artificial Sequence
  Synthesized
  misc_feature (61): n=a or g
gaaagcactcaggtggagaatgggttgttctgcctggctgcctccgcttataaacaacacngggctggtgtggtggccagggaaagctgggcgtctccatgagcccactgcttcctccaat

SEQ ID NO: 38532 - DNA, 121 bp, Artificial Sequence
  Synthesized
  misc_feature (61): n=c or g
ttcctctgtaaaacaagtcttctgggcagtaaagtactttttcctacagattgctaataanctgtatgtaaggttatataacttctgcacagattgctacggaatgtattgtttaatgacg

SEQ ID NO: 38533 - DNA, 121 bp, Artificial Sequence
  Synthesized
  misc_feature (61): n=t or g
acaaggaaaagaacacatcaaattattattgtgttttatgcactgaccttagcagcagtgnctttaacaggaaaaatattgctgtctagtaaatattctttcctacagaaatgctttattc

SEQ ID NO: 38534 - DNA, 121 bp, Artificial Sequence
  Synthesized
  misc_feature (61): n=t or c
ctaacagcttctcttagtatcaaactccccttaaagttgcagatatttaaaagagaaaganctgagaaaggcaaaacaaacgtattatttgttcaatgggaaaaaaaaacaaccaaaccac

SEQ ID NO: 38535 - DNA, 121 bp, Artificial Sequence
  Synthesized
  misc_feature (61): n=a or g
ttgttggattcattaaataatatctgttatcattaattcaaaacacattgtgtgtatatcntgtgtcctttccaatataagaacacattagcttcttctgcatgagaaaatacacatttat

SEQ ID NO: 38536 - DNA, 121 bp, Artificial Sequence
  Synthesized
  misc_feature (61): n=t or g
ttgcatttctgtaatggataaagaattggttggatgatcataaccagagggttctgattcnatgaaaagaatcaaaatacctcagtaaaaactgtgaataacaatgctggtttaagtgttg

SEQ ID NO: 38537 - DNA, 121 bp, Artificial Sequence
  Synthesized
  misc_feature (61): n=a or g
tcagcagggatttttttatacagtaatttagagtaacttaatctgaacttggatgtaaacnaagcacataaatcaaagttctgttatcgaaatgaactctcagaccaatgaatatttattt

SEQ ID NO: 38538 - DNA, 121 bp, Artificial Sequence
  Synthesized
  misc_feature (61): n=a or t
ttgtataagcattgacatctaaaaaaaaaatcctactttataccaaaaacaaacattctancctccagaaattcagattaagttgcaacttgaaagaaatccaatcccaaaaaaagagtta

SEQ ID NO: 38539 - DNA, 121 bp, Artificial Sequence
  Synthesized
  misc_feature (61): n=a or g
ttgtcaaccaagtattttggctgatcttattagataatacaggataagcaacacatcaccnggaaaaacatcctgccaaggtgaacctaacttggtgatttaatatgtcaaacttctcatt

SEQ ID NO: 38540 - DNA, 121 bp, Artificial Sequence
  Synthesized
  misc_feature (61): n=t or c
aaagcaacaaaagaaaaggcattacaaggaagaccagctgtgatttgtaaaagccttcagngtaaggagtgaggatctgggaaaaagaagcatgaacatttcttctctgggaaaagcaatc

SEQ ID NO: 38541 - DNA, 121 bp, Artificial Sequence
  Synthesized
  misc_feature (61): n=t or c
ccatgctggcctcacagaaagtggcacgtatggcaggattctgaggagaagacctggcagngtctttgcatgctaactgccaaacagatcccaaaatcaagcggtggtaagtctgcttact

SEQ ID NO: 38542 - DNA, 121 bp, Artificial Sequence
  Synthesized
  misc_feature (61): n=a or g
ttatgaaacaactttgatttctactattgtaaggagtgaccatcaaataccattgctggcntgcacttgcatctgtggcttggataacattgggtgcatctgttttattttactgaagcag

SEQ ID NO: 38543 - DNA, 121 bp, Artificial Sequence
  Synthesized
  misc_feature (61): n=c or g
caccaagcagctctcaccactgctgtgtgcagcttggatcagaattggcattgtggctgcnccaggaagaagcacagcttcaggtgccagggctgcacacgctgctcctgtacaggaggtt

SEQ ID NO: 38544 - DNA, 121 bp, Artificial Sequence
  Synthesized
  misc_feature (61): n=c or g
gtgaaccacatcacagcagctctgtatttacagtcacacgactgccccagaagaatggttnccctcagttcacaggtggccgttcatgacatgcttgagaatcactgcctctgcactactt

SEQ ID NO: 38545 - DNA, 121 bp, Artificial Sequence
  Synthesized
  misc_feature (61): n=t or c
gtaaacgatatgaatggctgcagcaaatccaccctggccacccatgctgccttccagactnctctgctgaagtgcatttttacctgctctagagcagcgtggggaaaaagaaacccagcag

SEQ ID NO: 38546 - DNA, 121 bp, Artificial Sequence
  Synthesized
  misc_feature (61): n=a or g
gcagcctgcaaaccaccagcaatgaggaaaacagcatccagggaagtactgctccgtggcngatcaaaggaacttcagcctgaatatgggaagagtggaacccgaaggttgacactgctga

SEQ ID NO: 38547 - DNA, 121 bp, Artificial Sequence
  Synthesized
  misc_feature (61): n=a or t
tactgtttgtcttattacactgaaattattcctcataatttctctgctacagaatgtagcntaggcagggattcttaatttgatgttagcgctgagatgtatggagtaagggatactgagt

SEQ ID NO: 38548 - DNA, 121 bp, Artificial Sequence
  Synthesized
  misc_feature (61): n=t or c
actgtcctgtgacaaacagctgcttttctcagtgcatgccatgggaaccttgctgtacctntgggcaccatcaggaaaagaaaagcagcgctatggaaagatgcagaaagtcacccaaagc

SEQ ID NO: 38549 - DNA, 121 bp, Artificial Sequence
  Synthesized
  misc_feature (61): n=c or g
atctctcccttgaatgctttcacctctcagaatggaagccaggaatactgccttagccttnatgtcccacttgtaaggatttacaggggctgtggatatgcttcacacaacaacaaacaga

SEQ ID NO: 38550 - DNA, 121 bp, Artificial Sequence
  Synthesized
  misc_feature (61): n=t or c
tgactgtgaagaaaaacaaggcattattgcacgtttcagaacaagaacattgagcagcagngctggatgctaagctaactgcctgctgggaatttgactttcagatattagttttaactcc

SEQ ID NO: 38551 - DNA, 121 bp, Artificial Sequence
  Synthesized
  misc_feature (61): n=a or g
taaaaagattttgtgtagctgtaacaagtaacccaaagcatttcttttttcatcaccacanatgatctgaactttgaagattgaaatttggaagagaaaagctgagactggctgcaaaaat

SEQ ID NO: 38552 - DNA, 121 bp, Artificial Sequence
  Synthesized
  misc_feature (61): n=t or c
gtcacatcagcaatttcctttatcgcggcagcagaaagacatgcacgcaataaataaaacnctcggacttaagaaggaaatatttcagcagaaaaagagctgggaaaggaggtgggtccct

SEQ ID NO: 38553 - DNA, 121 bp, Artificial Sequence
  Synthesized
  misc_feature (61): n=t or c
gcttctagctacagaatgacaaaacataccctgttttcatgtgcttattactcaggaaganggttacaagcatattgcattgatacaagctcctgattatttgtgctgttgtctgttacct

SEQ ID NO: 38554 - DNA, 121 bp, Artificial Sequence
  Synthesized
  misc_feature (61): n=t or c
catcgccgtagtacattagcaaaggttcgagaacagaagatgacaggctttcatcgagaancatgctgttataataacactctttcctgtgccatagcttctggcagtggaacccaccatc

SEQ ID NO: 38555 - DNA, 121 bp, Artificial Sequence
  Synthesized
  misc_feature (61): n=t or g
ttgggatccagcaggtagtaccctcaggggtgggcttccttcccacttcaggtatctgcangctcgcagcgttaactgtttttaggttggattgaatgttagaacagaaatcatgaacaaa

SEQ ID NO: 38556 - DNA, 121 bp, Artificial Sequence
  Synthesized
  misc_feature (61): n=c or g
ttcagtttaaccagaatgttacagtgaataggtttatgaaacctccagtaaggaagagcanaattgctcccacaacaacagaagttgctgaattttagtgtagtgtaactttcttaagtgt

SEQ ID NO: 38557 - DNA, 121 bp, Artificial Sequence
  Synthesized
  misc_feature (61): n=a or g
gaagtactctactgcatgagattcaggcctacctactgggattaatgtgtacgacctaaangctcttttctgtattatcaagaagttaaaataaccctcaggaataaaacacattatatcc

SEQ ID NO: 38558 - DNA, 121 bp, Artificial Sequence
  Synthesized
  misc_feature (61): n=a or g
ctcaaaccatttaaaacttctgttttgttttattaccagcaatgtaagagccctattctanttggtaccatagcataaaattgtggggcaactgctgtctatggacaggctctgttgccct

SEQ ID NO: 38559 - DNA, 121 bp, Artificial Sequence
  Synthesized
  misc_feature (61): n=t or c
gttaattcgttgctttgctgcagtgctgtcccatccgcaggagactctagcatcctaacantgatttgtatgtctgtagtttgctgagagatccagatttggactgtggtaacatcaacca

SEQ ID NO: 38560 - DNA, 121 bp, Artificial Sequence
  Synthesized
  misc_feature (61): n=a or c
ggccctccttttaattagagcaggctcacaatgagttggtgggcagcacctgggggccatnatctgattgaacccctccgctgcttgcagttgtttgcccatgccatggggttgaggcaat

SEQ ID NO: 38561 - DNA, 121 bp, Artificial Sequence
  Synthesized
  misc_feature (61): n=t or c
ggtgctagcatggggagaagcttttgatgcattttctgaagtcacttttaaggtgactttnaccacgtgcattagcagttgagagggaataacgttcatccttccatctcctgtctgcaca

SEQ ID NO: 38562 - DNA, 121 bp, Artificial Sequence
  Synthesized
  misc_feature (61): n=c or g
ggaggaagacactaattcactcagtggcattaggcaccacagaagggcgttggtgcctttntagggaactgaaaagggcgagcattgctggaaaggtgtgggaataggggaggcactgccc

SEQ ID NO: 38563 - DNA, 121 bp, Artificial Sequence
  Synthesized
  misc_feature (61): n=a or g
tagtaaaagaactaccagggcagtggcatgcataatcacgactcttgataaacgaacttcnaatgctgagcaatttttgcatttagttgttcccagccttctcactttcagaaatgattta

SEQ ID NO: 38564 - DNA, 121 bp, Artificial Sequence
  Synthesized
  misc_feature (61): n=a or g
tctctgcaattcgcacagacctgccatttgaagccctgtgaggcacactcccatcttcggncaggctctgagaccactatacatctgccttttccagtcttaaaaactgcaacgctcatta

SEQ ID NO: 38565 - DNA, 121 bp, Artificial Sequence
  Synthesized
  misc_feature (61): n=a or c
gtcatttatttgccgttatttcctactttgcccctaaaccttgactgaaaacacagactantattcagtaacttccatggttttgcttttcatgaaaatctagggcatccactgtagttaa

SEQ ID NO: 38566 - DNA, 121 bp, Artificial Sequence
  Synthesized
  misc_feature (61): n=t or c
ctgacacccactggagccggggacaagatgaaatgctccgattcaaagcagattaggactngctgttctggaaatcaagtgagttttgaagaggctgatgaagctcaatttcaaaactatc

SEQ ID NO: 38567 - DNA, 121 bp, Artificial Sequence
  Synthesized
  misc_feature (61): n=t or c
ctttttttttccttgttgatggcatctcatacagactggagacaacagttactgaaaaggngctttgtcctaatgcagtggtggctttacatgagaagggctctatctgcctagaagtgtg

SEQ ID NO: 38568 - DNA, 121 bp, Artificial Sequence
  Synthesized
  misc_feature (61): n=t or c
tttgctcacttctggcttctgcaattcagatcacacttattcctttcctttttaccccatnggggtaaaaggattttaaatagctgaaatgtgaagggctgaactcactgccagggtcctt

SEQ ID NO: 38569 - DNA, 121 bp, Artificial Sequence
  Synthesized
  misc_feature (61): n=t or g
taaatcaagacattctctcttgctaacagagagattgatgttattttgtagcagagtgganatgcgagaaaagaaaacttttgccatgaatctgtatgaggccccttccaaagtctttaac

SEQ ID NO: 38570 - DNA, 121 bp, Artificial Sequence
  Synthesized
  misc_feature (61): n=t or c
tgtcaggttgcagccagacctgagagctcccagcactgtaaatttggctcttcacacctgnagacgcttagaaagaggcttccagctctgcactgccaggtagttaacccagatttgctta

SEQ ID NO: 38571 - DNA, 121 bp, Artificial Sequence
  Synthesized
  misc_feature (61): n=t or c
gcagagcagtggctcaggtgggagcgcaaagcatcggcacggtgaggctgctggcagccgnggttgcctgtgctaatttcatgcccatcctcttcaactccccgcaaaattccaggcaggc

SEQ ID NO: 38572 - DNA, 121 bp, Artificial Sequence
  Synthesized
  misc_feature (61): n=t or c
tgcagcttcctggcatatttacagtagtgcccaacgtcatcaccccatcagcaagaactanagcactacttgcaattgaactacagcgtaagaactcaatgttattcttgtgttgtctgca

SEQ ID NO: 38573 - DNA, 121 bp, Artificial Sequence
  Synthesized
  misc_feature (61): n=t or c
aatcagtacactgactgcagcagacaccttcttattgctcttttaaggatgcagaaactcnttgattaccctttgaaagggtctaaaatatgccttcactattcttatgtgtcctctccac

SEQ ID NO: 38574 - DNA, 121 bp, Artificial Sequence
  Synthesized
  misc_feature (61): n=t or c
ggcatccagagccagagactctcagttgcttttgcaggcagagctgcacattgcacagcangggacagctcttctttgcaataccaggtgtgtctgcacaggccaaggtggagccaagcaa

SEQ ID NO: 38575 - DNA, 121 bp, Artificial Sequence
  Synthesized
  misc_feature (61): n=a or g
atagtgtagttttccttctgcccatgtaaagtgtaaaataaggtgagttagtattggatgntgagaattttagaaactaggaagcaatttccaaagagggtgattaaaagctcactgtttg

SEQ ID NO: 38576 - DNA, 121 bp, Artificial Sequence
  Synthesized
  misc_feature (61): n=t or c
ttctaagaacactttgactgtaatgtgctgctctgtagaatgtagtgaactgacaggtagnaggctgcttcctacggctggcttcatctctttttaaagcttctcagacttctgaagtgtg

SEQ ID NO: 38577 - DNA, 121 bp, Artificial Sequence
  Synthesized
  misc_feature (61): n=a or c
atattccttgtatcaccctgcttctggtgcattaaagcgtgttcttcacattacttctaanagtaatctctaggtaaacattttattaccgtagcatgaagacttggtgaatctgttgctg

SEQ ID NO: 38578 - DNA, 121 bp, Artificial Sequence
  Synthesized
  misc_feature (61): n=t or g
caccaactcataacattgaaagactaatacagacttttattggcttttaaatcatgattancctcattgttctgaatagatgatgcagaagccaagtactgatgtcattactggtttgtga

SEQ ID NO: 38579 - DNA, 121 bp, Artificial Sequence
  Synthesized
  misc_feature (61): n=t or c
tccaccactcaagccaaaacaaggcactaacttgataaatcccttcagctgaacagtgaancactgtcaagtcccctggcactggttttccagccaggctcacaccaactttacagtatct

SEQ ID NO: 38580 - DNA, 121 bp, Artificial Sequence
  Synthesized
  misc_feature (61): n=a or g
tttgaggagagagacagatattctcataaggattttaacacctacaagtttgacctttcanagttggtattatgctctgtttcttgcttcttcatgcttgtgatgcaaaattcaagagttg

SEQ ID NO: 38581 - DNA, 121 bp, Artificial Sequence
  Synthesized
  misc_feature (61): n=t or c
agctgttccaaaagtgagcatgaagggagatattatcactgcttagctatgtttacaaatntgtaacaagagtactatttaaagtatgttctttttgactaaatgcaatatgttgtcatct

SEQ ID NO: 38582 - DNA, 121 bp, Artificial Sequence
  Synthesized
  misc_feature (61): n=t or c
atacacattggaaggaataggaatccctctgtcctgtctgatagagttctgaaatgggcantcattcttgctttcttctgattcatctcctattttttccactgccaccaatacagcctga

SEQ ID NO: 38583 - DNA, 121 bp, Artificial Sequence
  Synthesized
  misc_feature (61): n=t or c
aggaaaaaaaaaaacaacacaaaacagagaacaagaggtggaatatggatgccacttcatnataattttaagcacttggctccgggaagcaatccaatccatgtgacatattgctcagatg

SEQ ID NO: 38584 - DNA, 121 bp, Artificial Sequence
  Synthesized
  misc_feature (61): n=t or c
ctcctgatgacattacaaggaacagattgcttggaatgctttacagacttcagctgaaagnccttttgggtaagctatctggaaaacactgatagaagcctgacatgaactttccatggta

SEQ ID NO: 38585 - DNA, 121 bp, Artificial Sequence
  Synthesized
  misc_feature (61): n=a or g
acagtttgtttttttcttttttaaatccacagtatattcttatagctctcctttgcttcancaaccacaactaaaagttttccttgttcttaagttgtaaatttgctcatgccttaagttc

SEQ ID NO: 38586 - DNA, 121 bp, Artificial Sequence
  Synthesized
  misc_feature (61): n=a or g
ttttttttttttaaatagatacaattcaatttttatttgagcaattccagtgagagaatcnaactgattctataaccagccctttcaaaacagctcagtaaatctcaaggtctttaaaata

SEQ ID NO: 38587 - DNA, 121 bp, Artificial Sequence
  Synthesized
  misc_feature (61): n=a or g
tagtgccagtttcagttaaaatttagccagggatctggagatgctgttactcttatttatntaacagatcagagactgtagtatcctcatggtatttatcttctaactttttcttctagaa

SEQ ID NO: 38588 - DNA, 121 bp, Artificial Sequence
  Synthesized
  misc_feature (61): n=t or c
caataccagacgttacaatgctttatgaccttttatcaccaatgacttgttgacacactangagagcaaaccaacttgaatccattgcagcagacggtgactcagcccctcaaagccttca

SEQ ID NO: 38589 - DNA, 121 bp, Artificial Sequence
  Synthesized
  misc_feature (61): n=t or c
ggagcagatgggaagcaccggtgccacggggctcggggacagcaggacagcatccccttgnactgatgcaaggctccacgtgctggatgtcagcagtttttggagccttggggctcccctg

SEQ ID NO: 38590 - DNA, 121 bp, Artificial Sequence
  Synthesized
  misc_feature (61): n=t or c
gagctcaggcaatggggatgcttcactcagatagtccagggctagctcttgtactgaggcnaggattggacagaaaatgaaacaagaaatagcaaagagaatctgaagagggttggagacc

SEQ ID NO: 38591 - DNA, 121 bp, Artificial Sequence
  Synthesized
  misc_feature (61): n=c or g
tgctttccagccccaacccaacactcgttgctgttactttgctgcctcggtgctgagcatncaagcagtgtagttaaaaaaaaagcctaatttgcaacagaactgctgccagctctatttt

SEQ ID NO: 38592 - DNA, 121 bp, Artificial Sequence
  Synthesized
  misc_feature (61): n=a or c
agcacaacgagcaactgccttcctgggacctcacaagacagcggcatgaagaggcatctcnctgctctgacaggtgaattcacatgaaataagcactggtgagagaagtgctaattactac

SEQ ID NO: 38593 - DNA, 121 bp, Artificial Sequence
  Synthesized
  misc_feature (61): n=t or c
gccgggtgagtgctgctggttgtcctccagttgggttggcacagacaggcagaccccaaancccccattcatcccagtaacggcagcaggaggctgtcccctgccacctccctgccttacc

SEQ ID NO: 38594 - DNA, 121 bp, Artificial Sequence
  Synthesized
  misc_feature (61): n=a or c
tataaaagtccagtagagtgatacgatcagctttttgattacaaccctatacattcaattnaaaaatttgtaggcaatgtatttatgttgactgaaaatggagtcacaaataaacaaaaaa

SEQ ID NO: 38595 - DNA, 121 bp, Artificial Sequence
  Synthesized
  misc_feature (61): n=t or c
ctatagcacttaaaagctaatatgtactaaatgtgctcacctgggtgcactgaggatttcnaccctcgccttgggtctctacagctcctttgactttttgagctcattcaggtggagagat

SEQ ID NO: 38596 - DNA, 121 bp, Artificial Sequence
  Synthesized
  misc_feature (61): n=a or t
tccatccattaaagataatacgtatatattacatcacgcaaccgtctttaattacttcacntgcacagtttcagtagtatgttctatgaactgaaaagttagacgatctaagtattcttta

SEQ ID NO: 38597 - DNA, 121 bp, Artificial Sequence
  Synthesized
  misc_feature (61): n=a or g
tgagaaggtgccctattccattagaaaggtccgtgtttaaataaattcctcttcttttatnctgaaacaaaaaaatccactttgcatgtgccatgcacagttcttataactacaacatatc

SEQ ID NO: 38598 - DNA, 121 bp, Artificial Sequence
  Synthesized
  misc_feature (61): n=t or c
gctgctccaatagaatacacgtgaacaaagtgtgagatacagatggatctgttttagtcgntactaaggcaagcatggaaagtaacctctcctagaaagtactgtaacattgcataacaaa

SEQ ID NO: 38599 - DNA, 121 bp, Artificial Sequence
  Synthesized
  misc_feature (61): n=a or g
ccttcaggtgttactgaggtttgggtagctaatggttgtgccgtgactaatgtacccagcnggtttaacgggcttaaacacttctgtgatgaataaaatgtaggagtgagattgagagacc

SEQ ID NO: 38600 - DNA, 121 bp, Artificial Sequence
  Synthesized
  misc_feature (61): n=a or g
ctctgcgtgttgttctgttgtaggcatcgagctgatctgtgaaaaggacattgaccttgcnacacaggttcaagagctgctggaattccttcatgagaagcagcatgagctggagcttaat

SEQ ID NO: 38601 - DNA, 121 bp, Artificial Sequence
  Synthesized
  misc_feature (61): n=t or c
ctgaagctgtgttcgtggaatagtggggcgcattgctgagctctttcttagtggaaactgnttcaggcagccatgaaacaaggagtgacaatgcagatgctgatgaagagcgctgttacat

SEQ ID NO: 38602 - DNA, 121 bp, Artificial Sequence
  Synthesized
  misc_feature (61): n=a or t
gaagtagtcaaatatagtgggttttgtaaatgttaaacatatgtgtgactgctaggcaagncgctttttgtaagttatgaaaaatatgcttggttcacagggaaaaagcgatttaatgata

SEQ ID NO: 38603 - DNA, 121 bp, Artificial Sequence
  Synthesized
  misc_feature (61): n=a or g
ccactgttgcactgaactcccatttcgagtagcagtactgcagtgaatagggaagaaaaanaaaagtcaaaatttccagtaaattcttttaacgtgttttggaggcactcttcttcttttt

SEQ ID NO: 38604 - DNA, 121 bp, Artificial Sequence
  Synthesized
  misc_feature (61): n=a or g
agccttcgtagctcaagctctggaaaacttaagccacgtctgagctctgaaccagagctcnttcagaacactgcattcagatccgggttgctcccacaaagcatggctttgctttccctcc

SEQ ID NO: 38605 - DNA, 121 bp, Artificial Sequence
  Synthesized
  misc_feature (61): n=a or g
ctgatttagccttctgtacaaactgaagaggactgaccatctcccacgttagttggcttanagccaaggcagaaagggcttgagatggagcaagctgtctggaaaaaaagagaactttcca

SEQ ID NO: 38606 - DNA, 121 bp, Artificial Sequence
  Synthesized
  misc_feature (61): n=t or c
cttactacaaaaatttgtctaagtataaaatcaaattgtaaaatattacagaatttgtcangagtaaggatgatggagaacttgtatttgcttacagtaagagacagcattcatttatact

SEQ ID NO: 38607 - DNA, 121 bp, Artificial Sequence
  Synthesized
  misc_feature (61): n=a or g
attgtgtatttggtactgttttactactaggcttttctttgtgagttcagtaaaacttganaacctacctccaccaatgcaaggtaggtaattgtaacacttaggaaagagcggaacttag

SEQ ID NO: 38608 - DNA, 121 bp, Artificial Sequence
  Synthesized
  misc_feature (61): n=a or g
ctgatttctacagaagatgatcttcttatagcaaataagtattttaattaggatgtaatantatttcttaccaacttcagtgctgaactcttcagtactctccccagtatcagaacacatt

SEQ ID NO: 38609 - DNA, 121 bp, Artificial Sequence
  Synthesized
  misc_feature (61): n=t or c
cctctcctggaacccacagcaccatccggacaccacttggacaccacctggacatcatccngacaccatatgggcaccatccggacaccaaccggccatgaaactcatcaggatgaagaca

SEQ ID NO: 38610 - DNA, 121 bp, Artificial Sequence
  Synthesized
  misc_feature (61): n=t or g
gttagcattatctaacctactgaaaggggaaggaccagccctcaccgtgtgaaatcagctnaaatgcaaaaatgcacaaatccagatcttattttttgcttttgtgagcatagaagcatca

SEQ ID NO: 38611 - DNA, 121 bp, Artificial Sequence
  Synthesized
  misc_feature (61): n=a or c
gtcatttaaaacgggagtgtgagtagagccctgttgcaggccacaaatagctgtattgggngcaacaggtagatagatagacatatgcatggagcagcatggtgggactgggccacgcggg

SEQ ID NO: 38612 - DNA, 121 bp, Artificial Sequence
  Synthesized
  misc_feature (61): n=t or c
gagcttttcttgattcatgagctttttgatgttgtgcattgttcatcagtgtgtattagtnatctttttgccatccacataatgctgatgaattaatgagctatataaaattattaatgat

SEQ ID NO: 38613 - DNA, 121 bp, Artificial Sequence
  Synthesized
  misc_feature (61): n=t or c
actggtgggtagctaatagtgtgcttcccatacacaatgtcccgaatttgctttctgtaangtcagattttaaaacaaaaacattcttataagatcagacactgagacagcagttagtgca

SEQ ID NO: 38614 - DNA, 121 bp, Artificial Sequence
  Synthesized
  misc_feature (61): n=t or c
aaaatcctagctgaaaaaaggggaaaaaaagccaaatgcaactcactgcctccaagctttnattttacttgcccaggtctgctgacaaagtaaagagcccctaattaaagcaggcatctgt

SEQ ID NO: 38615 - DNA, 121 bp, Artificial Sequence
  Synthesized
  misc_feature (61): n=a or g
gctgacacctgcaatgagtggctgttatcccaagaacgccacaactgtgagcagtgagagnggatacaaatggaaaggactggaaatcagtaatctggtaatcaccagggacaggtgacga

SEQ ID NO: 38616 - DNA, 121 bp, Artificial Sequence
  Synthesized
  misc_feature (61): n=a or g
aatattagtgataggtggacagttggattagatgatcttatggtcttttccagccctggcnattctatgattctgagtttcagtatagcagcatgtgataaggatgcttgctggaggcact

SEQ ID NO: 38617 - DNA, 121 bp, Artificial Sequence
  Synthesized
  misc_feature (61): n=t or c
tcctctcacttcatttgccaaaccgtcctcctgtaattagcgctcccgttagaggcattancgggctcacaccccggcgcgcatcccgtcgaggtacggcaaagtccacggacgcgcccac

SEQ ID NO: 38618 - DNA, 121 bp, Artificial Sequence
  Synthesized
  misc_feature (61): n=a or g
caaaatactagctctaatgagaaattccaaaggcaattaatcgattctacaaggagaaganctccttgactgtgggaggaaatatgaacttcaaagtcatatttacttgtcttgtagctgc

SEQ ID NO: 38619 - DNA, 121 bp, Artificial Sequence
  Synthesized
  misc_feature (61): n=a or g
agtggcatcaactgtcttgtaataaacttctcatttccttttttaagatgagcccactgcnacctgtctggtttcttactagttaactcaggagcgtgcttctcagagaaactctttgtgt

SEQ ID NO: 38620 - DNA, 121 bp, Artificial Sequence
  Synthesized
  misc_feature (61): n=a or c
catgggaaagacacagactacacaaacaggatctccaccaccagctggggtaggtgccagncacctgagcacaccaactgtgtctgacccagccagcccttcccagcagggcatgaggact

SEQ ID NO: 38621 - DNA, 121 bp, Artificial Sequence
  Synthesized
  misc_feature (61): n=t or c
ccacaagagctgtgcctcccaggtcaacgacacgagctactgcccacactgcggggaagangcctccaaggcaaaggaggtgacaatagcaaaagcagacacgacttcgacagtgtcgctg

SEQ ID NO: 38622 - DNA, 121 bp, Artificial Sequence
  Synthesized
  misc_feature (61): n=t or c
ccccgggctaaaggaggagcctgactcttctctgcagtggaagctgagggtacagtttcangtcgcagccaaacgcatcccacagctgctgccatctaaggttgcactccatcctgctgag

SEQ ID NO: 38623 - DNA, 121 bp, Artificial Sequence
  Synthesized
  misc_feature (61): n=a or g
gcaatgccatttggatccctttaacataaaatcttgtgaaacttggcaagatctgcacgtnactagtttcaacttcacactgcaagaataaagtctcatttgagaaaggaagtaaactttt

SEQ ID NO: 38624 - DNA, 121 bp, Artificial Sequence
  Synthesized
  misc_feature (61): n=a or g
gcagacaatttatgataaatattcagaggaaggttgtgcctatgaccttcagtctcatcancattgtttataatcaaaacaaatgtaccacttgaggtgaagagctcattttattttgtgt

SEQ ID NO: 38625 - DNA, 121 bp, Artificial Sequence
  Synthesized
  misc_feature (61): n=a or g
tatcctttggtaaattaagcaggaaggtaaacttgtttttagctagcacaaattctcactnccctgagtatatagtggttttgagtgtgattttttttttttttaagtaggtcaatattct

SEQ ID NO: 38626 - DNA, 121 bp, Artificial Sequence
  Synthesized
  misc_feature (61): n=c or g
aacagttcaagctcaatagctaagctcctagaaagtcgtttcccttgtggcatgttttctntgtaggtcaaactgagatcccactggtaagtgactcagttgttcttcaaacccatttata

SEQ ID NO: 38627 - DNA, 121 bp, Artificial Sequence
  Synthesized
  misc_feature (61): n=t or c
tattctctactgctatatcagtttttttttctattaaaaaactataattcataatgaatangtgtcaataatgccatctacacttcagtaaattcaaagcaccacttcccagtaacaatgc

SEQ ID NO: 38628 - DNA, 121 bp, Artificial Sequence
  Synthesized
  misc_feature (61): n=t or c
gcctagaactgtgttaaagacatgtttttactttaaatagcagaaaaagtattagaaaacngaatagtctccttacatagcaaaggtcactatgtcttaataagttgtttaaaaaaaatct

SEQ ID NO: 38629 - DNA, 121 bp, Artificial Sequence
  Synthesized
  misc_feature (61): n=t or c
caggctgagtcttgtccatcacttcatgtcctacttaaagcccccggtactgaagacctgngtggttctttggtgtagcccagcaacgtccacgctcttcacaatatagggctgatctagg

SEQ ID NO: 38630 - DNA, 121 bp, Artificial Sequence
  Synthesized
  misc_feature (61): n=t or c
caacagtatttttctatgactataaaggactttcctagtctgaggattttaagattgtggnaggattttattgttgccattgttcacagctgaaggagaaggttatttgttttactaagat

SEQ ID NO: 38631 - DNA, 121 bp, Artificial Sequence
  Synthesized
  misc_feature (61): n=a or g
tactctttttttcctgaagctactgaagcctgagaagcttttgtgaagtcatccaaaaacntttgcattagatgctcaaaatcacccagataaggtgtttacagcaatttcagctttgatt

SEQ ID NO: 38632 - DNA, 121 bp, Artificial Sequence
  Synthesized
  misc_feature (61): n=t or c
aagctaagaatcagcatgcttctgaagcatagatttgggtaaatgttagagtgattggaantgccaggttatgcaacttcagctcctcagcactgagtgattaaagccctcaagggattct

SEQ ID NO: 38633 - DNA, 121 bp, Artificial Sequence
  Synthesized
  misc_feature (61): n=t or c
cttgacttacttaaggtctttttgctctgataaggagtagcttaaagttgattgaaattcncaatggcagttgagccataattctactcttacagacgctgataggaaatcttgctctatt

SEQ ID NO: 38634 - DNA, 121 bp, Artificial Sequence
  Synthesized
  misc_feature (61): n=t or c
ctgcagagtagccaaacatctgtgcaactgctccagttacaccctgtaaggtcaactgttnggtctggcaacaattagtttcagtgcgaattttgcattctctgcaataaattcagaaaac

SEQ ID NO: 38635 - DNA, 121 bp, Artificial Sequence
  Synthesized
  misc_feature (61): n=t or c
gctcatagcttccccccagtgaacactgcatccagcaggctgctgcatgcaaaaaagaaancctgccttcttcctctgtagcagcccctcttaaggagtagtgactgccagcaccttcaca

SEQ ID NO: 38636 - DNA, 121 bp, Artificial Sequence
  Synthesized
  misc_feature (61): n=c or g
atatatttataggagacgctctgtttgtgagagctgcctttcccctgcagaagcaaggaantcgctccttcctcgtggagaagcccagatcatctaaaactctctctagcaaaaacagaaa

SEQ ID NO: 38637 - DNA, 121 bp, Artificial Sequence
  Synthesized
  misc_feature (61): n=a or g
aggttttggtcttgtgatgcaccagaggcagaggtcggtgtccggctccatcctctggacncacagatgttcctcttcctggtgttcccctgcaggcaggtcactctggaatggtcaggac

SEQ ID NO: 38638 - DNA, 121 bp, Artificial Sequence
  Synthesized
  misc_feature (61): n=t or c
atgcaattaaataaaactcccctgaacttctctgggaggagtggaaaaatccccaaacttnaagtcagaatggagacgcaaagagatttgcttaaaatagcacaagctcttatgatggaac

SEQ ID NO: 38639 - DNA, 121 bp, Artificial Sequence
  Synthesized
  misc_feature (61): n=a or c
tgcagcttcccaggaggcagcaagaatggaattttgtgcactgaaatacccttgttttgtncctttgcttttcccctgatggcttccctgcatgccagccagcctgctggcccagcagctc

SEQ ID NO: 38640 - DNA, 121 bp, Artificial Sequence
  Synthesized
  misc_feature (61): n=a or g
gctcctgatgtgtttcctgggactcctgttcccaaaacaggcatctccactagcactagtnttcatttccttttaagtggaaaaagacagataggtcattttagagtatggcttcattctt

SEQ ID NO: 38641 - DNA, 121 bp, Artificial Sequence
  Synthesized
  misc_feature (61): n=a or g
tactgctaaattccagccaagacattcatcaactgtgactgctgcttacttcaaaggatcnaatcacctggatatttataggtacaaacattcttcaccttcttgaacagtcacaataatt

SEQ ID NO: 38642 - DNA, 121 bp, Artificial Sequence
  Synthesized
  misc_feature (61): n=t or g
ttcatggatttgatggattgtgggttctgcatcttttctggtttactggtagtatattttntaatcttagctaactgatataaaggactgattgcacctataatccatcagacataaatca

SEQ ID NO: 38643 - DNA, 121 bp, Artificial Sequence
  Synthesized
  misc_feature (61): n=c or g
gcgcgctctggggagctccatttgcagcacaaaacacagaagacctccacgccccgtgaantcgcacctgtgttctggccaggctgctcaggcagtaccgtaagctcctgagtgggtttac

SEQ ID NO: 38644 - DNA, 121 bp, Artificial Sequence
  Synthesized
  misc_feature (61): n=a or c
agttctaaaaagaaccaaatgtaccaaggtcttagaaaatccattttaaacacctcactgngaaacagctggaacaaattttcagtgcaaattatgtaatggagaagaaacttgtattctg

SEQ ID NO: 38645 - DNA, 121 bp, Artificial Sequence
  Synthesized
  misc_feature (61): n=c or g
ttggattttttcttaggttgacataagtctcttcttacattagggggatgatcctagcatnccactgacacagtcacacacacctgactgtcagcccactagagctgtgatgcagtgggtg

SEQ ID NO: 38646 - DNA, 121 bp, Artificial Sequence
  Synthesized
  misc_feature (61): n=a or g
acagctacagccacttttctaacctgtgctcattcatactgagactgagcaatggtctganataggtgactgcactccctgaagcagagagattgctgctaaaagggctaggattataagt

SEQ ID NO: 38647 - DNA, 121 bp, Artificial Sequence
  Synthesized
  misc_feature (61): n=t or c
ctcctgcacaagtcagaagggacacacacctgcctgatagcttgtgaagacataagtcttnacaagactgtcccaggaaacaatatggcatatgatgttcatcctaaagtttagttatcct

SEQ ID NO: 38648 - DNA, 121 bp, Artificial Sequence
  Synthesized
  misc_feature (61): n=a or g
gggatgctcagaggtctgagacaagatgcacagcctttgatttctgaactagagatgtgantcatatctcagctgcaaataattttctcctgaaagcattgcttgcttataaaggacagta

SEQ ID NO: 38649 - DNA, 121 bp, Artificial Sequence
  Synthesized
  misc_feature (61): n=t or c
gtattgagcttgctaaacctccagcccccctgcaaatcagtcccatatgagaaacttagancattgctgggcatctcccacatcttaggataattctcttctatagattgaagtggaagaa

SEQ ID NO: 38650 - DNA, 121 bp, Artificial Sequence
  Synthesized
  misc_feature (61): n=a or g
tgttcagctcttcacaatgcagacagcaggaaaagggacacaggaaaacaatgcacagaancctgcccatgcaccgcctggatgccactgcagaactgggacagccccaccagcaaaggtc

SEQ ID NO: 38651 - DNA, 121 bp, Artificial Sequence
  Synthesized
  misc_feature (61): n=t or c
acgtgtgactgcttctgctcaaataacacacagaggtgcaccatgctttcagctcagagtngggttattcaccacagaataaatgttctctttgcccaaattccatacattggttaatttc

SEQ ID NO: 38652 - DNA, 121 bp, Artificial Sequence
  Synthesized
  misc_feature (61): n=a or g
aatcgaagtatataaaatcttaaatggcataagtaaggtcagcctagttactttttttccntctcagcacatttggtagaacaaggaatcataaatgatagttaagtgaaaggcagccggt

SEQ ID NO: 38653 - DNA, 121 bp, Artificial Sequence
  Synthesized
  misc_feature (61): n=c or g
aaagtaaaagacagtgcagagagggcagtttgtgttgcatactttctcataataactgaangtattgattaagaagctgtgagtaatcataggaagatatttatgttaatgtgatagcagg

SEQ ID NO: 38654 - DNA, 121 bp, Artificial Sequence
  Synthesized
  misc_feature (61): n=t or c
atcctacatgttcacaaaattaaatgcccaaaattactcctctcgggaggcaatgaacaanagagtgacagaacaacatcctcagatatgatctagacagactggagcagtgggtccagga

SEQ ID NO: 38655 - DNA, 121 bp, Artificial Sequence
  Synthesized
  misc_feature (61): n=t or c
cagcagtgagaggtggcatctgtggtgtgtcccatagagatccacagggacccttagaacnccattgccccccttagagtcccttagggtcccatacacacccagagagctaagaggcaga

SEQ ID NO: 38656 - DNA, 121 bp, Artificial Sequence
  Synthesized
  misc_feature (61): n=a or g
ggtccatttcctctacacagtcttctgatacaggagtgtcaggcatccatccctttagtcnttacctgggagagatattgataaactgtgtccacagctcagctctggcctggtttagcag

SEQ ID NO: 38657 - DNA, 121 bp, Artificial Sequence
  Synthesized
  misc_feature (61): n=a or c
gtgggctgtaagaatcttaacttgcattgcaacagattataaagggaagacaagctatgcngtgaaaatattcatttcagtgggatggatctacgttgctctgagggtcttcattctctga

SEQ ID NO: 38658 - DNA, 121 bp, Artificial Sequence
  Synthesized
  misc_feature (61): n=t or c
cagttgggcacagccaccagtgctacaaaagcttgcgtacaacgccacaggcaatgcagcngaaggagcacgaaccacaccggggtccctctgcccagcagctccatcagcccaaggctca

SEQ ID NO: 38659 - DNA, 121 bp, Artificial Sequence
  Synthesized
  misc_feature (61): n=a or t
aagtgcactcttagctgccaatggccattgctcctgaatcagtcagcacaaattatttacntcttccatctcaacctcaccaccctccatttattctttcatacttcaaagacagtgtatt

SEQ ID NO: 38660 - DNA, 121 bp, Artificial Sequence
  Synthesized
  misc_feature (61): n=a or g
cggtgttgtgtgcttgggtaagtctcatttatgctactttctgactgaggtttaaggtatntggaggaatgcttgaaacgccactgggtgccctttccccatcttacgactctaaaaccag

SEQ ID NO: 38661 - DNA, 121 bp, Artificial Sequence
  Synthesized
  misc_feature (61): n=t or c
caaatcacgtatgcggatccatatgccgtgtgaagcaatgctgacccgttggtatggcagngcaatttctgcatccaagaaaatgtcaagttcccccctccttggcttgcagttggcagta

SEQ ID NO: 38662 - DNA, 121 bp, Artificial Sequence
  Synthesized
  misc_feature (61): n=a or c
gctctatcggtttccaggagccagttctggggctggcaggggaacaaggccacaaccaacncagctataccatcctcagagcctcaggagagtaggaggttcaacttggtagtagtgtaaa

SEQ ID NO: 38663 - DNA, 121 bp, Artificial Sequence
  Synthesized
  misc_feature (61): n=a or g
ttttcatgattccagttaatagtgaactggcaggtatttctgcatgtctgcttacaaagancctccctgtcagggcagagtaactgacaccacagctttaaggccctcagagcgaggactg

SEQ ID NO: 38664 - DNA, 121 bp, Artificial Sequence
  Synthesized
  misc_feature (61): n=a or g
tatgcactacttttcataacatccttgctatatcagtcacattcctatgcattacatgcancttttaataaatcaagatgatatttaagccttttatcaagcaaaatattgccaaactacc

SEQ ID NO: 38665 - DNA, 121 bp, Artificial Sequence
  Synthesized
  misc_feature (61): n=t or c
atttctcaaatttgagggctctgtcctccagtgatgtgtgtgtctgtgtacatatatatanatatgtataaacacaattcttgtagcactgggcacaagcaggctctatttcttgttgtac

SEQ ID NO: 38666 - DNA, 121 bp, Artificial Sequence
  Synthesized
  misc_feature (61): n=t or g
tgactgttcccacagccatacaacacacaagagactgcaatctctgtctttgttggtgttnttatggctgttttggacaaccagcttcactgaaaaatgcctatttctgtgctttcagtgc

SEQ ID NO: 38667 - DNA, 121 bp, Artificial Sequence
  Synthesized
  misc_feature (61): n=a or g
gcaaccaaagaataggatgctcagagtccatcaaacctcagcagaataatttaaactgaancaagatgtgccaaaatagtaagaaatggatggagaggtggccgccaaacctccacagcca

SEQ ID NO: 38668 - DNA, 121 bp, Artificial Sequence
  Synthesized
  misc_feature (61): n=a or c
taaaagaagtgaacgttgctgtattctgtagcaaaatgtttaggaactgggttgaaacctnttaaaatgatttccctggattcagtggatctgccagctgaagaaatgcaaatagctttta

SEQ ID NO: 38669 - DNA, 121 bp, Artificial Sequence
  Synthesized
  misc_feature (61): n=a or g
ctcagctctgtaacgtaccttggtgttggtgcatctccatcgagctcttggtgaggacccnattgggtccaccctcatgagttggtcctggatcctgctagggagctgcaggatcacagca

SEQ ID NO: 38670 - DNA, 121 bp, Artificial Sequence
  Synthesized
  misc_feature (61): n=a or t
aagcagcgcttagaaagagcaacacagctcaaatgttgattgttcactgaatatttgatcncagttaaaatttgctcattgaatatttgagtgcagtagaaataggtgctcacgctatcca

SEQ ID NO: 38671 - DNA, 121 bp, Artificial Sequence
  Synthesized
  misc_feature (61): n=a or g
gtcagtagcattatatgttatttcttcgggattattgttcagttggtctcagtgccaaacnatgtccaggccagcagcctgaactcagtcagaccctacaacaccaagatgcaaagtgagt

SEQ ID NO: 38672 - DNA, 121 bp, Artificial Sequence
  Synthesized
  misc_feature (61): n=a or c
ggagctcaaaggagttggcaggtggtaagagacaccaccttttcaacatgaggatgctttnctttcctccttggcggctccgcttccccctgtgggacgtgcagcagagtcctggctgctg

SEQ ID NO: 38673 - DNA, 121 bp, Artificial Sequence
  Synthesized
  misc_feature (61): n=t or c
tgcaaggactcaatccaattagcactgtagagcttgcccactggtgtgggctcagactaanatgccataaaattcagtttctttaaaatgatggtggttgcatttacagtaagtgttttta

SEQ ID NO: 38674 - DNA, 121 bp, Artificial Sequence
  Synthesized
  misc_feature (61): n=t or c
gtagaacaacagcaaactaccatgctgtaatgcacatgaacaatcacagccatggattggnccctaaacagatgatgggccaaacccctccaaagattctattaaagctgctcaagcagaa

SEQ ID NO: 38675 - DNA, 121 bp, Artificial Sequence
  Synthesized
  misc_feature (61): n=a or g
gtcctgccactctgccttaccacggggattttttagccatttcagcacagccatcagagcntctgctgatggctgaagccttcccagtgagatgaacagcaactctttttgcaggccccgt

SEQ ID NO: 38676 - DNA, 121 bp, Artificial Sequence
  Synthesized
  misc_feature (61): n=a or c
ctgctgtttttaatttttaataattttgtaggggcctggtcagtatagtaattttggtcanctgtgagatggcatttcttcactttcctgggcacagtgagaggcctggttgcccttccca

SEQ ID NO: 38677 - DNA, 121 bp, Artificial Sequence
  Synthesized
  misc_feature (61): n=a or g
aaatccccatgatattactgtcttctaatttcttttttacaatccagagcttccatttcantcaagatgatatctttatgctattactttaattatcatattcaatatcttatcaaaagga

SEQ ID NO: 38678 - DNA, 121 bp, Artificial Sequence
  Synthesized
  misc_feature (61): n=t or c
ttactctcatagtgaggaggtgagaagcgcctaacaataacccttcaaaatttctggaaangaggattccatttttaaaagataatcttcattttattctcattgctcacttttggaagat

SEQ ID NO: 38679 - DNA, 121 bp, Artificial Sequence
  Synthesized
  misc_feature (61): n=a or g
caagttgttttcagggaaggcttcaaaaccataaacatccagcaaacctaggagtatcatnagatagtgcattttaatctaggagtaggctgaagggcttaaggttgctcggttaaactag

SEQ ID NO: 38680 - DNA, 121 bp, Artificial Sequence
  Synthesized
  misc_feature (61): n=a or g
atgattctgtgattctacgattctatgattcttggtagccaggcaaaatcaactctttacntcacgatttcttcttgataacgctgagcagatgtcacggagttacctagatagatctgtg

SEQ ID NO: 38681 - DNA, 121 bp, Artificial Sequence
  Synthesized
  misc_feature (61): n=a or g
gtatactgccgttagcacgaaggcaaaggccttgtaaagtggcagtagtgagtggttttgnttgtggagtttgaagttgattcattatgtttgtgttgttatatgtgttatcattaatggc

SEQ ID NO: 38682 - DNA, 121 bp, Artificial Sequence
  Synthesized
  misc_feature (61): n=a or g
ttacgtatgtcttctttcttttcttcagatatttgcacaactcctgggttagatgctactngagaggaactgctcttcttgtcaccgagatactatcttatggagttagccatctgctaca

SEQ ID NO: 38683 - DNA, 121 bp, Artificial Sequence
  Synthesized
  misc_feature (61): n=t or c
aaagtaatgttttctttatcatgtcacagttgttcacacacaaatttggcagggacagaancacaatctaatgcagaagtgctaacttacaaaactgaattactcagtaatctatgcaaca

SEQ ID NO: 38684 - DNA, 121 bp, Artificial Sequence
  Synthesized
  misc_feature (61): n=a or g
gacttcaacatgtgctgagggtgaagggaatcccagttaaacacacttttagtttggtgcngtgctttaaggcagaaatagcagcttaaaataaacctctgcattcctatgattttgatat

SEQ ID NO: 38685 - DNA, 121 bp, Artificial Sequence
  Synthesized
  misc_feature (61): n=t or c
actcacgcatccccagctgccccctcaggtaggtttctacctgtctcactgcacgaattcnagcatactacaccaagtgtagaggcactcacctgcacttaccttctaatagcaaagtgag

SEQ ID NO: 38686 - DNA, 121 bp, Artificial Sequence
  Synthesized
  misc_feature (61): n=t or c
tccttatcttatgtttacagagaaagtgtcagccagaaaaaaggtgaaaaaaggaaacaangaactctccctccacatctgaacaccatacatagactaagacattcctatttctgtggga

SEQ ID NO: 38687 - DNA, 121 bp, Artificial Sequence
  Synthesized
  misc_feature (61): n=t or g
gccttggcctgggattccttgcagcctggggtggcattggagcaagtcataaaggccatcncatacagctgtaggtgcaccttctgttgaaggagcagccgaacttgctccagtgcaagtc

SEQ ID NO: 38688 - DNA, 121 bp, Artificial Sequence
  Synthesized
  misc_feature (61): n=a or g
tttgaagaagttaggtctcaaaggcttaaatacatacaaaaattctgcctgtgtaacaacnaataaatgatgttgccttattggtaaggtgaaatccattactgtgctgctacagatgttg

SEQ ID NO: 38689 - DNA, 121 bp, Artificial Sequence
  Synthesized
  misc_feature (61): n=a or g
cataaaaatattaaacagttccttgaaagtctcctatggacaggtttactgcctcacacantgctaaaccttcacacggctcataagcagaggactgcgttttgtatagatgccaactgtt

SEQ ID NO: 38690 - DNA, 121 bp, Artificial Sequence
  Synthesized
  misc_feature (61): n=a or c
ggggaaaaaaattaaaaataaaatgtaaaatgtagaaaatgtatgaaagtaacaactcttngtatggcacagaacattttaggtaagtaatatatgcaagtgctttctttaacctgctcct

SEQ ID NO: 38691 - DNA, 121 bp, Artificial Sequence
  Synthesized
  misc_feature (61): n=a or g
cagcttacagctatgtccaacaacatgtgatgagcccttccaataagacgaggccatgtcntacttttggcaattggaacttttttttgccaccacgccagacagcaatagctgtgcctcc

SEQ ID NO: 38692 - DNA, 121 bp, Artificial Sequence
  Synthesized
  misc_feature (61): n=t or c
tacaaaatacatttcctaatttgtcacttaaagagacagatacagtttaaaggtttttttnccccccccataaactttcccaagacaatgaaaacaacaagcatattactcagtatttcta

SEQ ID NO: 38693 - DNA, 121 bp, Artificial Sequence
  Synthesized
  misc_feature (61): n=t or g
aactaggccttgctgtcccagcatcatctatcttgtccttcctgccttggcagatgttctngaacttttgttcatttattatgggtgggacttcaaaaactatctttttttcttttcctcc

SEQ ID NO: 38694 - DNA, 121 bp, Artificial Sequence
  Synthesized
  misc_feature (61): n=t or g
caaggtcgctatctcagctctggggaaggaacttttgctaggatgagctttcttgattttncagaatttatttaaaggttatttattaagctttgctaaagacttaaaaaactgatcggta

SEQ ID NO: 38695 - DNA, 121 bp, Artificial Sequence
  Synthesized
  misc_feature (61): n=t or c
aacaggatttctctgagggcttaagtacagtcttggattttgaagagactgttctataaanattcacttttatagagaaatcctgtatttaatacaacttgaatcttaggatagactacat

SEQ ID NO: 38696 - DNA, 121 bp, Artificial Sequence
  Synthesized
  misc_feature (61): n=a or g
tataataataagaaaaaacatctatttggaagtgtcacagtattggagataccattctatnttaatctattgtcaagaggaaaacagcgaactctaaaataacagctatttcctttgaaca

SEQ ID NO: 38697 - DNA, 121 bp, Artificial Sequence
  Synthesized
  misc_feature (61): n=t or c
gaactcctagagacttactagtttttttccagtacttcaaaagatttatttgggatgcttncacttggaatctgagagaaatgccattggccctttaggaagatttctcattgcctgggga

SEQ ID NO: 38698 - DNA, 121 bp, Artificial Sequence
  Synthesized
  misc_feature (61): n=a or c
tcatagtgttctcctgtgacttttaggaaaatactggaagattttaaattcaggccaggtnagaaactcacttgctatggtggtaagacagtttctgtgaaatagataataaggtctgaaa

SEQ ID NO: 38699 - DNA, 121 bp, Artificial Sequence
  Synthesized
  misc_feature (61): n=c or g
aggttaactttagacctggtactacaatgtgctggctataaaaaatatgtaagcacaaccngacggcctctggccagcagaaggcagtcaaatcactacatggaaagaaaaaaaaaaagca

SEQ ID NO: 38700 - DNA, 121 bp, Artificial Sequence
  Synthesized
  misc_feature (61): n=a or t
ctcacttcatcctacactaaggctggaagagaaacagtcaaacctgagaaagcaaagatcntgtggaataacgtgagtacacaggtcctattttctcggtcttgctacctttttgcaaaaa

SEQ ID NO: 38701 - DNA, 121 bp, Artificial Sequence
  Synthesized
  misc_feature (61): n=t or g
aataacttgagtttcctgagtttctatatgaggtcaagaaaggccaaagggctaccggagntaaaatgcccatccatttaaagtagctcagtttcttcagttaatagcacggggttataga

SEQ ID NO: 38702 - DNA, 121 bp, Artificial Sequence
  Synthesized
  misc_feature (61): n=a or t
tcaggaagtagaatgttctgcaccagttctccaagactggaaataggagtatgatcttgcnaacatctttacagtttatgttcatagaatcaccaaggttggaaaagacctctaagatcac

SEQ ID NO: 38703 - DNA, 121 bp, Artificial Sequence
  Synthesized
  misc_feature (61): n=c or g
tgattctaggaaagcaggaaaaacagacaagaagataggtgctttctccatttgatttcancactcctaccactgaatatggagacagaaggacagagacgtgaattgttgctgaccagtc

SEQ ID NO: 38704 - DNA, 121 bp, Artificial Sequence
  Synthesized
  misc_feature (61): n=a or g
ttttttccagattctgttttcttcttttcttctcagcagtttttggttcattggtccactncaccaaggtatgaattcaacaacagtatgacttgtagtctacccatttacaaagaggctt

SEQ ID NO: 38705 - DNA, 121 bp, Artificial Sequence
  Synthesized
  misc_feature (61): n=t or g
ttaagaaatagacataaattatcttactactcatgaataacgagaaaacaatataaataancatgatgagccgcagtatttttctctcaccctctagagattcatcttctcttacacagtt

SEQ ID NO: 38706 - DNA, 121 bp, Artificial Sequence
  Synthesized
  misc_feature (61): n=a or g
ttcggaggcgctgtgcctgggcagctgggatgagtgctttattttggagactggcttatgntaattgtgtacagtcaccttaaccaaaagccatagctgtgtcaccgcagcacagagggtg

SEQ ID NO: 38707 - DNA, 121 bp, Artificial Sequence
  Synthesized
  misc_feature (61): n=t or g
aaaagaatttgggcacactacagggaaggcaaaaatagtaaataaagttctcccttttgtntatgtaaggattaaaaacctaccagccctatccatcactgccagattctaagactgagtt

SEQ ID NO: 38708 - DNA, 121 bp, Artificial Sequence
  Synthesized
  misc_feature (61): n=a or c
gaaaaaaaaatggtcttttgtttggaaatgtcattgttcagcttcactatttcatttcttntctctttttgtttcttctgttcactctgtggataggttctgtagtacccttaacatgaca

SEQ ID NO: 38709 - DNA, 121 bp, Artificial Sequence
  Synthesized
  misc_feature (61): n=t or c
tgagtagttaaaaagagaatactcagagaaagaattgcagagaatgcatttctgaggtganagaacatgtggtagccttagagattattgcacgaagatttccatagccagaagaaaaaga

SEQ ID NO: 38710 - DNA, 121 bp, Artificial Sequence
  Synthesized
  misc_feature (61): n=a or g
ttctggatgactccatttccatgctagcctgactatcatgacgttgctgtcctatgtagcnaattaatcaataccaaccttttaaaagcagtggttagtttaaaagcccaagagaaagact

SEQ ID NO: 38711 - DNA, 121 bp, Artificial Sequence
  Synthesized
  misc_feature (61): n=t or c
actcaatctgtctatttttgcagaatgttttctctgataagaaaccagtctgaagcaagangcattaggggcatcagtgtctatataaaagacattttctatattacttagtgtcgcatca

SEQ ID NO: 38712 - DNA, 121 bp, Artificial Sequence
  Synthesized
  misc_feature (61): n=t or c
gttttccttacatattgcagagtaataagctgtaaccttaggtgtttattagctagcagcntgagcttttctctggtatctacaaaggccagttcttttgtctaaaaacgttttgttgctt

SEQ ID NO: 38713 - DNA, 121 bp, Artificial Sequence
  Synthesized
  misc_feature (61): n=a or t
acagaggaacagaggtgaacacatccaggtagcattgagaggttagctatggtggttatanaccagttatgctgctttagagcaactgtggagctgtgccctttttttttcattagcctga

SEQ ID NO: 38714 - DNA, 121 bp, Artificial Sequence
  Synthesized
  misc_feature (61): n=a or g
attaaactaaggaaactgccataatttgccatcacttcaaccaaaagagttaaaagtcatnggaactgtatgatgacaacaaagaattatgaatcttccaatcatgaatctttcttttaac

SEQ ID NO: 38715 - DNA, 121 bp, Artificial Sequence
  Synthesized
  misc_feature (61): n=a or g
attttgggcagtaagtacaaaagcactcaccaggggcaggatggacactgcaggcatgctngcagactgctctacgtctagggcactaggtggttttaatggggaacaaggatagttttac

SEQ ID NO: 38716 - DNA, 121 bp, Artificial Sequence
  Synthesized
  misc_feature (61): n=t or c
aggatctacaaggtgcgtgccagcacggatacagaggttgctggaccactacatagtgaanatcaatgctgaattttccatgccaagggatgcttctcaggttggcaccagaggcacccag

SEQ ID NO: 38717 - DNA, 121 bp, Artificial Sequence
  Synthesized
  misc_feature (61): n=a or g
gaggctcctattggaaactgctgcttctcagctaagatagaaggaggtgtatgtgctcacntgcctcttcaggcatctttacgtatgactttcttctactgtaatttttctgcctaactta

SEQ ID NO: 38718 - DNA, 121 bp, Artificial Sequence
  Synthesized
  misc_feature (61): n=a or g
atggggtggctttgttgcgtagtgccgaacggttccctcatactgatgcgctttgtgtacntctggcttaaagagtaatcattacaaattagattcctagatttagacacccaaaccgtgg

SEQ ID NO: 38719 - DNA, 121 bp, Artificial Sequence
  Synthesized
  misc_feature (61): n=a or t
ccacaaaaatgcaagtctttaggtgtgtttggcctaagatgtctctaagctttctaatgcngagcactcaggctcttagaaggatatccagtttcctacttggcttaggatgcctttgttt

SEQ ID NO: 38720 - DNA, 121 bp, Artificial Sequence
  Synthesized
  misc_feature (61): n=a or g
tctcagccaggatccactctcatcatgcttgtacaaaacataagtagcattcctggtgtcnctagagatactgcatgtttggagactcataaatgaaaataggatttggcctaagatttct

SEQ ID NO: 38721 - DNA, 121 bp, Artificial Sequence
  Synthesized
  misc_feature (61): n=a or c
cacaaatacgccaggaacagattaaatactatagctgcctttcaggataaagaagtgagtncataaagaaaaacacatgacagcagcaaatcctccctaatttgcattttaaaatgcatat

SEQ ID NO: 38722 - DNA, 121 bp, Artificial Sequence
  Synthesized
  misc_feature (61): n=a or g
aatctgaatgtcatacatccttccttaaaaagggcaagagaagagaggaaagaggcttacnagccttttttgtgttccctctggctttctgacttggaatactggcttctcttctaatatt

SEQ ID NO: 38723 - DNA, 121 bp, Artificial Sequence
  Synthesized
  misc_feature (61): n=t or c
aggcaagaagggttttcatttgcagtttcaggagcagacttgcttccatctgctcttttcntttgtgttcttgcctccagtcttgcaattctttttctacaacctgttgtgatgaagactt

SEQ ID NO: 38724 - DNA, 121 bp, Artificial Sequence
  Synthesized
  misc_feature (61): n=c or g
caggtgctttcaagaagcctggaagcacctgcaagggcaggatgctgcctgatggctttgngatttgcaaccacctcggtccctgctccaccctcccccacaaagccactctctgcccccc

SEQ ID NO: 38725 - DNA, 121 bp, Artificial Sequence
  Synthesized
  misc_feature (61): n=c or g
cctacagatgttgtgcatgggcttttctttgagaatggcatcctacacaagggcagactgntccaggctatgctgctacaagggcctctacagtgctctgtttgccagtcagtgtctgaag

SEQ ID NO: 38726 - DNA, 121 bp, Artificial Sequence
  Synthesized
  misc_feature (61): n=c or g
tgtcgctgtgttttgtttggccaccctttccttgctttggtaaatcacagctcgagctctnattacccaacgtaggagagctcgggctgttctgtgggcactctctgtgcctggaggtggc

SEQ ID NO: 38727 - DNA, 121 bp, Artificial Sequence
  Synthesized
  misc_feature (61): n=a or g
aaacacatgcatatgtagtgttctttgatgataaaacaagattttgaacataacaaaatantcaattgtgtgacatcacctttcaaataaaggtatacagcctaaggacactgaagggctg

SEQ ID NO: 38728 - DNA, 121 bp, Artificial Sequence
  Synthesized
  misc_feature (61): n=t or g
agtaaaaagatacctttaactcttttttattaaaaaagaaaaattggtattgtttctctancatttgtggaacctgaaagcactgattttaagacagtgctgctatatgtacaaaatttaa

SEQ ID NO: 38729 - DNA, 121 bp, Artificial Sequence
  Synthesized
  misc_feature (61): n=a or g
ctgccttactctagaataaagcagctttccacggctgttttatttcgttataagacatcantgtgtgggaagccaggaggctctgctcattgcaggagtgcccattgcagctgagtgccct

SEQ ID NO: 38730 - DNA, 121 bp, Artificial Sequence
  Synthesized
  misc_feature (61): n=a or c
aacaggtcagcatccagtcaggtcttcctatctccatatcccagtagttcagagccttgcngagcacgtggaagggctgtggtggtcctggctctatgcaaggggtggctttggcactctg

SEQ ID NO: 38731 - DNA, 121 bp, Artificial Sequence
  Synthesized
  misc_feature (61): n=t or c
atttccatcttccttagcttcattttctgctttggaacaatccaagaagacccctcgcccnctttcccctatcaatccaatcccaaagcttttgcaatcccaaagtcctctcctcctttgt

SEQ ID NO: 38732 - DNA, 121 bp, Artificial Sequence
  Synthesized
  misc_feature (61): n=t or c
ctgtgcttttcatttgtttgtttctttagaatccaaatacatctgcagggagtgccccagnccagaagggtgattctcagtgcagggataatttgaggtttcccttgggagctttatctcc

SEQ ID NO: 38733 - DNA, 121 bp, Artificial Sequence
  Synthesized
  misc_feature (61): n=c or g
ttggactaactgccttcagaagtccttttcaacctcataggtacaggatcctgtgacctgnagatgttggatccagccacaacaggagatgcagatcagattgtgctgtcttgttaccaaa

SEQ ID NO: 38734 - DNA, 121 bp, Artificial Sequence
  Synthesized
  misc_feature (61): n=t or c
gctggaatggtgtccgcgttaggtactaagagcaaggacttctacgtctggggtttcctgncactggtttcctttgggaggagctgctttctgctgcctgcaagaagggcgtggagcatca

SEQ ID NO: 38735 - DNA, 121 bp, Artificial Sequence
  Synthesized
  misc_feature (61): n=t or c
ttgacaactgcaatgtgatgtcttatgttgtgacattcaaattaaatctttttattgtaantgccagtaattttgatcttttctttcagtgtttctccactaggaaggccattattttttt

SEQ ID NO: 38736 - DNA, 121 bp, Artificial Sequence
  Synthesized
  misc_feature (61): n=t or g
tgttaagggctcctctatgttctgtatgtcacaatgatcggctatgccctgtctggggganctggtgaaatgaaggctggacttaggtgtagctgggcagatgggtcacgtgtcctgtttg

SEQ ID NO: 38737 - DNA, 121 bp, Artificial Sequence
  Synthesized
  misc_feature (61): n=t or c
caggacgagttctttccttacaaccttcacaagagccacagtgggctccagctgaggacangcctctgggctcaggactggagggcttgaaggttccttccaacccagcccattctaatcc

SEQ ID NO: 38738 - DNA, 121 bp, Artificial Sequence
  Synthesized
  misc_feature (61): n=c or g
ctccacaggtgcatgtactggggaaaaaagaagtgacatcacggccacacggtgcctttgntgctcttatcctcatgcaatcctttccttttggtgctgtagaagtgcagtcgccacagca

SEQ ID NO: 38739 - DNA, 121 bp, Artificial Sequence
  Synthesized
  misc_feature (61): n=t or c
cttctatttctccttcaacccgcatttgttttcatagcacggagaagtcatttttaccccnacgtactttcgtatgttcttattcacattcagctgcttctaagcagtgcctctaggtagt

SEQ ID NO: 38740 - DNA, 121 bp, Artificial Sequence
  Synthesized
  misc_feature (61): n=t or c
ctcatctacataatacacaaagctgagacctcctgtagaatgaacaacaaattgaataacnattgagggaagtctgaatactttttaatgtaggaacgcagatatataacaagctacagaa

SEQ ID NO: 38741 - DNA, 121 bp, Artificial Sequence
  Synthesized
  misc_feature (61): n=a or g
ctgttgaagcattttctatatttgtttaaaaaaaaaacaacacatgcaatactgtcgatgnttgtctttagaagtatatctatgctcagtatttgagactgagaacgctgaacttgtgtaa

SEQ ID NO: 38742 - DNA, 121 bp, Artificial Sequence
  Synthesized
  misc_feature (61): n=a or g
tctcagggacgaggagctgggctttcaccctcctcctcctcgagctgttgatttacttttnaatagcaaccagccccgtatcgatcgatcgtttcgcttctcttgtgtttacagcgtcccc

SEQ ID NO: 38743 - DNA, 121 bp, Artificial Sequence
  Synthesized
  misc_feature (61): n=a or g
cacttctcaagactctggcttgtgccgtggcatcctattatataaaactgagatgctaagncatgggaccaagttacgagagatgcaagtgttgtttaaaagaggaggggggattaaaaaa

SEQ ID NO: 38744 - DNA, 121 bp, Artificial Sequence
  Synthesized
  misc_feature (61): n=t or c
aacagaaaattgaatttcatatttacttttgtagtgaagtcaaccaccttaacatttgtcntaactacaaaaattatgctttctttaattatcttatcttgtacaaaaatgtatcaaactt

SEQ ID NO: 38745 - DNA, 121 bp, Artificial Sequence
  Synthesized
  misc_feature (61): n=a or g
ctcctaaaggcagaccgctctgctgtggttgtttgccttgtgtttgggtggcacgatgggntctgcgtgtttgcatgcgtcccttgggtgctgcaaagggggtctgccatgggaagggcag

SEQ ID NO: 38746 - DNA, 121 bp, Artificial Sequence
  Synthesized
  misc_feature (61): n=a or g
atggctgatgtggggatagagtctgctcgtgatcccttgtagtgacttttttcctgatcancaatgctgttgcttgaacatggagcagtggttgagaatgactttactgaagggctgattt

SEQ ID NO: 38747 - DNA, 121 bp, Artificial Sequence
  Synthesized
  misc_feature (61): n=a or g
cttatcataggcaattctgcctggcatccaatgagaagcaacatattcctgtctgcctgcntcatctatattttgttatatacctaaaactgaaatgtaagcagtttttgctggcaagctg

SEQ ID NO: 38748 - DNA, 121 bp, Artificial Sequence
  Synthesized
  misc_feature (61): n=a or g
cgggatgtggggagggatggggcggccgggcagagcgcagaggtggctccccaaaggcacnctccatttctcagccatttactgcgtttatccgcagccccggcggatggcactcacctcc

SEQ ID NO: 38749 - DNA, 121 bp, Artificial Sequence
  Synthesized
  misc_feature (61): n=a or c
ataaagagtgctttcagtcccttaacctagcatctgacacatgggagcgagtacccttaangcactcccattcattcccctgctgcatttgggttcctcccttgcctgtattccctctctc

SEQ ID NO: 38750 - DNA, 121 bp, Artificial Sequence
  Synthesized
  misc_feature (61): n=a or g
gagaggaaacatgtcctcaataaatattttgggtatttaaacaaggccagtgccctccacncagcaacatctaatgccactagaaaccaagtagtatgcattaagtggctgctttaccaca

SEQ ID NO: 38751 - DNA, 121 bp, Artificial Sequence
  Synthesized
  misc_feature (61): n=t or c
ggtcatctagttcaactcccctggaacgaacaggggcatttttgacaatggaggaacattnttggcaagctctaaaaaccatcaggattgagaaggtctctgaggacatcataaaggtcta

SEQ ID NO: 38752 - DNA, 121 bp, Artificial Sequence
  Synthesized
  misc_feature (61): n=t or c
ggggccagaatttagaaaggagtaaaaagtaagtgaatgtcattgaaatatttagacattnagacacatggagcaaaattatgtccgatgcaggtctgtgtatttttttatcactttctgc

SEQ ID NO: 38753 - DNA, 121 bp, Artificial Sequence
  Synthesized
  misc_feature (61): n=c or g
ctgttgtgtataacattattaaaatactgtttgcagcatttatgtatgggtcttcatcttntttgtcttagagatttattctcaaaagcttaaaaaaaaaaaatgtacctgttaggaaatg

SEQ ID NO: 38754 - DNA, 121 bp, Artificial Sequence
  Synthesized
  misc_feature (61): n=t or g
cccttcactattcaaatggatttacttcccacttggttatttcccacttcctttcataagntcaaattcagctctcaagcgcatgaggttcccaaatgaggtggactgaagtcccagagct

SEQ ID NO: 38755 - DNA, 121 bp, Artificial Sequence
  Synthesized
  misc_feature (61): n=a or g
cgtgctgaatctggaagacaaagggagcacaagtaatctaaaagtcctcaaagaatttaanttttacttctagggcactgccagctcaacaatctctgtcctgtattttttaagaatgttt

SEQ ID NO: 38756 - DNA, 121 bp, Artificial Sequence
  Synthesized
  misc_feature (61): n=a or g
gggcttctccatctcagcccacagtggagagatgttcaaggccaaggatagggccctgggngggccctccctgatggaggcattggacctgtccagagcagggagtggggaggggggctgt

SEQ ID NO: 38757 - DNA, 121 bp, Artificial Sequence
  Synthesized
  misc_feature (61): n=t or c
gtcagtacttgtagcacagccaaaagggccagttgccttgtcaccatgtaccagtttgccngtgttttattgtgtgtactgtcaagcttagggggacttttacctgagcacactggggcca

SEQ ID NO: 38758 - DNA, 121 bp, Artificial Sequence
  Synthesized
  misc_feature (61): n=t or c
ctggggaagcactagtaggtgttatcaccaaacctaagactctcaatgtgtcattgtgtgntgtactttttaatagttctgctagtcttgtcctacaccctgaaagtaaatagatggttca

SEQ ID NO: 38759 - DNA, 121 bp, Artificial Sequence
  Synthesized
  misc_feature (61): n=a or g
acaagccattttacttggctatcaagaacatgctgctcctgcaatagtgcactgtcagttntgatatatacaacgattttagcattcatgaagactgttcaggggacacgtgagtctctag

SEQ ID NO: 38760 - DNA, 121 bp, Artificial Sequence
  Synthesized
  misc_feature (61): n=a or g
tcctacaatgaagacagctgactgtgtatgtttggtgggaagagttaaattaagtattaanaacaatcatgaactttccaccttttttttattattactaggcttctaccctggattttac

SEQ ID NO: 38761 - DNA, 121 bp, Artificial Sequence
  Synthesized
  misc_feature (61): n=t or c
atagacatttctcaccagaaatctgcagttttgattgaagggagcacaatttctgtgctgnttggataatgcgggttctcaggaagcaggaatgggctcgctgtgctgcagccctgggtct

SEQ ID NO: 38762 - DNA, 121 bp, Artificial Sequence
  Synthesized
  misc_feature (61): n=t or c
cctccattcctgggtctaaaagtgccatttttaggagaatttcaaggtgggggcaaccacnggcataatatctgataggaaacacgtgggagttcttgttaccacgtagatgtcaaaagtc

SEQ ID NO: 38763 - DNA, 121 bp, Artificial Sequence
  Synthesized
  misc_feature (61): n=c or g
ctagatctgggaggaacatcaagacaagccaaggcagaggctgagctggcagcacttgctnagaccatttccttgaatgagagcaaagctcctctctggctctgggaaaccaactccagaa

SEQ ID NO: 38764 - DNA, 121 bp, Artificial Sequence
  Synthesized
  misc_feature (61): n=a or g
tgatgggactttgatccaagcctgccatccctgtgggtcagttttgatgctgtatggcagnaaagcacccagaattcttccaacagtgatattttatattcttaagtcccacatgttggga

SEQ ID NO: 38765 - DNA, 121 bp, Artificial Sequence
  Synthesized
  misc_feature (61): n=t or c
cacggcccacagatggcaaacacagcaacaagatggggctaccacggccacaacccagtgncacctcaacccacagccagggccatcgccggacacccgcagggacttacggccatcagtg

SEQ ID NO: 38766 - DNA, 121 bp, Artificial Sequence
  Synthesized
  misc_feature (61): n=c or g
agtacctgtatgacttaaaaagagaagtcttaaaacaaaaggaaacaaaagtattggttancaaaactccttttctctagaaagaaaaggacatgccttgaaacgtatatacgaggaacag

SEQ ID NO: 38767 - DNA, 121 bp, Artificial Sequence
  Synthesized
  misc_feature (61): n=a or g
ttccactaggtggaacagagagaaacgactgccaaagcctttaagttgaatcacagcttcntgtgtaagctgtgtgccagttcccagtccagtgctcatttgtcttccccctcaccccccc

SEQ ID NO: 38768 - DNA, 121 bp, Artificial Sequence
  Synthesized
  misc_feature (61): n=a or g
ctcctgagtgaagaaaggaataaagaaaagccaaaggttatgtaggagtcctaaaacctcnagcacagcagtaactctagagatacagactctacaaattctttttattttactttaactt

SEQ ID NO: 38769 - DNA, 121 bp, Artificial Sequence
  Synthesized
  misc_feature (61): n=t or c
ttcatgacaaccgcaatttttgaaaacaggtatttaacaaatttattattttcttagcctnttagcttaggaaaaccctatataaaggatgttcttctacaaggaaataagaatttaaagt

SEQ ID NO: 38770 - DNA, 121 bp, Artificial Sequence
  Synthesized
  misc_feature (61): n=a or t
tcccaccacttcccttaaagtgtgaaatttaacatttttctccgtaatattaaaatgaggnagacttcttcctctcccactgtgcaaatcttagaagcagtggagtgagttaataaattag

SEQ ID NO: 38771 - DNA, 121 bp, Artificial Sequence
  Synthesized
  misc_feature (61): n=t or c
gattatgttttcaggtgatttcagttgtttgaagccacttctcagctcctccagcctaaanagataaggacattaggaagacattgaccactatcaagtttaatggaaatatggcaaaaaa

SEQ ID NO: 38772 - DNA, 121 bp, Artificial Sequence
  Synthesized
  misc_feature (61): n=a or c
acactccatttaagtttctgttttagccacaatggaaacttatgcactgctgcataagtgncgccctctgaatagtcccctctatttctaaatgctgagagcacttgcttagtttgctgtt

SEQ ID NO: 38773 - DNA, 121 bp, Artificial Sequence
  Synthesized
  misc_feature (61): n=t or g
tattctgccatccacattcttccttacagcaaataaacctgcagtgagaaatcacattatnatgctaatatgcaggataaaaaagatcactatatttcactgcagtttctttgtaatgaat

SEQ ID NO: 38774 - DNA, 121 bp, Artificial Sequence
  Synthesized
  misc_feature (61): n=a or g
tgcattttttggtaaactgttaggagaacagggaaatacttcatgaggggctgctgcagcntgaggcagcgttgcttcctgtatatgactggagcttcatctgggagctgctggtgctgct

SEQ ID NO: 38775 - DNA, 121 bp, Artificial Sequence
  Synthesized
  misc_feature (61): n=a or t
ggctaacatactgctgttctaacacaaacagcagcttttctgttttaactctgtaaagcgnttttcttctatgttgttatgtataagcaacaattttaactgtttttgctgtattttcctc

SEQ ID NO: 38776 - DNA, 121 bp, Artificial Sequence
  Synthesized
  misc_feature (61): n=t or c
tacacaaaacttgagcgcagtggctctgaaattcttcagtcagacctccccaaaaattacnacatctgtctgaaggcaaatgcccccaagtgctcgttctgctttgtcctgtgtattcagc

SEQ ID NO: 38777 - DNA, 121 bp, Artificial Sequence
  Synthesized
  misc_feature (61): n=a or g
ctcaagtaaaaagagtttggtccaaagtactcagctcaaccccttcattactatagaccanccttaaccctcatgtaatggtggatcaccatccgaatgctgcataggctgaaatcaatga

SEQ ID NO: 38778 - DNA, 121 bp, Artificial Sequence
  Synthesized
  misc_feature (61): n=t or g
tggcactggtaatttgacatttaagcctacagaagcagagagatttgtcatctggctgggnatcattctgattattgattatatctcaggcagatgattctgcaactgagtgctgaaacaa

SEQ ID NO: 38779 - DNA, 121 bp, Artificial Sequence
  Synthesized
  misc_feature (61): n=c or g
aattgggaaaaggaaatccaacactgttgaacatgacaaggtcagttcggaggaacaaggnaatattgttgcatgagctaaaaaagtagcattacagcagctgacagcacctggagcactt

SEQ ID NO: 38780 - DNA, 121 bp, Artificial Sequence
  Synthesized
  misc_feature (61): n=a or t
ttttggccaaggatgtgtatattgcatgtagtgagcgagaagctgaccaaaagagactacntccataaaagtgaaatttctcctggaagtggcttagtagttgcaaatgttttggccagac

SEQ ID NO: 38781 - DNA, 121 bp, Artificial Sequence
  Synthesized
  misc_feature (61): n=t or c
cttgcttctttgacctagttacaagttacaaaaaactgcttcatgccctacacataggggntttcccattatggttgctcagctgtcacaaccaagacctgcccttaaggtaatgacctgg

SEQ ID NO: 38782 - DNA, 121 bp, Artificial Sequence
  Synthesized
  misc_feature (61): n=a or c
ggtgatggtaaacaaagttttcttttgtgaagggaacatttgtcagagaaatgcttgaagnaggatggcagtactgcaccatcttttgtgttgcactttgctttccatccagcagcctgct

SEQ ID NO: 38783 - DNA, 121 bp, Artificial Sequence
  Synthesized
  misc_feature (61): n=c or g
acaccttgccagaacactgcccaagtcctaggtactgtagcttacttttttattaccattnttctgattttgggacttttagaacttttttctatgtgaaaacttctcattatcagtttac

SEQ ID NO: 38784 - DNA, 121 bp, Artificial Sequence
  Synthesized
  misc_feature (61): n=a or g
ctttaagcttcccactgcacccaccagggaaccgggaggccacaaggagtaatgctccagnacctgtggtgttaccctggcctgagctatgtcagacccatgcaggatgtgtgtacctcct

SEQ ID NO: 38785 - DNA, 121 bp, Artificial Sequence
  Synthesized
  misc_feature (61): n=a or g
agaggtttttgtgggttttctttttcaagcacaaccttccactcatctcattttccttttngaggattaagttaaccttctcgtgtccctctaggagcggttggtgtcctgccacgagctc

SEQ ID NO: 38786 - DNA, 121 bp, Artificial Sequence
  Synthesized
  misc_feature (61): n=t or c
agcttcagccgattccattcttggggtgaaatcaggatttttttcgctctccccaaaactnccggctaagaaacccatcgatggccgccccgttcggctcctgtcggccgaaaagaaaaat

SEQ ID NO: 38787 - DNA, 121 bp, Artificial Sequence
  Synthesized
  misc_feature (61): n=t or c
aaagtactttaaccagggcatgcagaaggacagcttgctatttaaaaatatgctgtagccntttctgatgaaaaatagatgtgccaagaaaagactgtagcaagataaagtgaaatactag

SEQ ID NO: 38788 - DNA, 121 bp, Artificial Sequence
  Synthesized
  misc_feature (61): n=a or g
ctggctttgcagtgtttgaaaacaaaacaggactatgaaatgaaaacccaactttttgcanagcttttgcccatctggcaaagcagctggcgggaggcattgctgcaagcatctgctgctg

SEQ ID NO: 38789 - DNA, 121 bp, Artificial Sequence
  Synthesized
  misc_feature (61): n=t or c
aattattatttactgcacatggcctttattctctgttcattgggtaatttgtttaaatccngccctttcattcagtgaagtcaacaccaccaaagcagactgagttactccacggttacac

SEQ ID NO: 38790 - DNA, 121 bp, Artificial Sequence
  Synthesized
  misc_feature (61): n=a or t
caaaacattcttctttcactctacaccattcagtgcacttgattttcagccaaaaaatgcnttctgataatatgaaatccagctggtaacgtacctcatttggtgacatcttatcagtgtc

SEQ ID NO: 38791 - DNA, 121 bp, Artificial Sequence
  Synthesized
  misc_feature (61): n=a or c
agacttgaaaataacccaaatattcccttctgtgtgcaactgccttctttcctttgggtanaagataaggacaaaagacagtcccacactgtaagatgctacactgcataaaaggcatatt

SEQ ID NO: 38792 - DNA, 121 bp, Artificial Sequence
  Synthesized
  misc_feature (61): n=t or c
ttgagatgaaagactgcactgatataaagatctcagttcagtcttttctgaggtttctacnagtagaatggtaaaactgcaatttaaagcacaaaccagctaaatacatacctgaaataaa

SEQ ID NO: 38793 - DNA, 121 bp, Artificial Sequence
  Synthesized
  misc_feature (61): n=a or g
ttgtgcttcacgtctctgaaggtaaaaaaataccacctgaaaccaacactgagagcagtantacaaacagctgaagaggagactgagagcaactggatggagagaatgagcaggaggagac

SEQ ID NO: 38794 - DNA, 121 bp, Artificial Sequence
  Synthesized
  misc_feature (61): n=a or g
ttttgtgaaatgtagaagaattgctagtgagccctttttcccatacattctgctcttaacngtccttggtcaattaaattttcacttcatctttaccagggtgtgggatgctgagatggat

SEQ ID NO: 38795 - DNA, 121 bp, Artificial Sequence
  Synthesized
  misc_feature (61): n=a or g
tggaggaaagaattacactcaaggcagcgagctgctttaatgctattgcttgttaatcgcntgattaacaggttcttaaacttgacatggaagttgtttatctttgtatatagaggtggtt

SEQ ID NO: 38796 - DNA, 121 bp, Artificial Sequence
  Synthesized
  misc_feature (61): n=a or g
gcagcctgccgctgtggtcctgggcagtcgttcttctctgctgaatgccccgtctgtaganagaggagataaatatcatttcccaattcacagggatgtcatccgggtgtgctaaagacca

SEQ ID NO: 38797 - DNA, 121 bp, Artificial Sequence
  Synthesized
  misc_feature (61): n=a or g
aatggcagtgttaatggttcgtgtagctgtgggagcaggcagggagagggccccagcatcnctcctggcctgccgaccttcggtgtgcatggaagttttcataacaaaaatccaattatgg

SEQ ID NO: 38798 - DNA, 121 bp, Artificial Sequence
  Synthesized
  misc_feature (61): n=a or g
ccatcccctcggtgacggagggctgcaacggcagccggaggaccactgtgtgcctggaggnaaagcactcacaggtgacattttactgaagcaatgcacctcccagcaccaggttggcatg

SEQ ID NO: 38799 - DNA, 121 bp, Artificial Sequence
  Synthesized
  misc_feature (61): n=t or c
gtatcctggctgtggtgctgctagaacaaaaaaaaaagtgctatcacccctctactcctgntcataacttccgtatctgtacagttaggatgtgtccctcatggcacagagttacattgga

SEQ ID NO: 38800 - DNA, 121 bp, Artificial Sequence
  Synthesized
  misc_feature (61): n=a or t
gaatactgcgaacacatttatgctaagagttgcctgcacagcatcccttaatgatacttcnggtcagtgttgacatgaactccgttatgagctactttggggcgtgcatgtggtacttctc

SEQ ID NO: 38801 - DNA, 121 bp, Artificial Sequence
  Synthesized
  misc_feature (61): n=t or c
ttcccctccccccggaggagcaagcttcggctgggcttgcagacgatgctggccgggctgngctcggggcaccggttccaagtacagtgcctggttcggtttccgtatattctttggcttt

SEQ ID NO: 38802 - DNA, 121 bp, Artificial Sequence
  Synthesized
  misc_feature (61): n=a or g
caatagcagggaaaaaacaaaacaaaacaggccttttttaaattcccccagctctctgacnagctgaggagttatttggcagctacatcgttgctattctgaaacccaagtgccagatgct

SEQ ID NO: 38803 - DNA, 121 bp, Artificial Sequence
  Synthesized
  misc_feature (61): n=t or c
ccagatcaccagagttgttgatgtctaaaaggcaaggaacgattgcaaaaaatagtgctgnttttaaaattgcaaaataataactagcaagaataataagtagagagaaagggaaactact

SEQ ID NO: 38804 - DNA, 121 bp, Artificial Sequence
  Synthesized
  misc_feature (61): n=a or g
acactttaaaaatatgctggtttctgcttgtgattgtctgtgtagactcaaatgttaattnttgaagaatatacaaaatttaaaaaatctaaaggaaaaaggttgatgctttgtgaaatgc

SEQ ID NO: 38805 - DNA, 121 bp, Artificial Sequence
  Synthesized
  misc_feature (61): n=t or g
agctttgctgtaacagaagtaataaaaagagagaatataagaaatgtagatagcatgaagnaggactcagtgccttagctaggcaattgccaagcacatgtaagcagtagatggattattt

SEQ ID NO: 38806 - DNA, 121 bp, Artificial Sequence
  Synthesized
  misc_feature (61): n=t or c
atcagcgtttggaatatctatgtgctgttttcagcgaacacctgcagggaaatcctgctcntcttttagggacgctcgtaggactggagagagggatgtgaaagctcattttctggctgca

SEQ ID NO: 38807 - DNA, 121 bp, Artificial Sequence
  Synthesized
  misc_feature (61): n=t or c
gactaggaatccacagtatttcactatcacatcaaaatgcctttgcccttttctgttttgnatttatttgtaggacaaaatcatggtaagtgcccattttgtaggggtcctacctcagtct

SEQ ID NO: 38808 - DNA, 121 bp, Artificial Sequence
  Synthesized
  misc_feature (61): n=a or g
tgactttcagcagccctagaatcccactgtgactttaaggcaacgtctatgggtgttactngagtgtacactgcatgaaagcactaatggctcaagtagtctcttagctcagtcgtgggga

SEQ ID NO: 38809 - DNA, 121 bp, Artificial Sequence
  Synthesized
  misc_feature (61): n=a or g
tattgaatttggttcttctcatttgtctgtctctatgtaattaaagacttttttggggggnaaaaaagcccaacacatagcacacaagagatacgagttagacagcaagttatctgcatat

SEQ ID NO: 38810 - DNA, 121 bp, Artificial Sequence
  Synthesized
  misc_feature (61): n=t or g
agtgctagctgcaggaagatgttatctcatattttatgacacctatagtaattgcttactnatacccccgtgttgaaaaaacaaacctttttttcttttgttcccctgcactacgcattgc

SEQ ID NO: 38811 - DNA, 121 bp, Artificial Sequence
  Synthesized
  misc_feature (61): n=a or c
atacattaacacctttataactcattcaccagctggccctaaagctggcttttatcacttnagtatttgggtatttgtagaagtgttctttacctgctgcctgggcatcttctgagatgga

SEQ ID NO: 38812 - DNA, 121 bp, Artificial Sequence
  Synthesized
  misc_feature (61): n=a or g
tttgaagatgtccctcctgtaccctcatgaatatattgtgcttatcagcatctgatggacntctatgggctagggtggaatatgtgggtctcctagaacttaatatttcagaaggactaaa

SEQ ID NO: 38813 - DNA, 121 bp, Artificial Sequence
  Synthesized
  misc_feature (61): n=a or g
ttacttcatctgtaatttgtcttgtgttctggttagtactaaagaaacatgtaaaagagcntgagatttctgcatgattattagcaggaatattagcaacaaagggcatatgagatctaag

SEQ ID NO: 38814 - DNA, 121 bp, Artificial Sequence
  Synthesized
  misc_feature (61): n=t or c
ctgttgaacggactgctctgctgcttctgcgaagaccccagttagaaagtttcaccctttnttcaagaacaggaagcatccctgaccgctgacttcttcatgtgttgcagttgagatggct

SEQ ID NO: 38815 - DNA, 121 bp, Artificial Sequence
  Synthesized
  misc_feature (61): n=t or c
gtgacctgcctagttgaaattttgtctgaagtagagcgaagtcaagttagttgcaataaangatcacttctaatgcgagaaagtgcttacagcatcttagtaaatgctgcacattaagtgc

SEQ ID NO: 38816 - DNA, 121 bp, Artificial Sequence
  Synthesized
  misc_feature (61): n=t or g
ctgacctctaactccttctctaaaattctctggatattcctacggtgtttccacacaaatnaaattgtcccagatatctatacttgaatgtagagaaataaatctctcaaagaagtaaaga

SEQ ID NO: 38817 - DNA, 121 bp, Artificial Sequence
  Synthesized
  misc_feature (61): n=a or g
gggaaatgaaatttatcttgaagaagatgtgcttggttccttcaaatttttactcataaangatttttccagatgcagatttgtcccacaaaccaaactatgccataagctcactgcatta

SEQ ID NO: 38818 - DNA, 121 bp, Artificial Sequence
  Synthesized
  misc_feature (61): n=a or c
tcagggttgacaaacaaaattcttctgaacagttaagaagtcagtattcaatgaaactgantttcaccttgtccagaatattctcttttcacttacatcttctgggaaaaaagaaataaaa

SEQ ID NO: 38819 - DNA, 121 bp, Artificial Sequence
  Synthesized
  misc_feature (61): n=a or g
ttttctataagttttgcttcaggtccagttgtgctgaaacatctttgggacataaaataanggaaaactaaaatttcaagttaaatttggacattctgtgtctaaaacaagagactgaagt

SEQ ID NO: 38820 - DNA, 121 bp, Artificial Sequence
  Synthesized
  misc_feature (61): n=a or t
attgtgttggagaaagctggtcgtcagcaatgagaggaggtagtaaatgatgtcattcccnctccagagtgatacatttgtaaatacatttgtaaatacctatatttagtaggcagtgctt

SEQ ID NO: 38821 - DNA, 121 bp, Artificial Sequence
  Synthesized
  misc_feature (61): n=t or c
ctttttctttctgaaatatttgaagaatggtatttctgacaggtcccgagtagctggcaantgatcatataacttactgaaactagtttgaggaaatctactcaactgagggttaaaaaaa

SEQ ID NO: 38822 - DNA, 121 bp, Artificial Sequence
  Synthesized
  misc_feature (61): n=t or c
aaactccaccccagcataactggggaatactgttcattgatgattaccagatgtattgcangcatttctgctttgaaaattaacatagttaatagtgtgattgcaggctgttccacaacag

SEQ ID NO: 38823 - DNA, 121 bp, Artificial Sequence
  Synthesized
  misc_feature (61): n=a or g
gtgagaaaaaataatggcttaagcttccagttagcaaaaaggatgatacaaaaaaaaagtnaaacactggttaaaaatctgtgatgagcatatggaagggctaaagtttagggacacagat

SEQ ID NO: 38824 - DNA, 121 bp, Artificial Sequence
  Synthesized
  misc_feature (61): n=a or c
actaactaatagctattacaaggtaataggagttgttcagtttaatttctttaagtcaagnatttatatgggccttcatgggccatgtcatgcctcaggagactgagagtgtcctctgggc

SEQ ID NO: 38825 - DNA, 121 bp, Artificial Sequence
  Synthesized
  misc_feature (61): n=a or t
acttaatggtttgttgttttgccatggtcatcagtcttgtgaaaccagaaatttccccagnttggggcctgggcagaagaaaaatctttctataccccaaagtgtcagaagacagactgtt

SEQ ID NO: 38826 - DNA, 121 bp, Artificial Sequence
  Synthesized
  misc_feature (61): n=t or c
cactgaaagaaccaatatttttgctaggaactgccaaacatttgcaaaatgctcagctcangtggccatagggaatgaatgcataaactgttacgtgtacagtctaaggttcaagcataat

SEQ ID NO: 38827 - DNA, 121 bp, Artificial Sequence
  Synthesized
  misc_feature (61): n=a or g
tactaactttaaaaagattttgtctcatgttttgccttctcagcaaacattgtttttgtgncaatgtagtccttcctacagatactttattccatcttttatttttccccgctcttaaggt

SEQ ID NO: 38828 - DNA, 121 bp, Artificial Sequence
  Synthesized
  misc_feature (61): n=t or c
ctcttgcgtaataagctgcctgctcgttggtgcattgcactgagggtaaagtgtttaaagngttttctgtgctgtttgggatcactgaactcatatgcagcacactaggggtggttgtacc

SEQ ID NO: 38829 - DNA, 121 bp, Artificial Sequence
  Synthesized
  misc_feature (61): n=a or c
aattattgtacacaggctgagaggggattgctggacagatgtacgtattaaatcctgcccntaatttcattgtgggtgggaggacatgggacaacatgggtggattcaggcaatatcttta

SEQ ID NO: 38830 - DNA, 121 bp, Artificial Sequence
  Synthesized
  misc_feature (61): n=a or c
aattatggaaagataagcatgggctataggaaaaaaagatgtactgacttgaggtgaatgnaccttagtatgaaccttagtatgaacctgtgccttcaatataaacctgtatggatgactt

SEQ ID NO: 38831 - DNA, 121 bp, Artificial Sequence
  Synthesized
  misc_feature (61): n=t or c
taaacaagggtgaggaagaaaaatgacctagattaaacaaaatgttggcacaacagtaatnttgttcaatgaaaccctaaataaattttggccaaaaatcctaagaatttgctctagaata

SEQ ID NO: 38832 - DNA, 121 bp, Artificial Sequence
  Synthesized
  misc_feature (61): n=a or c
aagagagatttacagagaaaggcagaaaattctggcccaaacagcttcctgtcttcaggcngcagttatgctagggcttgttcactggcacttgccacctaaaattgaattgccaagtctg

SEQ ID NO: 38833 - DNA, 121 bp, Artificial Sequence
  Synthesized
  misc_feature (61): n=t or c
gattggggacttagtaatttaaagatggcacttttggaagcgttgtacttcagatatcacnctgtttctcaaggctgtgttttcctgatagcggctcttctgagttctgttattacctgaa

SEQ ID NO: 38834 - DNA, 121 bp, Artificial Sequence
  Synthesized
  misc_feature (61): n=t or c
accagtctccagactgcatggaaacagtagacaagctgcatgcatggtttgggtcaaagcnaggatttggaggggaaaataataggaagaagagtttgaaagtctggccaagctgaggttg

SEQ ID NO: 38835 - DNA, 121 bp, Artificial Sequence
  Synthesized
  misc_feature (61): n=a or g
gtgaatcacacatgttcagaaggttattccaaagtacattccaagggaatcgtgccaagcngcgagcattctccatacacgaacccagtgtggtccacaaggctacataacgtatttgctg

SEQ ID NO: 38836 - DNA, 121 bp, Artificial Sequence
  Synthesized
  misc_feature (61): n=a or g
ctgttcagatgcttccttgtctgtgtggagctggttactggaattagatcttaaaataaanagagacaatgcaccatgcaagcaagggaagaaatatcccatagcccttgaccaactttac

SEQ ID NO: 38837 - DNA, 121 bp, Artificial Sequence
  Synthesized
  misc_feature (61): n=a or g
cccaacacagaccattttaggaagctgagctggcagaaaagaaatggatttcaaaaagtcnttggcagtgagttagaaagaatcccaccaacacctgagcaagtgttaagaaagcaaataa

SEQ ID NO: 38838 - DNA, 121 bp, Artificial Sequence
  Synthesized
  misc_feature (61): n=t or c
cttgagcaaaacccatgtaatgtgtgttatgtgatagggtggcagatctaatggaagagangttgcttaaggcaataggttcgtgtacgcctaccttggaatagagccactctgctgctga

SEQ ID NO: 38839 - DNA, 121 bp, Artificial Sequence
  Synthesized
  misc_feature (61): n=t or c
caagctggacccagacttcttcagcattaggttcttattggcctgatggtcctggcagcanagaacagtgggagacctcctcacagaagaggaagcaatctatgcactcaaaactagcacc

SEQ ID NO: 38840 - DNA, 121 bp, Artificial Sequence
  Synthesized
  misc_feature (61): n=t or c
gagcccaagggtcaccgcctcgcccagaggggtccacgacagctcctccaataggggtcantgatggggatagaaaggagaaaaatgaaattaaagcattcccaaatcgctgctcacacgc

SEQ ID NO: 38841 - DNA, 121 bp, Artificial Sequence
  Synthesized
  misc_feature (61): n=c or g
atttaaattacctttttggttttaataattcacttggccctttgaatcatgttgttcttgnccatatctgcagagggagagctgggatggtacacaggttcatagagtcacagaatggcct

SEQ ID NO: 38842 - DNA, 121 bp, Artificial Sequence
  Synthesized
  misc_feature (61): n=c or g
cactttctagctttccccagcttctattgcaactattctgctcagctagctttccagctanttgaaactatcttgtagatcctctgatacttggaaggcttttcgaaaacaaacatgggag

SEQ ID NO: 38843 - DNA, 121 bp, Artificial Sequence
  Synthesized
  misc_feature (61): n=a or g
ccaacagggagtcacggtaaaaatctgaacagttgaataactgtgttcctgagaagatcangtggattagtactcttctggttccaactgctgcaaaattatgccatatctaatgtattaa

SEQ ID NO: 38844 - DNA, 121 bp, Artificial Sequence
  Synthesized
  misc_feature (61): n=t or c
attttcaagaaaagcaaatggaacaagaggagaaggagagtaaaacatacatattatccanttgcatgtaccctctttcaagaaatttgcattcacaaggtaaatcatacagttgatataa

SEQ ID NO: 38845 - DNA, 121 bp, Artificial Sequence
  Synthesized
  misc_feature (61): n=t or c
aatcttttctccagggccccagcctcaatggtcaagacctttatcagatgatctgataacncactacttgagacacttgagttttgaaagcaggacctcctgttgtccaagccctcatggg

SEQ ID NO: 38846 - DNA, 121 bp, Artificial Sequence
  Synthesized
  misc_feature (61): n=a or t
tttccattagtgacctctctattcagttcagaatcaaggaacattcctcaacacaaaatgnaaaagctggaagaagatgatgccatcaaatgaaagggagagaagagcagcattctacagc

SEQ ID NO: 38847 - DNA, 121 bp, Artificial Sequence
  Synthesized
  misc_feature (61): n=t or c
ctcagaagtttactgcagagcctgcagtctcattactgagattctcagaaacactcgtgcngccatattgcccctattttattcctccatgttcaaaacgaagaaaaaggacttacgtgat

SEQ ID NO: 38848 - DNA, 121 bp, Artificial Sequence
  Synthesized
  misc_feature (61): n=a or g
ccatagaaaagcctgaggccagctgtgccagggaggcacccggggatgttcttacctgcangtgttctgagctctggacattcacagtgctgtgctttatgtgtcaaactgcactagaagc

SEQ ID NO: 38849 - DNA, 121 bp, Artificial Sequence
  Synthesized
  misc_feature (61): n=t or c
aaccagactctaagctccatataaaaccacttaataggctaatagtgcaacctgccttaantcagaatggagccattctttcagaaagcaaacaaaaaataatctgctaacaccattttgt

SEQ ID NO: 38850 - DNA, 121 bp, Artificial Sequence
  Synthesized
  misc_feature (61): n=t or c
actgagaaaagctattctatgaaaactgttttgtgtcagaacaaactctaccacatcttantgaaaagaagcagaaaatgggaagatttgattaagtgtgaagtttcatcccaggagagat

SEQ ID NO: 38851 - DNA, 121 bp, Artificial Sequence
  Synthesized
  misc_feature (61): n=t or g
ggtagacaagcagacccagataaatatctgaactgttttggatgttgctggaatgtaattnggtaaattaatgtagaacacactctcctgtcactgccagtatttagcgtgacactgcaca

SEQ ID NO: 38852 - DNA, 121 bp, Artificial Sequence
  Synthesized
  misc_feature (61): n=t or c
gagaccacaacagataatgctggagatcattaagtcaccatcactggatattttctagaanaacaattggtcaggagtgatgtaagtatagttgagtttgtgttagtgctgggagatgaaa

SEQ ID NO: 38853 - DNA, 121 bp, Artificial Sequence
  Synthesized
  misc_feature (61): n=c or g
cctgcagctcgaccagccccaggtcaggtggagcttttaggatctttcagaggaagtcagnataccctggaagtgcaagcccttggtcgcagctaacaggaccagctctcacctgcatcct

SEQ ID NO: 38854 - DNA, 121 bp, Artificial Sequence
  Synthesized
  misc_feature (61): n=t or c
cctacaaagatgaaatccatctgcctgaccatactctgtccacccaagtgctgcattgccngtgttggctcaaacaccccgaagcccaccttgctggtgctgcagtgcttggtgccaaacc

SEQ ID NO: 38855 - DNA, 121 bp, Artificial Sequence
  Synthesized
  misc_feature (61): n=a or g
ttaggaagaaatcctgttatatatagacgcaaaaaatcaacattcagctgaatgtgcacantctacaagacaaagctgaaatctgctttctttctcctgtttgtcttctgcagttgctcat

SEQ ID NO: 38856 - DNA, 121 bp, Artificial Sequence
  Synthesized
  misc_feature (61): n=a or g
ccagagttacagttcttgctttcaacagtatttaataaactgataaagaaaagagagaatngaagacatgatgagaatttttatttctctgtaatcctgagtcacagtaaaaggtatcgca

SEQ ID NO: 38857 - DNA, 121 bp, Artificial Sequence
  Synthesized
  misc_feature (61): n=a or t
acaaaagagccttctggggcagaactccagctgcatctgagatcttgcctccacaaagaantttttttttccagcacacaggtttagtcagagcaggaagggaaagagttgctttaaaata

SEQ ID NO: 38858 - DNA, 121 bp, Artificial Sequence
  Synthesized
  misc_feature (61): n=t or c
gcacgtccggcctgggcctctctgagcaccacactgccttttaattagtgccgcaggaggnggagagctctaattatgaagggaatcatacattaggatgctgctggctcttcccttcctc

SEQ ID NO: 38859 - DNA, 121 bp, Artificial Sequence
  Synthesized
  misc_feature (61): n=c or g
caatagtgatacaagtgtaggatacaacccatgctactgatgctgtagcccttgtcaaaancttgatatctcagtaaagtgaaggaactaggtttaatgctatatttgcccatagattttt

SEQ ID NO: 38860 - DNA, 121 bp, Artificial Sequence
  Synthesized
  misc_feature (61): n=t or c
cacaggagcactttgctggtatctgtggcccttctagaaacccggtgaggaaactgatccngagaaggtacggagaggaaaaaggctgtgaagacaaactacaaaccataggggaagatga

SEQ ID NO: 38861 - DNA, 121 bp, Artificial Sequence
  Synthesized
  misc_feature (61): n=a or g
tgtaaatagcatcctttagctagagtcttcaggttgtttgttgtttaattctgtattattntaattactttcaaacaaaatcacttcctgtaagctttcaagaaagtcaaatgaacactgc

SEQ ID NO: 38862 - DNA, 121 bp, Artificial Sequence
  Synthesized
  misc_feature (61): n=a or g
ttcccagttcaactctctttgttactctgtagacttcaacaacccctgttggaataaaacncagtggagaaatgcagacaagttcactgcaagcacaggttcctgaaactgcaacttgaat

SEQ ID NO: 38863 - DNA, 121 bp, Artificial Sequence
  Synthesized
  misc_feature (61): n=t or c
ggctgcagtccagggagcagaatagagttccaggtcttccagactgcaaattgaattactnctctcgacattaaagtcaaaccaaagtctcatcaggacaacactgcaaaagcagtcttaa

SEQ ID NO: 38864 - DNA, 121 bp, Artificial Sequence
  Synthesized
  misc_feature (61): n=t or c
ctccatgtttttgcttaacgtcttcctaataatgtagctgcaagtgacagatgggcatctngcctccgagtgctttgctgttgggaatatgctgttgctttgctgatgcctgatgctttgc

SEQ ID NO: 38865 - DNA, 121 bp, Artificial Sequence
  Synthesized
  misc_feature (61): n=c or g
tgatgaatgcatagcgaagatttaatactgtagcgtttggcagaagataacctaaattctnttaagtcatgacatatccaaatgggctggtttcaacccccactcttctgttaggcagtgt

SEQ ID NO: 38866 - DNA, 121 bp, Artificial Sequence
  Synthesized
  misc_feature (61): n=a or g
aagtgaatgaccatccgttccccagaactgtgtgaggctgtgacttagcaacaggtctgtngggaactttgcggatccgccacctcccccaatcttaagagtcagcagaaataaatgaact

SEQ ID NO: 38867 - DNA, 121 bp, Artificial Sequence
  Synthesized
  misc_feature (61): n=a or g
ttatttgcaaagtggaacatcatgcttaccctgaagctggatatagagacttaaagttccnctcagtccccacctattcagtgcccaccaagcccagtttcatgctgggaggatcagctgc

SEQ ID NO: 38868 - DNA, 121 bp, Artificial Sequence
  Synthesized
  misc_feature (61): n=t or c
tcttttactgtcctccttcacagtgaagtttctgaaatttacgctaagtcgcgcattggcnttaagttcctcctaactaagccttctgtcattggctctctccccccgcttttttttttct

SEQ ID NO: 38869 - DNA, 121 bp, Artificial Sequence
  Synthesized
  misc_feature (61): n=a or g
gagattgctccattatatgtggtgcaatgaggaatgcttcctatttgtgtaccacacctanctgtgcatgaggtgagtgaactttcagctgggaagcagcatagctgcgcctaagtgtcac

SEQ ID NO: 38870 - DNA, 121 bp, Artificial Sequence
  Synthesized
  misc_feature (61): n=a or t
gtggctgtaataaacttttaatgagtgcagagcatgtaagaagtgcattcagtctcatatntacctgcataaggcttcttctgcataagcacctcccaaatgacaattccaaagctgcaat

SEQ ID NO: 38871 - DNA, 121 bp, Artificial Sequence
  Synthesized
  misc_feature (61): n=a or g
atttcccttttttgagtgattgtgtgatcctgcaatgatgcactgtggaggactgtactcnaaaggagcgctcagttccatacccatgagccccagaacaaagtgaacgcagaccctcccc

SEQ ID NO: 38872 - DNA, 121 bp, Artificial Sequence
  Synthesized
  misc_feature (61): n=a or g
caggtttttctatgagctccagttctgcctctagagtgcagtgcagtgccaacagccaacnttcccagaaggaatcaaagaccacagggtctatgctctaaatggaggataatttacttct

SEQ ID NO: 38873 - DNA, 121 bp, Artificial Sequence
  Synthesized
  misc_feature (61): n=t or c
gtttaatgtttaaattggttgatatctaaaaaattaggagttttaaacctcgctgggctanattcttttcaggaaagaaacgggagccctgctccttatgccacactttattatcacatta

SEQ ID NO: 38874 - DNA, 121 bp, Artificial Sequence
  Synthesized
  misc_feature (61): n=t or g
aaattacattcgagtttttacataaggctatctgcttttccaactaatgctttgattttgnactgtttctcataaagtcactaattcaaattagaatcatcagactgccacagtacaatct

SEQ ID NO: 38875 - DNA, 121 bp, Artificial Sequence
  Synthesized
  misc_feature (61): n=t or c
cagtttagcaaaagcaaattcagaaatagtcaccatctgtgaatacttctcatctgttatngtccctctatattatatctcaagtgattaagaattagttcaccaactagatacagaagca

SEQ ID NO: 38876 - DNA, 121 bp, Artificial Sequence
  Synthesized
  misc_feature (61): n=t or g
aaatatcgttcattaggaaatgattgtgaattcacagtttacttgggtttcctgctgttgnatgaggatatttcagtcctcatccaagacaaaaaactgttcccatgaccatatattaata

SEQ ID NO: 38877 - DNA, 121 bp, Artificial Sequence
  Synthesized
  misc_feature (61): n=a or g
tttttttttttccagaatttacttggaatgaacaccatgacccatttgcccatgtggaagnagcagacactttatatccccagtctctcccccaaaatcctgctccatctgaaactactgg

SEQ ID NO: 38878 - DNA, 121 bp, Artificial Sequence
  Synthesized
  misc_feature (61): n=t or g
cagaaccccactgcttctgattaaatgttcaaagactacaaagaaaaccaagacgactatntcagataccgaacctgtataatacaagtgatatgcaattcactcctagtatccacagagg

SEQ ID NO: 38879 - DNA, 121 bp, Artificial Sequence
  Synthesized
  misc_feature (61): n=a or g
agcactaaatgactccttgtagttcatcactccaaaaaggggcatagaatctcttcatccngcacaaaccctctcctctccaagagcatctatggcctaagttcccttctaccaaccagtt

SEQ ID NO: 38880 - DNA, 121 bp, Artificial Sequence
  Synthesized
  misc_feature (61): n=a or g
caagatggtttttgccagctagagagagggctcaaacgggtacagaatggctgcctaaaantgcagtcttcaaagtcctgtgagaattttctttgaaagtgcctttataatttgtaatttt

SEQ ID NO: 38881 - DNA, 121 bp, Artificial Sequence
  Synthesized
  misc_feature (61): n=a or g
ttacaatggtgaacagttgtactggtgaagtgaaggagcccagcatccttgctagcagcantggcatcacagtacaggagataaataatctgtactgagaattatttgtagctctaaatat

SEQ ID NO: 38882 - DNA, 121 bp, Artificial Sequence
  Synthesized
  misc_feature (61): n=t or c
cctctggtgaggaacacgcctctgcgttggaaggctgcgtagcgagcccgaaggtctcggngggtcaggagacactgagcttaacactaagacagctttctcagctgacaggcgtaaatcg

SEQ ID NO: 38883 - DNA, 121 bp, Artificial Sequence
  Synthesized
  misc_feature (61): n=a or g
catttatagtgttatcagtgtgtttttttatgtattttgactgcttcggttcctcgtggcntgttatgatttggtttgttctccaactagcagtgacaaaattggcatacactgttcactc

SEQ ID NO: 38884 - DNA, 121 bp, Artificial Sequence
  Synthesized
  misc_feature (61): n=a or g
ctggttacatctaatcattagagaaggattatgatggctttgatcacttctgacatggagnctgaatttgtgtcagatacactgattcaggtgtagagtcagacacaaagataagaagaag

SEQ ID NO: 38885 - DNA, 121 bp, Artificial Sequence
  Synthesized
  misc_feature (61): n=a or g
gtgctactaccatggagatccctcagcgatacaagccgacaaataagcttttcctaagtgncatattattgcacatgaactggttaactgctgctgccctgtgccaggcaagtccagcaat

SEQ ID NO: 38886 - DNA, 121 bp, Artificial Sequence
  Synthesized
  misc_feature (61): n=a or g
cccccaagccctccaccccaatgacaggagctccagtgcccacatcccgtcttccctatgncctttccttatggttcctttgggtttgtcttcacagcaacgtccccccatgtttggaggg

SEQ ID NO: 38887 - DNA, 121 bp, Artificial Sequence
  Synthesized
  misc_feature (61): n=c or g
cttttactaggatgctgggtcttcttacattcagctgcatatatattgaaactgaagaaanccatgagctcatgggccaattgcgagagcacttagagacttttttccccttctttggctg

SEQ ID NO: 38888 - DNA, 121 bp, Artificial Sequence
  Synthesized
  misc_feature (61): n=t or c
gagtcccttcaaactgaactaacgattctgtaggaagttaattgcaagtctacttcttaangactctccttataaagcaagaaatgcaatcaaaatcttaactttcattaggaaagcaggt

SEQ ID NO: 38889 - DNA, 121 bp, Artificial Sequence
  Synthesized
  misc_feature (61): n=a or g
aacctcagcagaaagccgttctgtgccatctccctctaaagtgcaatttagcctgggtgtncaatcttcctctctgccattctaatgggggagcttgtttgcccaataatcatcccagagc

SEQ ID NO: 38890 - DNA, 121 bp, Artificial Sequence
  Synthesized
  misc_feature (61): n=a or g
tatatgtgaattagagaatgttctcagtttcttagtgcaaaagaacaaaagttatcaaatntccccaccatgtcaaactacagaaggaaaaatgtttaagaagaaaaccacagaattcaag

SEQ ID NO: 38891 - DNA, 121 bp, Artificial Sequence
  Synthesized
  misc_feature (61): n=a or g
gtgcggcttctccggcgctttcttgctcaggcggttgtagccacgctgtttcttggtctcnccccagaggttggagccaccgtacatgctggggatgttgaggacggcgatgccctccaag

SEQ ID NO: 38892 - DNA, 121 bp, Artificial Sequence
  Synthesized
  misc_feature (61): n=a or c
cgaatacatatgtctgaggatgacctatgtttattctgaggcatgttgcagaaaacaatcnatttagcataagcctatttgtctataagatacagcagataagaataaatacatattactt

SEQ ID NO: 38893 - DNA, 121 bp, Artificial Sequence
  Synthesized
  misc_feature (61): n=t or c
tccctgtgaaagctgtcaagcagcgcagcaagaagcaccctcagctaaccaaaatttgttnggtgggcaggaaacagcacactggaaatgttatgaccctgacacccacccgacagagaag

SEQ ID NO: 38894 - DNA, 121 bp, Artificial Sequence
  Synthesized
  misc_feature (61): n=t or c
ccataggggccacaggacaccccctgcagtaatgtgccaggagggagaaaaatcctaaacngagtgcctggctgggccaaaaaagtcccattaccctccccccccccccccaagttctcag

SEQ ID NO: 38895 - DNA, 121 bp, Artificial Sequence
  Synthesized
  misc_feature (61): n=t or c
aaaatacgtatcaggaaaccagatgcagaaactaagggtggatggcaaacctcaacaccanttaaatagcatctttacaagatggtcagttcaaagtaattcctgctgctgaagtgtatac

SEQ ID NO: 38896 - DNA, 121 bp, Artificial Sequence
  Synthesized
  misc_feature (61): n=a or g
tgtttctccaaggaagggctgccttgtctttattaatcgtgacaccaagtgccactcaacncacacagttgtgtgcctgcatctccatcactacttccctccagccccattaatactatta

SEQ ID NO: 38897 - DNA, 121 bp, Artificial Sequence
  Synthesized
  misc_feature (61): n=t or c
taccacagactgatgaggcccccgacttgcggtgtgtgtggatgtcccatcagaaaggagntcacctcctgctgtaagccaggagaaacaaagttgttgttcctctaagtaaaatgatttt

SEQ ID NO: 38898 - DNA, 121 bp, Artificial Sequence
  Synthesized
  misc_feature (61): n=t or c
agggatgaggggatttggggttaggggtaggatttgggctcaaagagaggaatttgggggncagggaggggacttggggtgaggataagatttggggttagggataggattttggagtcaa

SEQ ID NO: 38899 - DNA, 121 bp, Artificial Sequence
  Synthesized
  misc_feature (61): n=a or g
gtaaactgtttgaggagtttgtggttttcatgagctcttcattttcctcctggccaacgcncacatcccctctgagaattaagtgttgaaatgtgagtgcctcctgatgctttgctaggga

SEQ ID NO: 38900 - DNA, 121 bp, Artificial Sequence
  Synthesized
  misc_feature (61): n=t or c
cacacaagtgcagccgttgtgcctttctcccccggcgttattgttgatggcatctgaagtnggtatgcaaaatgcctccgctcccagccgtgacacgtcgctgcttgaagcagcccagcag

SEQ ID NO: 38901 - DNA, 121 bp, Artificial Sequence
  Synthesized
  misc_feature (61): n=c or g
tttgcagcagctgagctctatgtagatgtcacaatctggccactgctgagagagtatatgnaactatctccccgttgacttctgctgtaaaaagataccttttcctttccactttctttca

SEQ ID NO: 38902 - DNA, 121 bp, Artificial Sequence
  Synthesized
  misc_feature (61): n=t or g
tcctaattccttgtgattcacttctttttcagattgttgtatttcgcgtttgtttttgtgnttttttttttccctgccgattccgtactcgcaccgcttttcactgaggcacaaactatct

SEQ ID NO: 38903 - DNA, 121 bp, Artificial Sequence
  Synthesized
  misc_feature (61): n=c or g
tgtttttcagtgtaaactatttttttttcacacgttaagtgaagaaaaatgaagttgaacntaggaaacgtgtgctacttaacgagacctctcttggggcaggataatccagccccaaatc

SEQ ID NO: 38904 - DNA, 121 bp, Artificial Sequence
  Synthesized
  misc_feature (61): n=t or c
cctaacttcacaagcaaaacttgaagataatcagtgggagttaagtgccattcaagccatnggggaacacaggacaggaaaaaaaggtgacttagctgacttagatctgctgttaaagcac

SEQ ID NO: 38905 - DNA, 121 bp, Artificial Sequence
  Synthesized
  misc_feature (61): n=a or g
gttaatttatctaaaggagaagcctagcaatcttgtacatgggcaagttttcttccgaatngcttactgcattattgtaaatctctggtttaggacatttattgtccttgggggaaaaaaa

SEQ ID NO: 38906 - DNA, 121 bp, Artificial Sequence
  Synthesized
  misc_feature (61): n=t or c
tactcaaaggatcctgcttcaggcactgagaagattctcctgggagaaaattctctggcanaattcaagtagtgcctgtcacttttctgacggtgctaccctggctctgcaaccctttggt

SEQ ID NO: 38907 - DNA, 121 bp, Artificial Sequence
  Synthesized
  misc_feature (61): n=a or g
tcctggctgctccttttgcacagggagcagtgtggttgttgttatctgatggccgtttcantgtgaggtcaccatctttataagaattaaatagcggggtttaaatgacaacaaattacac

SEQ ID NO: 38908 - DNA, 121 bp, Artificial Sequence
  Synthesized
  misc_feature (61): n=c or g
ttagcagaggccttgttttttaagatgctataagtgtaatttcaggggcattgctaacttntaatttcaatgtacgtgcctgtatgaatgggggctctcacggaagcagcctggatgcttt

SEQ ID NO: 38909 - DNA, 121 bp, Artificial Sequence
  Synthesized
  misc_feature (61): n=c or g
ctgataaagtaagggctacttcttaatcagagtagtaaaagcaaaaattcctgatcagtgntgatttacttagacagttccacttagttaagcagtaagtgagatggtgtatggcatgcct

SEQ ID NO: 38910 - DNA, 121 bp, Artificial Sequence
  Synthesized
  misc_feature (61): n=a or c
tctttcaatccccaagttcataaagattatcaacaagggcaatgctagatggattgcctanatgattagtacttcctatttaaaccgcagccaaatctttatgtgctctttccatcaaaca

SEQ ID NO: 38911 - DNA, 121 bp, Artificial Sequence
  Synthesized
  misc_feature (61): n=a or c
aaaatggaactttgagaaaacaccacatttcaagctgaaaagtgttaaaccaaatataaantggacagtctaatgcatattatgtcatctataaagagtaaatgcccatttcatttgacca

SEQ ID NO: 38912 - DNA, 121 bp, Artificial Sequence
  Synthesized
  misc_feature (61): n=t or c
acaagttctcccagccaagcaacatagtccttcttcaagaaaaggtggcaacacacacaantgagtaaagagatattacattaatagtcacagatggaaggtgagagtgcatatatttgtg

SEQ ID NO: 38913 - DNA, 121 bp, Artificial Sequence
  Synthesized
  misc_feature (61): n=t or c
tgttgcaactccacctatcatattatcaagctgagatcgaatcacttaatgattgaatcanttttatcacccaatcccctgtcactgaggctcttcgcccactagagtcactctgacgtcc

SEQ ID NO: 38914 - DNA, 121 bp, Artificial Sequence
  Synthesized
  misc_feature (61): n=t or c
taaggttcttacagactttatgacagcagtctcggaagtacagaaaagcattcagcactanagcaaagagacattggaggcaattttaacaaaagcatttaggcaactgctcctgattatg

SEQ ID NO: 38915 - DNA, 121 bp, Artificial Sequence
  Synthesized
  misc_feature (61): n=t or c
acctatgctcaggtgaccaaaagaagggccattcctagctcaggatcagccctgttttagncttctcctgttattggctctaacagcaagtgacatctgctttttaatacaaaaaggaagt

SEQ ID NO: 38916 - DNA, 121 bp, Artificial Sequence
  Synthesized
  misc_feature (61): n=a or g
cagtacttagagtaggagttgtttaaagaacatcctgtaggcctccttcttgattcttttntagccactgagaactgctgcatggtcttcccaaacctgcatcttaggaaatatactttct

SEQ ID NO: 38917 - DNA, 121 bp, Artificial Sequence
  Synthesized
  misc_feature (61): n=t or c
agcacagcagatagaacagctaagagaagccattttaaattgttattgtgcacttactggnactgctctcagaaaaggggagatggatccatacctctttatcactgtaggagatattccg

SEQ ID NO: 38918 - DNA, 121 bp, Artificial Sequence
  Synthesized
  misc_feature (61): n=t or c
ctttaccatttaaaacggtgcatctctgggagcaggggcccaaatcctgatttttcctagnacatctgaacattttaactgggctataggatcaagttgccccttgcacgttctccttatt

SEQ ID NO: 38919 - DNA, 121 bp, Artificial Sequence
  Synthesized
  misc_feature (61): n=a or g
ttcagtgttccgtgcagatatgttacaagtaaagctttattccaaacttgcaaagatacgncctaacctgctttcaatttttgttttgaacccagtgagctcagtgtgtcagcatttggat

SEQ ID NO: 38920 - DNA, 121 bp, Artificial Sequence
  Synthesized
  misc_feature (61): n=a or g
atattattgttccacatctcctctgctacagcacacagctggtggtgacgcgggaatgagntcccagcaaatcaaggtttattggaatatttttcaactgcactaaggaaaagggatttgg

SEQ ID NO: 38921 - DNA, 121 bp, Artificial Sequence
  Synthesized
  misc_feature (61): n=a or g
agaaaaaaggacctgatctagaacttacttatatagtctcttttggctatttttaaacacngaatctgattctgtcagttacctgtgaattgaagatgaaatattctggtttgcatgcatc

SEQ ID NO: 38922 - DNA, 121 bp, Artificial Sequence
  Synthesized
  misc_feature (61): n=t or c
agtgtgtgtgcctgcaatctgcttgtaaataaggctgaccttgcctctttgctctgttccnggttacacgtctggctgtaatccctttgtgtgctggaaagcaggggaaggagaggacagg

SEQ ID NO: 38923 - DNA, 121 bp, Artificial Sequence
  Synthesized
  misc_feature (61): n=t or g
gggttagtctaatgaccccacagaaggctgctgtactgttcagccgcgggcagccaacttnctgcactagcaaaccttctttccattgagcacagtatgcccagggaaaaaatcatgcaaa

SEQ ID NO: 38924 - DNA, 121 bp, Artificial Sequence
  Synthesized
  misc_feature (61): n=t or c
aggtacactaaatttaaggagaaattcttgctgatgctgcactagtagaaacaaatctgangtggtgacaaatttgggactaggaacagatcttttagctgccagtgtctgaagagaagaa

SEQ ID NO: 38925 - DNA, 121 bp, Artificial Sequence
  Synthesized
  misc_feature (61): n=a or g
tctgaaacattatgtgtcccgttctggagctcctcctgaaaccttttatatcctgcatganctgaggaatgaatacccactccctttgactgtcacagactcagcagctgttgcagaaaaa

SEQ ID NO: 38926 - DNA, 121 bp, Artificial Sequence
  Synthesized
  misc_feature (61): n=t or c
ttcagtgttcgagaagccaggatagagttaggagtttacagctcttaagtctagaataganccgtgaagtaaaaaatttgtgggactgcagactgctgcagttacagttgtgttatctgat

SEQ ID NO: 38927 - DNA, 121 bp, Artificial Sequence
  Synthesized
  misc_feature (61): n=a or g
tttatccatgtgaggtagtaaaatattgtggtttgctgcaggtgatggttaatgataagantaaagggttttaaaaatggatgaagtacaggttctcccaccccttggctcagtgatgctg

SEQ ID NO: 38928 - DNA, 121 bp, Artificial Sequence
  Synthesized
  misc_feature (61): n=t or c
cacataattaatttcaaaatatgcaagaacacagtcattaataacattactgcttgttttngtatctgacatcaaaaactgatgtaacctgaaccagcgctctgattcatcacctgttcca

SEQ ID NO: 38929 - DNA, 121 bp, Artificial Sequence
  Synthesized
  misc_feature (61): n=a or g
atagatctgctaattcctgtggctacatatgcattttcatgggtagataccctgctaaccntgaatagattacaaaaattgttttattcctatttcatcacctcagcttcaggcagaatat

SEQ ID NO: 38930 - DNA, 121 bp, Artificial Sequence
  Synthesized
  misc_feature (61): n=t or g
cctcacttcaaagccattcctactgaattttccctgattttggacttttcaaaaactgtanaatttcctaattggcctaactgtgagaaaatgtagtggtgtttaatttctgtgatttctg

SEQ ID NO: 38931 - DNA, 121 bp, Artificial Sequence
  Synthesized
  misc_feature (61): n=t or g
gaatttggtaatggcagccaccatgtttttgcttacagagacatatttgtgtacttatttnggagatttcgttggttacagcaaaataaactagctacatcaatactaaaatgaacattga

SEQ ID NO: 38932 - DNA, 121 bp, Artificial Sequence
  Synthesized
  misc_feature (61): n=t or c
ctgatttaggcttgtatataaaataatcttcaaatttgcattaataaaatatcattcatantctcctttaaaagtgttcagctgataattcttttgctgtgtagctgttaaacagggaatg

SEQ ID NO: 38933 - DNA, 121 bp, Artificial Sequence
  Synthesized
  misc_feature (61): n=t or c
gctgaacatacctgatttgttttgtcaactgcagtgttaaatatgattgctgtctggttgnaactttggagtagctcaccaggctgcacatctccaatgatgttctgctcaccagacacct

SEQ ID NO: 38934 - DNA, 121 bp, Artificial Sequence
  Synthesized
  misc_feature (61): n=t or c
tttattcttcacaccgttcttctactttcataagccgaatgatcacccacaagcattcaantacacaaaaagtcaaccactctaacaactctggaattattcaacttaatttataaggaaa

SEQ ID NO: 38935 - DNA, 121 bp, Artificial Sequence
  Synthesized
  misc_feature (61): n=c or g
ttcctttttctgctcaatatccaaaggcaaccgtgcctccgtacagcagcgatgctccagncttttaagggctcaccacttaggtgcaatatcttaaccacagcatagcagcttgccctca

SEQ ID NO: 38936 - DNA, 121 bp, Artificial Sequence
  Synthesized
  misc_feature (61): n=a or t
aagctgtatttaaaaagaaaaggggaaattctggcttttcaatacgggagccacactgtgnctagaaaaggagcgtgacattggctgaggcttgttccctcagctctgctcaccgctacct

SEQ ID NO: 38937 - DNA, 121 bp, Artificial Sequence
  Synthesized
  misc_feature (61): n=t or c
actgcatttgaactgaaagcatcatgcaggatctgttttatggggtaatgctccgttttanttatttatttttgtgcccaccccctactcctacctacccacagccccaatttagggcagc

SEQ ID NO: 38938 - DNA, 121 bp, Artificial Sequence
  Synthesized
  misc_feature (61): n=a or g
ttaggattacaccatgcaaatctgatagcacatggcagtttcccactaatgcaaaagaaancatttcattattgataagtagaatgcattcaatatgtaagtagctggagtcaacacaagt

SEQ ID NO: 38939 - DNA, 121 bp, Artificial Sequence
  Synthesized
  misc_feature (61): n=a or g
gggctactaagcctcagaaacagcgcataagctatttcaaaccaacactattttcatccanatggagacctaagttttcaagtgttctatacatacattcattaaaacaaaagaaaaaaat

SEQ ID NO: 38940 - DNA, 121 bp, Artificial Sequence
  Synthesized
  misc_feature (61): n=a or g
cttgtcttagatctgaatggagaacagtctgttttaaagttttttccaaagcttggattangtaggaaaatagtcatttcctgtctggatttcctctcctctccttttttttttttttttt

SEQ ID NO: 38941 - DNA, 121 bp, Artificial Sequence
  Synthesized
  misc_feature (61): n=a or g
agggacagggaattgttttaggaaccctgaccctaccactcctaccacacctcacttcgtntcactggtatgtggctctgactccccaccagctcaggtttgtgggccatcacatctgtac

SEQ ID NO: 38942 - DNA, 121 bp, Artificial Sequence
  Synthesized
  misc_feature (61): n=a or g
tcgttcctctgcttctatcctaatccttctcatatagctcttgcaatttaatgtaataatntaacatttttgttaactttccttggagatatttaaaagaccttcatctgacaatctgctc

SEQ ID NO: 38943 - DNA, 121 bp, Artificial Sequence
  Synthesized
  misc_feature (61): n=a or t
tgagatttctgtcaagggtgtattaactctgtggtaactccaaagtttgacttggcagaantggtggctatcttcagtgaggagtcttgcattaatatacagagctggaaatctgaacagc

SEQ ID NO: 38944 - DNA, 121 bp, Artificial Sequence
  Synthesized
  misc_feature (61): n=a or g
gaggccaatcatcttggatcacaaacatgtccagccagcatagctatatgtcagcacatgnctgctggttatatatactgatgtactgagttagtccataagcaatcgttctgctaacata

SEQ ID NO: 38945 - DNA, 121 bp, Artificial Sequence
  Synthesized
  misc_feature (61): n=a or g
aatttcaggtggtgttaaataacaacaaaaaaccaggcaatgccacagctgtccaagtaanctcggactttccagacatgactcttgcttttacatgcagccataaagcagagagataata

SEQ ID NO: 38946 - DNA, 121 bp, Artificial Sequence
  Synthesized
  misc_feature (61): n=a or t
ggatctgtcaccaggctttgcagaaggctaatccttagccataaccttcagaagaaggatncttctgccatttggagcaatgttgcactcaggagctgcatgtcactactgggcagccagc

SEQ ID NO: 38947 - DNA, 121 bp, Artificial Sequence
  Synthesized
  misc_feature (61): n=a or g
cagtgctgcaaataaggtcaaactccaaaccagagcagcataaaaacttggctgagaaatngccaaccacccaagtatatgcactatggtgttttttaaactattatttctgttctgcgta

SEQ ID NO: 38948 - DNA, 121 bp, Artificial Sequence
  Synthesized
  misc_feature (61): n=a or g
aaagacgttctctctgaccacagactgttcagcagggacactgcctgacttagtaaaggcnatatttggccaaaaattgtttggcaaagttgccgacctccgtttgcaggctcaagtgggg

SEQ ID NO: 38949 - DNA, 121 bp, Artificial Sequence
  Synthesized
  misc_feature (61): n=a or g
tgccttaggctggcagtgcagcttaaatgtttgagtagaaatgattaagcacacatgatgnaacagaagaacacagacaccacgtatactaactgttgtttctcatgttaaataaagtaga

SEQ ID NO: 38950 - DNA, 121 bp, Artificial Sequence
  Synthesized
  misc_feature (61): n=t or c
gaaatgtgttaaacaccatgagaagtaatgtttcttggaaacaaagcccagagaaaggctntacaaataaagtcaggagtgcatgtgtcccaaagcaaaagatgtggcagtgtcttcaaaa

SEQ ID NO: 38951 - DNA, 121 bp, Artificial Sequence
  Synthesized
  misc_feature (61): n=c or g
tgatgacaaaagtacacatggatgtgagacaactgcatggagcacgcaatgccatccatgncagtcatatggcaaactcaaaaccaatttagtataaaatataagtggccaagagaaagga

SEQ ID NO: 38952 - DNA, 121 bp, Artificial Sequence
  Synthesized
  misc_feature (61): n=t or c
atagtcctgctgtgccacctctgcagtataggacagggtggctttcaggatgctgggatanttttaggggtcaaaccggctccagtgctctcctccggctctgcttgttacctgtgctatc

SEQ ID NO: 38953 - DNA, 121 bp, Artificial Sequence
  Synthesized
  misc_feature (61): n=a or g
aataaatcacacaaaggagaacaagattccattgctaagctggtctttaaaataagcccantaattccctgtttctccaaggtgctgcctaccttggtcacagaaacgcccaatgttactt

SEQ ID NO: 38954 - DNA, 121 bp, Artificial Sequence
  Synthesized
  misc_feature (61): n=a or g
aattgtttctcaaattccacggctgcgacatattattacagtggatggcaaaccaacaacntggtcagaatttcccaagggtgtcattgttcacactatggcttctgtgcaagctatggga

SEQ ID NO: 38955 - DNA, 121 bp, Artificial Sequence
  Synthesized
  misc_feature (61): n=a or g
agattcccaagtaaaaaaaatgtaaaataagttgtcatacatataaacactaaagtatgtnacatataacacccaagtatgacacttgtcattttatcaggaaaatatgcaaaaagaaaaa

SEQ ID NO: 38956 - DNA, 121 bp, Artificial Sequence
  Synthesized
  misc_feature (61): n=t or c
aatgcatgctttgtttgcattggaatgccctccatgagatgcaaagatattattagggggnaggggatcatcagactcccaactcagccatgtcatcacttctgaaactcataaaactatg

SEQ ID NO: 38957 - DNA, 121 bp, Artificial Sequence
  Synthesized
  misc_feature (61): n=t or g
accagcctggcacgttaaggtcagtaggtcccaactgcaagttacccttgtacacaagctntgcatggagcaaggtcaggagcaaattcatagcctgctacagccatccttcctgtggagc

SEQ ID NO: 38958 - DNA, 121 bp, Artificial Sequence
  Synthesized
  misc_feature (61): n=t or c
atttggagttacccatttgctagtagtaacatggtgatgtattggcattttgatcaaaaangttacccttcagacactgcaggcataggacttccaatgagaattgtctaactagactgta

SEQ ID NO: 38959 - DNA, 121 bp, Artificial Sequence
  Synthesized
  misc_feature (61): n=t or c
aaagtaggcagaagtcaaattattctaaagctaattaacgcagaagagaattgtggcaganctacatcagctagcataccgctttgaattcttcagatgggaaagaaggaagcagttgaaa

SEQ ID NO: 38960 - DNA, 121 bp, Artificial Sequence
  Synthesized
  misc_feature (61): n=a or g
gcacaacagtgattgaggaaatctgaagcttggcagtacggccgaatagcagcgctaggangaaagcctgtactgcagggagggagagggacacaagaaatgaaaaagttgtgtagtgaat

SEQ ID NO: 38961 - DNA, 121 bp, Artificial Sequence
  Synthesized
  misc_feature (61): n=t or c
ggtgttaaacgatcgggggccggagagctggggaagtgtcagacagccctcacgtccctcnggaggctgcacttttagcaagaggctatctcttaaagcagagctgctatttgccgcagag

SEQ ID NO: 38962 - DNA, 121 bp, Artificial Sequence
  Synthesized
  misc_feature (61): n=a or g
agattcaactcagattagtcacacagcaattattgtagaaaagcataagaggcacagttancattcctattattaaaatcaaggaagcatttttacacagcaagatctttctagcaaggag

SEQ ID NO: 38963 - DNA, 121 bp, Artificial Sequence
  Synthesized
  misc_feature (61): n=a or c
atatatatatatatatacacacacacaggaatatttcagcccgtgttagggaaaaaaaaanaacacagaatattcaaaaaatagtatatagtatatatgtaaatagtatgtgtcttttaat

SEQ ID NO: 38964 - DNA, 121 bp, Artificial Sequence
  Synthesized
  misc_feature (61): n=a or g
cagtagcttcagaatctacaggcataaagactaggaacattgtcacagactttaacctagngttcatcaagttgcattccttgtaccttccttccccctctcccccacctacccaaaaaat

SEQ ID NO: 38965 - DNA, 121 bp, Artificial Sequence
  Synthesized
  misc_feature (61): n=c or g
gaggttgatctcgtacactggctgctcttcaatctgattgggtgagatgggaaatgtgatnccaggtgttcaagtgtgtccccaagcccccagacaaggagtcaccatacccagactgagc

SEQ ID NO: 38966 - DNA, 121 bp, Artificial Sequence
  Synthesized
  misc_feature (61): n=a or g
gcttgacaaagctacttcagtctgacccttgcataaattttaccactgtggaaagaaagcngctggcactgaggcaaaggaaatcttggtgaggaagtagcgaagcaaggaagctgctctt

SEQ ID NO: 38967 - DNA, 121 bp, Artificial Sequence
  Synthesized
  misc_feature (61): n=a or g
tacagcttacccatagatacctgcagttttgtcgtacttattatttgttcataaaagacanttcagctgcattttgttccatggaaatgacttcaagcagttttgattatctcaacactga

SEQ ID NO: 38968 - DNA, 121 bp, Artificial Sequence
  Synthesized
  misc_feature (61): n=a or g
acttaaaaatctactacttgcaatttctattcttttctatttcaggatttttaagcaaatnatacagtaaaccaatttgtggtaaatcatgtctagagagtttctagccaagaaagtcgag

SEQ ID NO: 38969 - DNA, 121 bp, Artificial Sequence
  Synthesized
  misc_feature (61): n=a or g
gaggaaaagccatcagacttgccatttgtgagcttgaaagcgagggaacagctttccatcntcaggctcgttccacacaccagatggccaagagaattagatgccctggcctggcaccaga

SEQ ID NO: 38970 - DNA, 121 bp, Artificial Sequence
  Synthesized
  misc_feature (61): n=t or g
gagggatgacggcagagaatgggaaagatttaggagacagaaagccccatcctttactacncagaaacattattactgttaaagtctttttggcacttctagacgtaacaaatcactaaca

SEQ ID NO: 38971 - DNA, 121 bp, Artificial Sequence
  Synthesized
  misc_feature (61): n=a or g
taggaaatctgatactaatgtaagaaaatgatactgaaatgacaacgtaggaaagtgttgnctcacatatgaatcgccatgcgatttttcagacatgaaaatttgacttgcaacgatgaga

SEQ ID NO: 38972 - DNA, 121 bp, Artificial Sequence
  Synthesized
  misc_feature (61): n=t or c
atgtctgagctgttgtgaaaaggtacagagctccaggacggagtgcgggaggctcccatcnctttgcagagatgtgagcacaaaaaaaaaaccaataaatgcagaggtcctctgggggaaa

SEQ ID NO: 38973 - DNA, 121 bp, Artificial Sequence
  Synthesized
  misc_feature (61): n=t or c
tatcaatttctcagacattagcaaaaatacaaattttacccacaaaaacattcctttttancattctgcctttggcaaaaatgagatttctaatggcttgggctttccattttctctcatc

SEQ ID NO: 38974 - DNA, 121 bp, Artificial Sequence
  Synthesized
  misc_feature (61): n=t or c
taatatccttgatccagcaataggagagcatctcctgtaacatcagtttgttacctttcangatgaaataaaacctggaagaatcaccttattaagttcctcatttctttttcagcccacg

SEQ ID NO: 38975 - DNA, 121 bp, Artificial Sequence
  Synthesized
  misc_feature (61): n=a or t
tgaaatttatgcaagaggaagcaacggtatcgagggtcgtctggaatgttgatggatacanacagctctacttcctctttatattatgggaataagaaaatgactgcagtcccaataattt

SEQ ID NO: 38976 - DNA, 121 bp, Artificial Sequence
  Synthesized
  misc_feature (61): n=a or g
actttatgagacattcctgaggctgccccttgcctcctgccttgagttcttccattctggnctgctagaagaacagtgcagcagactgaacctgctgagaactgtgccctgatgtgcggtg

SEQ ID NO: 38977 - DNA, 121 bp, Artificial Sequence
  Synthesized
  misc_feature (61): n=c or g
aattctttggctccatcatgttttcttctcatcatcagattcgttctattactctcctatntgtacaagtagctggtcataatttttcccatcttcagttaaaaaaagaaaaacaaccacc

SEQ ID NO: 38978 - DNA, 121 bp, Artificial Sequence
  Synthesized
  misc_feature (61): n=t or c
tggctgagcagctgggctgctttccattagctctgcctgtcactttttccacatgcactcngcatatcagcctccaggagagctgctctccctcgtgtttctcaacacctttggcagcagt

SEQ ID NO: 38979 - DNA, 121 bp, Artificial Sequence
  Synthesized
  misc_feature (61): n=a or g
ctttagttgcaatactggttaagaaacaaactgtgatgtctgaatgaagccaaatgtttcntttccttatggattttgcatcctctgttcactcagcgtgcaaagcaatgaccacttctac

SEQ ID NO: 38980 - DNA, 121 bp, Artificial Sequence
  Synthesized
  misc_feature (61): n=t or c
ccttcaccatgttttcaaaacaaacataagcagcactgagaaatcctttaaattaagacangcgactattgtagtttcttgaaaagacactcacaaagtaaatacaaatctacaaaatgaa

SEQ ID NO: 38981 - DNA, 121 bp, Artificial Sequence
  Synthesized
  misc_feature (61): n=t or c
catttttctggccacatgtactacaagtttaaaaaggcagaaaaagtttttgcaagctggnctgatcttctgcattaaatggggcatttggtttcagtcaattgcttcttgatattaaatt

SEQ ID NO: 38982 - DNA, 121 bp, Artificial Sequence
  Synthesized
  misc_feature (61): n=a or g
ctgagtcaggaaggaggcagcagactcactcaccctgagtgtctgcaggaagctggggtgnggggccagacagagggccgaatagattgtcatttctctcccccttttcctctgcctccta

SEQ ID NO: 38983 - DNA, 121 bp, Artificial Sequence
  Synthesized
  misc_feature (61): n=c or g
taactgagatggtcacaagtcccatagtcacccaacagatctacttgagtaatagtaacangggaatttctttgtgaactgtcaaaacaggatctgtccagatccctactttccttggcat

SEQ ID NO: 38984 - DNA, 121 bp, Artificial Sequence
  Synthesized
  misc_feature (61): n=t or c
ttaacaaagataatctcctatttttccattcccgcaagaaagaagactccttctgtggctnatatcctccacagatatttgatagctgggcttcatttgcccatctgaggtatcctagtca

SEQ ID NO: 38985 - DNA, 121 bp, Artificial Sequence
  Synthesized
  misc_feature (61): n=a or g
attttccaaagaggttggctactttaagcttggaactgctttcattgtcagtgcattccangtcctcagtctcagttgcctgaagcaatagcagcagaacagtcaagagcatgcctgtaat

SEQ ID NO: 38986 - DNA, 121 bp, Artificial Sequence
  Synthesized
  misc_feature (61): n=t or c
agagaaatgccaactgctctgaaataaccacagcaaaggaagctgtgctaggaagcccagngcacccaaaactcattgcaagagcaatatcctgtcaactagaatttgctcaggtagcaga

SEQ ID NO: 38987 - DNA, 121 bp, Artificial Sequence
  Synthesized
  misc_feature (61): n=t or c
tgaacaaggacaatcattcctctggcgttgctagtccagagatctctgttctttatcaaantgagagtgagacaaaatggcaaagctgctaaatctgccatggagtatagggaagacttgt

SEQ ID NO: 38988 - DNA, 121 bp, Artificial Sequence
  Synthesized
  misc_feature (61): n=c or g
agggaaatgggtcagtctggcatgcaccagatttcaggatggggcttgcaccccttggcanattcccttgctgcgctttagggcctgtctggttgcatggttgtatttgtctcatctcagg

SEQ ID NO: 38989 - DNA, 121 bp, Artificial Sequence
  Synthesized
  misc_feature (61): n=t or g
gattttaaataaatttgtcacttagcttaaaaattaaaaataattaaagataaggtctcanaagaattgaatttctgtgcctcctcacttccatctgattcctttcactaacaatgtgctc

SEQ ID NO: 38990 - DNA, 121 bp, Artificial Sequence
  Synthesized
  misc_feature (61): n=a or t
tcagttactggtcactttatattatccaatttcaattgaaataaaatcgtaggatcatgtnggtttttctcatgagaaaagttgttagtcatctgtataatggcatttttttttctcatgg

SEQ ID NO: 38991 - DNA, 121 bp, Artificial Sequence
  Synthesized
  misc_feature (61): n=a or g
agcttctgcctgtacagcatgatgatatgggacatgctgcagatctgcacatgggcaggcngtgagacagtgggactgaaccacacatggtattctgtacagactttccttggtctggacc

SEQ ID NO: 38992 - DNA, 121 bp, Artificial Sequence
  Synthesized
  misc_feature (61): n=t or c
gaatgtgctaaatctccatccgaaatgacactgccattcattagagagatttcggcatgtncttaagtgttggctgtggagatgtttaagcaggtgatcattacttgtacgtgtgaaatgc

SEQ ID NO: 38993 - DNA, 121 bp, Artificial Sequence
  Synthesized
  misc_feature (61): n=c or g
gttaattcacaaatcaaaaacagcttgtatcatttttcctctcctttgattttcctctttnacaaaagattatttgctcatttggtggcattttatacaaaagattaattctgtgctctgg

SEQ ID NO: 38994 - DNA, 121 bp, Artificial Sequence
  Synthesized
  misc_feature (61): n=c or g
tattccatgccatgttgtgccatccgtccgattccatccatcagatcccatttatctggtnacatacatcccatccccacctcatccattccaccccactccactgcaccccatctgattc

SEQ ID NO: 38995 - DNA, 121 bp, Artificial Sequence
  Synthesized
  misc_feature (61): n=t or c
aatgcaacaggagatatccacattgtaatttattttggttcatgcgaccagttctttgttncggtttggacaaaagattatttctccagaagataacctttttataagggaaaaacaaaca

SEQ ID NO: 38996 - DNA, 121 bp, Artificial Sequence
  Synthesized
  misc_feature (61): n=a or t
ttttttccaactcggtgttcacactaaattctgttttacctgacccttgctcactgaactngtgattttttggctgacaatggtcagtgtcagtggaggacaacttcaaattgtctgtgcc

SEQ ID NO: 38997 - DNA, 121 bp, Artificial Sequence
  Synthesized
  misc_feature (61): n=a or c
cagtgaccaatccatcatttctttttatatataattatttgtaattttcatagtatgcacncatgcctagaaacctactagatacatggagtaaagttttgatgctgtcccacagttaaac

SEQ ID NO: 38998 - DNA, 121 bp, Artificial Sequence
  Synthesized
  misc_feature (61): n=c or g
tagcacagatctgaatgccttgacttttttttcccctattgaagttcagtatcacaggtgntaagctttcaaaatttttgacctttgtctttcacacatttacaggtaaagcagacttaaa

SEQ ID NO: 38999 - DNA, 121 bp, Artificial Sequence
  Synthesized
  misc_feature (61): n=a or c
caggcctgctacaaattagttggaaagagctgtcatcatactccttcaataagcgtaagangttaaaaataggataacaaatcttgttattctactacttgtaaatgtacatctaagacag

SEQ ID NO: 39000 - DNA, 121 bp, Artificial Sequence
  Synthesized
  misc_feature (61): n=t or c
tcagagcccttgtggcaagccaccaagggcacagatgatcttcctctcttagaaaacaaanggtcaaaacaaggagaaaagtccctgtggtagaggcccaacaatcaaatgagctaaacaa

SEQ ID NO: 39001 - DNA, 121 bp, Artificial Sequence
  Synthesized
  misc_feature (61): n=a or g
ccctggaagtgtcacagtttctgtgggaagcaaacttatttgcacatcctaaatggtcgcnatattagttgcatgatcactgggtgggtccctatagcacagcagtctgcccaggtctgca

SEQ ID NO: 39002 - DNA, 121 bp, Artificial Sequence
  Synthesized
  misc_feature (61): n=a or g
atgagtcactgtggaggttcctcttgtccctgtctattggagtacctccatagttagtccngtctagattagtttttggacatttacctacagaggagaggaatcctgcccaagtgcagtt

SEQ ID NO: 39003 - DNA, 121 bp, Artificial Sequence
  Synthesized
  misc_feature (61): n=a or g
gcaggaaatggagcaagcacctttctctgcgtgtctgactgccagctatgagctcagcccngagctgagaggcacagagagctgaggtgccctctttgctcatccctcctcttcctctcct

SEQ ID NO: 39004 - DNA, 121 bp, Artificial Sequence
  Synthesized
  misc_feature (61): n=a or t
ggccaactcatttttctaaaatttagctatgtttgttgcttgcttaatgcaaataggaaancaagctttgttgccagtgaaataagctctttggttctgaactattgctgttttaagtact

SEQ ID NO: 39005 - DNA, 121 bp, Artificial Sequence
  Synthesized
  misc_feature (61): n=a or t
gactctgcacagcagtttctgcatgttgtggtatataggtcaacataccaataaagaccancagagtctaatagcagggtgtgatatattcaacaaaatcagcttggtgaatatggtaagt

SEQ ID NO: 39006 - DNA, 121 bp, Artificial Sequence
  Synthesized
  misc_feature (61): n=t or g
gagaactgctaggaagaaggcctggtgggactgaacacggatgccaggtggtccagctttngtttcactggaaaccagatacaccatggacagcaggatgcagatattttctacctgtggt

SEQ ID NO: 39007 - DNA, 121 bp, Artificial Sequence
  Synthesized
  misc_feature (61): n=a or g
gatcaggcctgctgggctcaccgaaggtgtcactgtctgctaacatgacagccacttgtcnaggcagaaaggagttcttcctctggccacgttgacctctcaacataccgagtgggttttg

SEQ ID NO: 39008 - DNA, 121 bp, Artificial Sequence
  Synthesized
  misc_feature (61): n=t or c
cagactttctgaagaaagagatgactgtgcacattagtgagtgataacagggatagtttangaataaagatgcttaatttccaaaggaatgattataggatatagtcagccagatccatgt

SEQ ID NO: 39009 - DNA, 121 bp, Artificial Sequence
  Synthesized
  misc_feature (61): n=t or g
actgagtgctcacagccaagtccccatgcaaaagagctgtggtgcatttctccctgctgcncagcctggtggcttacctattcctgggtctggaaaaggctgagccagcttaggtcatcct

SEQ ID NO: 39010 - DNA, 121 bp, Artificial Sequence
  Synthesized
  misc_feature (61): n=t or c
cccatggcagcaagcccaaagggaggatccaggagcagaaatgtaccgtgtttctggaccngagttccctatggttagcaaatgaacaaatctgctcttttgcctgagcaagcatgacaag

SEQ ID NO: 39011 - DNA, 121 bp, Artificial Sequence
  Synthesized
  misc_feature (61): n=t or c
acatttcagcaagatgtgcttcgtgccagcctcctcctgctgagtttttaaaaaacaacangcttggaaaccgaatctcttaatgtggccacaacttccattaaaaccgactgagcagtgg

SEQ ID NO: 39012 - DNA, 121 bp, Artificial Sequence
  Synthesized
  misc_feature (61): n=a or t
tttaaataatgaattggaagacaaataaatgacttaagtatgaaattttggccagattacnttggaaggaggtaaatgtggccttggaaatattctcttcgctttcgaagccaacgttttt

SEQ ID NO: 39013 - DNA, 121 bp, Artificial Sequence
  Synthesized
  misc_feature (61): n=a or g
tggcacgtgttaggaaaggttttagccaacaatacggatttaaaagtgccagagccagcangtggatgggtaggccttgtgggtgctaacagatagccacaaccggggccaacataaaaca

SEQ ID NO: 39014 - DNA, 121 bp, Artificial Sequence
  Synthesized
  misc_feature (61): n=a or g
tgatctctttcatttctgtaaatgtttatctagattggtaactgacagaaggcagtttgtncctctcctcaactgcacatcacttgaagaaactaaaacattccttgagtaatgagcaaat

SEQ ID NO: 39015 - DNA, 121 bp, Artificial Sequence
  Synthesized
  misc_feature (61): n=a or g
cacaaccagagagcaatacatcagtggtttgaaaattagtttctgaagttgtcaacttaangtgtaatgtgcaggcctttgttgttcaagaacaaagtgaagatgaacaattgatcctttt

SEQ ID NO: 39016 - DNA, 121 bp, Artificial Sequence
  Synthesized
  misc_feature (61): n=a or t
atttatcttctcatttccttggcctgctgctgtgcataaaatataagaaaggatcgggaantatgttaaaatcataaatgactagatctaatgcaactagataatagcttttaatgaatga

SEQ ID NO: 39017 - DNA, 121 bp, Artificial Sequence
  Synthesized
  misc_feature (61): n=t or c
aacatacaagtcttctcattagctagtgcatcagcttcatagcacacgcttcaccattaantgaagctcagcatgcactattatttccttccaattccagagttcacagagcaaaaatgta

SEQ ID NO: 39018 - DNA, 121 bp, Artificial Sequence
  Synthesized
  misc_feature (61): n=a or g
tctcacccttctgttcgttattttcctgggactgtgcatactttcagggaagagagttaangaatgtgaattgctactgttgtgctgacagcgttgttctagtgcactatgtggactacca

SEQ ID NO: 39019 - DNA, 121 bp, Artificial Sequence
  Synthesized
  misc_feature (61): n=t or c
agagaaaaaacatttctgagcctgtgagagtcaaagaaaaatggtgtctaagaggacaagntctgccagttccacagcagtcagatgaggtatctgcctaacaggaagaggcttcagttga

SEQ ID NO: 39020 - DNA, 121 bp, Artificial Sequence
  Synthesized
  misc_feature (61): n=a or t
aacatttttatttaacttgtgcaaatgttaaaggtttgactctgagaacattaactcagcntagtggttaccataggtaactgcttaaattgtcatccataggccacaaagtggtatgaga

SEQ ID NO: 39021 - DNA, 121 bp, Artificial Sequence
  Synthesized
  misc_feature (61): n=t or c
caatgaaagaactaccctaggtttaatagggtgcaattggattgattccaaacttgaatangaattatttgaagagtgtaactactgctgccagattgaatggcaatgtttaaaacaccag

SEQ ID NO: 39022 - DNA, 121 bp, Artificial Sequence
  Synthesized
  misc_feature (61): n=a or g
ctctaagtgctgcaggtaggatgccacgttctccttcagtgcagtcacgctggatgccacnctctggaatttctcttccagctcatcatactccttgtcctctgtctgcaaggcaaggggc

SEQ ID NO: 39023 - DNA, 121 bp, Artificial Sequence
  Synthesized
  misc_feature (61): n=a or g
tttcccacaaaaaaattacaaagccataaatctatgctgtagactaccctagtatcattgntagctcctaccatacttcgatttaaaaatatatacaatcttactaacaaaaaagtccatt

SEQ ID NO: 39024 - DNA, 121 bp, Artificial Sequence
  Synthesized
  misc_feature (61): n=a or g
gcacagtgttagacagcaaggatatggctgcattcactctaaggggaaaaaagacactgtncaagcgtgatgataaatgaacgaatttaggatccaatgtcccagattacaaaagaagcta

SEQ ID NO: 39025 - DNA, 121 bp, Artificial Sequence
  Synthesized
  misc_feature (61): n=a or g
aaacagaattgcagtacttttaaaatacaccaagtattgaagtaagctctttatagatacnctaataaaaaaaactctgataaaagatgtaccgtagcaaatattgaaaatgcctaaactg

SEQ ID NO: 39026 - DNA, 121 bp, Artificial Sequence
  Synthesized
  misc_feature (61): n=a or g
gtttgtcctcttggctaatgagcctgtccagagatgatggccttctcataaagtacaagtngaactgtgattctgtgcaaataatgcaaaatagtcaaggccgccatctgctgaatttgag

SEQ ID NO: 39027 - DNA, 121 bp, Artificial Sequence
  Synthesized
  misc_feature (61): n=t or g
tccatgttgttttctcaaatgtggcactaatcatcaaaaacttaaaaatatcatgctagtntttactgcaaacaatcagtacatacctcattcattccttaatgatcctttaccaatcact

SEQ ID NO: 39028 - DNA, 121 bp, Artificial Sequence
  Synthesized
  misc_feature (61): n=c or g
taaactttacttgcattttcctattacagcacagcatcagtgtatcacataaaatgataancagcgcattgtgctgaaaattagacatgtaattaagtcagtgtcacagaagactgccttg

SEQ ID NO: 39029 - DNA, 121 bp, Artificial Sequence
  Synthesized
  misc_feature (61): n=a or g
accagatttagtaggcaaccacttactttattttttgatttagctatggaagattctctgntctgctgagtgacaaagctgactttgtcaactgtgagccagtcctttgacagaggttatt

SEQ ID NO: 39030 - DNA, 121 bp, Artificial Sequence
  Synthesized
  misc_feature (61): n=t or c
taaaacagctcagttttgagtccagcattccagctgcccctggaaggtggaacttggcccngaagatcaccattcaagcctcaccagtgtttatgagaaccaattctatgattgaccattt

SEQ ID NO: 39031 - DNA, 121 bp, Artificial Sequence
  Synthesized
  misc_feature (61): n=t or c
ttggtaggctgattacagcagtgcatttcagagtcaaacctgcaatattgcacatagcctnagatgacttcaacactatgtacatgcatggacatgggttgttgtgcccagggagctgtga

SEQ ID NO: 39032 - DNA, 121 bp, Artificial Sequence
  Synthesized
  misc_feature (61): n=a or g
tgtttgtaggcgtacctgaaggtgtatttaacaggcaacagacctatcaggcttgttgctngcttgtgaactctattttccaactggaggaatgactaattttacagaggagtacacaagt

SEQ ID NO: 39033 - DNA, 121 bp, Artificial Sequence
  Synthesized
  misc_feature (61): n=a or t
tccattacagagacaaattgctgtctgtagaagcagtgtggagcagccagtagtcatgacnggcttctctccttctgaaggctgccatgatacagagcagctcccaccactgtgcggtgga

SEQ ID NO: 39034 - DNA, 121 bp, Artificial Sequence
  Synthesized
  misc_feature (61): n=t or c
aacggaatcagggaatctgccagctctgacagccctcatctcccacacccgggtcagttcnctttgtttatccccagaggtcttacagcacatggacaccggtgcctttcacaaagcccat

SEQ ID NO: 39035 - DNA, 121 bp, Artificial Sequence
  Synthesized
  misc_feature (61): n=t or c
tctttgtgactctctcatacagagcttctgctcaacggctcaggggtggaaagagcgcctntgaagtgaccactctcacagttccacagctgcgaagagcagcagcaaggcgtgcctgtat

SEQ ID NO: 39036 - DNA, 121 bp, Artificial Sequence
  Synthesized
  misc_feature (61): n=t or c
ctaacattttctgatgactatcattatcatagtaaggagtttggtagcataaccttagtantatatattttcattgtgagaagatggaatgactgtccacaaggactcttagccataatat

SEQ ID NO: 39037 - DNA, 121 bp, Artificial Sequence
  Synthesized
  misc_feature (61): n=a or g
acagtcacgcgtcaggcttcgtttctgcttctctatgttccagacagcagacagctaaaantatattgggtttaagcaacaaaattaagaacatttttacttcctcagcagaatatcctta

SEQ ID NO: 39038 - DNA, 121 bp, Artificial Sequence
  Synthesized
  misc_feature (61): n=a or g
agactttccagagattggaacaggaaaaaaaagaaaacagcctgtaagtttgtatgtggangggtaactggagttaaggaaatcaaggtcttggaagtatctgaagctgtcttctgtaact

SEQ ID NO: 39039 - DNA, 121 bp, Artificial Sequence
  Synthesized
  misc_feature (61): n=a or c
acacagaggccaggagctgttgatcaactatggctgtacctattagtccagacaaatgaanaagtaaactttcttacacccagtgtaacaaagcactgggagagagctggtccttccataa

SEQ ID NO: 39040 - DNA, 121 bp, Artificial Sequence
  Synthesized
  misc_feature (61): n=t or c
tcctttggatcacctctcacacacagcatgacagcttctcttctacatatccatgcacctnggtaccttttcccaccccagaacttagcacagtgcttcgcacggaaaagaagggaaatcc

SEQ ID NO: 39041 - DNA, 121 bp, Artificial Sequence
  Synthesized
  misc_feature (61): n=t or g
actgatgggcgccccaagcccatcgaggtgggacaaacaaggacctaaacccttctgcgangtgttcctgcactgcctggcaacccacagggatgtgcaggatgagaacgttctgtgggcc

SEQ ID NO: 39042 - DNA, 121 bp, Artificial Sequence
  Synthesized
  misc_feature (61): n=t or c
agattcaaaattgaactgcgaaaagataagaaatttgtcaagagtgatagtggcatagtcnagaatatagtgaaacatgggaaaatggaaagagatattgtcacgtgggagagattgagaa

SEQ ID NO: 39043 - DNA, 121 bp, Artificial Sequence
  Synthesized
  misc_feature (61): n=a or c
tggccaatctctagatgccataggtacattatgataccacagggctctgaaaagcacaaanaatcctttggcagtcttgtcagaccaacttcaaatcccttttcaaatattgtaaagaaat

SEQ ID NO: 39044 - DNA, 121 bp, Artificial Sequence
  Synthesized
  misc_feature (61): n=t or g
acccatccaaggcattcttgcgttgttgacgatgacctgtgcaagggagggccctcagatngaggtgagcgttgggcactgagcagcagcctctgcctgtgttgtgttggccgaagctgca

SEQ ID NO: 39045 - DNA, 121 bp, Artificial Sequence
  Synthesized
  misc_feature (61): n=a or g
aggcatacttcaaggatgcacatctatcaaagcagtcgggacgcagtttctcatccttctntaagtccccagtcgcacactgtcccatgccaaatccaattgtgagcacactaatcccatc

SEQ ID NO: 39046 - DNA, 121 bp, Artificial Sequence
  Synthesized
  misc_feature (61): n=a or g
aacactgctctaaactatttcagggcatatttacagcggatcaaacagctaatatggaacntatgttttctcagtaataattctggccatctcccttatctgatgctgtaagccctcttct

SEQ ID NO: 39047 - DNA, 121 bp, Artificial Sequence
  Synthesized
  misc_feature (61): n=t or c
gtaaaaacagaatgagaaaattaggctttgcatggttgacagcaaattaaatataaaaatngattcagttataactaaagggtactaatgagaactgggtgttaaaaagaggtgttttgaa

SEQ ID NO: 39048 - DNA, 121 bp, Artificial Sequence
  Synthesized
  misc_feature (61): n=a or g
tcagcagaggaacacagaagacaaggaaagaatctgcaattaacttctcttttctatgcangcaggcaaactttggagcatggaagcttttttttttttttttttttttttgcctgatgcc

SEQ ID NO: 39049 - DNA, 121 bp, Artificial Sequence
  Synthesized
  misc_feature (61): n=a or g
caagtactgttttctagtcccttcatcagctgtcttgattttctctgctcaattaactcantattcttcattttctcctggtagcaggagacccaaaactgagcacaggactcagggtgtg

SEQ ID NO: 39050 - DNA, 121 bp, Artificial Sequence
  Synthesized
  misc_feature (61): n=t or c
cagaattttctccattatttgcaagttctcaaagaagaattttcttcattctggattagcnttttgcaaaatctattaagacttttaatttcatttaaaaatattcttatgttttgaaact

SEQ ID NO: 39051 - DNA, 121 bp, Artificial Sequence
  Synthesized
  misc_feature (61): n=t or c
tactcaaaatttgaaaatattcctgaaattgacaggcaacgctacgctatcttttcattantttaatttcaggacttgcatagtagtaaatttacctgcatcatcgaaaacaaactgctag

SEQ ID NO: 39052 - DNA, 121 bp, Artificial Sequence
  Synthesized
  misc_feature (61): n=t or g
ctcagagaactttggcattttacagacacttgctctatcattcagagaagtcattactttnactctcaaactaaaaatataatcaataatcttataaattagcacagataagaaaaatcac

SEQ ID NO: 39053 - DNA, 121 bp, Artificial Sequence
  Synthesized
  misc_feature (61): n=a or g
aaataacaagggttagctccattttcccattctcagtctagtcttaatatcaagaagagcntggatttcttgttttctcttcgccaggagctgcagcctgcagcaaaaggctcattatctc

SEQ ID NO: 39054 - DNA, 121 bp, Artificial Sequence
  Synthesized
  misc_feature (61): n=t or c
gaggatgaggagtcagacagacaatccttaaaccttctcactggcaaggtctgcagctgcnctgtcttcagagtgcttttaaggacatggcagtggaagagttctcatggacctcggagcc

SEQ ID NO: 39055 - DNA, 121 bp, Artificial Sequence
  Synthesized
  misc_feature (61): n=a or c
ttctagtagaacaaggaatatacagaagagattcatagatccaggcttttccctacaggtnaaagagcagtgtaagctatttctgggtttcatttccctcttgccggtaggtcatggaatg

SEQ ID NO: 39056 - DNA, 121 bp, Artificial Sequence
  Synthesized
  misc_feature (61): n=a or g
gtctatacgtgtttcatttccatcttatgcagaagcgttagatggatcatttaaccttttngattcagtttgtctgcataaaagggccattaatattcattatcctctggaggatattctt

SEQ ID NO: 39057 - DNA, 121 bp, Artificial Sequence
  Synthesized
  misc_feature (61): n=t or c
ttttatgtaaacataagccttccagccaggcttgtacagcagctttaacctggcaggaatnctcctgcttgcttccagccagcttgcttccctgcgctggcaccatgtgtctttgcatcgg

SEQ ID NO: 39058 - DNA, 121 bp, Artificial Sequence
  Synthesized
  misc_feature (61): n=a or g
cgcgtttctgtcataactgttctccatcacctctcactttcccaacatttatcccactacnctgacaattttagctctggcaggaatgcccaagggttagggctgggttggtttttttttc

SEQ ID NO: 39059 - DNA, 121 bp, Artificial Sequence
  Synthesized
  misc_feature (61): n=a or t
tcaagccaaactttgtgcatcaggctgtgttcacttgggcttggaataactccggagttgngtgttcatttgggggcagagtgtttcagctgtatcataaaaatcaggtcttgaatatatt

SEQ ID NO: 39060 - DNA, 121 bp, Artificial Sequence
  Synthesized
  misc_feature (61): n=a or g
aatatgtgggcttacttactttcagatacaatcaaatacaattaactatttgtagtaggtntagttatttctttagctactgtatatgttgccataaatagcactaagcttaaaaagaaag

SEQ ID NO: 39061 - DNA, 121 bp, Artificial Sequence
  Synthesized
  misc_feature (61): n=a or g
tgtgctcaagaaatggaaataaggaggtttaaaatttcagagccaaaaagcactcaaaatncattttgaagatacctgttttactatttaattttagctatctattagaaatcattctcat

SEQ ID NO: 39062 - DNA, 121 bp, Artificial Sequence
  Synthesized
  misc_feature (61): n=t or c
cctcattaacccccttacctcactgctttacaccctcttggatctgactgttcctggattngtgtctgattggtttccaggagtgtgttgttgtgtggcagtgtcctttcctgtagctgcc

SEQ ID NO: 39063 - DNA, 121 bp, Artificial Sequence
  Synthesized
  misc_feature (61): n=a or g
tattgatctctgtgtatttgtttatttcaatgacagctgcagctgcttcagttggaaggcnatcaatagcgaatggaaaccctgcgaccacatgaacactgcatgccccaggagtcacaca

SEQ ID NO: 39064 - DNA, 121 bp, Artificial Sequence
  Synthesized
  misc_feature (61): n=a or g
tggagaaatagaggaaggattgagaattggtattctaaggcttttcagaggatatccattnatttataaatgtcctcccttcatgaatgcaactgtaactttatttcccagagtgctgaga

SEQ ID NO: 39065 - DNA, 121 bp, Artificial Sequence
  Synthesized
  misc_feature (61): n=a or g
ggtgcatccataattacatttcagaaatcaaatcttaaagtgaaaaatatcaatccagacntctttaaaatgtctggtcattaaaattctgtatactctacccagctgcacacgatacact

SEQ ID NO: 39066 - DNA, 121 bp, Artificial Sequence
  Synthesized
  misc_feature (61): n=a or g
tgcagtcacttaaagacaaatttgttgagatgcattgttgcccaaatatcctaggagtttncaaacctctagaagcttttctagtactacttacatgaattgatatttccccagaaaataa

SEQ ID NO: 39067 - DNA, 121 bp, Artificial Sequence
  Synthesized
  misc_feature (61): n=a or g
gacgttgtgccatgcgaagacttcacagaaactgatgccagagcaccagagtttcttgaanctctgccttcagaaacctttgtaaaagaaggagatgatgtgttactcttttgcataatga

SEQ ID NO: 39068 - DNA, 121 bp, Artificial Sequence
  Synthesized
  misc_feature (61): n=a or t
gtttccatgctgggtcgctcatgcacaaagttgcatagtttttagatcctggtccatcacnagggtgagcagctctgcattattctgcataaccagaaaatgcaaggaacagcagcctata

SEQ ID NO: 39069 - DNA, 121 bp, Artificial Sequence
  Synthesized
  misc_feature (61): n=t or g
gcggaccttcattgctgttgtctgcctcctcatgggcatctacatgatggtgaagctgctnctctactctgaggtgcggaggaccatcagggacccctggttctgggggctctttgcttgg

SEQ ID NO: 39070 - DNA, 121 bp, Artificial Sequence
  Synthesized
  misc_feature (61): n=t or g
taagaaaaaacagttcaatgaagaaaacaaagaaactggacaacgtacccacagagaagtnagatggcaaacatgtgaaaacgtgagctttcatactggaaacatcccaagtcagttatac

SEQ ID NO: 39071 - DNA, 121 bp, Artificial Sequence
  Synthesized
  misc_feature (61): n=t or c
aggaaggaatattcaaacaatcctgtaataagcatatcgtttctcctatctgagtcacaantagaaacagatgtatctagacagcctatccctttcatttgtttgtgtagaaattttctat

SEQ ID NO: 39072 - DNA, 121 bp, Artificial Sequence
  Synthesized
  misc_feature (61): n=a or c
gtcttccaggattttcattttaagagtagaaaagtgctgtggtcaaatgctattaacatanataaatatatagcaaatcgtttcatttcaatacaggctgttgggaaaagatgaatctctt

SEQ ID NO: 39073 - DNA, 121 bp, Artificial Sequence
  Synthesized
  misc_feature (61): n=a or g
tggagtagtgctagaagtgcagttggtgatgggttaacgtggtccaggcaatgcactacanaagcgctctttgcaatggcatcttgaatacgtaggagtgtggctctcggaaaaagggtat

SEQ ID NO: 39074 - DNA, 121 bp, Artificial Sequence
  Synthesized
  misc_feature (61): n=t or g
gcagttacttgaaatttattctgtcgtgtaaaatccaaaatatactatttctaacagttanaattctctgtgtaagtgttaacaaggactggattacaacaatatgtctacccttgatgtg

SEQ ID NO: 39075 - DNA, 121 bp, Artificial Sequence
  Synthesized
  misc_feature (61): n=t or g
aacattatgttctttgcagcgcagagtttggctataaattatgctggtgtgagttgaatanaactttatgagctgaattctgctgaggccctgaaagcctgtgctgttcagttgtaagcaa

SEQ ID NO: 39076 - DNA, 121 bp, Artificial Sequence
  Synthesized
  misc_feature (61): n=t or g
gtcccaagaaggagttaaatgaataggaaggaaccgattgggtaagagttctgaagaggancaatcaggattgacagatcccacgacctcagcacatcccacggccccaacacatcccaag

SEQ ID NO: 39077 - DNA, 121 bp, Artificial Sequence
  Synthesized
  misc_feature (61): n=a or g
aaccacccagaacagctcattaattagatatcttccaccaactagttgcataaaaactatnaaaatcattctaacagatgctgtatgctttcacattaaacctttttaggctggttaacat

SEQ ID NO: 39078 - DNA, 121 bp, Artificial Sequence
  Synthesized
  misc_feature (61): n=a or g
tctgttgtcatgttcagacaacgttcgttactgacttgcatgagctgcatgacctggggcnatgggcatttttatcttgagagatgtctcagccaaatattatccctgtacagtataatct

SEQ ID NO: 39079 - DNA, 121 bp, Artificial Sequence
  Synthesized
  misc_feature (61): n=a or c
gtgttcctctggttctcaatcaatccaagtcagtgttgcagaggtagaattttgttctcanttctgtcctcttccatccagagctggatgaaagcatcccgagctgccttggactgcagga

SEQ ID NO: 39080 - DNA, 121 bp, Artificial Sequence
  Synthesized
  misc_feature (61): n=a or g
gcgagcggtgatgaattccctccattgctgcagcttcagaagaaaatacgtcctgcagtgnagaagctctgcaatttgagcaggacgacctgagagcgtcgcagccgggaaaacagacgtg

SEQ ID NO: 39081 - DNA, 121 bp, Artificial Sequence
  Synthesized
  misc_feature (61): n=t or c
gtgtcatttgttccatcatctatgtaaacaatgagcccatttgagtttctgagcttttgangttaattacatcttgtagcaatgaattcctgagttcaatttttcattcagtgaaactgca

SEQ ID NO: 39082 - DNA, 121 bp, Artificial Sequence
  Synthesized
  misc_feature (61): n=t or c
ccccatagagagagattcttatgagcgtacatctaaggagatgactatcacactttatccngtttctaattgtgcacttctctgaatgaggaacagagctgtaaaatctcaagtgccaagg

SEQ ID NO: 39083 - DNA, 121 bp, Artificial Sequence
  Synthesized
  misc_feature (61): n=t or g
ctctgaactgctgaatgagtcccccatggcagttaatatttgattatggttctagaaaatnttcagcttttacaattagtgtcaaagcagtggtaagcccctctttgattcctgggtgtag

SEQ ID NO: 39084 - DNA, 121 bp, Artificial Sequence
  Synthesized
  misc_feature (61): n=a or g
ccctgtcagcccgggctgctgtgctcccccaaaccctctccttcaagcaaaaagagctctnttttatgcattgctgcagtccagatacctctttctttccgttcattgaaaaccaagctga

SEQ ID NO: 39085 - DNA, 121 bp, Artificial Sequence
  Synthesized
  misc_feature (61): n=t or c
tttttactggtaccagggcagcactattacagcagttctaagggagtgttggtgctgtctntctatggccaagattgcacatcctacttccaaagtttttctgagttggtggtatgataat

SEQ ID NO: 39086 - DNA, 121 bp, Artificial Sequence
  Synthesized
  misc_feature (61): n=t or c
tcacctctcccagatacctacactcaacacaagcagaatgcattcaggttccttggcaganaaaaggatatgcaggagcatttgtccccttagagacttagtaaacatctgatgcatagat

SEQ ID NO: 39087 - DNA, 121 bp, Artificial Sequence
  Synthesized
  misc_feature (61): n=a or t
ttaataaatacacctttactgattgctaagacagtttaacgatactgaataggaaagaaangcaacagtccctaatatgtacccagatgctatttgtgaaaataccagtgtgcacaatgta

SEQ ID NO: 39088 - DNA, 121 bp, Artificial Sequence
  Synthesized
  misc_feature (61): n=a or c
aggtgtcctgacaaccccaaatctgctaatagacgtgagcagagaggaatgacagacctcngaaactgtgttgagaaagcaatgaaagaggcatgggtcagagcagacctcactcagccac

SEQ ID NO: 39089 - DNA, 121 bp, Artificial Sequence
  Synthesized
  misc_feature (61): n=a or c
tggagattatttcctcagagaagccaagcactttgaaaacagatacaagctttacatcaanatgttgatgttgaaaacatttcaacctatggttgcaaagcacacatctccagtaaattta

SEQ ID NO: 39090 - DNA, 121 bp, Artificial Sequence
  Synthesized
  misc_feature (61): n=t or c
gcacaaaaaagcatggtaggatcacaagtcttatctacaaactcagaaatttcaggtaagnaggataaagtgttttctgaaaggaatttaagcagctagtaactggtgaagaggagatgtc

SEQ ID NO: 39091 - DNA, 121 bp, Artificial Sequence
  Synthesized
  misc_feature (61): n=a or g
tcagcttgtgagagaaagtcacaacttttaataagatgagggatttacattcatttaggcnccagttgtatagaaagttgtgtgtttaagaaacataatgtttgtggagaactgcaaaaga

SEQ ID NO: 39092 - DNA, 121 bp, Artificial Sequence
  Synthesized
  misc_feature (61): n=a or g
gttcccagctagtacagtttaaagaatagataaggacccagcgtatctacttccaaagaanaacttgtagggagctccttgcagatttgcatttcgttatttcagaacatgatagtcaagt

SEQ ID NO: 39093 - DNA, 121 bp, Artificial Sequence
  Synthesized
  misc_feature (61): n=c or g
caaagctgaccccagagcttctctgctgccagacctatagcagctggatggcgtcccaggnaatcactatgaaaaacctgccttaagaatttgggtcggtttggattgagaagattgctgg

SEQ ID NO: 39094 - DNA, 121 bp, Artificial Sequence
  Synthesized
  misc_feature (61): n=t or c
tgacagacaaaaactgggcgcttgcaaaaacattcataaaggtgacttggtgagcagttgnttcattggaaaatggctgtggcatgaacattctggaggcatgcagtaagcttatgcagct

SEQ ID NO: 39095 - DNA, 121 bp, Artificial Sequence
  Synthesized
  misc_feature (61): n=c or g
tgaaagcttctattcacagcagtgagtagatcctatttataatagccaaaaagaaaaaggntgggtttctttccaccagaatgtaacactagctccactgagtagttgaatctcactctat

SEQ ID NO: 39096 - DNA, 121 bp, Artificial Sequence
  Synthesized
  misc_feature (61): n=a or c
cctctgccgatccagcctaacacagactaaaccaggtgatgggttttagtgaagcaagatnagttgtatattatgccacggcgatttagaagttccgtctagtctttgcacaaagaaaaat

SEQ ID NO: 39097 - DNA, 121 bp, Artificial Sequence
  Synthesized
  misc_feature (61): n=a or g
tttcaggcttgggatcttgctaggtctttgtctatacagtatgttcctatgatacagtcantgcagtaatatcatctctatagctaaaaataagccaagaaaatggcatttctggaatctg

SEQ ID NO: 39098 - DNA, 121 bp, Artificial Sequence
  Synthesized
  misc_feature (61): n=t or c
aaattaaaaatttaattgaggttttggtctggaagaccatcctctgagatgcaaagaatanaggcacctatgaaataatttccatatgaaagcaaacagtgctgtttcttcattttctaat

SEQ ID NO: 39099 - DNA, 121 bp, Artificial Sequence
  Synthesized
  misc_feature (61): n=a or g
ctagccagctagtaaaactagaaagcagctgctttttgattccagaagtagttgagctgangagagatggtggccaggccagttctggtgagagaagtattaaccaacagagcactgggta

SEQ ID NO: 39100 - DNA, 121 bp, Artificial Sequence
  Synthesized
  misc_feature (61): n=t or g
tcctttttctcatgagcattactgattagttttcaaattcctgacctaacctaaaaatatntagggagttcttgaaaacatcatctgtatgcttttcagtgccaaatgaagggaataatat

SEQ ID NO: 39101 - DNA, 121 bp, Artificial Sequence
  Synthesized
  misc_feature (61): n=a or g
cctgtttgctgaagaggttctgccttggtttggcttaggtggaagacaatctagcatcaanatagcataccttcttttttggttctttttgtgaccatcatccaggtctctgtttacttgg

SEQ ID NO: 39102 - DNA, 121 bp, Artificial Sequence
  Synthesized
  misc_feature (61): n=a or t
gatccaagaaacctcaaaaacccattccaagaccattggtaagaatgtctgaattgctcanaaggaaaattcattatgaaatcaatacaattcatgtaaaaatgcatattttagatactga

SEQ ID NO: 39103 - DNA, 121 bp, Artificial Sequence
  Synthesized
  misc_feature (61): n=t or c
aaccatagtttaggctgggaaagtttaggcttttcgttctgagcgtctctggttcaacttntctcttgttagctagagaaatgctttgacacgtgccagtatgtataccagtaatgctaat

SEQ ID NO: 39104 - DNA, 121 bp, Artificial Sequence
  Synthesized
  misc_feature (61): n=a or g
cgcttgctgccaaccaaatctattaactccccttacaggtaaaccagcctttcacagtatntacaacaccacattcctgtattctccactttggaacaaaggaaaacagagtaagctcttt

SEQ ID NO: 39105 - DNA, 121 bp, Artificial Sequence
  Synthesized
  misc_feature (61): n=c or g
atatagaatatggtttttgttgttgttgtttgcttgtttgttttctaaatggtccacaganaaaaaatctgtctcatctcttatgctggattgataacagtgcaaatcatctatgaaaaaa

SEQ ID NO: 39106 - DNA, 121 bp, Artificial Sequence
  Synthesized
  misc_feature (61): n=a or g
tacctggaaagaagcagagaggctgcgcacaaggcaacagcatttagagacagagggtctnttggggctgtgttcatagcacatcgggctctccagggcacagagcagactgagttggatt

SEQ ID NO: 39107 - DNA, 121 bp, Artificial Sequence
  Synthesized
  misc_feature (61): n=t or c
agaatcactgagtgctgttgctctgtaactacccacatctcctccttttacccttctgaangatacagaatgaacacaaaaaataaattaaagcagtaagaagttttaagtaatgagatct

SEQ ID NO: 39108 - DNA, 121 bp, Artificial Sequence
  Synthesized
  misc_feature (61): n=t or c
ctttggcagaaaacccagcaacacacacgtgcagatggacctccatcctcgcacagctgcngaggaggctccctacagagtggcacggcgtacctttggcccggtggtcctcctccttggg

SEQ ID NO: 39109 - DNA, 121 bp, Artificial Sequence
  Synthesized
  misc_feature (61): n=a or c
gaaaaccaaaactcacttctaaactctgtagactgtgagatattctgactggcacacattncaggaagaacattggataaatgttttcagtagcaaaaatacagaaagacagaaaattttg

SEQ ID NO: 39110 - DNA, 121 bp, Artificial Sequence
  Synthesized
  misc_feature (61): n=a or c
gcttcctgattttaacagtactgaaatttctccacctgcagaaataaaatcagggtaaganattttgattaagtatttgtatttttcttttggtgagagaaaggagcttttgtctgtgacc

SEQ ID NO: 39111 - DNA, 121 bp, Artificial Sequence
  Synthesized
  misc_feature (61): n=a or t
tcctcagacacacctacctctccctctgatccttcagagtttatttgaaatgtttgaaaantaaaatcttatcaacagctctgtgcaaaaggaaaattttgccaaaatatttgaattcagt

SEQ ID NO: 39112 - DNA, 121 bp, Artificial Sequence
  Synthesized
  misc_feature (61): n=a or g
ttgaaatgtaactgaactcactattgctgaaatgtaatggcttatttcgctgtttaaaagncagccgtaacagtgcattcccagaaatcctatctttgcacagttcactttcaaaacataa

SEQ ID NO: 39113 - DNA, 121 bp, Artificial Sequence
  Synthesized
  misc_feature (61): n=t or c
cctcatataataagatttttttcagacacttctgacatgaactgacatgaacatgaacttnggttgagatcaaactaaagcctcccatccactcctccatcctccccatcacatcaccttc

SEQ ID NO: 39114 - DNA, 121 bp, Artificial Sequence
  Synthesized
  misc_feature (61): n=a or g
gctctccaggtgatactgagtgcacaggtgggtgcttgcacagggaagccttcacccaacntttgaaaaggaaccatgcagaatagccccaaatgagccaaaaagggaacttgcatgaaac

SEQ ID NO: 39115 - DNA, 121 bp, Artificial Sequence
  Synthesized
  misc_feature (61): n=c or g
agactgatgaggaacacattctgaatttttctctgtggcttcagacttcccaatcagaganattaatagattggatttggaatcctttgtaaagcaggaccaaaatccacactctattgtt

SEQ ID NO: 39116 - DNA, 121 bp, Artificial Sequence
  Synthesized
  misc_feature (61): n=t or g
agctcttcttgaacaaagcctttctgagatactaaatactgttactgtactttgaaaaatngagaatttgaagaaagagagttggagatcatgccaataggaagaaaacattcattatgaa

SEQ ID NO: 39117 - DNA, 121 bp, Artificial Sequence
  Synthesized
  misc_feature (61): n=t or c
gaaatctcagtcttcctccttcagtgttggcaaagtagggctgggggaatgcttctgctcngtgatgcgcacatgagagcagtgggagcactcacaaacatggtcatgcaggaaagcagat

SEQ ID NO: 39118 - DNA, 121 bp, Artificial Sequence
  Synthesized
  misc_feature (61): n=c or g
tactgaattttaaacaggactttgcactgaggataaatcaagcttcaattcatatgagctngctgtagtcaacactagcagtggggtgtgtgggaaactttaatgtatgaatttcttccat

SEQ ID NO: 39119 - DNA, 121 bp, Artificial Sequence
  Synthesized
  misc_feature (61): n=a or g
gggtagagcccagaaataacagccattaaaacatggaaggcttcagaggtggctttgtgcngtgggttatttctgagaggttacagtagaagtggagaacaaaaatctgttgtaggctgtt

SEQ ID NO: 39120 - DNA, 121 bp, Artificial Sequence
  Synthesized
  misc_feature (61): n=t or c
agcaactatttcaaatggttagtctgatgtagaagatctacttaatcattatagaatttangtgcatacacacctgaagcaaaaccgtttgtaaagatcatcacacttaattatactaaaa

SEQ ID NO: 39121 - DNA, 121 bp, Artificial Sequence
  Synthesized
  misc_feature (61): n=t or c
aagaaaaaaagaaaagctaaagaataaactaggaaaaagagaatacagagagctctcaatncaggactgagcgtgcagctgtgagaagctgcagaaataatcactacgtgtcagctgcatg

SEQ ID NO: 39122 - DNA, 121 bp, Artificial Sequence
  Synthesized
  misc_feature (61): n=a or g
atagagatgagcatatttatgctcacactacacttgtggagtattttacattttattcacnattttgttggtaaaaattctatccaattaatctagaattgggtaattaattttagtttac

SEQ ID NO: 39123 - DNA, 121 bp, Artificial Sequence
  Synthesized
  misc_feature (61): n=t or c
ttatgctttccaacttgcatttcttgcctttgaaatgtttcctccataattaaaagcaaanttttcttgtcacaagacagaattcctttgtgcagaaaaacgaagccaagcctatacgtta

SEQ ID NO: 39124 - DNA, 121 bp, Artificial Sequence
  Synthesized
  misc_feature (61): n=a or g
gtaggatccagcttatatccatatctgcattctacttttctactaattcaacagcaagtgnaaaagcctcatctaaacacatttaattgctcagcagaacagtattttcttttcagcaatg

SEQ ID NO: 39125 - DNA, 121 bp, Artificial Sequence
  Synthesized
  misc_feature (61): n=a or g
attcaaactctcttctagcaggcaaagattatctatacagctctaagcacccctagcttcntgacctagaacgaggtagatcttgtatttcacacactggctttttatgttgtactgctgg

SEQ ID NO: 39126 - DNA, 121 bp, Artificial Sequence
  Synthesized
  misc_feature (61): n=a or g
tttggcagaacaggagaggaaatgcaaatgcaaagcctacatacctatatccagagcacanatttgttatgttaatgagagaaaatgaggaagagggaagacaccctggatatctgattgt

SEQ ID NO: 39127 - DNA, 121 bp, Artificial Sequence
  Synthesized
  misc_feature (61): n=a or c
tttgcaaatagtacagggaaagggatgcacctcttcacagagggagaggaagcatgggtanagtaccatccacagttccattggtcattgctgctttgccctctgtccaaaaattcagttt

SEQ ID NO: 39128 - DNA, 121 bp, Artificial Sequence
  Synthesized
  misc_feature (61): n=t or c
gttcctcccatgctggaggctggtttgctgtgcgggcattctgggcttctcccttacaccnacatttcccactggtccttaccctgatgtgcccattcacactcctggttgtgtctccttc

SEQ ID NO: 39129 - DNA, 121 bp, Artificial Sequence
  Synthesized
  misc_feature (61): n=t or c
aaggacaaggtcacagtgaatgagcagcaaacccaagcgaaactggagttcattgggggantgacagactaagacacaaacacaactcaaaaggtaaaatcatatgcttcctcacccactc

SEQ ID NO: 39130 - DNA, 121 bp, Artificial Sequence
  Synthesized
  misc_feature (61): n=t or c
agtcaatgttttcacaatctctgcatttgttttctcttgcctaagactactaatttaccangcagtatcgtaccaagtgcttttgagtgaataggagaggtaggcatttattttgtataga

SEQ ID NO: 39131 - DNA, 121 bp, Artificial Sequence
  Synthesized
  misc_feature (61): n=t or c
caaaacaggaaaaaaaataactaatgataaagggcttgtttgcagtaggaattcaatttancagaaaatctagccacgacatacctcagttttgaagcctgtgaccatgattttacacatg

SEQ ID NO: 39132 - DNA, 121 bp, Artificial Sequence
  Synthesized
  misc_feature (61): n=t or c
tgcctgcagctatagcactcagtcctataagcagagtgacgtccaaagagtcccaatgggntgagcagcccactgtgggtgatggtctgctgatggtctgatgccaggtgtggtggtgggg

SEQ ID NO: 39133 - DNA, 121 bp, Artificial Sequence
  Synthesized
  misc_feature (61): n=a or c
agtctaataaagctgtccttttttgacaccattacagttgcatctgcctggtctgacaagntaatatgttgctgaaaggaattctgtgtggaaaaatgttcacacagagataacgttataa

SEQ ID NO: 39134 - DNA, 121 bp, Artificial Sequence
  Synthesized
  misc_feature (61): n=a or g
ctcgttcatcattaggctccatattatagaatcattaaggtttgaaaggccgctaagatcnactaacccaacaaccaacccatgcctggactgctctagaccatgtccctcagtgcctcca

SEQ ID NO: 39135 - DNA, 121 bp, Artificial Sequence
  Synthesized
  misc_feature (61): n=a or g
gctggttgtgatgacctgctattatctcccaggattttctgtgaaagcaaagagaagctangaagcaatcagcactggattgtacctgccttctatacaaacatgtaaggatcggattatt

SEQ ID NO: 39136 - DNA, 121 bp, Artificial Sequence
  Synthesized
  misc_feature (61): n=a or g
attatttcctgagcccccatggagagaaatgacaggaaatatacagtgaagcagaggaaanccatcctgcccctttaaaaagctccagcaccaggtgcaaattgcttaagcagcagcagat

SEQ ID NO: 39137 - DNA, 121 bp, Artificial Sequence
  Synthesized
  misc_feature (61): n=t or g
ttgccaggggcagggcagcgaacacttcaacagaaacctgtaattatagtcctttctcatncccttgtttgaatgggaatggaaatggccttgttagtctaaagacttacagctagtaact

SEQ ID NO: 39138 - DNA, 121 bp, Artificial Sequence
  Synthesized
  misc_feature (61): n=t or c
gtaaaatgaatactgacagccatctgtttttaatggagtcagtggaactgtttatgctcangttgcaagtgaaagaaacttctaacagagcatttgtttaggaaagcaaagagacaaatta

SEQ ID NO: 39139 - DNA, 121 bp, Artificial Sequence
  Synthesized
  misc_feature (61): n=t or c
tcctcttatgcttcagaatttgatgttcgtcttattctattgggagggaaaaagaaagtanacagcctttaaatgatgagaagagctgtttacagactttagatttcctttggtttccata

SEQ ID NO: 39140 - DNA, 121 bp, Artificial Sequence
  Synthesized
  misc_feature (61): n=t or c
cttcgggagatttgcccttttttaatctgaggtcacctcctacttggaggccaactcaccngactgcacatccacagctgtctcagtggcagcaggtgactcatgagctgaagccaatgct

SEQ ID NO: 39141 - DNA, 121 bp, Artificial Sequence
  Synthesized
  misc_feature (61): n=t or c
tataagctggttgctaaattgaccgctaggtcaatgctgatggtatgtcagcctggtcagngtgctcaaacctctatctggatgccaaaatgtaggtagctccagagctgagtagcatttt

SEQ ID NO: 39142 - DNA, 121 bp, Artificial Sequence
  Synthesized
  misc_feature (61): n=t or c
aaaactaaccagtagcatgttgcagaactcctagctgcctaatcatgattaaaaatactcnaaaaaaatcaagtacggagagtttcagaacgatgccacaaagtgcaagctgggacagcca

SEQ ID NO: 39143 - DNA, 121 bp, Artificial Sequence
  Synthesized
  misc_feature (61): n=a or g
atgcagaacctgacattattgaacagcttgtggagtttgcttatactgcaaggtagttttnttatttaaaactgacgtttctgctagaaagcctgccaactctaagtgatgaaatcttaaa

SEQ ID NO: 39144 - DNA, 121 bp, Artificial Sequence
  Synthesized
  misc_feature (61): n=a or g
gttttactcacaggaacgcacatcagtagctgcacaagcagttttgaacttgggcaaagcntgctctctccataaacagagtaaataaattagctttgccatcaacgcctcttgtttgcct

SEQ ID NO: 39145 - DNA, 121 bp, Artificial Sequence
  Synthesized
  misc_feature (61): n=a or g
ctatgtacacattaggaggtgcttttccattcttatattagagcctctaaattaatctgcnaacatgaatcactcttgattcttggatttctggacagtgaagtatcagtatatatcagtc

SEQ ID NO: 39146 - DNA, 121 bp, Artificial Sequence
  Synthesized
  misc_feature (61): n=a or c
cagatatttgatctatgaatgtgctgaaaaaactgtttttccgtaaatttatggagtccantacctttgaggcgtggactcaacgtgtatgtaaaattaagtagtagaaccctcttctcat

SEQ ID NO: 39147 - DNA, 121 bp, Artificial Sequence
  Synthesized
  misc_feature (61): n=a or c
gtttttctcatttcctgctcgtcacttcccaagagaatcaaaacacagcagtggtatcccnccctccgtgacatagtccagtgtttatggaagaatacaacctctggcatcaggatggtga

SEQ ID NO: 39148 - DNA, 121 bp, Artificial Sequence
  Synthesized
  misc_feature (61): n=c or g
ctctgaacagtggaactgaaatgaagactgaaacattaaagattaactcagggtgcagcantgcctgaaatccatctgctgttttattttatgatcagtgctttcttgtcaaagcatattg

SEQ ID NO: 39149 - DNA, 121 bp, Artificial Sequence
  Synthesized
  misc_feature (61): n=a or c
gtgcacagttcagagaggcagcgttgtcccacataacgctaccttttcagtatgcagaaancatgatttcattctttgtggaagaaaattaaatgtttattttcagaacttctcaaaaaaa

SEQ ID NO: 39150 - DNA, 121 bp, Artificial Sequence
  Synthesized
  misc_feature (61): n=t or c
tggatgtaaatgttgatattgtgtcacaagagaagaacatgagtgccttttagttgtcttngaaaaactcaaagaatatagtcagtttaaaaatctgatttacctcagtgtctccttggaa

SEQ ID NO: 39151 - DNA, 121 bp, Artificial Sequence
  Synthesized
  misc_feature (61): n=t or c
caggatttagtacagtctcctgctcagagcaaaatgcagattaagattgcattgccttgcncttgggtgtataaaacctccaaggacagagatgacccaaccactctggacaacatctcaa

SEQ ID NO: 39152 - DNA, 121 bp, Artificial Sequence
  Synthesized
  misc_feature (61): n=a or g
agcccattcctgctttccaccctctcccacctatcgccacaacaagagaagcctctccacnaaggggctgaaagatgcacaacctacgcaccaatccacattagtttggcacgcctgaggt

SEQ ID NO: 39153 - DNA, 121 bp, Artificial Sequence
  Synthesized
  misc_feature (61): n=t or c
gaaccactggatagctggatgcttccaagaacctgatcccaaataatgcaggaacccatgnactttgtagtgtattactactcaaatgtctattagcaatggaagaagaaggaaattcaga

SEQ ID NO: 39154 - DNA, 121 bp, Artificial Sequence
  Synthesized
  misc_feature (61): n=t or c
gaattttttaacctggaatttgttgtctttgtgtaaactctgttgtgtttctctaatgcangttcagctcagatgtagacagtcgtttctaaaggttatagaataggtttgtgccaccgta

SEQ ID NO: 39155 - DNA, 121 bp, Artificial Sequence
  Synthesized
  misc_feature (61): n=t or c
agaactgaggtgtctaaggtgaaatacagaaggaaggatataagaaggaccctcttaaagnagtagattctccagaaagtccaagaatgtctccagaatgtcaaagttcatgagataccag

SEQ ID NO: 39156 - DNA, 121 bp, Artificial Sequence
  Synthesized
  misc_feature (61): n=a or g
tggcatgaaaacgcacatggggagggagtgcgtgcagtacgtgatgggcagatagttgatntggccaagggtgtgggagaggtgggaccgtaaggagaagctggggcagcctggagggtca

SEQ ID NO: 39157 - DNA, 121 bp, Artificial Sequence
  Synthesized
  misc_feature (61): n=t or c
aatcttgattttcattattttttttttaagatttggctccttgcttatggaagcttggaangatggatgcttggttgattgtattcatcaacaaccacagcgctggcatacactaattccc

SEQ ID NO: 39158 - DNA, 121 bp, Artificial Sequence
  Synthesized
  misc_feature (61): n=t or c
gactttttttttctttcttttttttttcatcaatcgcacacatgcattcaattgtccaganctatgatattatttacaaaagtaaaatagtgcctggagtgcaacatcacctgcacatcct

SEQ ID NO: 39159 - DNA, 121 bp, Artificial Sequence
  Synthesized
  misc_feature (61): n=c or g
cactgcatttcagtcatatattaagtatactgacataccttgactttcatcatctaccacntaatgtcctaatcactagctaggaggtactgaaatgctgttttccttgaaggtcaactca

SEQ ID NO: 39160 - DNA, 121 bp, Artificial Sequence
  Synthesized
  misc_feature (61): n=t or g
taggaatcatacggctctgttgtctcaaggtgtgattttatcacagtccaaagaagtgagnggcaagactgtgtgtgattgggatgggaggctactaaggaagcacaaatggcatgtttca

SEQ ID NO: 39161 - DNA, 121 bp, Artificial Sequence
  Synthesized
  misc_feature (61): n=t or c
cacctcaggactccagcacgctgtttacctacggcttttaggtcacagcaacgcctttttnatagggctcgaggtgcagatgggcagaatgcaacgcaggatcgcagccctctctttctca

SEQ ID NO: 39162 - DNA, 121 bp, Artificial Sequence
  Synthesized
  misc_feature (61): n=a or t
ttacatcttactctccctctgcatcagaaattattttttcttattactcatgacaaacatntaataatgctttcttcactctcagtggcttttgcacctcacagtatttcatcaaagatgt

SEQ ID NO: 39163 - DNA, 121 bp, Artificial Sequence
  Synthesized
  misc_feature (61): n=t or c
tttgcagtaaaaccccacacagttctacaatgggatttatgtggcttccgtagcagatatntgagcctcaaaaagatctggagtgccacaaaacctgggtttggtttcatacgcttaattc

SEQ ID NO: 39164 - DNA, 121 bp, Artificial Sequence
  Synthesized
  misc_feature (61): n=a or t
agttctggctgaatgtgttctgcttcctcaggcagttgccaagctgctcccagaggtaatntggaataattttggtagatttcctgtggctgatctccgtcaattatggtgctttcttcct

SEQ ID NO: 39165 - DNA, 121 bp, Artificial Sequence
  Synthesized
  misc_feature (61): n=t or g
ccccttgctgctggaggccaaattctctgggtgctgaacatggctgtaaatcactggtgcnccatgtggaggtgtgcaaggactcaaccttgtactcttgcaggctttcctttgaacacat

SEQ ID NO: 39166 - DNA, 121 bp, Artificial Sequence
  Synthesized
  misc_feature (61): n=t or c
atcttaaaataataaatcctccccatgcagcttaacatggatatcctcatcacagagcaangtggcattgatcacagcccaaagagctttactgaaacaatcccgcattaatcagaaggca

SEQ ID NO: 39167 - DNA, 121 bp, Artificial Sequence
  Synthesized
  misc_feature (61): n=a or g
ctgaagacgtgagttttcaagttttcaggaccttcctctgattatttttcctactcattcncacataaataacttctgatccaaaataacaggagtctcagcactcctttgggggaaaaga

SEQ ID NO: 39168 - DNA, 121 bp, Artificial Sequence
  Synthesized
  misc_feature (61): n=a or c
tgaaaggtaatgcaactcttttcctagaacactagaagcaactgagatgcaaattgaaacnaccaagtttttatgttaactgcaagaagtgttattcccacccccttggatcgaagttctt

SEQ ID NO: 39169 - DNA, 121 bp, Artificial Sequence
  Synthesized
  misc_feature (61): n=a or g
atgtggaaagaagggttgagttagtcacatggacttttctaccttgcagcctgcaaagtgnaaactgccttttttggtctatcataaatgtggaaaacatgatttccacgttcatgaaatg

SEQ ID NO: 39170 - DNA, 121 bp, Artificial Sequence
  Synthesized
  misc_feature (61): n=a or g
tttcccctcccctgcatccctccaatccagaagttagaatacccctgcacacactgcacgngaggagcaatccagaaagaattttctgaaacatttttcttgccattttacagcctccctt

SEQ ID NO: 39171 - DNA, 121 bp, Artificial Sequence
  Synthesized
  misc_feature (61): n=c or g
aactattgccatagtggtactcagacccctgggctgggattactgataagaaaagtagcantgttgcagttatcttcttttgcctgggagtagctggaagatcctagcccggcccctcact

SEQ ID NO: 39172 - DNA, 121 bp, Artificial Sequence
  Synthesized
  misc_feature (61): n=c or g
tcatttctgcagcttgaatcctcacttcctaaatcacaggggtgaaaacccctacaggctncatatacccccagtttcccccacgtggctctgtagtacgtgtcctttctaatcaagaacc

SEQ ID NO: 39173 - DNA, 121 bp, Artificial Sequence
  Synthesized
  misc_feature (61): n=a or g
aagaagggtcagctttgccattatctcatccagacagacagagggaccttggccaataagnaaactagccagtgaaggaagatcagaaaaaaaggagatttttatcctctctaattctttg

SEQ ID NO: 39174 - DNA, 121 bp, Artificial Sequence
  Synthesized
  misc_feature (61): n=a or t
acagatgcgtctttgacttttcacacctcatttcagatgcaaacgcaactagcagtttttntttgatgtgaaaaagagaagtaatcatagagcctagaagcaaaaggcactgtttgttttt

SEQ ID NO: 39175 - DNA, 121 bp, Artificial Sequence
  Synthesized
  misc_feature (61): n=t or c
tgacataaggaacttatcagtgtacattacgtttgtttcaaacccagaagtacatttcaanttttaggtggagtagacaagccacttgagaagctattttgaattcctgcagtcccttctg

SEQ ID NO: 39176 - DNA, 121 bp, Artificial Sequence
  Synthesized
  misc_feature (61): n=a or g
aaagaggcccaaaacaactatctaaaaaaaaaaaaaacctctggaagaggatgacaaatcntgaagctgagctaggtgcagttcaattgcagccaccacatgggattaacacaaaggccat

SEQ ID NO: 39177 - DNA, 121 bp, Artificial Sequence
  Synthesized
  misc_feature (61): n=t or c
cagaacactatcattgttcagcagagaaggatgtaaaacaagtctatttagggacacaagnaagaaataataggagaaaaggctcagtctttggaatttcctgctttacagcagcattagc

SEQ ID NO: 39178 - DNA, 121 bp, Artificial Sequence
  Synthesized
  misc_feature (61): n=a or g
tattcatcacacaaaaagatactgtctcatggctcttgagagatattatagttcattatantacatctatatcaatatgacctgttccctctggtaagtgttatctacatctataatagta

SEQ ID NO: 39179 - DNA, 121 bp, Artificial Sequence
  Synthesized
  misc_feature (61): n=t or c
gtggtggctttcatgcatcagtaattgtgtgccgtgctctgaaggaccccagacacaacanaccgctggcctttagggggctgatgtaaaaggagcattgtccttcactgaacaaagcttc

SEQ ID NO: 39180 - DNA, 121 bp, Artificial Sequence
  Synthesized
  misc_feature (61): n=t or g
ggcagcagtctgcaggggactctggtgcccaggagctgataagcttggcatctgcagtgantttttggggatccttttcctgagggctttgtcttagcagctggggatccggcagatccct

SEQ ID NO: 39181 - DNA, 121 bp, Artificial Sequence
  Synthesized
  misc_feature (61): n=t or c
ccccgccgttagcagtgccaccatccggagcgattcatggcagaatgagctgcaaagctgnttcttgctgaaaaagaagtgacaacggagcccggggatgggaggaggtctggctgcagca

SEQ ID NO: 39182 - DNA, 121 bp, Artificial Sequence
  Synthesized
  misc_feature (61): n=a or g
aaggtgagcttggtgttttctcctcttgacatcattcttcatgtttgacaatagtaaaccncagtgaaagagatgtgaaattgtattaatgctctcttttctttgccaataagaattaaag

SEQ ID NO: 39183 - DNA, 121 bp, Artificial Sequence
  Synthesized
  misc_feature (61): n=a or g
aagcacaaaacgttgtaactgcacataattaaacctagttatagtatcactgacttataantagaagtcattgtaaggaaacaaaaaaaaattaagtgcatacttctgagctccctcttcc

SEQ ID NO: 39184 - DNA, 121 bp, Artificial Sequence
  Synthesized
  misc_feature (61): n=t or c
ttcaaaatcacctccaaaaagaggtgatgagtgacagcctataggggctgcagacataacnctgaaagagggcactcaccaacagctaccactgcatccaaatatttccaaacgcttggaa

SEQ ID NO: 39185 - DNA, 121 bp, Artificial Sequence
  Synthesized
  misc_feature (61): n=t or c
gggagtgatggaggaagaacagccatatcacgtgtcacttctaaagaaataagaaccaagnccagtgagcgtcacctcagtgtaattctgaagcctctagtccttcacatctggttgaaag

SEQ ID NO: 39186 - DNA, 121 bp, Artificial Sequence
  Synthesized
  misc_feature (61): n=a or g
aaaaaggtgatttaaatattgtattttcttcattctcataaaaggcttactagcatacacntttttgatgctcttccctcttccccctcccccaaccactaaatatgcacatatgatcgat

SEQ ID NO: 39187 - DNA, 121 bp, Artificial Sequence
  Synthesized
  misc_feature (61): n=t or c
ctctctcccttccactccagaagaaaagaaagtgcctataaaggccttgtttgtccgactngtctgaagggaccatattgctgtaggtgcagcgggtcccggcgtgacggcgttgtctttt

SEQ ID NO: 39188 - DNA, 121 bp, Artificial Sequence
  Synthesized
  misc_feature (61): n=t or c
aaccacccaaagaactttgtgatttatctgtaattttaatagctagataactttactattngttatcttcagtttaagccctcttatttctcttcacctccattctactcaattgcatttc

SEQ ID NO: 39189 - DNA, 121 bp, Artificial Sequence
  Synthesized
  misc_feature (61): n=t or c
tgcttggttgggctgtgcacaggagttgagatattaggtagtggtgtgggtgagctgttanggcaagttcttgcaagcctgtgcacagggctattgtaatgttccaatatgattttgctgt

SEQ ID NO: 39190 - DNA, 121 bp, Artificial Sequence
  Synthesized
  misc_feature (61): n=a or t
accaatacctaaggacatggttgatccatagctcagtaaataaccattaaacaaaaaaaantatcaaagttgtatagacaacaatagtcaactcctacagcttaaattcattaaatggaaa

SEQ ID NO: 39191 - DNA, 121 bp, Artificial Sequence
  Synthesized
  misc_feature (61): n=t or c
agcacttttgtacaagagtgttcagtgtctctggattaaattctgaatgaaacacatttanatacgtggacacatacatttagctgaatggcaaatactgcagttgacacctcccatgacc

SEQ ID NO: 39192 - DNA, 121 bp, Artificial Sequence
  Synthesized
  misc_feature (61): n=a or g
agcagatgaggcactgtaggaggagatcattactagttcttaaggaaaaagatgaagaatncgacttgtactgttacaaatactaagcattacataaaaacaagattaaagatcttttctg

SEQ ID NO: 39193 - DNA, 121 bp, Artificial Sequence
  Synthesized
  misc_feature (61): n=a or g
cttttttttgattttgattttggggtggttccccctttgattttgaggagatccctttggnttttcaggtggatccctcattgattttagggtgattccttcaggttttgaggtggtgtcc

SEQ ID NO: 39194 - DNA, 121 bp, Artificial Sequence
  Synthesized
  misc_feature (61): n=a or c
ttttcataacagatcttggagatctttgtggcttcacttttatccactgtgaagaaagagntaactttcaagatgcctttagtgatggaatattccccctcttccttctctgaaaatgtga

SEQ ID NO: 39195 - DNA, 121 bp, Artificial Sequence
  Synthesized
  misc_feature (61): n=a or g
gctttttcatcatattttctcctcatcctttgcaaaaggggaatgagagagccatgcagcnaagctgagctgcccgttagtgctaaaaaatgcttccctatgtccttctgtaagctgaatc

SEQ ID NO: 39196 - DNA, 121 bp, Artificial Sequence
  Synthesized
  misc_feature (61): n=a or g
ggggaatatttactgaaagtggtataccatctgtgaccttggtgtagcttattttgggggnccagaaatgagctgtgttggttagaacaaacccaacatatcttgggtatataattgcttg

SEQ ID NO: 39197 - DNA, 121 bp, Artificial Sequence
  Synthesized
  misc_feature (61): n=a or g
atctaaaatggagatccactgcttgtgtattccagcaacagctgctgcttcagaaaagtantgctttaagcagctgaattgtcccagttggtttgccagacattccttctccaaaccttag

SEQ ID NO: 39198 - DNA, 121 bp, Artificial Sequence
  Synthesized
  misc_feature (61): n=a or g
tttttttcaatactctttcctgtaatgtattctaagcaaacatcatcacctctgcagacangttattccagatgtggacagaagaggatgtactggcacatgacacaaagcttttgagtgc

SEQ ID NO: 39199 - DNA, 121 bp, Artificial Sequence
  Synthesized
  misc_feature (61): n=t or c
tatccacgggggaattggagtttgcctggttttatatttcattcctaagtaagaaaataangtatagaactgtggtttgaagctctccatcatggttatttaaggaaacagctctgactta

SEQ ID NO: 39200 - DNA, 121 bp, Artificial Sequence
  Synthesized
  misc_feature (61): n=c or g
accccaattttttagaacttgctattaatatttcacgggatttgttactagtaagtgttgntagaaaaaataatgacaaaacttactgtaaaacctttgagttctttttcttttcttctcc

SEQ ID NO: 39201 - DNA, 121 bp, Artificial Sequence
  Synthesized
  misc_feature (61): n=t or c
gccgcgtggagagaccccccaggtggggccgccgggcttcccgtttgttgcagtgaccctnaatgagctcacttttcaggataataaatcagtaaagagggaaaacgtaactttttagcca

SEQ ID NO: 39202 - DNA, 121 bp, Artificial Sequence
  Synthesized
  misc_feature (61): n=a or c
gacatctacctgtttgcccatcaaccctgcacttatcccaccctgaactatctaacagacnttacagcattaaacctgaagtggtgctgctcttatgtacaggtggccctacgaaactatg

SEQ ID NO: 39203 - DNA, 121 bp, Artificial Sequence
  Synthesized
  misc_feature (61): n=a or g
gtgaggcactaacaaaaccatcacgcttctgagaccttggtggtggtgtttctggctatgnagccgctcttttcttgtgttcagaagcacgggattcattcccagctgcctggttgctgca

SEQ ID NO: 39204 - DNA, 121 bp, Artificial Sequence
  Synthesized
  misc_feature (61): n=t or c
cgagtggcagcttgctgcatgactcagcactaccccaggggcttggttttgctgtggcgtngtgccagctctgcagagcatcagggaggagcaggatggtggcactgggcaagcggaaggt

SEQ ID NO: 39205 - DNA, 121 bp, Artificial Sequence
  Synthesized
  misc_feature (61): n=t or c
ctgacttctcattttagagacagcaaaactctgtagactgttctatcaaggaaaaatgtantttgttataatctaaatctgttctattgtgttttgtactcacctcacttttttttttttt

SEQ ID NO: 39206 - DNA, 121 bp, Artificial Sequence
  Synthesized
  misc_feature (61): n=t or c
acttactgggaacaacagaagatattttggatatgacttcccaaataagctttgaagtggntctgaagattaggtgccagcaaattacagtgatatttacacttctgtacctccattgtag

SEQ ID NO: 39207 - DNA, 121 bp, Artificial Sequence
  Synthesized
  misc_feature (61): n=a or g
ctcttatggaacattttcagccatactatggcctgaggtaaacatgagagtgtgttgggtnggagacacagctgtcagtgagggaaggttctggggcagaggggggtggtgtgctggcact

SEQ ID NO: 39208 - DNA, 121 bp, Artificial Sequence
  Synthesized
  misc_feature (61): n=a or g
gtacgaatgtctgtccagaagatgcaatgatttggttggtactgaggtgtctggcagcaangaaaggtgttgggagctgccacgagctccttaaccttctgactaatgcacgaagtcactt

SEQ ID NO: 39209 - DNA, 121 bp, Artificial Sequence
  Synthesized
  misc_feature (61): n=a or c
caaactcattttaaaacttacatcagttcagacaaggcctctcatgaatagtatccaaatnaagggcaagtattggccatttggaccaaaatatactatcctgtgggaaggttttgtgttc

SEQ ID NO: 39210 - DNA, 121 bp, Artificial Sequence
  Synthesized
  misc_feature (61): n=a or g
ccccagggctcacaggcattgggattaacacagttgtagcacagctgtgggaatcagcagntctggaggtaaccaagcgagagctgcccaaaacacaaaggcaaaggagaagggagaaacc

SEQ ID NO: 39211 - DNA, 121 bp, Artificial Sequence
  Synthesized
  misc_feature (61): n=t or c
ataatgctgatgaagtcttctgtgcatacatgcagactttttcgcacaccccacagactanggactgccacgacttaagatgtactaccctcttatttctgtacagaaccctctggaatga

SEQ ID NO: 39212 - DNA, 121 bp, Artificial Sequence
  Synthesized
  misc_feature (61): n=t or c
tttttgtatgcaatatcctttattgcctatagagggaaactggaataaacagtgcccgttnacctgcatctacagaaatctgtatgttgtctatacctgcacagctccatgctgcagactg

SEQ ID NO: 39213 - DNA, 121 bp, Artificial Sequence
  Synthesized
  misc_feature (61): n=t or c
gcctggtgattatttcagcatccttttatcaagcacttgcaggtccctaattctgctaagnccctccagctgaggtgctggcggcaatcagatgtccctgctccccacagcagatacgtgg

SEQ ID NO: 39214 - DNA, 121 bp, Artificial Sequence
  Synthesized
  misc_feature (61): n=a or g
ttggtgaagagctttatttattttttcttttttttaaactgaaacgtggtgagggccatcntattgttcttacaagaattacagtttgacgtttagtgagagctctctgtgcacgctctct

SEQ ID NO: 39215 - DNA, 121 bp, Artificial Sequence
  Synthesized
  misc_feature (61): n=a or g
ttcttttcatgttagtagcagaaaatgaggctgcatttattatgtcttcacgttcacattnaatgctacttaattatgttttcaaattttagttcattgactctatttagacttaactttc

SEQ ID NO: 39216 - DNA, 121 bp, Artificial Sequence
  Synthesized
  misc_feature (61): n=a or g
gaatcaggaggatcactttttcttcaatgtgtatctgctttcctgctgctaaagtgtagcnttggactttcttctacacagtcatgctacttattcatcttcaatttggtgttaacactaa

SEQ ID NO: 39217 - DNA, 121 bp, Artificial Sequence
  Synthesized
  misc_feature (61): n=a or g
tcagttgtttctggcattctctaaaactgtgtcatttatcttgcctatggttatgaacacnattgtggaagcctacatttcctactcttagctccaagaaaccaagtcatatatggaagga

SEQ ID NO: 39218 - DNA, 121 bp, Artificial Sequence
  Synthesized
  misc_feature (61): n=a or t
gatcagattatacttgtactcttactatttttcttactggccatttaaacatatctccacntctgtttaaaactgcaggaagtgtggtatgggtgagtgggcagtaaggtgggttgggaat

SEQ ID NO: 39219 - DNA, 121 bp, Artificial Sequence
  Synthesized
  misc_feature (61): n=a or t
gggcaggggctgctccgtttgtttgttaccatgtgggtatcctggggatctcaagagagcngctgcgtttctctttgcccccacatctccgtccatctctccccaggtcatgcgtgtccta

SEQ ID NO: 39220 - DNA, 121 bp, Artificial Sequence
  Synthesized
  misc_feature (61): n=c or g
ggaacgtctaaatcactgcctgtaaagtatttataaggactggtgcagattctcagtgtcncccagcagagctataagtgcagcttctgcttttcaagggaatgcattttcctgaatggaa

SEQ ID NO: 39221 - DNA, 121 bp, Artificial Sequence
  Synthesized
  misc_feature (61): n=a or g
tggctggtcaccaccttcctgctctcttgattttggccctttctcttccaagttgagcccnaggtaggcagccttgtcccagatagtttcagccaatagatccctggctgtatccctggct

SEQ ID NO: 39222 - DNA, 121 bp, Artificial Sequence
  Synthesized
  misc_feature (61): n=a or g
ggtagtactgctcactgccagaatgagcaattcttgtattgccttgtaaaaggagtacacnagctataggtttatgtgtggatttccatctctcctgtatagctggtgtagaaaggtagcc

SEQ ID NO: 39223 - DNA, 121 bp, Artificial Sequence
  Synthesized
  misc_feature (61): n=a or g
agtgcacatgctttaaaatgtcctctgagaaggactggatttaaacaaagctgtgtgcctnttagtttgtatggagtgacagatacaaaccagatgagtagctttgcatgtgctgcttcta

SEQ ID NO: 39224 - DNA, 121 bp, Artificial Sequence
  Synthesized
  misc_feature (61): n=t or c
tttcttttcttcttcttcttcttttttttttagatctttccacagttttttgggtgacacngggcaagttacttactttgctttattgtttgagtaacagtagctctgtttatatcttctg

SEQ ID NO: 39225 - DNA, 121 bp, Artificial Sequence
  Synthesized
  misc_feature (61): n=t or c
tgtaattgtatataaatacctgagaggacagtataaagccaaagtactatttggcaccagngaaaggacaagaggaaatagacacctactgaaattcaagagataccatctgagtgtgaga

SEQ ID NO: 39226 - DNA, 121 bp, Artificial Sequence
  Synthesized
  misc_feature (61): n=t or c
cagtggaactgagcaaaccagctcagtttgagacaaaagaatgagttacaggaaattctangctgaggcctttccagaagtgaaatttctttgttccccatctctggtgcagatgaccaaa

SEQ ID NO: 39227 - DNA, 121 bp, Artificial Sequence
  Synthesized
  misc_feature (61): n=t or c
aacgtggtcatagtcataggttgggtcctcctcagagccaaaatggacccgcacgctggcnagggctgtgaagagcacgctcttacgcttggttttctggcagctctcgcagatgaccagc

SEQ ID NO: 39228 - DNA, 121 bp, Artificial Sequence
  Synthesized
  misc_feature (61): n=a or g
agacggcacagccacgtgtgttgacccattgaaggcctccgcacgtgcctcaacggtgggntaacgcctgcgacacagaaacaagagcatctcagtgctactcctcttttctcactcaaaa

SEQ ID NO: 39229 - DNA, 121 bp, Artificial Sequence
  Synthesized
  misc_feature (61): n=t or c
ctgtagtaactggtcatccatgtatttctataaagacaagatgaatgaagtctgtattaantttatagaaatctgatggaaatgaatgcagttcattttcttaaaccacgctcaagaacca

SEQ ID NO: 39230 - DNA, 121 bp, Artificial Sequence
  Synthesized
  misc_feature (61): n=a or t
aagtgagtacttgcctgattttgtaacaaagggaaagccagaaaaataatgggaagaaatncttcctattgagacacttgattttacaaccggcctagctaccaggcagttggtgtactag

SEQ ID NO: 39231 - DNA, 121 bp, Artificial Sequence
  Synthesized
  misc_feature (61): n=a or g
catccacacagcaggtggcagccacgaagattaccacgagcactgcaaacagtgcactgcngccagttccatctggacagaagttataaaggaaaaacgcaagaaacaggtccaggccctc

SEQ ID NO: 39232 - DNA, 121 bp, Artificial Sequence
  Synthesized
  misc_feature (61): n=t or c
gattccccatgaaatgggagggtctaattggatttttaatccctagctaatcaagcagcanattgcacgtatgtgttttgtgtaggaactgaaaagttctttccactgccctattataaga

SEQ ID NO: 39233 - DNA, 121 bp, Artificial Sequence
  Synthesized
  misc_feature (61): n=a or c
cactaatgagccaactgaattgagttatgaggtgttttaatgtatagcatatagaactttnagcctttctaacagtaaattctgttgctaaatttcacagtgtaattctataaatcataga

SEQ ID NO: 39234 - DNA, 121 bp, Artificial Sequence
  Synthesized
  misc_feature (61): n=t or c
cccactgtgttagtggtaggttggtcttagggactatttaggtttttggacacacaaacantcttctgaccactttactacaaaaacaaaacaaaaaaaaaccaaaaaaggtctagatgag

SEQ ID NO: 39235 - DNA, 121 bp, Artificial Sequence
  Synthesized
  misc_feature (61): n=c or g
gatgggcccaggattgatattcacttgaatgatgcctccttgcactgagcaatgtgttcantccaaccccgtggcaacacctcatcatgtacgtgtccaggggctgtcatggatgttccca

SEQ ID NO: 39236 - DNA, 121 bp, Artificial Sequence
  Synthesized
  misc_feature (61): n=t or g
agctttttcatggaaatcgctctgtagcttttaaaaacagaacatcttgtgtcctacatanagcttaaactacaatactccacttgaaaaagcatgccagaatttcaactctttcaaaaat

SEQ ID NO: 39237 - DNA, 121 bp, Artificial Sequence
  Synthesized
  misc_feature (61): n=a or g
tgcaaatagaacgtgaagtattttttcttcaaacatatgtgcccactcataatacattgancagcatcagagtgttgctgtagtccccatgcctttgcattattcaggcttttggttagta

SEQ ID NO: 39238 - DNA, 121 bp, Artificial Sequence
  Synthesized
  misc_feature (61): n=a or g
gtaaaattgattagaaaaggaaaatgaattcaaaatattaaagcactctaagactttacanttatccattttagtctctgagggaagagaaagccttttgtttcatggaatattgaaaaga

SEQ ID NO: 39239 - DNA, 121 bp, Artificial Sequence
  Synthesized
  misc_feature (61): n=a or g
atttagtatgcactttataatcactatcactgatgtaaattcacatagtgccactctatcnaattcagcaagttacttaattacataagaaagtttggcccttgatgattcacattcaaag

SEQ ID NO: 39240 - DNA, 121 bp, Artificial Sequence
  Synthesized
  misc_feature (61): n=a or g
ccaagcagacatgcaactgcagtgtctttagcctttccctgtcctgtatttgcattttagntttcacattgttcacactgattcaatttctgcatagagtctgcatactgtaggagtacag

SEQ ID NO: 39241 - DNA, 121 bp, Artificial Sequence
  Synthesized
  misc_feature (61): n=t or c
gtgcctctgctcgtgtgaggctgtgagtaagcttaataaagaaaagtgaataaaatagcangttcatcaaggaacacttcccttcagatgctatctctgttctccccacccccaaggaagt

SEQ ID NO: 39242 - DNA, 121 bp, Artificial Sequence
  Synthesized
  misc_feature (61): n=a or g
gcagtcttccatggatcaggagttgcactcctcttccagcacctaccctaccttctggtanagctcctttaagtagcagcttctggaaagttatggagtgtcagaatactcaatcaggaaa

SEQ ID NO: 39243 - DNA, 121 bp, Artificial Sequence
  Synthesized
  misc_feature (61): n=a or g
agaaagttgtgactcaaaggattaattctaaatctatataaaacacaattagcaaagttcnttcagaagccataaagtaaaaatatatttatctgtgaaaactggtgtcccttccagtatg

SEQ ID NO: 39244 - DNA, 121 bp, Artificial Sequence
  Synthesized
  misc_feature (61): n=a or g
aatcgagctgtgcaagccattctgggatgaactgtaggagtagctttactgcatatagcantgttgcacagctgatctgcatcaggcaacttagaggaataaaatgtaattgcttaaatag

SEQ ID NO: 39245 - DNA, 121 bp, Artificial Sequence
  Synthesized
  misc_feature (61): n=a or g
ctatcttagaattcagaattattagcacgtgacattgtagattcttctacaaaattgactnaattaatcaaaacctttgcttgtccccagacctggacaaggtgaccactgtggatgcacc

SEQ ID NO: 39246 - DNA, 121 bp, Artificial Sequence
  Synthesized
  misc_feature (61): n=a or g
atctcagcactatcaactgcagttggtggtgctgagctctccttggatctggattcaaaangagccctttgaattcaccaggaaaggtaaataaaggcacagaaggtgcgctctgctcttc

SEQ ID NO: 39247 - DNA, 121 bp, Artificial Sequence
  Synthesized
  misc_feature (61): n=c or g
atagatgagagagttacattaggagaaataaatgcactacttgaaaaattaatttgtgagntctttatccttatccagcctcccttgaaggccttttgaaatgatcttgttccctaaaccc

SEQ ID NO: 39248 - DNA, 121 bp, Artificial Sequence
  Synthesized
  misc_feature (61): n=a or g
gctgtgggccataaaaccaggctgctttagtctgccaggattcttccagctggcactgaanggacccacacaacgcacccagcacctaacgcctgggctcctatgaaggagtcctgacact

SEQ ID NO: 39249 - DNA, 121 bp, Artificial Sequence
  Synthesized
  misc_feature (61): n=a or g
tgttggtgatttcagggtgttttgaacagtggaaggcagcaaagtaaatgtctgaagaatnctgatagcatgagacaggctctaaactcccatttgctccgatatctgcagttcgaatcaa

SEQ ID NO: 39250 - DNA, 121 bp, Artificial Sequence
  Synthesized
  misc_feature (61): n=a or g
aaacactctgggcttgcctacgtgtggtttttttgtgctgatctaacaaaactgaattggngttgcatcaacttaattaaatcatagcaaaagctactaatctaatccttaaatttggttt

SEQ ID NO: 39251 - DNA, 121 bp, Artificial Sequence
  Synthesized
  misc_feature (61): n=a or g
tcagtatctgcaaaatagctgcattgtggttcagtgaccacttctgctgtgttaatgctcngggagagcaacagcacttgtccttggctgccgctgggcgatgcgagctgcttgagaggtg

SEQ ID NO: 39252 - DNA, 121 bp, Artificial Sequence
  Synthesized
  misc_feature (61): n=t or c
tgttgggtactattgcccccccccagcagaaaaactgctttggaaaatacaccagcatgcntccaaaaatgctgccccattcagtgtgcatctctctgaagcattcttttaggctatttgc

SEQ ID NO: 39253 - DNA, 121 bp, Artificial Sequence
  Synthesized
  misc_feature (61): n=t or c
agtagcagaacatcaaatgaatagaaatgttgtctgccttgaaataagacacagaagtggnactgaaagtcagaagttagaaaggtaacaggaaatctctatgtcagtcactggagaaaaa

SEQ ID NO: 39254 - DNA, 121 bp, Artificial Sequence
  Synthesized
  misc_feature (61): n=a or c
ttattacttaaagcaatgacaagaactatgtacatattataaatatatagattaagatagngaatcttttatgtccattaatttccttgcctgaggacatacaacaaagctctgtaatgtc

SEQ ID NO: 39255 - DNA, 121 bp, Artificial Sequence
  Synthesized
  misc_feature (61): n=t or c
gcagagaggcagcctgtaccctatcactgccaggctgaaggcaaatactcaaaggatactncaaggataacaagcatagttaagctgttctttctataactgaaaaataaataagtaaata

SEQ ID NO: 39256 - DNA, 121 bp, Artificial Sequence
  Synthesized
  misc_feature (61): n=a or g
tcggttggcctggggacatggaggccaccagccctgggcatcctggggcaggcagatcctngtgctttctgccccatggacccttctgatctgagcgtggtaccggtgctaatgctctcca

SEQ ID NO: 39257 - DNA, 121 bp, Artificial Sequence
  Synthesized
  misc_feature (61): n=a or g
tactttcagaatgaaatacaaataagttctaaagccaacaccaaacaacaagctgctgcanagcagtatatattaaaagtaatgaaactaagctggaaagtgcaaacttcagtggaaaaat

SEQ ID NO: 39258 - DNA, 121 bp, Artificial Sequence
  Synthesized
  misc_feature (61): n=t or c
tggatgtgaaaaatcaaagctgttcctctccctttatttcttttcatgtgagtttccccanccccccagttcaaatgcagttggaacttgcagcctggaaacaggtaaccatctatataag

SEQ ID NO: 39259 - DNA, 121 bp, Artificial Sequence
  Synthesized
  misc_feature (61): n=t or c
attcaaaagtgtctgtctttcaatttcttttgcatttaattctgcaaattgtccttggctntgaacaggcaaaattctgccagtcataatcttgccaaatcagaccattactggactatga

SEQ ID NO: 39260 - DNA, 121 bp, Artificial Sequence
  Synthesized
  misc_feature (61): n=a or g
tctgtgacaaaatcactggtatatcttgagtaccagatgtttatcaagctgtttgcctaantattgacacccttcctctaatttgtctcttgacagtgatttgtcaaaagatgaattctta

SEQ ID NO: 39261 - DNA, 121 bp, Artificial Sequence
  Synthesized
  misc_feature (61): n=a or g
cacactcctggacagtgctaaagttgcagaatagtaagacagccttatttttgcccagtgncctgttctgcactggtgatgtttactgcttgccatggtatcatcccaattttgttctccc

SEQ ID NO: 39262 - DNA, 121 bp, Artificial Sequence
  Synthesized
  misc_feature (61): n=a or g
tggtgttactgaaataagcaggactgtggggtgtagaatcgaagagggagagactgctgcntcagcatccacaatgccatcatctaacctgaagaagctcaaacaaagaggagacagtgaa

SEQ ID NO: 39263 - DNA, 121 bp, Artificial Sequence
  Synthesized
  misc_feature (61): n=t or c
gctaaggacaactgactttgttattgactttttagctagagctaaaaatctgtggtaatangcatattcacattggagctcttgcacgtaaagggcaaagttgcagagatgacaagctgga

SEQ ID NO: 39264 - DNA, 121 bp, Artificial Sequence
  Synthesized
  misc_feature (61): n=a or g
tcagaaatacctcatgacctgcattctgtaggaaattccaactgaagatagaggaggagcngagcacggggcctgcctattttgattccccggcagcagtttctctccacaaccacggctc

SEQ ID NO: 39265 - DNA, 121 bp, Artificial Sequence
  Synthesized
  misc_feature (61): n=a or g
attgcgttaattaaaaggttgggtctgtagtctgctgtgtgggtgttacgccccgtcctcnatcggagtcggagcgctttgagtttggataacagcggcttggagaggcctaatcccttaa

SEQ ID NO: 39266 - DNA, 121 bp, Artificial Sequence
  Synthesized
  misc_feature (61): n=t or g
agcagcagtctgtacaaactgatctcatattccctggaataaaagcacaggctgcctgctncacaccattcagggaccataaagcagtcagaaagccaacttacttggttttcccaaggaa

SEQ ID NO: 39267 - DNA, 121 bp, Artificial Sequence
  Synthesized
  misc_feature (61): n=a or g
ggtgctgctgtactcagagtaattttgcagcattaaacccatcaattgcatacaaataacngagcagaagggatgggtacccaactgcaattagcagtggcctatccccagctctgagggt

SEQ ID NO: 39268 - DNA, 121 bp, Artificial Sequence
  Synthesized
  misc_feature (61): n=c or g
gtgcttttctcataggtgagcctatggagcagccaggaggagcacttagtgttatgggagnctcctatgctcttgtgtttgtgtataggtggatcactgcgaacacctcagaggttatttg

SEQ ID NO: 39269 - DNA, 121 bp, Artificial Sequence
  Synthesized
  misc_feature (61): n=t or c
tcattccttgggctcccaccattcattcaccaccggtgaggaaacacaaacatgtacagcntctccgtttaggaggatgtactgaaatgctgcgtgttaaatatgcagcaacagcgtgctg

SEQ ID NO: 39270 - DNA, 121 bp, Artificial Sequence
  Synthesized
  misc_feature (61): n=t or c
actacaagaattaccacacagaatgtcccagacatgccagttggtatctaggtcagagcanactttctgagctgaaaaagtaggtgaaacctacatgtgtgtaaaggcatgaaatgatagg

SEQ ID NO: 39271 - DNA, 121 bp, Artificial Sequence
  Synthesized
  misc_feature (61): n=t or c
tgccctgagaccaacgggaggaatgggacagagctctgcaagaatacctccattgagcagnacttctgccaatccaaattgagcagctctgcaggtaatgcccttctcaaggaaatcctcc

SEQ ID NO: 39272 - DNA, 121 bp, Artificial Sequence
  Synthesized
  misc_feature (61): n=t or c
ctccgtgctgctttaatcacaaaacccagcacctccacatccccgacgttataaacgcgangccagggctgtggctgagggtgactcgggatgttcccccgcattgcccaaccacaggtaa

SEQ ID NO: 39273 - DNA, 121 bp, Artificial Sequence
  Synthesized
  misc_feature (61): n=t or g
ttgggggaaaagtaacaacatcttaaaaataaatgtatgtgccacaatatttaatgtgagntaattcttgagttatttatctgtgcaacagcgatgtttgctaatttccgtgagcagataa

SEQ ID NO: 39274 - DNA, 121 bp, Artificial Sequence
  Synthesized
  misc_feature (61): n=t or g
gactagaactgccagaactgtgtcatgtgcaacatagctgggatttctgattatggtagtnaagcacaacaacagtaaatttaactgatccttttgaactatacaaaaatccagctttggg

SEQ ID NO: 39275 - DNA, 121 bp, Artificial Sequence
  Synthesized
  misc_feature (61): n=a or g
taatttttcccataccctgggacttcgagcaacccacaggagagctcaagccgtaccaacnttggtttctgtcttgcacagccactgcaaggcctcagctcccctcaggtatggagccagg

SEQ ID NO: 39276 - DNA, 121 bp, Artificial Sequence
  Synthesized
  misc_feature (61): n=a or g
aggctgtaggatttatttctttgaatggaagcataagctgggagagactgaatgctatccntgtggatggattgcttggtgatgtttttactcataaaatggaaagcttggtgtttgccgt

SEQ ID NO: 39277 - DNA, 121 bp, Artificial Sequence
  Synthesized
  misc_feature (61): n=t or c
ttatggagtgttgcttgggcagaatatattttttatcatctgatttcaaaattgttatgcnaaggcttactataaagcatattcttgcaaataaaatagtacggcatatctttaagggtgt

SEQ ID NO: 39278 - DNA, 121 bp, Artificial Sequence
  Synthesized
  misc_feature (61): n=t or c
ttcaaagccctttcacttcgttctggattcctaaagccccagttttcccgaaagatacagngtgtcctgcctgagggcataggtaccaataaatcaaaagtgtcatattgtcacatttcat

SEQ ID NO: 39279 - DNA, 121 bp, Artificial Sequence
  Synthesized
  misc_feature (61): n=a or t
tgaccatgaaatccaaatgtaaattgctgtacaaagtgcctcagatctcactgcttcctangccctgccgtcacttgtgaccacaagccttttcttcctctcctgttctgttgttccaccg

SEQ ID NO: 39280 - DNA, 121 bp, Artificial Sequence
  Synthesized
  misc_feature (61): n=a or t
agatttttttctttggtaatgagttttatgcttccttgtctatcattattaataatgaaantttcaacattacctgcaatacactgttcctttttccatcttcccttactacacaagatac

SEQ ID NO: 39281 - DNA, 121 bp, Artificial Sequence
  Synthesized
  misc_feature (61): n=a or c
atacacacagttgtaagagaattctaatttaatagatgacatttctatttttgagtaagtntgctgatctgcaaaacatcattttggtttcattttataatgggaacaacctaaacacaaa

SEQ ID NO: 39282 - DNA, 121 bp, Artificial Sequence
  Synthesized
  misc_feature (61): n=c or g
taagacgccttgctcctctccggttgtgctccagctcttccaacacacagccagcacccanagtgtcctgttattttccttatctcatttcctttcttcttgtcatggcatggatagtgtg

SEQ ID NO: 39283 - DNA, 121 bp, Artificial Sequence
  Synthesized
  misc_feature (61): n=a or g
gaatgtggttgtcttgtatagatatttcatctgttatattttgctgtgtttgcatccagtngtgtacaatttgaataagcctttacacataaacgggaccatgattcctaagagatctata

SEQ ID NO: 39284 - DNA, 121 bp, Artificial Sequence
  Synthesized
  misc_feature (61): n=a or g
cttgagcattgccagtctgcacatttgatttattaaaaatgaaagttttttttcatgagtntttttcttacatgacatcttgaccagcactattttcatagtgcagatacgaagtcagctc

SEQ ID NO: 39285 - DNA, 121 bp, Artificial Sequence
  Synthesized
  misc_feature (61): n=c or g
agaattaaaatcaattgtgaaatagttcagtgggacagacagagtccttacaggcctgtanaggttgcagaagtgaggaggcaatggttacttgctcttgtcgtgacattagtagaatgag

SEQ ID NO: 39286 - DNA, 121 bp, Artificial Sequence
  Synthesized
  misc_feature (61): n=a or g
gcggttccagatctctccacagatctggggatgaacatcttcaaaaaggtgagtggaaganaattttactttaatttacctatgattcagcatctgaatgtcctggtaagtagcagctgaa

SEQ ID NO: 39287 - DNA, 121 bp, Artificial Sequence
  Synthesized
  misc_feature (61): n=a or g
cagctcttgggcaactgtagtgtggctcatgtggtcactccgtacttactgacaaaagaanacagaggatattcagctaaaaggcactctaagtgcaaaaatcttttactgtaattgcagt

SEQ ID NO: 39288 - DNA, 121 bp, Artificial Sequence
  Synthesized
  misc_feature (61): n=a or g
gctagagctcaaggagagtatggacaatgctgccacatattaggatttgaattttgggtcntcctgtgtggagccaatggttagactcagtggtcctcaggggttccctccaactcagggt

SEQ ID NO: 39289 - DNA, 121 bp, Artificial Sequence
  Synthesized
  misc_feature (61): n=a or g
tataacgcaaaaatcgcgcacctccgaagcagctccgaattgccgcgtatcggcaatgttntagcaatccccgttgaggagccgctgggtttgtggaattaataagataaatgttgaaagc

SEQ ID NO: 39290 - DNA, 121 bp, Artificial Sequence
  Synthesized
  misc_feature (61): n=a or t
aagactgagttatttgaaatgggaaaataattcaaaatgcaaggggatgctttcagagtgnacagcaaatttttctataaacgcaagaccatgcacttaaatgagaaatatatatagttag

SEQ ID NO: 39291 - DNA, 121 bp, Artificial Sequence
  Synthesized
  misc_feature (61): n=a or c
taaacagcattccagaattgtattgagatgtagcattctttatttcagagagggaagcganaggaagaaaaaagaatgagaggcagagctcatgagaggtaattgggccagcacgtcaggg

SEQ ID NO: 39292 - DNA, 121 bp, Artificial Sequence
  Synthesized
  misc_feature (61): n=a or c
aactcagtttcacactttcttacatattggtattccattgtagtattagacaaggtatagnataataactatttagcacagcactgtataacaaaaataacatgttttgtacatatgccca

SEQ ID NO: 39293 - DNA, 121 bp, Artificial Sequence
  Synthesized
  misc_feature (61): n=t or c
gacactgactcatttccatgtgaggaatgggatcgaaagccttcaacagtggcactgcagnggggcagctcatgggcaaaaatgtacatgcagaggtaggccatgattaggtttggttcta

SEQ ID NO: 39294 - DNA, 121 bp, Artificial Sequence
  Synthesized
  misc_feature (61): n=c or g
aggcagatgcagtgctgttcctcataccaaacagccctttgcacaggttgtatcagaaatnccttgtgggagaggaaacgggtctccctgtgcgatttggagccatcaccacctacattgg

SEQ ID NO: 39295 - DNA, 121 bp, Artificial Sequence
  Synthesized
  misc_feature (61): n=a or g
aatcattttatgtgttccaatggacgttttattgtgcacctactgacagttctgcttcagnatgcaagacgaattgcactgttttttggtggttgtttttttttctgctgctgctttatgg

SEQ ID NO: 39296 - DNA, 121 bp, Artificial Sequence
  Synthesized
  misc_feature (61): n=t or c
ctgcaaagaaattctcctgtcaaccaggcaaatttaaaaataaatagttgcaattaaatgngctgctacattatttatgtagatgcatttaatttgcaaaaagctgctataaaatattccc

SEQ ID NO: 39297 - DNA, 121 bp, Artificial Sequence
  Synthesized
  misc_feature (61): n=t or c
cagctaagctcttgcagaagtccaaattgttacaagctttcatatgggaatatgaaagccnactacccagtatttttctgcataagtctaaaaagtgtctgcccttgaccttctgaaatga

SEQ ID NO: 39298 - DNA, 121 bp, Artificial Sequence
  Synthesized
  misc_feature (61): n=a or g
ttcaacttagtcctatatctggctggtagttatacgacatgcatacaatagggttaggatntgctgaatgcttcttacgttacagctgcaagagaagatgtgactcttcctgcattttgca

SEQ ID NO: 39299 - DNA, 121 bp, Artificial Sequence
  Synthesized
  misc_feature (61): n=t or c
caaatggacttttttgtcagggccctgacattgctaaatgcctaaatttccctgaccagcntcagctgaggactccaagaatataagggatattctgagatatactgttgcagcgtattct

SEQ ID NO: 39300 - DNA, 121 bp, Artificial Sequence
  Synthesized
  misc_feature (61): n=t or g
aataattacacgaggcacatgaacagggaggacatcgcttctctttcccaggagctgaccnccctgcgtatagcataacatgcacgctaggtttaaaattacaaaaacccaaccgagtccc

SEQ ID NO: 39301 - DNA, 121 bp, Artificial Sequence
  Synthesized
  misc_feature (61): n=t or c
atacaggaatgtatgcaggatattgaactaaattgtgagttgaaatttcttcattgctgangatgagcaccagtgaataattgtttgaaggcaagttatgatgacaccgatgcctttagta

SEQ ID NO: 39302 - DNA, 121 bp, Artificial Sequence
  Synthesized
  misc_feature (61): n=a or g
agaaagattccctcttagtagcccacagcccagtgaccacctccttccaagtacttctgcngtgtaaatgaataattgtggttaaaataacaatttcacagtagttaagacctttgtaggg

SEQ ID NO: 39303 - DNA, 121 bp, Artificial Sequence
  Synthesized
  misc_feature (61): n=t or g
atttattcatttatacagaggtcagtacaaaataaccaaattatgtcagaaagcactgttntacgtgatgggtatatatacgtatgtatatatttaacatataggcagctcagtacttctg

SEQ ID NO: 39304 - DNA, 121 bp, Artificial Sequence
  Synthesized
  misc_feature (61): n=a or g
tacgatggtcatattgccctgtatcagttgtgttctctagacaggaaaattgatctgtttntatacacaactttcccggctaattttggaagtactccaggtactgtatttttttgaactg

SEQ ID NO: 39305 - DNA, 121 bp, Artificial Sequence
  Synthesized
  misc_feature (61): n=t or g
tcttcagacaatccttaatgttttgaaacgctgtatgatgacataatgttttggaaacccnttaatatcttttaaaaacgatcacctgcagcctttccatcactgtggtttgtgctgcttg

SEQ ID NO: 39306 - DNA, 121 bp, Artificial Sequence
  Synthesized
  misc_feature (61): n=a or g
gcctttgtgtgactgtgacccagctcttgtgcatgttcaccagcccgcagagaagtgaggncacttgtgcgagggcctacacaagttgttgtgtgcctgggccttgcttaccggccaggct

SEQ ID NO: 39307 - DNA, 121 bp, Artificial Sequence
  Synthesized
  misc_feature (61): n=t or c
ggaagatgggtgtgaatgaaataagaatttggccaagaaaaagcactattaattcatgccngtacatgggctgtattcccatggaagtcagacagctcaatgggaatgccttgaggagacc

SEQ ID NO: 39308 - DNA, 121 bp, Artificial Sequence
  Synthesized
  misc_feature (61): n=a or c
cagaatgtgaacatccaccttgttttcttctcctgtggctccacactgcttaaaatctacnggttcgtaaggtttcctaaaggttcgtacaggttctcctttcagaagatttagctggatt

SEQ ID NO: 39309 - DNA, 121 bp, Artificial Sequence
  Synthesized
  misc_feature (61): n=t or c
ccagcttaataaaatgatggaagaaaatgacaaaccactgctgtatcttccaaaggaatgngttcagtgttttatggaacactgaagctaaaaggcaacacaaactgtgcacagcctactt

SEQ ID NO: 39310 - DNA, 121 bp, Artificial Sequence
  Synthesized
  misc_feature (61): n=a or g
ttattattttcatttagcacgtggcatcatcaatctatggtatcatacttgatctatctcntttgaaaagaattgtacatttagacaaattgtcaataactgtactgtgaaaatatatcag

SEQ ID NO: 39311 - DNA, 121 bp, Artificial Sequence
  Synthesized
  misc_feature (61): n=a or g
tacagtacacctttttttagcctagtgtcaaaatcaatatttagaatgcaatatatagaangctgtagggactgccatcacttttcaggtacaatttatgtttcaaagtcatcatctattt

SEQ ID NO: 39312 - DNA, 121 bp, Artificial Sequence
  Synthesized
  misc_feature (61): n=a or c
gtatcaccttaaactgactgggaaaagaatcaaggaaactctttagcctaaatacgaaagncaacaaatctaagaaaagcattaaaaactgtaattgaaaacatgatatgcacctttcaca

SEQ ID NO: 39313 - DNA, 121 bp, Artificial Sequence
  Synthesized
  misc_feature (61): n=a or t
tgtatacatgttatggcataaaatgagttatatgatttggtgaaagcttgaattgctctgnaaagatttctggttttaagtttgttacaaagtgatacttaagctgtgatgtgagcataca

SEQ ID NO: 39314 - DNA, 121 bp, Artificial Sequence
  Synthesized
  misc_feature (61): n=a or g
cctgctctgtttcctatgactttaaaggaggagaatgtgggctgagagcttccaccctgcncagacggcacagctgagctcagagctgcccagctgctgggccatgtgtgctggggcagac

SEQ ID NO: 39315 - DNA, 121 bp, Artificial Sequence
  Synthesized
  misc_feature (61): n=t or g
aatttaattcacttgtggacctccctgtgctctcctaatgctggaattcctggcattcctntttagtatggaataggatagcatcatctcagggcagagcctcccaggtgctttggagggg

SEQ ID NO: 39316 - DNA, 121 bp, Artificial Sequence
  Synthesized
  misc_feature (61): n=a or g
atttcatagtgagggtgtatttttataggataaatgcttgggaactaaagtgtgtggcctnagctgctttaagactaaacagagctttaagaagctttttagttgtttgtttctctattga

SEQ ID NO: 39317 - DNA, 121 bp, Artificial Sequence
  Synthesized
  misc_feature (61): n=t or c
agctgtaaaccagtaagtacaagtgaagtactcttcatctgtaagatacatcattactcangacaacgatacagacagcgttcgtatctgtggactatgaagcagtatatttgagatgcac

SEQ ID NO: 39318 - DNA, 121 bp, Artificial Sequence
  Synthesized
  misc_feature (61): n=a or c
gatctatgagatacgtctttcctttagatatcattagctacgtagatgggagagtacttcngaaatataaatgatatggctctttaaaaaaaaaaagtaatttagatcctgtatttaagtc

SEQ ID NO: 39319 - DNA, 121 bp, Artificial Sequence
  Synthesized
  misc_feature (61): n=a or g
ggaggatggatgaatctggaaaaaaaatccttcttaaattttactaaatccatttgactangcgagggttttacacctcaaggtagtgtagtactagacagtctgtggaacctctgtaatc

SEQ ID NO: 39320 - DNA, 121 bp, Artificial Sequence
  Synthesized
  misc_feature (61): n=a or g
ggaagaaatttagcaacagggtcaaaacaaaagcatctggcagtcctcttagttctcaganctataactcttatttattaagctgaaccttggaggaggggctctacttcattgagcatac

SEQ ID NO: 39321 - DNA, 121 bp, Artificial Sequence
  Synthesized
  misc_feature (61): n=a or g
atctgatggtacaaaatcttacactgcagacttgatggatttttagttcatagcaaaaaantctttgctaacaatttgtatttacttgggagaaagaggtcctggatgcactttttggata

SEQ ID NO: 39322 - DNA, 121 bp, Artificial Sequence
  Synthesized
  misc_feature (61): n=t or c
aggctactaagggctactaagatgatgtaggacttggagggtaatgtgtatgaggagcagnggaggtccctggcgtggctcagagcaaaggagctgagaggagacctgatggtggctgcag

SEQ ID NO: 39323 - DNA, 121 bp, Artificial Sequence
  Synthesized
  misc_feature (61): n=a or g
tgctcagttttttaaattccctacatttaaataaggtgtttttataccttttgatgctttntaacataaaagtgtggggggaaaaaatgatgcacctgaattgaataaagtttaagtttct

SEQ ID NO: 39324 - DNA, 121 bp, Artificial Sequence
  Synthesized
  misc_feature (61): n=t or c
tcggtgtcctgcaagagagatatgtggggcattatctcactttgccactctatgccattcnaaattggtaaatgggagtatgtttagttggaaggaaaaataaatctgtgaaaagggtggc

SEQ ID NO: 39325 - DNA, 121 bp, Artificial Sequence
  Synthesized
  misc_feature (61): n=a or g
ttttagcaatcaatgaatacatcaacttgtactgaagggtgatggtaaacttggctttgantttagtcagccacaaaagctaagtgccagaagggaattcctgacaaagcacacggatttg

SEQ ID NO: 39326 - DNA, 121 bp, Artificial Sequence
  Synthesized
  misc_feature (61): n=t or c
gtgtgaggttgaccttactttggcaatattccatcagggtaagtattatattttagactangaggattggacacaaataatgtgacatgaaatttagaaaaaaagaagtgtaagaaatgcc

SEQ ID NO: 39327 - DNA, 121 bp, Artificial Sequence
  Synthesized
  misc_feature (61): n=a or g
tggctcaccacatctgctgctgcctcatttaaccacccgcctgcaaaacaacagcttgccnggagcgttgcctggcggcactgtgccagcatggctccgtcctgcagggtcccccactgcg

SEQ ID NO: 39328 - DNA, 121 bp, Artificial Sequence
  Synthesized
  misc_feature (61): n=a or g
ctggatctctgtaaaggcaaagcttcattatttccaaagctttattagcatcaacgttttntaaagactacagaatttgatctgaaaagattcttcgaaaatctggcagcctgaatagaaa

SEQ ID NO: 39329 - DNA, 121 bp, Artificial Sequence
  Synthesized
  misc_feature (61): n=a or c
aggcatcctcagagtcacacagatccttcgtgtacacacaaacatgttgtgcacccacatngggaacctatgcatgacagcctgtgtgtaattgcatgctgcaggagcgtgcattccctgc

SEQ ID NO: 39330 - DNA, 121 bp, Artificial Sequence
  Synthesized
  misc_feature (61): n=t or c
atacatgaagtaagagcttgtcaagtatctctggcagcatataatatttctccataaatanttgctgcatatttgaattcaaatgtgtacaggttttaagaaacctaatcagccaatatag

SEQ ID NO: 39331 - DNA, 121 bp, Artificial Sequence
  Synthesized
  misc_feature (61): n=a or g
caatagtatttcctgcatacctgtatctacttaacatttgctggctcacgaccacaaacanttgatagaaaaagaaaggaaactccaagatcctgctctgcactgaaattttactgctatg

SEQ ID NO: 39332 - DNA, 121 bp, Artificial Sequence
  Synthesized
  misc_feature (61): n=a or g
atttttataaaccatgaactttctgctcttttttaaacaacagagaggtacttttttgtcnttgtttctgtgggtaatatttatgctagctgttttttagcagtatgtcttattttagcct

SEQ ID NO: 39333 - DNA, 121 bp, Artificial Sequence
  Synthesized
  misc_feature (61): n=a or g
gcagcatccccaccaacactccaagccccagtgctgtgcctgcctgggctttgttgtcaanaactgctcgctgatagagacagtgcacccacaaaggagttgtgagcagaaggacgtgcac

SEQ ID NO: 39334 - DNA, 121 bp, Artificial Sequence
  Synthesized
  misc_feature (61): n=t or c
aacggtgccgtttctgtgtccgtgtggggtttgcatttgggcactgctgcagctgtgttangttgagttctaatactgaacctccggaatggaactggtggggttggatgtggggctcccg

SEQ ID NO: 39335 - DNA, 121 bp, Artificial Sequence
  Synthesized
  misc_feature (61): n=a or t
gtttttgttaccatgcgttcatgtgatgaactaaatgagtcatgggcagatcgcagataanagcaatgacaccatcccagaccatccttcctccctgaacagactgtgggagtaatgaaaa

SEQ ID NO: 39336 - DNA, 121 bp, Artificial Sequence
  Synthesized
  misc_feature (61): n=a or c
atccagtgaagatcttaatagtgatacagaaagtacattcagaggctacttgggcatagcnatattctcaagaggtacagtatctggacattttccccagcacaagaatgatgcggagcta

SEQ ID NO: 39337 - DNA, 121 bp, Artificial Sequence
  Synthesized
  misc_feature (61): n=t or c
atttttaaagccttcgcacataaattttcttgatgtatgatgcaatgatatttcatcaaangtggcctgttggtggtaattgcatcttttttaccaaccatcactgagacatcatcagtag

SEQ ID NO: 39338 - DNA, 121 bp, Artificial Sequence
  Synthesized
  misc_feature (61): n=c or g
tgctcttcacatcaaacaagtcacttttgctttgcaagtgtttgctattcttctgatgcantaagtcacaaaagcatcaacagaaaacatttcaaacatattagtcatgcgcttttcagac

SEQ ID NO: 39339 - DNA, 121 bp, Artificial Sequence
  Synthesized
  misc_feature (61): n=t or c
gaagaaagaaagggtagcacacagatgacatccagccacccaaccaatccaccagaccacncaaccaatccaccagattattcatattcttgtgttataaagaagtccaagaaaatatgat

SEQ ID NO: 39340 - DNA, 121 bp, Artificial Sequence
  Synthesized
  misc_feature (61): n=a or c
ttctgtgagagggaagcagagttaggaagagcctcagctgctctcctggcccttccatacncagttcctatgaaacacactttcctttaaaggccaacatccaggctctgagaaagctggc

SEQ ID NO: 39341 - DNA, 121 bp, Artificial Sequence
  Synthesized
  misc_feature (61): n=c or g
tagtactcataagtagctatcagtgggactgctttctcacttgcatcacattttagaatancatggagaaacagatttccatgcgaatttatcagtagaagcactagcagtgtggagtgga

SEQ ID NO: 39342 - DNA, 121 bp, Artificial Sequence
  Synthesized
  misc_feature (61): n=a or g
agcaatgaatgcacagatttaggagacacaccaagagaaagctgcctttggatgagaagcngtggaaattgcctctacataagcagaggaagaagccaccttctagatacactaacagtat

SEQ ID NO: 39343 - DNA, 121 bp, Artificial Sequence
  Synthesized
  misc_feature (61): n=c or g
taatattttatgaaatttactgtacactcagtaagaacaaaactagaaagggatggggaantcaagagactatttcagcactttccgcatgaaacaagccttccctctgcactgcttttaa

SEQ ID NO: 39344 - DNA, 121 bp, Artificial Sequence
  Synthesized
  misc_feature (61): n=a or g
attctttcacatattctgctgactagtttgacttcttgcattttatctgtccactctcttnggagcagcaatgacaaaagctcagaaaatttgtgccgagaaaataaacatacatcctcag

SEQ ID NO: 39345 - DNA, 121 bp, Artificial Sequence
  Synthesized
  misc_feature (61): n=t or c
actatttgcctgtcctgttcttaatctcttcttagatatcccctgtaggtcatgatggaanatgttgtgaagctaactggactagtgagctgattctggagtattctactctactggtctt

SEQ ID NO: 39346 - DNA, 121 bp, Artificial Sequence
  Synthesized
  misc_feature (61): n=a or c
gactgttcttttgagcggtcagtttccaaacagcactcttttatacttctaagcttcaggnagcattttcaaagacagaaatgacatgtggacactgtctataattacctagaatacagac

SEQ ID NO: 39347 - DNA, 121 bp, Artificial Sequence
  Synthesized
  misc_feature (61): n=t or c
ctttgtgaacatacagtggcttcttccagcacacaactactgtttccacttgctttgcttncatatatattgctgtctagctgaagcatctttatttcagcttcaacattcaggctgtccc

SEQ ID NO: 39348 - DNA, 121 bp, Artificial Sequence
  Synthesized
  misc_feature (61): n=a or g
ttgtacccattggcaggtgacagtttccaggactgcatcattaccagtgacaagacatatntgagtcaaagccaaatggcaattcatagcatagttacatgtgaattccccatagaaaaaa

SEQ ID NO: 39349 - DNA, 121 bp, Artificial Sequence
  Synthesized
  misc_feature (61): n=a or t
gagaatgattaaatgtatgagtacatgtgggtatgtaacggcaccttctgcttttaatgantcagagaataaggaggcagaaatgcatgctttacaggagaaaatgcatgcaggcatgcat

SEQ ID NO: 39350 - DNA, 121 bp, Artificial Sequence
  Synthesized
  misc_feature (61): n=t or c
agatgagatcagttcaccaggtccacgtcaatcaaaaagtcaatagttgttgcagaaaganagcaatgcaatttaagctgactcgctcttagtggaggaagatcaaaccaccccacaacta

SEQ ID NO: 39351 - DNA, 121 bp, Artificial Sequence
  Synthesized
  misc_feature (61): n=c or g
tctgtgttgggatgctaataataattcctcatggaaggagcatgtatggccacttgaaagncaatgctggtataaagaggttcaggacacccccaccgtgctccaccctgatcctcccctt

SEQ ID NO: 39352 - DNA, 121 bp, Artificial Sequence
  Synthesized
  misc_feature (61): n=c or g
tctgaaactgacccagctcagctgcaaaatatttctaattcgtaagaaatacattgtctgncccttctgagctctagtgtacattatgatcagtttgcacaaattctcagtctcaaaatac

SEQ ID NO: 39353 - DNA, 121 bp, Artificial Sequence
  Synthesized
  misc_feature (61): n=t or g
tcagataaagttggcacttactgcataattaggtacttgagggtgttcctgtgtgtacagngttctctgcatcctcattattaatcagttactgtatatatcaccttttgagtatctaaca

SEQ ID NO: 39354 - DNA, 121 bp, Artificial Sequence
  Synthesized
  misc_feature (61): n=a or c
cttaatttttcttgcaaatttagacaatcactgtcatcgtgaaatgaagaggaatattccnaaaagaaatacaaactgaaactgccaagaaattggtacgaacaacaagatcttttgattg

SEQ ID NO: 39355 - DNA, 121 bp, Artificial Sequence
  Synthesized
  misc_feature (61): n=a or t
tcttacaaacagtaaaaaactgtgtggtatgttaaaagtggctacgcacgccagattatcnttcccctttttgctaagtagaaaagatatctttttagtaagaattttactagtgttttat

SEQ ID NO: 39356 - DNA, 121 bp, Artificial Sequence
  Synthesized
  misc_feature (61): n=a or t
gctctgatatgcactgcaaaaatgattgatatatccagtacttgtatttaaggtgaagtancctctgcaagcctgaaattgccgaggcccttagttgaaatgcttttctattgtgatgctg

SEQ ID NO: 39357 - DNA, 121 bp, Artificial Sequence
  Synthesized
  misc_feature (61): n=a or g
ttgaccctgatacgagtgatatgtcatcttttgcaagattttcagcatcaggatggcactnaagagtacagacatgaattccatatatttctagtacgagatcatactttgtataacaaca

SEQ ID NO: 39358 - DNA, 121 bp, Artificial Sequence
  Synthesized
  misc_feature (61): n=a or g
agtgactggccactgcaattcaggaacagtttagagttagcctcttctagcaaacacaacntgaattctattataagagtttctgcttggccataaagcaaaggatgagttcatatctgtt

SEQ ID NO: 39359 - DNA, 121 bp, Artificial Sequence
  Synthesized
  misc_feature (61): n=t or c
ctgatagatgctctcagctgtgtatccattactgcagcttggtgtcagaatcaatacatgngcctaagtgagatttgtgcaggtgctgcgttctggactcagagctcagtactggtactta

SEQ ID NO: 39360 - DNA, 121 bp, Artificial Sequence
  Synthesized
  misc_feature (61): n=a or g
ttgtgtataaggttcatcttgcttgtggatatgcccttttcaatttgcttcctagtgtgtnatcccaaatttaaaagcatgagtttgattgaaaactaaatgtttagattttttagtcaaa

SEQ ID NO: 39361 - DNA, 121 bp, Artificial Sequence
  Synthesized
  misc_feature (61): n=a or c
gtaagctttagagaggaagggatttacatggtgagcaaagctccacttgggagctggctcngagcagctctaagagtggctttcagacttttcaaaaagtattctctctttcccgctgtga

SEQ ID NO: 39362 - DNA, 121 bp, Artificial Sequence
  Synthesized
  misc_feature (61): n=t or c
cagaggcgtaaccctgccctaaacaaacatagctgtggtcctgttactgctctgtgcacangtctgcaggtccatagcacttgtgcctggagctggaatgtctcagtgggcttcaaagagg

SEQ ID NO: 39363 - DNA, 121 bp, Artificial Sequence
  Synthesized
  misc_feature (61): n=t or c
ggctaatattttttctggctgatcacctatcgatcctcccgtgtctcctacattcattttntgctgataggcaacagcactcactcctgtcacacctggcctaggagacatggaatggaaa

SEQ ID NO: 39364 - DNA, 121 bp, Artificial Sequence
  Synthesized
  misc_feature (61): n=t or c
tgccaggagtaggaggctttacagaacaaatcacattgttgcatcttgaggttcattaacnaaagctgatgtgcaaattaattcaaaagttagcttccactctttttttctcctttttctt

SEQ ID NO: 39365 - DNA, 121 bp, Artificial Sequence
  Synthesized
  misc_feature (61): n=t or c
tgggctctctatcaggcttatggatgggaagaaaaatcagccattgggcccaatagtgcanaaaagctgagtgccctccactgtcaaaccaatgaccatttgactgcactcttcaaccctc

SEQ ID NO: 39366 - DNA, 121 bp, Artificial Sequence
  Synthesized
  misc_feature (61): n=c or g
ccttcatttttgccaactgggaatctttatgaatattcaattttagcagcgcttcaacaanagtacaaatatctcaagggttttatattgatcttctccaaacgttcgtattttggtttat

SEQ ID NO: 39367 - DNA, 121 bp, Artificial Sequence
  Synthesized
  misc_feature (61): n=t or c
acttgcaattttatgtatgtgctcaccctttgtcgtttgacatgctgataatagtggattntcctgtatagtatataggaaatattttggataatgtgggcatactgaagcagaagttatt

SEQ ID NO: 39368 - DNA, 121 bp, Artificial Sequence
  Synthesized
  misc_feature (61): n=t or c
atatcagcaaacaactatgaggaaaacagaaaacattcttcaaagaacagacttttttttnccctaatgcctgccctgattaattataagctgaaaggaatacttgatgtctggtttgtat

SEQ ID NO: 39369 - DNA, 121 bp, Artificial Sequence
  Synthesized
  misc_feature (61): n=c or g
ttcagtttgcgtgaggctctgtgaccgagctgctctgtctacttccaatttttgttcatcnccacgtgtgacttagctcagtgagtaactgtggattcagaagggttaagaagagggctta

SEQ ID NO: 39370 - DNA, 121 bp, Artificial Sequence
  Synthesized
  misc_feature (61): n=t or c
tgaatgcctgtgctgtccacagcaatcagactctgccatgggaaacagtcctgcattctgnctgcaggtgggcagacccagattcagcacagtgggtccgtaacatcccatgctttgaggg

SEQ ID NO: 39371 - DNA, 121 bp, Artificial Sequence
  Synthesized
  misc_feature (61): n=t or c
gagtagttcagccctttccccacatctggtaaggctgctgtggtgaatccatcccgtatgngtggttagagctaattcacatacgtgacaggtctccagtctttgctggaagcattcacca

SEQ ID NO: 39372 - DNA, 121 bp, Artificial Sequence
  Synthesized
  misc_feature (61): n=a or g
gcatggtcccactccttggggagcaggactgcctacccataacattaccaaatgaatactncccctaaaaatgaacagcaagcagaagtcacctctcattcacttttgttggagaactgat

SEQ ID NO: 39373 - DNA, 121 bp, Artificial Sequence
  Synthesized
  misc_feature (61): n=t or g
cttattggcataaaagatcagcagctcacatatccttaaaagtggcacactatgtcatagntggcacactacagtgctccaaggatatgtttcactcatgtcacggtgtgatgctattgta

SEQ ID NO: 39374 - DNA, 121 bp, Artificial Sequence
  Synthesized
  misc_feature (61): n=a or g
gctttaggtcagcttcaactataattcatgagcaagtaatctaaatttcagagagcaaggnagggagagagattttattgtagctgcatgaaaaagaggaattaaaaaaagacaacacagc

SEQ ID NO: 39375 - DNA, 121 bp, Artificial Sequence
  Synthesized
  misc_feature (61): n=t or c
cctccttccttcaagtggagttcctcttcatggtcaacccaattgagctgaacctgagcangttcatctagagaagtgagcagaaaccagggcaggagctgagatgcaaagggcagtaggg

SEQ ID NO: 39376 - DNA, 121 bp, Artificial Sequence
  Synthesized
  misc_feature (61): n=t or g
agctatttttgtacttcctttttacagaaggagaacgtgcacacttccaactcaaccatancaaccccaacggccttctgaagatctcccatttgggaacaggagtgccagccctgctgac

SEQ ID NO: 39377 - DNA, 121 bp, Artificial Sequence
  Synthesized
  misc_feature (61): n=c or g
taaggacagaagatgctgaaaatgtataagaaacccagaacacaatctgtttggaaggcantgactgcagcacttagatccaggtgaagatggagcagagtccagtaatgagccattatca

SEQ ID NO: 39378 - DNA, 121 bp, Artificial Sequence
  Synthesized
  misc_feature (61): n=a or t
gttacacaatcctttcaaatagacaaattagctttcctaagttgcattttgcactaggtcntctgatcctttttttagtcaaagaatagttaaatggcataatctactcaaaagtttttat

SEQ ID NO: 39379 - DNA, 121 bp, Artificial Sequence
  Synthesized
  misc_feature (61): n=a or t
tgctgactttgtcaaatgtggcttaacttcagtgaacttcagctataatgtgcaatacatngaatgactgcgattacagtcattccatattcctagaaagacagtttaagaaacaacacag

SEQ ID NO: 39380 - DNA, 121 bp, Artificial Sequence
  Synthesized
  misc_feature (61): n=a or t
ggtacgctcaagggaaatgataaccttaatgtaacaacagctgactcaaaaataaggtcantcaatgtatttggtaaggtggcagattttccacgttgttcccaatccgtaactgagatct

SEQ ID NO: 39381 - DNA, 121 bp, Artificial Sequence
  Synthesized
  misc_feature (61): n=t or c
ggggctgcttggggagctgtggggcagggcagggtgctccactgtgctgctgtcaggtggntgctgcatcttttctaattaaaataaaatcatcctaggattcgtgaaatgaatacttggt

SEQ ID NO: 39382 - DNA, 121 bp, Artificial Sequence
  Synthesized
  misc_feature (61): n=t or c
aaagaaaaaaactggacagtgaagatactctgatctaaagaattagttagtggaatgtcanctacagcaaatggaaaaaatatctattggttggaacaactaaaagcagtttgtgctgctc

SEQ ID NO: 39383 - DNA, 121 bp, Artificial Sequence
  Synthesized
  misc_feature (61): n=a or t
aaacaaaagtattgtttcttactccgatatcactaaacccaacgctctaaattctcttgantaaaaagagctacatcttgcttttatgactccttatgaaactcatccaaagtcatgattt

SEQ ID NO: 39384 - DNA, 121 bp, Artificial Sequence
  Synthesized
  misc_feature (61): n=a or g
ccaacttgggatatgctatgattctatgacttttgggacgtcatgaaattaagcagaggtntagagacctctggaatacgacactgctgaaaggttcattaaagactggaaggtggaggca

SEQ ID NO: 39385 - DNA, 121 bp, Artificial Sequence
  Synthesized
  misc_feature (61): n=a or c
gaggctgctcaaagcaaaaaattagatgaaagtacgtcattgcagttccttggttataaanttatgaaatcaaagtggtagagacctttcagcaaggtcctcttaattcctttggtagagt

SEQ ID NO: 39386 - DNA, 121 bp, Artificial Sequence
  Synthesized
  misc_feature (61): n=a or g
aaaggaaaggatcagtcttagaaagaatgggaaattcacagcagatgctgccaccctcccnaaaaccccaactcagagaatccaaaggatacatttttctgatccaatatttactgctgtc

SEQ ID NO: 39387 - DNA, 121 bp, Artificial Sequence
  Synthesized
  misc_feature (61): n=t or c
aggcatttcccaattcttttccatgtacagatagtaactgtagttatcaatgcgatattgnggcacaaaaatattacagaagacaataaattaaagctactgaatgccttgcaactaaata

SEQ ID NO: 39388 - DNA, 121 bp, Artificial Sequence
  Synthesized
  misc_feature (61): n=t or c
tcaaaagttaggctatggtatacaaggttgcatatcagaacttaattcagtttgcttgtgntcatgatttacaaccaatagtacgtgaagatcactccatattttttttttttccccacag

SEQ ID NO: 39389 - DNA, 121 bp, Artificial Sequence
  Synthesized
  misc_feature (61): n=t or c
aattcagcctttgagcagaataaggcaggcaagtttacatcaaagctctgtttcatcgtcnttagaccaatctgttggaaaagacagctggtccttattaaacaccctttaaatgttgcag

SEQ ID NO: 39390 - DNA, 121 bp, Artificial Sequence
  Synthesized
  misc_feature (61): n=t or g
ggtgtggctgaggaaggcaaagtggctgttgtccttccaaagaaacagactggccataccntgattcgtgctgacgtcgtgccctacgtcccaccggcctgggagcggggctgtgggaagt

SEQ ID NO: 39391 - DNA, 121 bp, Artificial Sequence
  Synthesized
  misc_feature (61): n=t or c
cacaaaagacataggctttctagaaatatttgtaaataatgacacccagaagaaatttctngtaagaggagacaaaatctgacttgagagctcataagagactcagtgagatgcttatgga

SEQ ID NO: 39392 - DNA, 121 bp, Artificial Sequence
  Synthesized
  misc_feature (61): n=a or c
gtgagctgttcctaaaattgataaatgagcaatagtcagatcaggagacattgtttgtganagtgcagtatgatgtgatgctgggagcaggagagccaatagtgggctgtgggctggaggt

SEQ ID NO: 39393 - DNA, 121 bp, Artificial Sequence
  Synthesized
  misc_feature (61): n=a or g
gaaggtcctggagtaaagcattcatttccacatccccttcctttgggatatgcacgaaggnaacacatctccggctctttttgaagaatcggagcccatcaccaatgggatccagatgttt

SEQ ID NO: 39394 - DNA, 121 bp, Artificial Sequence
  Synthesized
  misc_feature (61): n=c or g
tgtttaatgaacattcttaagcaggagcacagcagtggatgcagtctttaaaaagcttagnagactgataaatgtttttctttagaaaaatacatcatatattactgcttctttaaactgt

SEQ ID NO: 39395 - DNA, 121 bp, Artificial Sequence
  Synthesized
  misc_feature (61): n=t or c
atttgacagtgagtcttttctgccagtgtatgataatcagcagactggagtatgtcctaancagaatgctaggtattgttttgtattattctgtcattgaatatagctttagtgtggtttt

SEQ ID NO: 39396 - DNA, 121 bp, Artificial Sequence
  Synthesized
  misc_feature (61): n=t or c
ggtgcttttctggatgcagcacttggggcgcaccactgcttctgcccagaagtttgcgttncagggcatttatagcaaaacgtgactgtgtaaacttctgtaattttttgcctttcccact

SEQ ID NO: 39397 - DNA, 121 bp, Artificial Sequence
  Synthesized
  misc_feature (61): n=a or g
ccagtggttttatgtctgcagtatgcggatggcaacgagaatattcacacagaattcactngattatgcaatctattctacactcagggtgacatcacatcaatagtaaggataatatgtg

SEQ ID NO: 39398 - DNA, 121 bp, Artificial Sequence
  Synthesized
  misc_feature (61): n=a or g
ccacattgagggctaaatagagctcctatttgaatctctcagctgtggctctggcatgctntagcagtgccatttctgctcacatccgagctctgcacacagtataaaagcagttttaaaa

SEQ ID NO: 39399 - DNA, 121 bp, Artificial Sequence
  Synthesized
  misc_feature (61): n=t or c
caggttatctctaggaaggagtgatattgctacctcctcctgagatcataacaacactctnactttgaactttgactcagttttgctcctgactgcaagtaattaaattagacagctggct

SEQ ID NO: 39400 - DNA, 121 bp, Artificial Sequence
  Synthesized
  misc_feature (61): n=t or c
accctttgctttctcagtgtgtccttcagtgaaattgaatgttcataagcagcttctcaanattagcctttttttctataggctgtctacaaggaaagcagttgaagtataacgttgaata

SEQ ID NO: 39401 - DNA, 121 bp, Artificial Sequence
  Synthesized
  misc_feature (61): n=a or g
agcacccttgggaggtccaggggcgtttgctgaacaccttctgtggcccattttgtgctcnttgagtggggaggtttggaacccatcgccttgcagttctgttctgctcagtcctctcctg

SEQ ID NO: 39402 - DNA, 121 bp, Artificial Sequence
  Synthesized
  misc_feature (61): n=t or c
aggaacctgaagtgacacttgtgccactaaaatgtctcctccagaccttggccgggatccngtggtcactgggaagcaggtgatggagatcaagcacactctgaaggaagcccgttccctg

SEQ ID NO: 39403 - DNA, 121 bp, Artificial Sequence
  Synthesized
  misc_feature (61): n=a or g
gtcagcttaaactgggtgtgatgggaagaaaaaaggtgctaccaaaccccactgactgatnaaaattgaaacttctcatgggaacacagagacctggacctgacttctatcagtttcaaaa

SEQ ID NO: 39404 - DNA, 121 bp, Artificial Sequence
  Synthesized
  misc_feature (61): n=t or c
ctggataatcaaatcgtgtaagtaaaagaacaggtaagtaactctatgacgttgttttatnccatgttagaataagctcccattgatgatgagctctaacttcatatgcacttcaaaatct

SEQ ID NO: 39405 - DNA, 121 bp, Artificial Sequence
  Synthesized
  misc_feature (61): n=t or c
agctgttttaattttgaaactgtcatcccttaatgaagtgcagagcttctgggatgaaaanagatcaaaaagaggacttgagaatttaagatctcctcatacaagcactatgacgtaccat

SEQ ID NO: 39406 - DNA, 121 bp, Artificial Sequence
  Synthesized
  misc_feature (61): n=a or g
caccgtcgtatcaatgactgacacagaggggaccttctaaggaagggaacacagccagagnatgccaaacacatacctccagcttgtcgatcctcctgtatatctgcctcatctctgtagc

SEQ ID NO: 39407 - DNA, 121 bp, Artificial Sequence
  Synthesized
  misc_feature (61): n=a or g
gcaccgaaagatgccctgatcagttagttattcttctctcacactgttttgtgctggtctnacatcaatgtgttaatccattaagtcagatcaggaaactgatctgcccaaagaatatttt

SEQ ID NO: 39408 - DNA, 121 bp, Artificial Sequence
  Synthesized
  misc_feature (61): n=c or g
tgtgctctcctcccagatgacttcagtatggaggagggagcacgcattacacctcccacantttgggtccaccttcctacgtgctcatacgcagggtcattttcaagtgcacagcttcaca

SEQ ID NO: 39409 - DNA, 121 bp, Artificial Sequence
  Synthesized
  misc_feature (61): n=t or c
gctatatacagggtagatatggtacaggactcaaaggggaggtatgtggccatggaccaanactgtaaacccaagtgacactaaccaactgtgttaaggtaactgacttctaatacggagt

SEQ ID NO: 39410 - DNA, 121 bp, Artificial Sequence
  Synthesized
  misc_feature (61): n=t or c
ctggctcagcaagttctttctctttggtgtatggtgccaagcttagtgctaatttttgagntgtctgttctcagtgcaagagaaaaatgagattaagattttgctgtgttacaatattatg

SEQ ID NO: 39411 - DNA, 121 bp, Artificial Sequence
  Synthesized
  misc_feature (61): n=a or c
gtggtgctaggatcgacctcaccaggaggacactaggactggcttctctagatggtggcantaggatggcctctctggacggtggcactgggatggcctcgacgtgtgatggcagcaggat

SEQ ID NO: 39412 - DNA, 121 bp, Artificial Sequence
  Synthesized
  misc_feature (61): n=t or c
agaggggtgtgagctcccaaaccccttctggtgacaggataggtttctgagtatttcaccncacgttttggctatgcatggaaaactgtgattttgtctgaaggtaaaacctgtttgttct

SEQ ID NO: 39413 - DNA, 121 bp, Artificial Sequence
  Synthesized
  misc_feature (61): n=t or c
tttgaagacataataaattagaggactagttgacagctcttcaaaattgtggcttgccgangttcaacgagttgaaatacactcccagttaagaattcagatgagggaagcttgctttaga

SEQ ID NO: 39414 - DNA, 121 bp, Artificial Sequence
  Synthesized
  misc_feature (61): n=c or g
ctgcagactcaaaactctaactttgagaaaattatttatttgaacacttatttgagtgcanacaatccttactttcaggcctaatgcaattctgaagagtctgctagatcccactcctggg

SEQ ID NO: 39415 - DNA, 121 bp, Artificial Sequence
  Synthesized
  misc_feature (61): n=a or g
atctgcactatgcctctttgccttttaatgaatcaactgactagcacttattttaaaaacnggtcatatttagagacatttttcaaagagcaccagtttgataagagtgcaggactgggtt

SEQ ID NO: 39416 - DNA, 121 bp, Artificial Sequence
  Synthesized
  misc_feature (61): n=a or g
atgggactactacttcatggtgtgcttgtgcttttcttcagcatatttatttttcagctcnattattaccttcattttattgtatcagtaggtttcagcagggcaggagtttattttcccc

SEQ ID NO: 39417 - DNA, 121 bp, Artificial Sequence
  Synthesized
  misc_feature (61): n=t or c
ccttgtgtgagggtagagggaatgaaggtgagagaacaccgctctctgcattctttctccntttatgggagctaagcagaagtcaggtttgagtaaatgtatgtacattacaccatggcag

SEQ ID NO: 39418 - DNA, 121 bp, Artificial Sequence
  Synthesized
  misc_feature (61): n=t or g
tgacaatatgtaagggctaatggcttaatgaatctctttttccagtgatgtatctctaaanagactgttaaatcctaggctaggttttcttttgaaggaacacttggaatcaggtatctgc

SEQ ID NO: 39419 - DNA, 121 bp, Artificial Sequence
  Synthesized
  misc_feature (61): n=a or g
tggagtggtggacaatagagagagattagttatctcttcaccctatttcagatttctgacngtcaaaagtaatttctacctgtcagccagcaagtgcagctcagttcctggcacagcacaa

SEQ ID NO: 39420 - DNA, 121 bp, Artificial Sequence
  Synthesized
  misc_feature (61): n=a or g
gaactggccactggaattacatttcgtccaaccccagtgtttaaagcagggtcattgcaanaggttgctcagttctttgtccagttgggatttgagtattgctaaggacagggaatctacc

SEQ ID NO: 39421 - DNA, 121 bp, Artificial Sequence
  Synthesized
  misc_feature (61): n=t or c
gcacagttgagctcagaatagtagttttcagagtagcctcagactgggcctgttgctttgntggccaacttttcaacagtagcctgttgaatttgttcctttagttaggctgaaatgccta

SEQ ID NO: 39422 - DNA, 121 bp, Artificial Sequence
  Synthesized
  misc_feature (61): n=a or g
tgcaaactacatagactaatactgtagaaagccatgagcgtgggctttgtttctgctgctngtctagcatatgaaaaggagaggtttattgaaggtcattatattaaatgggtaagtaatt

SEQ ID NO: 39423 - DNA, 121 bp, Artificial Sequence
  Synthesized
  misc_feature (61): n=a or c
tctgtatttagcaccataactcatcttttactagatcagtccgatgtattacactaataantttcaaccgtttaaaatattcctctttcatgccttacagatttttggaaccaaaagaaaa

SEQ ID NO: 39424 - DNA, 121 bp, Artificial Sequence
  Synthesized
  misc_feature (61): n=t or c
aaagtaaaagatgaggtaaatggatttgcttgaaaagtaatgctaaagttagtgatttctnaaataaaacatccagccaccacatgctgaaaaaaagtaaaaagctgtagttctggagagg

SEQ ID NO: 39425 - DNA, 121 bp, Artificial Sequence
  Synthesized
  misc_feature (61): n=t or c
tttgatttcctaattttaaaattatatgttcaatatcgggatctggtccattcttattttnatgctctataatttttgtccaaaaggatggcatctagaggctcagatgaaatactacaag

SEQ ID NO: 39426 - DNA, 121 bp, Artificial Sequence
  Synthesized
  misc_feature (61): n=a or g
gataggcaaaggtaatcacgtcaggtgcaggtaagcaatcttcagagccttgggaccgccnctctgactgatgcaaagcatccggcgaggccggagtcctggctctgaagaagagacaaac

SEQ ID NO: 39427 - DNA, 121 bp, Artificial Sequence
  Synthesized
  misc_feature (61): n=a or c
ctgtatgcagctcagagctacatgtgccaccccatacagcaagttggacacggggtcagcncagcccatatgtgaccaacgtgcatgtggggacctgtgtatcacctccatgccccaagca

SEQ ID NO: 39428 - DNA, 121 bp, Artificial Sequence
  Synthesized
  misc_feature (61): n=t or c
caagtagaggattaggtcttattctcatggggtttaactaggcaaatgttaaaaggtctgncttcaataacaatatccttaggaccaatattaaaatgctttcctgagctggtccatgtgg

SEQ ID NO: 39429 - DNA, 121 bp, Artificial Sequence
  Synthesized
  misc_feature (61): n=a or g
gacccttcttgtgctagaggatgagccttcccatgttggaagaagagcttcagatcatgcnttgggtgaaacctgagtggacgtgcagcaccccataccctccccacctccaaacccacat

SEQ ID NO: 39430 - DNA, 121 bp, Artificial Sequence
  Synthesized
  misc_feature (61): n=a or g
agaaacatggggtggcagggaaagtttcacttaaatatacttcaatttatactcacttaanaataagtacacgcagtccatgttcatatcctaaggacttgccacagctgatcaaatactt

SEQ ID NO: 39431 - DNA, 121 bp, Artificial Sequence
  Synthesized
  misc_feature (61): n=t or c
cccccttgcttgccctgttggtgagcaatgaggccaatgcctcctcctgacagcctcctcnccactgaggctgccaatggaaacctggcaaaggatacgcttcttgtctaagggatcagaa

SEQ ID NO: 39432 - DNA, 121 bp, Artificial Sequence
  Synthesized
  misc_feature (61): n=t or c
tacatcccctgaaaacaagcagaaaggtaattaatacttgtgagaaaaaaatattgtttgnatgataacacagtaagtatgagtgtttgtttcagtttaagaatggtaacatttcggatgt

SEQ ID NO: 39433 - DNA, 121 bp, Artificial Sequence
  Synthesized
  misc_feature (61): n=t or c
tgagcggacagccaccagacaggatggttttattgcatggttgtttgttcagctgacaganggggctgtgcttggatgctgcatcactgagaacacgtagcagggcggaatatgtggtata

SEQ ID NO: 39434 - DNA, 121 bp, Artificial Sequence
  Synthesized
  misc_feature (61): n=a or g
aaggaaatggaaaattttgcagattgttctttcaacgagcttcagaaaactcttaggtgancaatctaatagagaaatctgctggaattaagattcagctttatagcgaaggatcttgact

SEQ ID NO: 39435 - DNA, 121 bp, Artificial Sequence
  Synthesized
  misc_feature (61): n=a or g
taagaaaccaacaatatgaaatcaaatttcataactcagtcctaaggattatgaccatcantagccagctgctagtaggagtgctggttctgcttcttccccagacttccaagggatgctg

SEQ ID NO: 39436 - DNA, 121 bp, Artificial Sequence
  Synthesized
  misc_feature (61): n=t or c
cgtaactggtatttactgcattaacctcagctatgaaaggaatcataaccccaatttcagntggacaggttagctaaaacctcaccccctaattattactattaaaatcttattctgaaaa

SEQ ID NO: 39437 - DNA, 121 bp, Artificial Sequence
  Synthesized
  misc_feature (61): n=t or g
ttaaggtgcgattggagtacgctgtcaaatgattcgtcttccttttttgccatttttaacntaaaaatatttggctgctatctcaggctacagcaaatggcgtgtcccttttgaatgcaat

SEQ ID NO: 39438 - DNA, 121 bp, Artificial Sequence
  Synthesized
  misc_feature (61): n=t or c
cccaatatctcaattaattcataaccttggatgtcatttgccttttcatggtcactggatntcaaaggggtgatttactcccctccgatcaggtcatgaaaagttaatgtggtttaatggg

SEQ ID NO: 39439 - DNA, 121 bp, Artificial Sequence
  Synthesized
  misc_feature (61): n=a or g
ggctcccagccacaccatcaccaacaactagcgacagagggagcagaaaaagctccccacnaagtgacaagctgcacccacactggcaccttccagtggagcacccctgggctgcagaccc

SEQ ID NO: 39440 - DNA, 121 bp, Artificial Sequence
  Synthesized
  misc_feature (61): n=a or g
ccacagaaaaaccacagcaaaccacacagaaaactaccagaaaactcctaaataatccaanttgaaagaaactcaacgtcttctaaccaagaggcatggcacacctctgtctgacttgaac

SEQ ID NO: 39441 - DNA, 121 bp, Artificial Sequence
  Synthesized
  misc_feature (61): n=a or g
gaggaaacaacacagatcactgaatacagaaggtttattgtatcatctgttcaccatgacntctagtttaaattatattcagtgcctggaaataaccatttaattgtcttaggaaaaaaaa

SEQ ID NO: 39442 - DNA, 121 bp, Artificial Sequence
  Synthesized
  misc_feature (61): n=t or c
gggcacataaaggtaaagatgtgtatattatgtacagtgacctgcacaaagcaagagaaanacaaataggaaaaaaagagtacacaatagtatggccaggagaaatcagatcagcgagtta

SEQ ID NO: 39443 - DNA, 121 bp, Artificial Sequence
  Synthesized
  misc_feature (61): n=a or g
ttttcaatcttggccatgaagatgtcaaagaatggggcatggttgcaatctctgggcaaangaaacttaggacaggaatggcaaggcagtattacaaagggctgcaaacagttttgcagaa

SEQ ID NO: 39444 - DNA, 121 bp, Artificial Sequence
  Synthesized
  misc_feature (61): n=a or g
ttactgaaataatagtaataatatagcagatgaccatcctagagtagaatatgatcctacncatttatgtcttcctaggcagtatagttactactgggaaaaattgaattgattgcaacgg

SEQ ID NO: 39445 - DNA, 121 bp, Artificial Sequence
  Synthesized
  misc_feature (61): n=a or g
tcgctgtgcccggacccacacctaaggaagcgagtgctgttccttggaagttgtcccaatngtctccattttattggtagattctcctcggctcccgcagaacgacaccaccctccgtcat

SEQ ID NO: 39446 - DNA, 121 bp, Artificial Sequence
  Synthesized
  misc_feature (61): n=c or g
ttgggtgtgatttttattttaaaaaaatccaattagaagtcaaattttgcttatacaaaanaacaacacttaggttttggtgccaatttaagctgtcatcatagaatcattaaggttagaa

SEQ ID NO: 39447 - DNA, 121 bp, Artificial Sequence
  Synthesized
  misc_feature (61): n=a or g
cttgaagtcacattatttctttcaatgggcatccaggcaacaactgagaatctatgaaacntttgcatatttttcatgtttcacccactttgacatgaagtttcagaccaggaagtgcagc

SEQ ID NO: 39448 - DNA, 121 bp, Artificial Sequence
  Synthesized
  misc_feature (61): n=t or c
agcttttgactgataccttttcacagtaaaatatgataggaaatattcattttgacgccangttccattttctaaggggggattctaaaagaaattacttcatttcagctcaaaagtttgc

SEQ ID NO: 39449 - DNA, 121 bp, Artificial Sequence
  Synthesized
  misc_feature (61): n=t or c
ctctacccctcccatggtgtaggctctacccctctcataacgtatctcaggcctggagaanagtatctgtaacatttagaggataactcaagacaaacgactagacaggagagagtgcaca

SEQ ID NO: 39450 - DNA, 121 bp, Artificial Sequence
  Synthesized
  misc_feature (61): n=a or g
cacttgatgaaaatgagggtttttagtgttgtctgtagatgtcataaagtgaatctatcanagttggaaatggagtcttaagtaattctatatggcatcgttggttattttttatagagga

SEQ ID NO: 39451 - DNA, 121 bp, Artificial Sequence
  Synthesized
  misc_feature (61): n=c or g
gctttgaactttggcaagtgtcagttatatgcacatgcaggtgctataatgcgaaagttanagtcccaaaccttaatgtctccctaccatctatcttttgcaggtctgctgaccttcacct

SEQ ID NO: 39452 - DNA, 121 bp, Artificial Sequence
  Synthesized
  misc_feature (61): n=t or c
tttacattctttctagatttgtagtgtctcacacattcttgcatgttctcatccctaactnttatataaccactggatagagcacagaaataaggcttcaaatggagtagactcagcaatt

SEQ ID NO: 39453 - DNA, 121 bp, Artificial Sequence
  Synthesized
  misc_feature (61): n=c or g
aagggacagaactttgggcatcctgagaatgcagttttgggtgcgcatattgctactcgcnttaaatatttgaaatagtttctgcaatagagagtacctggaagtagaattgtgttgttga

SEQ ID NO: 39454 - DNA, 121 bp, Artificial Sequence
  Synthesized
  misc_feature (61): n=t or c
ataatactagtgtctctcctcttttaatggtgattataatgaattttattgtggcatgatntttggctaaatctgtattgtcctgcaggctcaaatttaaataaatacataaatcgatttt

SEQ ID NO: 39455 - DNA, 121 bp, Artificial Sequence
  Synthesized
  misc_feature (61): n=t or c
aggaagacctcacagtgcaggaatgcaacaaatgtctcctctctaactcattccccttgcncttcatccactcatggatagcagattttgctggcagcagcagcaatctaacttccagcga

SEQ ID NO: 39456 - DNA, 121 bp, Artificial Sequence
  Synthesized
  misc_feature (61): n=t or c
gccctactcctcccggagtccttatcagtggactttgaatcatcttttcctctgttctgtncagaactgagatccatgcaattgcagtgcagcccggttccctcagaacgttggcacagtg

SEQ ID NO: 39457 - DNA, 121 bp, Artificial Sequence
  Synthesized
  misc_feature (61): n=a or g
tttttttctttcatacatctaactttttcacacgtagggatatagagaatattttttcacntggtttgtacaaactaattttcatctacagatattgaaattggcatgagaagtaccccag

SEQ ID NO: 39458 - DNA, 121 bp, Artificial Sequence
  Synthesized
  misc_feature (61): n=t or g
gttcttgtaattctgaattagctggtgtttttttagcagtttgatgtttctcagacagcanaacaggtcattgaagccaagtgatgtatacccagaaacagatcatagtactcatttattg

SEQ ID NO: 39459 - DNA, 121 bp, Artificial Sequence
  Synthesized
  misc_feature (61): n=a or c
gggatgacaaagagaaagaagagagacttatttaagaacttaagatttcctccatctgttnactttcagtcttttgcgtgggtgtatatatatgtgtgtgtagaaagcagattttaatatt

SEQ ID NO: 39460 - DNA, 121 bp, Artificial Sequence
  Synthesized
  misc_feature (61): n=t or c
catcacaagagataaagtagcagagggtcctattcaagagatgcactaaaaatgcttattnatccaaaaatcgaggatgatctttggattgaaaggcaaaataaagcttgatgatgctgtt

SEQ ID NO: 39461 - DNA, 121 bp, Artificial Sequence
  Synthesized
  misc_feature (61): n=a or t
gctttcacgtgaggccttataaacttgtaacccagaatgtactgatgcaaacaaacagagnaagggcagcagacaaagagcagagcatgtgctgacataaagccgtgtagaggggttgaaa

SEQ ID NO: 39462 - DNA, 121 bp, Artificial Sequence
  Synthesized
  misc_feature (61): n=a or g
ttgacagcttaacagctgttgccaaaaatttccataaatctatggcttttgaaaaatgaangtgaaaatattctgcttgccacttcaattccagcaaaaacaaggcagttaaaaaccattt

SEQ ID NO: 39463 - DNA, 121 bp, Artificial Sequence
  Synthesized
  misc_feature (61): n=t or c
tactactcagtcacagcagctgcccctaaaaatccagaagctgtggtgcacgatgacacangtgcacaaagcaggtataagctccttatctgaactaaaccaggcagagatatggccctat

SEQ ID NO: 39464 - DNA, 121 bp, Artificial Sequence
  Synthesized
  misc_feature (61): n=t or c
acattcagtgagatctggagacatttctcctttgcagctcatcaactttttccttgtccantcccactagtacgcaagttactgattttctcattgtttgatgaatgtgaagtctgtggga

SEQ ID NO: 39465 - DNA, 121 bp, Artificial Sequence
  Synthesized
  misc_feature (61): n=a or g
ggaattcaccaccgctgtttgacaaagtgcagctttcattcttgaaagacttttcagtccngctacataagataaaactcaactaagcctatcttgaatgacaaataatttttaatgtaat

SEQ ID NO: 39466 - DNA, 121 bp, Artificial Sequence
  Synthesized
  misc_feature (61): n=t or c
agcttctgcagattcagcactacgtacacttaaagctagcatttcagtccatgcagagccngtgtcacctggtgggctcttgctatgttccttcgattacagcgatcagtagcaaatttcc

SEQ ID NO: 39467 - DNA, 121 bp, Artificial Sequence
  Synthesized
  misc_feature (61): n=t or g
ttaatgatatagactcgaagtgtccaaatctatgccccagtaaaagagctcatatagctcncattgaccagggctccagctgaacggccttggatgtccctttactgctgtcttctcaggc

SEQ ID NO: 39468 - DNA, 121 bp, Artificial Sequence
  Synthesized
  misc_feature (61): n=t or c
tatttctgactgtggacacttccagcagttgttctcatagctgccacagagcaagttccangcagcacaccaaatgtacacagatgtattcccaggggggtgaacaacgtgcctgtccaac

SEQ ID NO: 39469 - DNA, 121 bp, Artificial Sequence
  Synthesized
  misc_feature (61): n=a or g
agtaataaatcagtgtatcctgtagtcacctttccaatatgttctaagtactgtaacattnattaacttcaaataagttacttaaatacaatgtgtatagattaaacttcacagtctcata

SEQ ID NO: 39470 - DNA, 121 bp, Artificial Sequence
  Synthesized
  misc_feature (61): n=t or c
tgtggactgttcatgttaattttgagccaaagcaaattcagaatgctgttatatgttctanagtacatcgctgttatttcctgtttctcaggcaaacatgcagcagatagctttggaagac

SEQ ID NO: 39471 - DNA, 121 bp, Artificial Sequence
  Synthesized
  misc_feature (61): n=a or t
caacttaaatgtgtacttatagacagaaaggagcttcaggaatgaacagataggcaagtantgggagtaattcttgcaaatctccctaaagtttggtggaatctatagtacgagacagaag

SEQ ID NO: 39472 - DNA, 121 bp, Artificial Sequence
  Synthesized
  misc_feature (61): n=a or c
gtagagcctgaagggagacagttgtaatggagaaaatgatttggagagtgagaagatgatntattacgggtatgtgataaccgaaacagcagtggtcagttgcacagataagaacaactga

SEQ ID NO: 39473 - DNA, 121 bp, Artificial Sequence
  Synthesized
  misc_feature (61): n=t or c
tgaggctggggtatggggtatggcatcactggagcgttcccatgaacctggacgtcatcanccaacactgccacgttggcagatccatgagctggaggggtatgggaagtatgactcaggt

SEQ ID NO: 39474 - DNA, 121 bp, Artificial Sequence
  Synthesized
  misc_feature (61): n=a or g
ggacacataccttaaattccattaaatataggggcagacaacaaccaaacaaacagaagtngtgtttgttctgaaaggcatgcaaaataaagacagatggcacagggccatgcaattcacc

SEQ ID NO: 39475 - DNA, 121 bp, Artificial Sequence
  Synthesized
  misc_feature (61): n=t or c
tggcaagagtcagtggctgggagctgaagtcttaccacatcaagtgagaaatcacattaantgtagtgtgcacaactgagccactgaatcaaactgcattaggaggcctttggttcttcct

SEQ ID NO: 39476 - DNA, 121 bp, Artificial Sequence
  Synthesized
  misc_feature (61): n=t or c
atggaaagagattctctttcagaagctccctttcaaaagctttctgttcagaaatagggcnggcaataagcgattattatacattaatagcagtgtcactgctcggtagacaagtcagaac

SEQ ID NO: 39477 - DNA, 121 bp, Artificial Sequence
  Synthesized
  misc_feature (61): n=t or c
aagaatttatacttctcaatctgctgatttgcttgtctctctatcaaatgtctcaacctcnggagctgtagaactattagcagtgccgtggaagggaggggaagaggataagttcatctct

SEQ ID NO: 39478 - DNA, 121 bp, Artificial Sequence
  Synthesized
  misc_feature (61): n=a or g
aacaagccccaggtgttacatttctctcacaacagaaactccttaggcaggaccaaaacanatgagtaaaatgtttttctcatcttttggccctaaacacacacagtgtccatctagctat

SEQ ID NO: 39479 - DNA, 121 bp, Artificial Sequence
  Synthesized
  misc_feature (61): n=a or c
ctgtggcaggcactcacgttaaaaaaaaaataaccctgccctttcatgctgaagcatattncaaaatttggtcactaaaataatagaccaggcaagttttacaaaaatctacagcccggtg

SEQ ID NO: 39480 - DNA, 121 bp, Artificial Sequence
  Synthesized
  misc_feature (61): n=a or g
gcagttggtctttgccccacgttttctgcaaacgatggcagatccaggttcacatcagcangtgcagagagagacattagttcttctgagccacaaaagccacttccctccctgaagagct

SEQ ID NO: 39481 - DNA, 121 bp, Artificial Sequence
  Synthesized
  misc_feature (61): n=a or g
agaccctgctgtggaactcccacggacctggcttggcttgcatcaggaggtattgctgtcngcacaaaatacatcacacccatcagataacacgcgcacattgcacacattgacagagaac

SEQ ID NO: 39482 - DNA, 121 bp, Artificial Sequence
  Synthesized
  misc_feature (61): n=t or g
gttacccaaaaagaggattttgaataaagtgtgactccatcattgatagccactctatagnttaattcagaccttggcctttgtcaaattctaatgcttcttcagagttattatattttaa

SEQ ID NO: 39483 - DNA, 121 bp, Artificial Sequence
  Synthesized
  misc_feature (61): n=t or c
tcagtaaatcgagttgctagtgagtaggaaaagaggatgacacttaaaaactttacaaaanggttgaaagaattattttatagattaattttctcatagtcaaaatgtcagacagacctta

SEQ ID NO: 39484 - DNA, 121 bp, Artificial Sequence
  Synthesized
  misc_feature (61): n=t or c
ccccagtccctgctctccacagggagctcaaatctgggttttatgtgcagtaataaaaagnaggccaaatattccagcaggtagtatttcagtgggcaaaaaaacttcttttttccccccc

SEQ ID NO: 39485 - DNA, 121 bp, Artificial Sequence
  Synthesized
  misc_feature (61): n=t or c
agacaaagacagaatgctcaacagactttatgacattgggatgaataggaaattaaatttngaagtgtagggtacatatctactgtcagaaatccaggtattcaggtgtatcaggtaacca

SEQ ID NO: 39486 - DNA, 121 bp, Artificial Sequence
  Synthesized
  misc_feature (61): n=t or c
gtgccttaagaaagcaccacacctcctccccatcacgctgactcctgcagaaggcataagncaaatgtttaacaaattcttgttccttgtcagaaacaaaggatttcagggactcctgaag

SEQ ID NO: 39487 - DNA, 121 bp, Artificial Sequence
  Synthesized
  misc_feature (61): n=a or g
ccagttatgggaaattaggcttagaagcacaccctaagtgcaactaagtacaactccctancagaccaggcagcatcagctttgcaatgactgtaactcaacttccagttcagaataagaa

SEQ ID NO: 39488 - DNA, 121 bp, Artificial Sequence
  Synthesized
  misc_feature (61): n=a or g
gagttaactggaaaattgttatgctatgtatttttcactatcccacttttaattctgcaantattttagttccacagctgatgcattgtgtctcagtcaatctgcacttcttttaagcatt

SEQ ID NO: 39489 - DNA, 121 bp, Artificial Sequence
  Synthesized
  misc_feature (61): n=t or c
ggcagtggttcgaggtgtgcccgtgcacattgaatgctgccataattacagggaacgcaangtcttcaccattcatagagctttgtggatgcgtgcatgcagtttctgctaattgacattt

SEQ ID NO: 39490 - DNA, 121 bp, Artificial Sequence
  Synthesized
  misc_feature (61): n=a or g
tttgataggattctttttcctatgtatgattctaccaacaaacagagaagcactttttaangtctatttgggaaaacaactgaaaatatatttttagaaggcatgacaaagcagacctctt

SEQ ID NO: 39491 - DNA, 121 bp, Artificial Sequence
  Synthesized
  misc_feature (61): n=t or c
atgcaaaaatacctgtcttgagagggttcactgtatgtgcacctgataaaaatcacaacangggatcggctttcttctctgcttgcttggcttttggcatgcacagccaagctctggcagg

SEQ ID NO: 39492 - DNA, 121 bp, Artificial Sequence
  Synthesized
  misc_feature (61): n=a or t
aaaaaaagatactattcctgcatgactttgatagaatagatgtaagcttccaaaataaatnaataaataaatgtaaacttccaaaaaacagatgcatgcttcatggtgtaaaagccccttg

SEQ ID NO: 39493 - DNA, 121 bp, Artificial Sequence
  Synthesized
  misc_feature (61): n=t or g
acactataataaatggattttctgagaatgacttgtgatcaatttcaaattatagaagtcngtaatatactcagtttctccctacatatgctctcctaaataatgacttcaattacatgtg

SEQ ID NO: 39494 - DNA, 121 bp, Artificial Sequence
  Synthesized
  misc_feature (61): n=t or g
aatgagaaacagaagcaaaaaaaaaaaaaaccccaccagcactaaattaccctgaataagnagtgtaaaatttcaagcacacaaacagtcttgtttgtgtgcttgaagcaaccaaactaaa

SEQ ID NO: 39495 - DNA, 121 bp, Artificial Sequence
  Synthesized
  misc_feature (61): n=a or g
agaccccctccatggcagattttggctggcacaagtgtgcctacacaggatgggaggtggntccacggccacctgggaaaggagaaggtttgctggcttgtgcccctcccatggccagatc

SEQ ID NO: 39496 - DNA, 121 bp, Artificial Sequence
  Synthesized
  misc_feature (61): n=a or g
gcagatggtgtttgacaggctatttgacaagacagccatcctaatgggatgacagctctgnaattcccattgcttgggaaagagaactctgtagcaatcacagttcgatgttgctccaggc

SEQ ID NO: 39497 - DNA, 121 bp, Artificial Sequence
  Synthesized
  misc_feature (61): n=t or c
actacactcaagtgtgttcaattaatttaagggctttcaaacttacatttctaacacctgngaggagatttgtacccttacttcacttaattgcatgttctgaagaatagcaaattattac

SEQ ID NO: 39498 - DNA, 121 bp, Artificial Sequence
  Synthesized
  misc_feature (61): n=a or c
aactcattcattcaacacgttaatttggaagtaagaatcaaacatctggtgcataatatgnttgttatagtttgaatttcttttacctgataagaatgggggggggggaggggagggtgta

SEQ ID NO: 39499 - DNA, 121 bp, Artificial Sequence
  Synthesized
  misc_feature (61): n=t or c
ctctggaatgagtgagctataactattgaatagcttgtaatatcacaacgatatcagaatngtttatatcaggtttatagtaggagaagtatgtactgcagatctccaagccctttgacag

SEQ ID NO: 39500 - DNA, 121 bp, Artificial Sequence
  Synthesized
  misc_feature (61): n=t or g
aaagtgtcccaaaaggcacgtgaaggggcccttccattggcctgtgtgcagtgaaggcctngcagaggggtctttagtaatatagctgtttagaggcaaaacccaatgggcttgtgaggaa

SEQ ID NO: 39501 - DNA, 121 bp, Artificial Sequence
  Synthesized
  misc_feature (61): n=t or c
cctgcatgatcactcacatgcgtgcatcctggttgcttagtaaggaaaaaggagtaaacantgcatgggctgattgggttccagatctcaaatgtttgtgggaaaaatccaatgcaaagct

SEQ ID NO: 39502 - DNA, 121 bp, Artificial Sequence
  Synthesized
  misc_feature (61): n=t or c
ccatgtggatcactaaatggtaacccctgaagaaccacataaaaatgcatgtgtgtttggnttctgtctgctcgtttttgtcttcagagcttgtaaactctctgggcagcattcactgtct

SEQ ID NO: 39503 - DNA, 121 bp, Artificial Sequence
  Synthesized
  misc_feature (61): n=a or t
catacaatcttatgttgctaaaaatggctagtcaaattattgcagctgccctctatccatngactttttactttaacaattatgtgaacagaatattgagtaaaagctatttttaatatta

SEQ ID NO: 39504 - DNA, 121 bp, Artificial Sequence
  Synthesized
  misc_feature (61): n=t or c
gcaaacgcctcttcacagctctcagataaaatgacaagttattacgttcatattataatangaaaccagaaggaaattcagaactggaatttagagagatgaatgagcaattacttgtcat

SEQ ID NO: 39505 - DNA, 121 bp, Artificial Sequence
  Synthesized
  misc_feature (61): n=a or c
taaatggattcacttttgagggagatctgagaaggtaccagtgacaaagcaaaatacttgntgattgctaaatatattttagttttgagacaaacctgtggatagcttgtacttcagccat

SEQ ID NO: 39506 - DNA, 121 bp, Artificial Sequence
  Synthesized
  misc_feature (61): n=a or t
aacagtcacaatttttaatgcatttatgaagcaaaaaatgaagcaacctttaatacagagnggaatacagagaatgtgtttcatcttaaactttaggcagtcaacttaactcattcctaaa

SEQ ID NO: 39507 - DNA, 121 bp, Artificial Sequence
  Synthesized
  misc_feature (61): n=t or c
cccactgctcagcctgtctaggtctctctggttggcatcctgtccttcaagcatgtcaacngcacaacatagctcggcatccccaagcttgagggtgcactcagtttcactgttgatgtca

SEQ ID NO: 39508 - DNA, 121 bp, Artificial Sequence
  Synthesized
  misc_feature (61): n=t or c
tgtggtgaacatgctgctgctcatctttggtggcactatcatagctccccaatggatgganataggtctagaaagcacgtatgtttgtttcccatcagagtcaggaatatgtcattgtgtc

SEQ ID NO: 39509 - DNA, 121 bp, Artificial Sequence
  Synthesized
  misc_feature (61): n=a or g
caagcaagtaaaatgcctattttctatctctaatttaattgtaggatatttctctatgtanttaagtggatgctaatcctccataatttctgtgggaaaagcagaattccacatggcttgc

SEQ ID NO: 39510 - DNA, 121 bp, Artificial Sequence
  Synthesized
  misc_feature (61): n=a or g
ttatttttattttcactttatgggataagacagactagaatgcatcatttccttatcggtngctaaactgcttacttgggagtgcagatttcctgttttgttttgcaaattttgttataaa

SEQ ID NO: 39511 - DNA, 121 bp, Artificial Sequence
  Synthesized
  misc_feature (61): n=a or g
cttttgttcttgacaaaagggaaaaaaagaaacaactgtgatatgcagtaaccaacagtcnctacccatgacctgactgtggtgaccacccactactatgcctgaaagtagatgagcagcc

SEQ ID NO: 39512 - DNA, 121 bp, Artificial Sequence
  Synthesized
  misc_feature (61): n=t or g
gtgcattagtgtgacactggcatgatgtacagatcatcgggggacacctcagtgttactgnaagccagacagtaaaaacgattgtggtaacgctgtgtttgttatccgagcattggaaaga

SEQ ID NO: 39513 - DNA, 121 bp, Artificial Sequence
  Synthesized
  misc_feature (61): n=a or c
gcagacaagtgcactcctgagcatatttcaaaattcagggaaatctgcaggaaccactganggagcatcccctggattaacccaaattacacaggtggcaaatttatactgttttgagtct

SEQ ID NO: 39514 - DNA, 121 bp, Artificial Sequence
  Synthesized
  misc_feature (61): n=a or g
tcacatccaccctgtgaatgccacagagtgagccctcccggagcacatttctgtgcacacngaggagatagaagcagtcagcgtggatttagcaggggtaaatcatgcctgaatggcttga

SEQ ID NO: 39515 - DNA, 121 bp, Artificial Sequence
  Synthesized
  misc_feature (61): n=t or g
gtgctgctgagtacaggattgggtaagggaagtaggagagccatgcaaagtgaaggctttngggcggtgccagacagataatttgtggaagcgtgtgtgagattgaatttaaagaacagtg

SEQ ID NO: 39516 - DNA, 121 bp, Artificial Sequence
  Synthesized
  misc_feature (61): n=a or g
actcgtgttaaaatgctttttgaaagatcagacaaatggcaatataatgagaaaatgaaanctgttccagcttgccttgccttcagtagtacaaccacagtgcctattttagccaggccct

SEQ ID NO: 39517 - DNA, 121 bp, Artificial Sequence
  Synthesized
  misc_feature (61): n=c or g
gcatttcataagtgacccattttccaaagaggttggaatgaaagcatctcaccgtaattanagaacaactcttaattttgtttgaaaacacatttcctgtatagtatcagtaccaagttgt

SEQ ID NO: 39518 - DNA, 121 bp, Artificial Sequence
  Synthesized
  misc_feature (61): n=a or g
atttagtcactcatgaagctttatggcatatggattcacaaggatttctcaaagttaaacnccactaaacattatagcttctatatgtgaggatggtgaagaacagtttggaccagtaaac

SEQ ID NO: 39519 - DNA, 121 bp, Artificial Sequence
  Synthesized
  misc_feature (61): n=a or c
taaacctcatctcaagcagaaagcacatgtccggtccaaaacctgtaccagtcactagaantaattcctggagttcaagggacttcaaatttgatccaaggaaggagggtttacaactgct

SEQ ID NO: 39520 - DNA, 121 bp, Artificial Sequence
  Synthesized
  misc_feature (61): n=a or g
tcttctcctctccaacatctcagctctggtacccacccacccttactgccaaaaggcactnagctcacaaggaaacattccacatggccttgacataagatatcagcttgctgatctttgc

SEQ ID NO: 39521 - DNA, 121 bp, Artificial Sequence
  Synthesized
  misc_feature (61): n=t or c
ctcccaaagggagcaagggaagatgagcactgttgagaggccctgagccacagcacctacngccctcgagcagctcatctgtgtagcccacaggcagcctgccccccgaatgcacatcaca

SEQ ID NO: 39522 - DNA, 121 bp, Artificial Sequence
  Synthesized
  misc_feature (61): n=a or g
gtgattctgtgatgctattatctcttccaacacaagccattccatggtcctatgactggantgaacttgctgtggagttttgcgctgattgtttgcccttctgcccttccagtgctggggt

SEQ ID NO: 39523 - DNA, 121 bp, Artificial Sequence
  Synthesized
  misc_feature (61): n=t or c
ataaaaatactcaggcacagcacgtatgaggaagcaaacacagtacttcaccacaatcacnggaacatttcctgtagctcctctggtagaggaaacagcaggtatcatacatggtggggca

SEQ ID NO: 39524 - DNA, 121 bp, Artificial Sequence
  Synthesized
  misc_feature (61): n=a or c
tgtaataaaaatcagtgctgcaaacactgactgcagaactggaaatgcagaagtgaaaacnaaaggaccagaagcgcacgtatctcggggttctttcaatctcacacttgtgtcatgcaga

SEQ ID NO: 39525 - DNA, 121 bp, Artificial Sequence
  Synthesized
  misc_feature (61): n=a or g
tcctccttccctccattatgtgaggcaagatctacagctctggtgtgtattgcaaactcantgttttttcatagctccatttgggaactgtagctatcccagactggacaatgagactcca

SEQ ID NO: 39526 - DNA, 121 bp, Artificial Sequence
  Synthesized
  misc_feature (61): n=a or g
agcccttccttaaggaagctctcaccgaattccttcccctgctgaggagttcagcatcacncctggcattaagcctccgcatttcactccgaggaagggcttgaaagaaaggaaagcagca

SEQ ID NO: 39527 - DNA, 121 bp, Artificial Sequence
  Synthesized
  misc_feature (61): n=t or c
cttcagtttcttgccttatggttactacagaaagtcctctgttccccttaccattaaggantttttcttctcgaaacatgtcaaagtcccatgaaaacaaactttcatacatttaaatatc

SEQ ID NO: 39528 - DNA, 121 bp, Artificial Sequence
  Synthesized
  misc_feature (61): n=a or g
gacattaatcaggatcaaaccagggaataaggggccagcagcaccagcagcacaaaagganccctcagagggaaataggagggacaagcctcaaccctatagttgtcaaaatggtagttct

SEQ ID NO: 39529 - DNA, 121 bp, Artificial Sequence
  Synthesized
  misc_feature (61): n=t or c
ctgccctgcttacatgggtccttcttggtggtcagtgtcctcagacaaaatagcctgggcnttttccctttggattttaacttgaaactgcagaactaaatgctcccagccccttgctgaa

SEQ ID NO: 39530 - DNA, 121 bp, Artificial Sequence
  Synthesized
  misc_feature (61): n=c or g
ttagccagtgctgatacattgtggaaaacgagtgattaataaacttcagtacttttatttncctccttgaggcatgatgatgtggctgcttcacagtgagaagcagagaagcatgagtata

SEQ ID NO: 39531 - DNA, 121 bp, Artificial Sequence
  Synthesized
  misc_feature (61): n=t or c
gtgaggagaccaaccaccgacctctgccatttgcctggctgcaccaatctcatacagtggntgcttgaggactgcttgctctagccctatctcatacacagcactgtgctccttactgcaa

SEQ ID NO: 39532 - DNA, 121 bp, Artificial Sequence
  Synthesized
  misc_feature (61): n=t or c
gggagaaaactgcctctgatacatatgtcaggagctagttatctgcaagaagtagagaaangtaacctcatgtttttcactagggtatgctgtcctggatatcttttgatgcatctgctta

SEQ ID NO: 39533 - DNA, 121 bp, Artificial Sequence
  Synthesized
  misc_feature (61): n=a or g
ggaaggaggcaggagattcacaacacaggtggatttccaagactggtctgtatggcagccnctctgtatggataccactctgtacggctgccactctgtcatcctttgccagaaacaactg

SEQ ID NO: 39534 - DNA, 121 bp, Artificial Sequence
  Synthesized
  misc_feature (61): n=a or t
acaagaaaggaatagatgctagcatttcataagcgaatgaatgaaacggagttgaaacacnaaaaaatggtggcatgcatgcttaaatgttgtgttgaatgcaggggctcagacttatcag

SEQ ID NO: 39535 - DNA, 121 bp, Artificial Sequence
  Synthesized
  misc_feature (61): n=t or c
tgtaagattaaatgagcacaaaacacattaagatatcgaactgcagaattttacatttcanacacagttctagttatatgttatttatataacagttccttatattaaatttgtgtgaata

SEQ ID NO: 39536 - DNA, 121 bp, Artificial Sequence
  Synthesized
  misc_feature (61): n=a or g
cattggccagacctgcaagccattaccatggtattaacaacattcagatggagagtccccnaggacaaaggaaatgaagtgctgtgcacttaaaaatccattcataataggaaaatccaaa

SEQ ID NO: 39537 - DNA, 121 bp, Artificial Sequence
  Synthesized
  misc_feature (61): n=a or g
atacatatgttttggctgtactgcttttgtgtgaaaaacaggccttggctgtttcctgtantaacaaagacacctgaaagaagactttgttcaactgtaaattaaacttaattgtctgcgt

SEQ ID NO: 39538 - DNA, 121 bp, Artificial Sequence
  Synthesized
  misc_feature (61): n=a or g
acaagagcagtgaaactgtctgtggctgtcagtatactgaaccactagaataaatattgcnatatacgttgtacaagatttattttttggagagaaaaaaaaaaaccaacaaaacttccag

SEQ ID NO: 39539 - DNA, 121 bp, Artificial Sequence
  Synthesized
  misc_feature (61): n=t or c
ttggtccctctctgcaggggcagcgtgcagacgtgtctttgcatcaggctgacactcacanggagatgctccagtctgtaaggccccaatttcttttcttgtgcactctctgacttcattg

SEQ ID NO: 39540 - DNA, 121 bp, Artificial Sequence
  Synthesized
  misc_feature (61): n=t or c
ctagcaaacagaatatgtgctggactgtaatgtaagtacgtaaatatagggccttagttangatgggaatttaaaacacttagtaaaaatgttttttatcaaagtaattgcagaagaattc

SEQ ID NO: 39541 - DNA, 121 bp, Artificial Sequence
  Synthesized
  misc_feature (61): n=t or g
tccacccctgttctcttttccccctctcccaggtgttactgtacaagaatccaccttcagngctctgtttcacacaactgtgggttcccttgcttgaatgggccgtgtcttttcccacctg

SEQ ID NO: 39542 - DNA, 121 bp, Artificial Sequence
  Synthesized
  misc_feature (61): n=a or g
gttgtaagattacagtacagtcagtattagagtactgagaattccatttaccactgaaggntatgtatggggtctttttaagcacactaagtgtgctctgttagcaagatggtctgtgttt

SEQ ID NO: 39543 - DNA, 121 bp, Artificial Sequence
  Synthesized
  misc_feature (61): n=t or c
ataggctgcctggtcctctctgctacctcctcgggtcgacaacgggagataaatttgctcngtaggaaccttttgtgggccgtgctgctgaggcaatttgcagtttgctgtggaaaaggca

SEQ ID NO: 39544 - DNA, 121 bp, Artificial Sequence
  Synthesized
  misc_feature (61): n=a or g
atttcagatcctttaaaaaaaagaagaccaattattctgttagtttcagtgtagaaatccnaaccaactctgcctattttatcagcataatgctgggcccctcagtggggctgattgggct

SEQ ID NO: 39545 - DNA, 121 bp, Artificial Sequence
  Synthesized
  misc_feature (61): n=a or g
tttcaaaataatatttgatactgatataactgataacagtttcaaaagaatatttgattcncttaaaatctgtcattgaacaacagctacatttgacataatctctcatatgctccttagt

SEQ ID NO: 39546 - DNA, 121 bp, Artificial Sequence
  Synthesized
  misc_feature (61): n=a or c
cacaatgaaaatcctgtagtagtcaaggatttagttaatattaattcactacagctctagnagtgactagaactgtagtcactttcagactaaattggctttatatcagagaatatcagca

SEQ ID NO: 39547 - DNA, 121 bp, Artificial Sequence
  Synthesized
  misc_feature (61): n=c or g
aatgcgtgttctgcaaacaacccttgccgtacttcagcctgtgtcttctgcaccatagatngttacccaaatactccaagtgcctttcagttcatggtgagctttgtggaataggaggttt

SEQ ID NO: 39548 - DNA, 121 bp, Artificial Sequence
  Synthesized
  misc_feature (61): n=a or t
gctcactacaaaatttgtaagtccaaagcttaacaccatcatgtacaagtgatatgccttngcacctgctgaattggctttttaaattacaccagcaataaataaattaaaaagtatatag

SEQ ID NO: 39549 - DNA, 121 bp, Artificial Sequence
  Synthesized
  misc_feature (61): n=t or c
ctgggtcatagaggtcttcgtggtccctccttatggatagagtcaagattcaggttgcagngcagtaaatctggagcatttcagattatttctatagagttactgccaaacaatccatgta

SEQ ID NO: 39550 - DNA, 121 bp, Artificial Sequence
  Synthesized
  misc_feature (61): n=a or g
tccaaataagtccttggcaagatggattgcaataaccagagtacttcactgttgcttttcnaactcaacttgccaaatctaagaaagatgtcttaaaataattgggtgtgcaaaagtggca

SEQ ID NO: 39551 - DNA, 121 bp, Artificial Sequence
  Synthesized
  misc_feature (61): n=t or c
gggattacttttaagcactttttcaataatttcaaaataatctttcaataatttcaaaaantcaataaaagcggaagtaataaaaaaatcatggtctccacagcattcagctgacacacat

SEQ ID NO: 39552 - DNA, 121 bp, Artificial Sequence
  Synthesized
  misc_feature (61): n=t or g
ggcattcacattagaattctttaataatgacatgttgcgtattgcagagtaaagtgctgtncctgggttgtttcgcttgaacggaggatgttatgaatctgatcgttgtctatttgagcac

SEQ ID NO: 39553 - DNA, 121 bp, Artificial Sequence
  Synthesized
  misc_feature (61): n=t or c
gttccttggctgaagtgggccgtcctgagcgacggaatggacgtgatgtcattatgaagcngagataaccgtgcaagtctgatgggaagatcctggctggagccagctcagtctggcagcc

SEQ ID NO: 39554 - DNA, 121 bp, Artificial Sequence
  Synthesized
  misc_feature (61): n=t or c
aagtgattcagatcagtccataaagtgttttcaaaattacccctgaaccttttatacaagnttagctgaactttatttttgaaatatttaaccttttttccattttgaaggagaattacag

SEQ ID NO: 39555 - DNA, 121 bp, Artificial Sequence
  Synthesized
  misc_feature (61): n=t or c
aacaacacagaagacatcaactacaactaaacaaattatatttacttctaatatacacaanatgcacaaaagcttaagtcagtagaagttttactgtttacttcaacaaaagaagagttag

SEQ ID NO: 39556 - DNA, 121 bp, Artificial Sequence
  Synthesized
  misc_feature (61): n=a or g
atggggactggacagttttgaggatactgatattttaaaagcagaattagatggaaatgtngtacttgtgtaatacaatgtttacatttggagtaagtcaaggaacaagatgaacacactc

SEQ ID NO: 39557 - DNA, 121 bp, Artificial Sequence
  Synthesized
  misc_feature (61): n=c or g
agctggagaagtgactttggtaagtgaggacataaataggaaatgactgtccatgtcttcnaggttcttcttgtcttcacagtcacacaacaactatgtaaagacacactaatctgattgg

SEQ ID NO: 39558 - DNA, 121 bp, Artificial Sequence
  Synthesized
  misc_feature (61): n=a or g
gtttttttttttcccccgaacatctggaagcagtttctttctacagatgtttcccctacanatacataccctccactcactgctccagatccagatgtttccaaatagctcagtgttcttc

SEQ ID NO: 39559 - DNA, 121 bp, Artificial Sequence
  Synthesized
  misc_feature (61): n=t or c
gaagggaaaggaaaaggtatctggcagcaggagaaatagccagcgtcctccctgctggagngaccactgaggaaaagctggagccacaaaggaattctgtttccctggagtaggcctaaga

SEQ ID NO: 39560 - DNA, 121 bp, Artificial Sequence
  Synthesized
  misc_feature (61): n=a or g
agctggtgcaagcaataccggtaattcatcaggaactctgagaagatcttatgttcttctntgaccagactctccaaacaggtcagtaccaaagggtatcaaagtactaaagagattaaaa

SEQ ID NO: 39561 - DNA, 121 bp, Artificial Sequence
  Synthesized
  misc_feature (61): n=a or g
ggcttctggtccacagaaactgtaacatttccaaagctttccccctgattttgagaaaaantaaataatttggtagtaaggacagcctggtggttgtgctgatgagcttggctgtgggagg

SEQ ID NO: 39562 - DNA, 121 bp, Artificial Sequence
  Synthesized
  misc_feature (61): n=t or c
tgctgggttaaaaataagtcactgagacaagtaaaaatgtttgggttcttctatttttctnaaaattatattgccatcttcctttattccattaagggctggaagacaagtaggaagagac

SEQ ID NO: 39563 - DNA, 121 bp, Artificial Sequence
  Synthesized
  misc_feature (61): n=t or c
tgcctagagctgctgcgtgattgtcttccttatcctgcaaccttcatagcactgactgcangaccaacctggcttcacttctgtgaggaactgggctgcaccactctttggggtctcccca

SEQ ID NO: 39564 - DNA, 121 bp, Artificial Sequence
  Synthesized
  misc_feature (61): n=a or g
attactccctagttcatctagagcagaagaaaaggggcttttcacaggttatttttcaacncagcatgctgccatagacacatatatggttcagaatgtggcatttttcattttcatgcag

SEQ ID NO: 39565 - DNA, 121 bp, Artificial Sequence
  Synthesized
  misc_feature (61): n=a or g
cgtgaagaaaatttcccagctgaagttggttttccattccagactgtataattacacagcncaagtgaagcacaacaaactctagagcacaagaatgaacaggaacagcctttgctgtcca

SEQ ID NO: 39566 - DNA, 121 bp, Artificial Sequence
  Synthesized
  misc_feature (61): n=t or c
gagcaagatagagctatatctacaaaaatagggcttcaggaatcttcagtctcttgcatgnttcctaaatacctgtcaaaacttaacatacttctcaacagctacaaggcagaaaatgaga

SEQ ID NO: 39567 - DNA, 121 bp, Artificial Sequence
  Synthesized
  misc_feature (61): n=t or c
caatgtaatggcttgactgaaggcattcagtacatgggaatccaatgcatctttgaacatnagggatttattagttttcacattgggaaaaataaaaaaaaatcagcatactgaaacagtt

SEQ ID NO: 39568 - DNA, 121 bp, Artificial Sequence
  Synthesized
  misc_feature (61): n=t or c
cacagaacataaagcaggttcactcaacactaatcagaaacacgtcaggcagacacacacngtgtgaccaccgctggtgctcttgaagaaaaaaatgagtcgtgaaaaatctccctatcaa

SEQ ID NO: 39569 - DNA, 121 bp, Artificial Sequence
  Synthesized
  misc_feature (61): n=a or t
ttagatcagccaattatcccttgtatttgaggtcccagtggaagaaagagaccatcatganttgctacgttgcaaggaatttgacatcagaaagttcatttcccaatagcactccactgtt

SEQ ID NO: 39570 - DNA, 121 bp, Artificial Sequence
  Synthesized
  misc_feature (61): n=a or g
atggttatcataataaaactgtaagaagtttatgaagctttgggtttggacaaaaacgttngtcagtgtgtatggacaaggctcataattcaaggctgtggtcattttttgcataatactc

SEQ ID NO: 39571 - DNA, 121 bp, Artificial Sequence
  Synthesized
  misc_feature (61): n=t or c
tgctttggtgttttattgctctttactcattcctctactatcttaactgaaattatatccngataatacatttctttcctgcaagcaaggcaccattcttgcttctttgaatcaaagatac

SEQ ID NO: 39572 - DNA, 121 bp, Artificial Sequence
  Synthesized
  misc_feature (61): n=a or g
ccaggagagggtggcctatttacacagtgacaggctcagtatctcctcgctgatggagatnttagaatctcttatcagacagcaggctgcattaaggccgttcccccagcagagcctagga

SEQ ID NO: 39573 - DNA, 121 bp, Artificial Sequence
  Synthesized
  misc_feature (61): n=a or g
gcacatgagagacagaaggatgctaagcctccaccgttagaattgtatgttaccatgagancatttgaaataaagctttatctccagatgatgtgtccatctggtaacccctgatttccat

SEQ ID NO: 39574 - DNA, 121 bp, Artificial Sequence
  Synthesized
  misc_feature (61): n=a or g
tctgggtaactatcattcttaagttaggaaatggctttacttctgtattctccattctccntagtataagttcacaagaagaatgttaccggacatctcttctgcttctttgttctcatca

SEQ ID NO: 39575 - DNA, 121 bp, Artificial Sequence
  Synthesized
  misc_feature (61): n=a or t
tctcccacatatttccatgagagagaaaaggattttgtgaggaataacaaaggtatttttnacagttctgtataatcaccttcaaagaatatttagaagaatttggagtgcatacagttag

SEQ ID NO: 39576 - DNA, 121 bp, Artificial Sequence
  Synthesized
  misc_feature (61): n=t or g
tcaaggttagcatacaataggaccttactgctttttaattacaaattacaaagcagcaaantctacactgcatcttgtgttaagtttggatttctatagcatagtgaaattctaataataa

SEQ ID NO: 39577 - DNA, 121 bp, Artificial Sequence
  Synthesized
  misc_feature (61): n=a or g
cagagcttacttcttgaactagtttcctagttagaatgtccttgttcatcgtccatacttncttgccattcctggaggggtcgatactgctaggaattttctgcagcaatttgaacaaagg

SEQ ID NO: 39578 - DNA, 121 bp, Artificial Sequence
  Synthesized
  misc_feature (61): n=a or c
cccggagttacagagaagatattagtttaacatctctctgagtctgctgcgtgcattgggnactttccagggttggtgttctgggaacagcaaagactacagggcagcagtttgtctcctg

SEQ ID NO: 39579 - DNA, 121 bp, Artificial Sequence
  Synthesized
  misc_feature (61): n=a or g
aatggcagagaaacctaccgaagccaagctgttcgcgtgaacatttatttggcttagcccntgctattctgacgtttccttttgcaaagttggcatattgacacatcttgtcctaggtaga

SEQ ID NO: 39580 - DNA, 121 bp, Artificial Sequence
  Synthesized
  misc_feature (61): n=c or g
attacagaggcacacactgtctcttccttgtatgttcagagcatgttctatctaactctgnaagtgccttctttgctctagatatgctccatttttgctgcagctcccattcttacctatc

SEQ ID NO: 39581 - DNA, 121 bp, Artificial Sequence
  Synthesized
  misc_feature (61): n=t or c
gttggtgcattaggggaccatgggtctgcactccgaattagtgataattcatcaaacagtntccaacttcatggaacattttccttcctcttccttcacagtatcctcaagcactaaatct

SEQ ID NO: 39582 - DNA, 121 bp, Artificial Sequence
  Synthesized
  misc_feature (61): n=t or c
agagttctcctgaggagtacctgttggagcaccatcagctgcacacagaggaagtcttccngggacaggaagtgcatgctttggaatggaagtacaaaactgcaaaggtgaggagagaatc

SEQ ID NO: 39583 - DNA, 121 bp, Artificial Sequence
  Synthesized
  misc_feature (61): n=a or g
aatacacttcagttctgcagcttatttcacatgctcttgaaaactgatggttagtaagggncagaccatttttctggtaatttgtgtagacatagaacttggtttacttctctactgttta

SEQ ID NO: 39584 - DNA, 121 bp, Artificial Sequence
  Synthesized
  misc_feature (61): n=t or c
tgttccatgcttttaggctggtgtagaaattctggagggaaaaacaatcttaattctacanatttttcaacgtgtacatttctaagataaatcaagaagcaacttctgctagtgggtaaaa

SEQ ID NO: 39585 - DNA, 121 bp, Artificial Sequence
  Synthesized
  misc_feature (61): n=a or g
caaagtgaaaaagtcaggaaaacatctaatttttaattagttctccccttttgggagatcntttgattttactggcagaattagcaagtgaaatcatttaagaactgccatgtaaatgtcc

SEQ ID NO: 39586 - DNA, 121 bp, Artificial Sequence
  Synthesized
  misc_feature (61): n=t or c
catcaggtcccagtatatttgggtgccttcttgcaaatggttctccagcaagaagagggangaaaaatgcagtacctcaggtttctatacaagcagtggctcatagagttttttacgggta

SEQ ID NO: 39587 - DNA, 121 bp, Artificial Sequence
  Synthesized
  misc_feature (61): n=a or g
gctggggggatcgaacccaaacccgacagcttttaaccacagcccttcccatctcctcccnaccccgaaagtccagcagtgctctgagctcattggggccattggtgatagagggctgagg

SEQ ID NO: 39588 - DNA, 121 bp, Artificial Sequence
  Synthesized
  misc_feature (61): n=a or t
aagatggaatctggtagttttgtgtggtctgagacatgtcacctgtagtagtgttttaacnatgttaaacacagatcagggagaacctgatttacataagcaaaaatatttatttaatgca

SEQ ID NO: 39589 - DNA, 121 bp, Artificial Sequence
  Synthesized
  misc_feature (61): n=a or t
tagtacaaaatgataaccataatagtaataataataattaagaaagctttctgcttgacancattaatttttgagctgattctgttaactcctgttttctcctgtttgatgtttgctaatg

SEQ ID NO: 39590 - DNA, 121 bp, Artificial Sequence
  Synthesized
  misc_feature (61): n=t or c
cacaagaagtaatctgcatgtgttaaacatttaatgagattccaacccatggtatgatagncactgccttcatattgtgtcaaaataatacaaaggaaagtcaagtttaatggaaaaaacc

SEQ ID NO: 39591 - DNA, 121 bp, Artificial Sequence
  Synthesized
  misc_feature (61): n=t or g
atcactgtttgtgaaaagcaaaataaagcaaatgtccttatttgcttaaagcaaatttaantctacacattggctctaaaaatgtattgggtgttgttttagaataacttaaaagttttgg

SEQ ID NO: 39592 - DNA, 121 bp, Artificial Sequence
  Synthesized
  misc_feature (61): n=a or c
gcaaccccatgcccatgggatggaggtggtagctgtcagcttcccccacccaaaatatttnatggagagaccatctccagggggtcctgttcaatcttaatttaccttgccttgagtagga

SEQ ID NO: 39593 - DNA, 121 bp, Artificial Sequence
  Synthesized
  misc_feature (61): n=t or c
aacaaaacaaaacaaaacaaaacaaaaaaaccgactctcacttcatcaattcatttagttnggatctaaacttttgcattagttgaggaacatatttcacttcagcagctctaaaaatgcc

SEQ ID NO: 39594 - DNA, 121 bp, Artificial Sequence
  Synthesized
  misc_feature (61): n=t or c
agccagaagcaagaaggatgaggatcctgaaaggagtcttcactatcagatgtggttgtgnagaatgagtgcaattagcagagcgactgcaaaggagaaagcgattaaatttgctccctct

SEQ ID NO: 39595 - DNA, 121 bp, Artificial Sequence
  Synthesized
  misc_feature (61): n=a or g
atatttaaaatggttgcaggagtacttgctttggaggcaaattctgagatgtgaagatccntcagtaggtagaaatgcatggatgaggggatagccctaaacaaaatccatggataaatct

SEQ ID NO: 39596 - DNA, 121 bp, Artificial Sequence
  Synthesized
  misc_feature (61): n=a or g
gctgttacagacatgggttaggtaacttgctcccactaagacaagaccacttgctatccanactcatcagctccccaaaaacacagacctgtctcccacagctcttagttttttgataggt

SEQ ID NO: 39597 - DNA, 121 bp, Artificial Sequence
  Synthesized
  misc_feature (61): n=a or c
ttcttcataaattttctctgcttaactgatgttttctaacaaatgctatttatgatgtganatcctgagtttcttgaggcaaatatttaggagccaaacccacatctgtaattattacagc

SEQ ID NO: 39598 - DNA, 121 bp, Artificial Sequence
  Synthesized
  misc_feature (61): n=t or c
agaaggtttaatgttatagggaggtttagccgtcgttttctgacttgcaatgaaaatgtcntcagtagggctaaagaggatgcgagaacatctctactggctgcctccagataccatcatt

SEQ ID NO: 39599 - DNA, 121 bp, Artificial Sequence
  Synthesized
  misc_feature (61): n=t or g
aatgctctgaaattacattttgcttagaaaaaaaattatacattagttgctagaaaactgncagggagagtgaactgagtggagttcagctgatctcagaagacttaaaattttaacagca

SEQ ID NO: 39600 - DNA, 121 bp, Artificial Sequence
  Synthesized
  misc_feature (61): n=t or c
cagcgtagaagagattctaagcagagagtgcttaatgaataactctgtacaaagaggcctnctaactcccgatgtatattaagctttctgctttctttctgaaatatattaatagcttcaa

SEQ ID NO: 39601 - DNA, 121 bp, Artificial Sequence
  Synthesized
  misc_feature (61): n=t or c
ttttccttgtctgaatgtggtagtatttaagatgggctttgttcaggccagtgtttgttantgaggaatgaaattgtagaatgtatacaaacaaatgcatgcaaacacatgctatgcttaa

SEQ ID NO: 39602 - DNA, 121 bp, Artificial Sequence
  Synthesized
  misc_feature (61): n=a or c
ctgagggaagtgctgtttcacaggctgtcttccctggtgaagctgaattcaactacacagnccacacctcaagacaggcataacctcgtccccttgtccctggctccaagcagatggagcc

SEQ ID NO: 39603 - DNA, 121 bp, Artificial Sequence
  Synthesized
  misc_feature (61): n=a or t
gcttcagaagtgtgggatgactttgttttcctggccagtggggttaagataggctgaaaanttaataatgaatattaggcttttgttttcaggttggtccgcttcaagttggaattatgtc

SEQ ID NO: 39604 - DNA, 121 bp, Artificial Sequence
  Synthesized
  misc_feature (61): n=t or c
agctgatcaaacgaagggatagagcaggcctatggataatcactgtccaagagtaaaaagntccacagtttaatacttgcccaaatagtacattagactaaggatacattttaaatagtca

SEQ ID NO: 39605 - DNA, 121 bp, Artificial Sequence
  Synthesized
  misc_feature (61): n=a or g
gttaataactgcagcactccgtgaagtaaatactcattagcccctgttctaacaacgtggngtggtgtggctctgtgtcatcagtgactcagccacacagggtcagtttcagtttggggag

SEQ ID NO: 39606 - DNA, 121 bp, Artificial Sequence
  Synthesized
  misc_feature (61): n=t or c
tttgctccttattgtactggtttggcttaactgatggaagacacaaaaatatcagtgtgantgatagctattttgtgaatacagataggtgctttgcagctgaacctgagttaaccaagtc

SEQ ID NO: 39607 - DNA, 121 bp, Artificial Sequence
  Synthesized
  misc_feature (61): n=t or c
aactgcaaagaatcaaggtagaataaataggaaaaaacagtatcttaaataaaccatatantttcatttttagttcagtctgtcattgtgagccattcacagtatcccggaagagtgttac

SEQ ID NO: 39608 - DNA, 121 bp, Artificial Sequence
  Synthesized
  misc_feature (61): n=a or g
ttcagaagctttacctatgcaatcctgccctctggtgtacatcggacaagcatctgtttcngaattcacgtaactgaagcaaaccatcaaaagcctgaagcacttaaactaactactgcac

SEQ ID NO: 39609 - DNA, 121 bp, Artificial Sequence
  Synthesized
  misc_feature (61): n=c or g
tgcctccaatgatcaccgtcctagggacgaagagcttcacagggtccctcttgatgcctgnaggacagggcagcaccgatgtcagctgtgtgccatctcctgcccatcccctgcccatacc

SEQ ID NO: 39610 - DNA, 121 bp, Artificial Sequence
  Synthesized
  misc_feature (61): n=t or c
tctgctcattttgcatctggtagtgctgtggcaccaagatgctgggtgggtagtgagtggnaaattaacatacaaatcataactcggattgaggagcattggattccagaggtgtgcaggg

SEQ ID NO: 39611 - DNA, 121 bp, Artificial Sequence
  Synthesized
  misc_feature (61): n=a or g
acataagaaatactgtcaatatttaaaccctctttttctcactgctaggaacagagtgctntcagcagtcaatccggaaacacggcatttcattttcagcaaaaaccaaggacttttccct

SEQ ID NO: 39612 - DNA, 121 bp, Artificial Sequence
  Synthesized
  misc_feature (61): n=t or c
aagaaggaacttctgatcctggacttccctcttctggcagtttggtgtattcttcagcctngacttatgtggctcagacgccatgtgacttggaaggtcaaacatatctgagcaggataac

SEQ ID NO: 39613 - DNA, 121 bp, Artificial Sequence
  Synthesized
  misc_feature (61): n=t or c
cagctctcctgatcactggcacacacggttctttccattcacagccaggagttaactccanagaaggacaacccattggtctgttattctgcccatttatgaaatatctatccagattttt

SEQ ID NO: 39614 - DNA, 121 bp, Artificial Sequence
  Synthesized
  misc_feature (61): n=c or g
gaatttaatcctgacatacgattttaatgcatttaccagaatgagcgagaaatagaaatantgttatttttgtttgaagatttcctacctattttatggatattttactttactaaaatga

SEQ ID NO: 39615 - DNA, 121 bp, Artificial Sequence
  Synthesized
  misc_feature (61): n=a or g
ataaaataaaataaaataaaataaaataaattaaattaaaatggaagagcctgagttaagnggaaagagaggcgcccagtttccatttccacaccacttattggctgctttcagtccctcc

SEQ ID NO: 39616 - DNA, 121 bp, Artificial Sequence
  Synthesized
  misc_feature (61): n=t or g
tccccatgcagacagcagattgaaaagtgatactgggtatcattacgctaataaattcatnaattggtcttcctaagtttgagtacatcataaggtacaaatgggtctgcctttttatgac

SEQ ID NO: 39617 - DNA, 121 bp, Artificial Sequence
  Synthesized
  misc_feature (61): n=t or g
tttaaatatcctccagaatagcttgtggctacataataaattgatcagtagctgagcaatncaagttaaagcattgcaaatgaagtccaagggtagaaatcagcattagatagacagaatc

SEQ ID NO: 39618 - DNA, 121 bp, Artificial Sequence
  Synthesized
  misc_feature (61): n=a or g
atctcagaacacaaactttgaagtgagcaggctttgaaaagctgtctactgtgctctaacntgagtagaataaatagtctgtgatctgaagtctgtgaacctgcagtgtatgcttcaaaga

SEQ ID NO: 39619 - DNA, 121 bp, Artificial Sequence
  Synthesized
  misc_feature (61): n=a or c
tagtgacattttacacagtgctgctctacactgttctccaggctggagaagggcctggtgnagagcttgagtgcagccaggttttactcaaaggggcaggagacccactgtctccagactt

SEQ ID NO: 39620 - DNA, 121 bp, Artificial Sequence
  Synthesized
  misc_feature (61): n=t or c
accaacatgttatattaagcagcatgctggggtcggctttctcaaaaaccatttctgtttnggcaaaatgacctttttttggtggaaaagtaattgacagagaaattccccaccaagtgcc

SEQ ID NO: 39621 - DNA, 121 bp, Artificial Sequence
  Synthesized
  misc_feature (61): n=t or c
tccctgaattttaagccagtttctattatgttttgttataaacagtataaccacaatttgngttctatgtgaagaatcaacttccatctgaggtgtgtaggacgatactatcttcatctag

SEQ ID NO: 39622 - DNA, 121 bp, Artificial Sequence
  Synthesized
  misc_feature (61): n=t or c
attgctaggcttcccaagcattttaacctaggataaaggctagcctttacatgcatgctgnctgttatacatgaaacgaaaacacatttcccaccataggaaagtaacgattaacctgcat

SEQ ID NO: 39623 - DNA, 121 bp, Artificial Sequence
  Synthesized
  misc_feature (61): n=t or c
tttctcatactgggagaacaaatattcgcttatcattctagcatctggcaaagaagcagcnacagaatctcatatatccctacacaattcgccataactggcaggcttttctaaaactgaa

SEQ ID NO: 39624 - DNA, 121 bp, Artificial Sequence
  Synthesized
  misc_feature (61): n=a or g
tgtgtgatgccattgcatagctaaggggaaaaggagaggaaacagtgccttgtgccccagntgtgcagggctggattcagtccttggttcttactcaaactcaagtggtgaaactggagtt

SEQ ID NO: 39625 - DNA, 121 bp, Artificial Sequence
  Synthesized
  misc_feature (61): n=c or g
aaacaagttagaaatgctcagcatggctgttttgaaatggaattacttccctgattttgtntctcacaataatttaaccaccaaatcaactcagatactctgcccgacagtgaaaatttca

SEQ ID NO: 39626 - DNA, 121 bp, Artificial Sequence
  Synthesized
  misc_feature (61): n=a or g
ctgctgctaaaccacaagaaacccagtggggagaaacaggtatgtataggatttgctctcngtgtctaggctgatctgatcaaaagagaagaatcatgcaaagcgcataagcaagaagaaa

SEQ ID NO: 39627 - DNA, 121 bp, Artificial Sequence
  Synthesized
  misc_feature (61): n=t or c
tcatacgaaaagataagaactttcaatgaggtaacctcgatgcacaagaactccttttccnccagctaaagctctgtggtgcctatagtattcttagcaacagccatttggaatgtggtgc

SEQ ID NO: 39628 - DNA, 121 bp, Artificial Sequence
  Synthesized
  misc_feature (61): n=c or g
cacacatatgtgctggatgatctgacctctggcttagttttaactaattctgtttgatttntgctaattttcccaccttctttaaaaagtgtaatgcctgttgtgcaaagaaagaagcagt

SEQ ID NO: 39629 - DNA, 121 bp, Artificial Sequence
  Synthesized
  misc_feature (61): n=a or g
cttgctcatccagcagcctgctttgtggttcagtgactgtgcaagccaggatcctggcatnctataaggtagaatggctgctctatttctggttttaaaaaggagattttctcagttcttg

SEQ ID NO: 39630 - DNA, 121 bp, Artificial Sequence
  Synthesized
  misc_feature (61): n=t or c
ttttcattttgctggtgttttgaaccataagaaagagtggtcattgggagagtagtcgtanggtaaggttgaaataaacggagaggttgaggggtatgcactttgcttagtgttaacatcc

SEQ ID NO: 39631 - DNA, 121 bp, Artificial Sequence
  Synthesized
  misc_feature (61): n=a or g
gaatttttacttttcaggaaacgagagccatgtcaagcatccaagttctactaaaagtcanaacttgattctctcatcctgacctaggcctatgaaaatcctaggcctttgccctgtggca

SEQ ID NO: 39632 - DNA, 121 bp, Artificial Sequence
  Synthesized
  misc_feature (61): n=c or g
gcagagatcaggtgaagggtacgtgtttttcctgtttagaaaagcatacctaagaccccanaggtgtttgcacccaaagcatttaaccttttgtttgctacctgcatggagagattgctgg

SEQ ID NO: 39633 - DNA, 121 bp, Artificial Sequence
  Synthesized
  misc_feature (61): n=a or g
ggacaggctcagagttgagccctaatgcacagattacagtactacagctccccaggctccncctgctccatgattactgctccaaaagtgacaaggagcaggcagcgcatccttcctgctt

SEQ ID NO: 39634 - DNA, 121 bp, Artificial Sequence
  Synthesized
  misc_feature (61): n=a or g
aaccagtttgattcaacattgattaccatgtgttaatgttactgcttgtgttatttgaacngtatttcattaatagtgttttaggaaaatacatcaaatatattaaaacaagacaagttcc

SEQ ID NO: 39635 - DNA, 121 bp, Artificial Sequence
  Synthesized
  misc_feature (61): n=t or c
cagatttcttttgcctagaaaaaaaccttagttctcaatgtattgtcagtatgtgatagtngacccctgtgcatgtgtttggggctttaattattgtgaaggaagccttagaagagggtat

SEQ ID NO: 39636 - DNA, 121 bp, Artificial Sequence
  Synthesized
  misc_feature (61): n=t or c
cggtgctgctcacctcacccacaccacgaggataaaggggtggcatcttcctcaccagcangggaaaataagggttctgcaaaccctttggaaacagaaggttttaagtgatgtggtatga

SEQ ID NO: 39637 - DNA, 121 bp, Artificial Sequence
  Synthesized
  misc_feature (61): n=a or g
cactcctctgaactacagtacagtaaataaaaataattactacatttcaggaatacggctnctacaatactataaggcagaggtgaatgtaaaggacttctacctgaaaacagcacatgtt

SEQ ID NO: 39638 - DNA, 121 bp, Artificial Sequence
  Synthesized
  misc_feature (61): n=a or c
ttcctctttgtgaatttggccatctactgctagaagtggggaaaaaagataaaagtgaggntcgccccacagttgtgactcaaccctgctgccccccatctcttcaccatgcatacgtatt

SEQ ID NO: 39639 - DNA, 121 bp, Artificial Sequence
  Synthesized
  misc_feature (61): n=a or t
tccactgcacaagggagagaagggatgaaacacaacttactcccaacttcttcagtccttnaacttaaaacacacccctcggtggtttgtgcaagaagcttctaacatcttactccaaggg

SEQ ID NO: 39640 - DNA, 121 bp, Artificial Sequence
  Synthesized
  misc_feature (61): n=a or c
ctccttctcttcagggataaactgagatgattcagtgtactctccagcccttattttaatnccatttaaacaaataattgtgccctacaccttccttaattatcagtttactctattatgc

SEQ ID NO: 39641 - DNA, 121 bp, Artificial Sequence
  Synthesized
  misc_feature (61): n=c or g
atgctcgatcccaagggttgagtccctgctcacagcaaccaaaaggcagatggcctgcagngacttctgaccctctttgttttggtcgtagatctgcatacagcaagggtggaaggcaccg

SEQ ID NO: 39642 - DNA, 121 bp, Artificial Sequence
  Synthesized
  misc_feature (61): n=a or t
ggtgccaaaggaagatgatctgcccaaacacagtacttaggaagggtatgcactgctgcantgtaagaaaatgagttagtagcaaatataagccccaaaggactctatgccactgaagatg

SEQ ID NO: 39643 - DNA, 121 bp, Artificial Sequence
  Synthesized
  misc_feature (61): n=t or g
agatttttcataccaagataagctaaacaaccactccctgctttgaagccttacagttggnttggtgacaatttaaagaccagaaaaatcattctgtgctttagaagcagactcagtcttc

SEQ ID NO: 39644 - DNA, 121 bp, Artificial Sequence
  Synthesized
  misc_feature (61): n=t or c
cttagtacagctgacaaatttggatccataaatacctgctaagtttcaagattgactacgnaggacttcgaagaaatagggcattcagactcagtttctggcattaaaaaacaccactttg

SEQ ID NO: 39645 - DNA, 121 bp, Artificial Sequence
  Synthesized
  misc_feature (61): n=t or g
ctgtagcggtggtttcttagggcatggggggcttgccaaaatgggaaaccaaagctgtgangaggaatgcctcaagatccctaaaaactccccaaattcaccaaaccatcctggctgctga

SEQ ID NO: 39646 - DNA, 121 bp, Artificial Sequence
  Synthesized
  misc_feature (61): n=a or t
aataaagtgcttgtgtcacatatagatctgcaagccagtgccaaaacctatggtggcaggnaagcaggtggctccttcaatcatagaatcaccaaggttggtggtagaaacatctcaagag

SEQ ID NO: 39647 - DNA, 121 bp, Artificial Sequence
  Synthesized
  misc_feature (61): n=a or t
taaaacactctaattacactttgtttttgaaagcaaaaaatagcatttggggtaggtatangtcagaggtaggtgttcttttgtttatctagtcttgtaaatggatcaaccagtctgatta

SEQ ID NO: 39648 - DNA, 121 bp, Artificial Sequence
  Synthesized
  misc_feature (61): n=t or c
attatatttgaagttatcaagaaacaaaatgttgtttcttctctctgccttccaaagttgntgggaatttgtgggatttttttggtggtttttgtttgtttgttttgttctaaaggtaaaa

SEQ ID NO: 39649 - DNA, 121 bp, Artificial Sequence
  Synthesized
  misc_feature (61): n=a or c
attaaacctattaactagtatctgctcagggaaagtggttgcacatggtgaatacattatnctggttttagtaactgttgccattagtatttgcagaccaagtaaatgggacatggtttaa

SEQ ID NO: 39650 - DNA, 121 bp, Artificial Sequence
  Synthesized
  misc_feature (61): n=c or g
agaacgaacataaattgatagtgaactatgtaatcaaccgcttcagagtaggtccataganctacaatgaacatggactatccattctatgggaaattcagtcagtccaggtttgctttca

SEQ ID NO: 39651 - DNA, 121 bp, Artificial Sequence
  Synthesized
  misc_feature (61): n=t or c
tctaaacaatcttctagatattatcctacatgtagaaacgtgtgtatacaatgcatataangtagcttaaaaataaagcacatactttaccgttccttttttttaacatctaattatatga

SEQ ID NO: 39652 - DNA, 121 bp, Artificial Sequence
  Synthesized
  misc_feature (61): n=t or c
tgagaagttgagtgattgattgccagattgaatcacttgagtggttcatactgctgggtantgcatgcaacaattagttgctgtgggacaatgtgctgctcagatacatccctatgcaatt

SEQ ID NO: 39653 - DNA, 121 bp, Artificial Sequence
  Synthesized
  misc_feature (61): n=a or g
agaaagattattagaaacatctgtatgccacttggagtactcctttttatcagaaataaangttctgcttctattctagtgcagctctgccaaacaaatctcttggtgcttttgtattcta

SEQ ID NO: 39654 - DNA, 121 bp, Artificial Sequence
  Synthesized
  misc_feature (61): n=a or g
attcttctcacacgtttactacaacaactgatgctatataacatgacattaggaagttcantcttaacagagaaagaatgaaaaaattccctgggaactttattacctggaagacgtgctg

SEQ ID NO: 39655 - DNA, 121 bp, Artificial Sequence
  Synthesized
  misc_feature (61): n=a or g
tcaggcagtctgagctcgggttgttgctgtatgaatgattaaagcagtgatcctccaagcngtatcaatcccctggatgctgaagtgggacccgaagaagacagacaagtttgaactactg

SEQ ID NO: 39656 - DNA, 121 bp, Artificial Sequence
  Synthesized
  misc_feature (61): n=t or g
cagactccctctttcaccgctgggaaggaaaaatgaaagagtaacaaaggccttttttggngggggggtcgttttgtggcgtttcagtcacttctaaatgaaatattcagatcgccttcgc

SEQ ID NO: 39657 - DNA, 121 bp, Artificial Sequence
  Synthesized
  misc_feature (61): n=a or g
taaattatagcatctttgatttgctcagatatgcactaaaatatcaaaatgagggctaatntttgcacagtgttgcaggctccaattttcacattggttctagtcatgtgacacaatccag

SEQ ID NO: 39658 - DNA, 121 bp, Artificial Sequence
  Synthesized
  misc_feature (61): n=a or c
gccttcagaagtgggagttagtgagaagtgggtattactgcttcagaggctggcagccagntaatccctacatgaagtggcagctgccattgagctcaagaaatgcgcacttcaccacaca

SEQ ID NO: 39659 - DNA, 121 bp, Artificial Sequence
  Synthesized
  misc_feature (61): n=t or c
aacggtgctcaatgggacaaaagtagcatccagggggatactgggttggctagtggtagcnggagggcgccgggatgatcagaggtgtgtagaggtacacagtggtggccggtggtgctca

SEQ ID NO: 39660 - DNA, 121 bp, Artificial Sequence
  Synthesized
  misc_feature (61): n=t or c
tgctcaactattttctttgtctcataagaagcactgacttcaagcacacagttggtgaggnccccatgaagttctctgcagtttgctgaataagactgtgcacattttgaaacaaattaga

SEQ ID NO: 39661 - DNA, 121 bp, Artificial Sequence
  Synthesized
  misc_feature (61): n=a or g
gccaggacaaagcctggcattaacaccagatggaaacgtggggtcacagcatttcagtgcnaggaacacgaggctcacctcgccctgctttgctctgggcacccacctgtgctggcagagc

SEQ ID NO: 39662 - DNA, 121 bp, Artificial Sequence
  Synthesized
  misc_feature (61): n=t or c
caatgccttcttgccagattgcatgagatttgtggatacttggatttttcgtaaccattgnagctctacaggatgttttcagtggtgaaaagctcttgtttagacagctgttcatgttgtt

SEQ ID NO: 39663 - DNA, 121 bp, Artificial Sequence
  Synthesized
  misc_feature (61): n=t or c
atatattttggggtagaactaaactaaattatcatgactaaaattcatgaagttcttaagntcatcttagctgtgaaatttgcatcggtatctctatggctttcttatatgaaataattct

SEQ ID NO: 39664 - DNA, 121 bp, Artificial Sequence
  Synthesized
  misc_feature (61): n=t or c
cttcatttcagttttgagctgcctcttgcagatttcagtccctatttcaaacaggattccnctgtcatcctggtgctggtgggcacaggagcaagtgggaaaagcactgttgtgagccagg

SEQ ID NO: 39665 - DNA, 121 bp, Artificial Sequence
  Synthesized
  misc_feature (61): n=a or g
ttatttctccattacatcttcccttgtatgtcttggcagctgactgtaccttattaccttngctgggcaatcttctgagatgccttttggaaacaagtaaactctgtccagggaatcagct

SEQ ID NO: 39666 - DNA, 121 bp, Artificial Sequence
  Synthesized
  misc_feature (61): n=t or c
tctcggatcctttttgccccttcaatgtcctcggggctatttggttgccccgtgcctctcngtgtgacaattgcttgtttccctgtccctgcaggacatcttggaaggtgggaacctgtgg

SEQ ID NO: 39667 - DNA, 121 bp, Artificial Sequence
  Synthesized
  misc_feature (61): n=a or c
tagcatatcttggatattttcctatttcctctcatccattctctgcaattttgttttttcntagattgtatttatcttccacactgcagaaaacatgcagaaagggaattatagccttgcc

SEQ ID NO: 39668 - DNA, 121 bp, Artificial Sequence
  Synthesized
  misc_feature (61): n=a or g
ctacatgaacagcatgcaattctatttatagactccactgtgttgagactgaagagaaatnctgggatgggtgaaatagtaaagaaaaaattctttattttgttcatgtttgtgttcttgc

SEQ ID NO: 39669 - DNA, 121 bp, Artificial Sequence
  Synthesized
  misc_feature (61): n=t or c
gtaaaatctaatcactaagaactaaacgggtgaaggaccaaaacatcagaacaggatatantgatgtatttatttgacattttcctatatttaacctaatatgaagtataatatcaaaaca

SEQ ID NO: 39670 - DNA, 121 bp, Artificial Sequence
  Synthesized
  misc_feature (61): n=c or g
tttgtgaatctgtctccccctttattttctgctaagatttttttccccacccaaatcatgncagtgcaagaaaacagaaagaaggaacttttctctataagatgactatgggaggaaagaa

SEQ ID NO: 39671 - DNA, 121 bp, Artificial Sequence
  Synthesized
  misc_feature (61): n=t or c
ttagaatttcattatcaatttaaaattatttaaaattaaatttgaaacaacttgaatactnttattgtgcatactgttctaattactaaatttctggtgggggtaaattaattgactcttt

SEQ ID NO: 39672 - DNA, 121 bp, Artificial Sequence
  Synthesized
  misc_feature (61): n=t or c
gagtaaatgaacgatattgcaacaaaaactctgtcagaaatatctcgttggcaccactganattaccttgtaagtctgaaaatcatctgatactcaggcagggtcaacctgggtttcagct

SEQ ID NO: 39673 - DNA, 121 bp, Artificial Sequence
  Synthesized
  misc_feature (61): n=t or c
cctgtcctcgactcagggacggggactcaagccccattatgctcagttcatgagactcttngtggtggttcccgacgctccgctgcaaataacgctgacgcctcaggtaagagatggaatc

SEQ ID NO: 39674 - DNA, 121 bp, Artificial Sequence
  Synthesized
  misc_feature (61): n=a or c
ctatgatgagttatttcaaacaggccacagaaacggataagaaagacctaactaagaaggncgctgttatacagtaatactgaatgttagcatccattatcccatctgactaaggagtttg

SEQ ID NO: 39675 - DNA, 121 bp, Artificial Sequence
  Synthesized
  misc_feature (61): n=t or g
gctgttcttttgattgaacagtcattgcagagcccaaaggaagggatatgctgggctttanggacacaaactatatgattacaaaacaagttgactattgaaaggaaactgtttctgacta

SEQ ID NO: 39676 - DNA, 121 bp, Artificial Sequence
  Synthesized
  misc_feature (61): n=a or g
atcagttgtgttcattaagaatttatgcactgcagcacgatctcctcaatttaggggaggnttaattaatttaatgggggtttgctgagctttgtccctcccgtgtgaccctcctggtgtc

SEQ ID NO: 39677 - DNA, 121 bp, Artificial Sequence
  Synthesized
  misc_feature (61): n=c or g
atggggcagggcagggttgtctgcaagcgttcagaaagtttgagtctggtcccaccagatnatggaacagccttactggtcaggtggtgatgttataggttaccatgtgctctttgtgttt

SEQ ID NO: 39678 - DNA, 121 bp, Artificial Sequence
  Synthesized
  misc_feature (61): n=a or g
caggtggaacctcgagctgcctgagctgcacaatacaggcaatgcattggcacatcatcancgtgaagtatctcaaattcccaaatcagccccaaatgtctttttacctcaagccaaaaat

SEQ ID NO: 39679 - DNA, 121 bp, Artificial Sequence
  Synthesized
  misc_feature (61): n=a or g
agaaaagatcactgaaaatttacataatgttgaactgaaaattatttagcagtcacattgngacttagataattattaattatttatcctgtctttctatcaccagggaggagcgggcggt

SEQ ID NO: 39680 - DNA, 121 bp, Artificial Sequence
  Synthesized
  misc_feature (61): n=c or g
aggggagaaaaaggcaaagctgttcgcttcagctgtgcgactgacaagctgcagcaatganatcacccccagccccataatcagggccgttttccattagcaattcacagtgctgcagcac

SEQ ID NO: 39681 - DNA, 121 bp, Artificial Sequence
  Synthesized
  misc_feature (61): n=a or g
tgtgaccttcactgcttttttccctaactgcatgggggaagacccttccttagcggcgtcnaaactacctgtaaagtttttcagagattcaatgactcctgaactcatttattcctctgaa

SEQ ID NO: 39682 - DNA, 121 bp, Artificial Sequence
  Synthesized
  misc_feature (61): n=a or c
ttaacatacagttgggggaagtctgatggtctacgatgattcttgtttgtgaagctgttgntggacagaacctgtcacacagaaattctccctcctcctggagcagctgcccagctcaggg

SEQ ID NO: 39683 - DNA, 121 bp, Artificial Sequence
  Synthesized
  misc_feature (61): n=t or c
tttgaccctcttccacgcagacaattgagatattttaaagtggctcatgagcacaggactngtttttcagagggaagctttaagttaccaaaggaaagatccatttagatggaacgtctaa

SEQ ID NO: 39684 - DNA, 121 bp, Artificial Sequence
  Synthesized
  misc_feature (61): n=c or g
acattgtcccttgtgtgcagttggattgtctggaaggcagaaagtggtatgaggaatgggncaattaataatgataataatggtgctgtgcctcttgcaggcccgagatagccctagggag

SEQ ID NO: 39685 - DNA, 121 bp, Artificial Sequence
  Synthesized
  misc_feature (61): n=a or g
ttccaccgattaccataatactacaaaggctgacatcctgctgtaatttttaatgacggtntacttaagtatttcaaaagtcttaagcgtgttttacaacccttacttaccagcaagctat

SEQ ID NO: 39686 - DNA, 121 bp, Artificial Sequence
  Synthesized
  misc_feature (61): n=t or g
ttttgaaatttctacatgctccaaataaaacaagctgcgtggatgtatgggactaatttgntttttttggaactttacatacatggatatattattactatcattttcatcatccttagct

SEQ ID NO: 39687 - DNA, 121 bp, Artificial Sequence
  Synthesized
  misc_feature (61): n=t or c
gactttctagatgaatctgaaacaacctcattttacagcttgaagttctggagcttactcnaaaccaaagagaagaaagtttagcttactcttgggtatcagctaactaactctcataaca

SEQ ID NO: 39688 - DNA, 121 bp, Artificial Sequence
  Synthesized
  misc_feature (61): n=a or g
cagaatcaggtggaatatttctagcaagacatacaggacagataaagcttctctcctaagnttttcagcatgtttcgtttctcttttcgtagcatactggtacaccttagtcgcgggggag

SEQ ID NO: 39689 - DNA, 121 bp, Artificial Sequence
  Synthesized
  misc_feature (61): n=t or c
ttttaaatatgcagttctgcaatagtggttcagttgtgaaacatttgggacacaaccaaantaacataaagtaaatgcacggaatgcactgatggacagtttccaaagcaaaaccttgcag

SEQ ID NO: 39690 - DNA, 121 bp, Artificial Sequence
  Synthesized
  misc_feature (61): n=a or c
tctgtggaaaaattcatgggcatgaacaatctctgcttaaaaatctgctttagaatgcaantttgtaaaataatgttgtgtggttcagcctttgtcttagtgatttgcaggtaatatcttc

SEQ ID NO: 39691 - DNA, 121 bp, Artificial Sequence
  Synthesized
  misc_feature (61): n=a or g
gtcacattttatttattttttgcttattttcttattattgaaaattgctccaggctgcacntgtattcctttgactgccagtacaaagaagaaatacttgctggttttgctttagtataca

SEQ ID NO: 39692 - DNA, 121 bp, Artificial Sequence
  Synthesized
  misc_feature (61): n=a or g
tttagaagtggtacataatgaatagctcttctcctatttccacgtttctaaacgaagatcntgctttaaaaatccattcttttgtcttatgaaagtgaattaaacactttttttttttttt

SEQ ID NO: 39693 - DNA, 121 bp, Artificial Sequence
  Synthesized
  misc_feature (61): n=t or c
tcgaggtttagatgtgtgtgggaacagaaccaagagggagcatttggaagagcagtcccanggttcttcatttttgtggaagagtatccacaaaatacttttattgggtcttaatgctagg

SEQ ID NO: 39694 - DNA, 121 bp, Artificial Sequence
  Synthesized
  misc_feature (61): n=a or g
atatctagaccgaatagttgcttggctccttatctacagctagttacaaaacaaaaataanttttaaaaaagaactgagctgcatagtctcctccatttccattcttgatcttaagtggta

SEQ ID NO: 39695 - DNA, 121 bp, Artificial Sequence
  Synthesized
  misc_feature (61): n=t or c
cacaaatagctgtatccttacaagtgcaatacaaaacatcatactggaacgtattaacagnttgttgacagtaagacttaaagatgtattcaaagttctgacacataattgattttttggc

SEQ ID NO: 39696 - DNA, 121 bp, Artificial Sequence
  Synthesized
  misc_feature (61): n=a or t
agtagctcaagggactctctgtaaaagtttccagaggttggtggtatacaattcctagttngcaacaatttttcctttgtccagggccgtttccctaccttttcccttttcgcacctcctc

SEQ ID NO: 39697 - DNA, 121 bp, Artificial Sequence
  Synthesized
  misc_feature (61): n=a or g
gattcaagacactgtgacaacagcctaagcccatgtccaatgaatattttaaaataggggntgtatatggtaaagtattaaggcccataagcaccataagggctagcataacagctgaccc

SEQ ID NO: 39698 - DNA, 121 bp, Artificial Sequence
  Synthesized
  misc_feature (61): n=t or g
tttcccttgttcctttgaaggatgttccttcaaattccctaaactccgctggctttttgcntacaattttttttataatggaaaataagagttgatcccaaaaagagacatctacttatta

SEQ ID NO: 39699 - DNA, 121 bp, Artificial Sequence
  Synthesized
  misc_feature (61): n=t or c
ttattgttatgataaagttgttgggcaagctgaattctgatgcatttttttctgtaatacngttttgtggagtggctgattcttccaaggatgagatttctgttttgattcttcaaaatga

SEQ ID NO: 39700 - DNA, 121 bp, Artificial Sequence
  Synthesized
  misc_feature (61): n=t or c
tgcttgagtcccagtggggatggaggccctatgctgctttgattgcatgtcctcccattcngtcaatatttagttcttacacctctcatctgttggaacatcgcccttctcagaaaaagca

SEQ ID NO: 39701 - DNA, 121 bp, Artificial Sequence
  Synthesized
  misc_feature (61): n=a or g
tgcaaaaagaatccttgtataagctcactgaaaaggggtgaaggaacctaatgtaaagctnagttgttaagttgtttgtagctaaaaatgcaacttatataaatctgcaagtttcccacgc

SEQ ID NO: 39702 - DNA, 121 bp, Artificial Sequence
  Synthesized
  misc_feature (61): n=t or c
gagcatcagttccttagaggggaagacgccgtgatttatgcaaaagatgaaaagatacagngtgaaaatgcagttctggaaggaatttacatttgcaattcaacctccttctggaaagcca

SEQ ID NO: 39703 - DNA, 121 bp, Artificial Sequence
  Synthesized
  misc_feature (61): n=t or c
ccttaggaataggaacagccaattgtgcctgtcttcagcagagtcaagaagaaggacctanggaattatttggtagtcagcatgaccctaatctcccgggaaagagatacatcaacttttc

SEQ ID NO: 39704 - DNA, 121 bp, Artificial Sequence
  Synthesized
  misc_feature (61): n=t or c
accttcaaccacttcctactgcaaaccagtagatgaacctatgccagatcttaatggactncattatgtgacagttttctgcagaacaaaggcatgctttagccataaggtaacagtgagt

SEQ ID NO: 39705 - DNA, 121 bp, Artificial Sequence
  Synthesized
  misc_feature (61): n=a or g
gaataataataaaaatcagagtatgagtctgcaagtgtgaatgttttatccctatctgctntccgaggtttctaacctgaaactcaatgagatattcaggccctgataatggggatcctgt

SEQ ID NO: 39706 - DNA, 121 bp, Artificial Sequence
  Synthesized
  misc_feature (61): n=a or t
ttccaaaaacagttccattgtgcaaattgttgtgtattaggtgtgggaaataagttttcantgaaaaagcagaactcttactttcttgtgtctggcaaactaaggacaaggctataattct

SEQ ID NO: 39707 - DNA, 121 bp, Artificial Sequence
  Synthesized
  misc_feature (61): n=t or c
gcattttctaggtttctccaagctgtacattctctgaatcaaacctggactaaacatgttnttaaacacaatattttttactcctgtaactctaacagactcaatcagttctacttaaaga

SEQ ID NO: 39708 - DNA, 121 bp, Artificial Sequence
  Synthesized
  misc_feature (61): n=a or t
ccacagcatccaaacaaacaagatctgcatgcatgagcatgactgacaactttgggcctcngtagataccacccatattagccagctatttagcagacagagctacaaaaaaaaaaaaaaa

SEQ ID NO: 39709 - DNA, 121 bp, Artificial Sequence
  Synthesized
  misc_feature (61): n=t or c
aaaagagagcgatgtaatcattaagtatctacatgagtaataagcaatactgcagctctgncaaaagatgatcaattaagcccttgaccagaaaattgcacagatgctgttaaatctgaaa

SEQ ID NO: 39710 - DNA, 121 bp, Artificial Sequence
  Synthesized
  misc_feature (61): n=a or g
catatatttgctgagtttatctcacagcttggacatcccagtgcccactgtaactgatgcnggctgtggtgtgtgcatgttatccctgtcctccgtatgatgctgattcatattcagtttg

SEQ ID NO: 39711 - DNA, 121 bp, Artificial Sequence
  Synthesized
  misc_feature (61): n=t or c
tggttcttccctgtcagctctcaagacaacaactggctgtgctctctataaaggtggtcanataactgccagtttatgagaccttaccaaaatgtattcctgttgcactgaagatgcccca

SEQ ID NO: 39712 - DNA, 121 bp, Artificial Sequence
  Synthesized
  misc_feature (61): n=a or g
cttagtgttggtcaacctaggtgcagtactgatttcacagtttaagacactttaaagtgcnaaaaaagcaagtcccgatactgacttagagacctgtaaatacagaagtactaggagataa

SEQ ID NO: 39713 - DNA, 121 bp, Artificial Sequence
  Synthesized
  misc_feature (61): n=t or c
tctcacgccctttctcctggtgttgctttggattactgtaagggtcatcgatctgtcggancgctcacgcgggcaattaaagcagtaaataaggaaggggagggagcggggctggaggaag

SEQ ID NO: 39714 - DNA, 121 bp, Artificial Sequence
  Synthesized
  misc_feature (61): n=a or g
accgaatgcgagccatctgtcaaaaacaaaagctaaattctgtgtaataaaagccacacantgattgatatttcacattaaagggagagctgaagaaagcaattttgtttatgggcaaacc

SEQ ID NO: 39715 - DNA, 121 bp, Artificial Sequence
  Synthesized
  misc_feature (61): n=a or g
ccagcctaaaacacagcaagtacagaatctatatcagaaacaaaagctcaaacagggcaanagtgttaaaacaaagggagttgtgttgtaatcatcagctttaccccaaagagcttctttt

SEQ ID NO: 39716 - DNA, 121 bp, Artificial Sequence
  Synthesized
  misc_feature (61): n=t or c
aaaaaggagaggaaaaaaaaaaacccaccccaaacctgcctggaaagaaacaacaagcagngatggatctaaaacacaaagaagtgttatccgtgggcattattgattaagttttctgcac

SEQ ID NO: 39717 - DNA, 121 bp, Artificial Sequence
  Synthesized
  misc_feature (61): n=a or t
acttagacaacacaaaacaagttgttttggcaaggaaccccccttaactactccactgaanatcctcatttccttctgtagtcatagaaaggaaataaacattactgggttgccctttctt

SEQ ID NO: 39718 - DNA, 121 bp, Artificial Sequence
  Synthesized
  misc_feature (61): n=t or c
ggactcttgtactaacgaaggaatgatttattatcatttacataacctggcatttgtgcanaccaaaggccagattttcagagtgctctgctcctgcagtttggggccaggctttcactgg

SEQ ID NO: 39719 - DNA, 121 bp, Artificial Sequence
  Synthesized
  misc_feature (61): n=a or g
tccatgattcctgctgcttctcctgctaccaaggccagcaagatgggtgctaaccaggaanagggtgggcgagagaatataagtgaattattcaaatcctaacatttcaaccagacaagtc

SEQ ID NO: 39720 - DNA, 121 bp, Artificial Sequence
  Synthesized
  misc_feature (61): n=t or c
cacagcaccatttctgtctttattggatttaggctcatgactttttcagcaccattcatanaaatggtgtcataaaatacgaatcaaaactccaggtccgtgaagggagttaaggatccaa

SEQ ID NO: 39721 - DNA, 121 bp, Artificial Sequence
  Synthesized
  misc_feature (61): n=t or c
agctgtactagagcctctaagcttttcaacaaacaaatgctcaaaccgaaaatccccagtncttctacttctttttattagctctatgttggctcaacagcagctttcatgctagtagcag

SEQ ID NO: 39722 - DNA, 121 bp, Artificial Sequence
  Synthesized
  misc_feature (61): n=t or c
gatgttccaaagcagggtctgtgcaggtggggacacaacaggtttggggaaggtgacatcnattcccatgtattttttgccacattgatttctataaattttatgtagaaaccatgagcct

SEQ ID NO: 39723 - DNA, 121 bp, Artificial Sequence
  Synthesized
  misc_feature (61): n=t or c
tgtttggctagagttctagcttaaaaaaataatggtgggaaaaagaagataaagtctatgnaagaaaggtggctgagtatgaaaatgagaagaaaaataggaagatgaggtgtgggttttt

SEQ ID NO: 39724 - DNA, 121 bp, Artificial Sequence
  Synthesized
  misc_feature (61): n=a or g
ataaagcagaaaagttaaagaacagaatgcctataggggagaggcgttgcggaatgccccnctcctccctcactctctccacccatagtaccctcctcctcctctccccctctctccttct

SEQ ID NO: 39725 - DNA, 121 bp, Artificial Sequence
  Synthesized
  misc_feature (61): n=a or c
caggcagatagcaatgcaaaacacagaaaacaataggtgaaacagcaatgggcttacaggnacaaagagaattaaatattttggatatttaaactttggtgcctgccagtttggcaggcta

SEQ ID NO: 39726 - DNA, 121 bp, Artificial Sequence
  Synthesized
  misc_feature (61): n=t or c
gccaagatatccaaggtccgtcatgggctctgacagaggtaattttatttgtagtatttcnagttcaaagccttgtcagttactgaatgaagttgctcaaaaatctaaatacaggaatttt

SEQ ID NO: 39727 - DNA, 121 bp, Artificial Sequence
  Synthesized
  misc_feature (61): n=t or c
gactggggggaggatgttataagacaccaaaaatggggagaatttcggcagggagcagacncagttctggtgacagccacaagaagtggaaatacaaactgaaaacatttcactgactgat

SEQ ID NO: 39728 - DNA, 121 bp, Artificial Sequence
  Synthesized
  misc_feature (61): n=a or g
aagaattcccaaagaagttaatttcctgtctggaggacatttaaatgtgttgcctttattnttctgttagatttcctaatcagaaaggactgggttgtaaaataaaacagttggaatgtga

SEQ ID NO: 39729 - DNA, 121 bp, Artificial Sequence
  Synthesized
  misc_feature (61): n=a or g
agagcaggacacgagcaaagggattacagacccgacccgctccaccgggcattaaggctcnggagcagcactcaacctatggaacagaggagctggctcctcaatatttttcactataatt

SEQ ID NO: 39730 - DNA, 121 bp, Artificial Sequence
  Synthesized
  misc_feature (61): n=t or c
tttgcatatgtgacacacacaaccccatggctgaaactcagaggcagaaagctatagggcnaggagaccaaggtaccaagctgttcctctaaagaaagttgaatcaggtcctacaaacact

SEQ ID NO: 39731 - DNA, 121 bp, Artificial Sequence
  Synthesized
  misc_feature (61): n=a or g
gagatgttgctgctcctcaggtgtgggatttctagaggggatttccgacacggagcttcancaaagctggtggttaccaacctgctgcttggatgtccgttgcttcagaatttacacataa

SEQ ID NO: 39732 - DNA, 121 bp, Artificial Sequence
  Synthesized
  misc_feature (61): n=t or c
atatattttttacaataagaaatgtccctagcagtctgagagagtcttttctctctctatntgggaacaggagaatggaaaacctcaatttatatctcagcatactcagtggagtcattaa

SEQ ID NO: 39733 - DNA, 121 bp, Artificial Sequence
  Synthesized
  misc_feature (61): n=a or g
atgttgcatattctgcagtgttgtttacccatatcttgttctacatcttcattatttttanttcaggtagcaatacatccctctctcatagctgaacaataaatgtgacttcacctcctaa

SEQ ID NO: 39734 - DNA, 121 bp, Artificial Sequence
  Synthesized
  misc_feature (61): n=a or t
taaagatagaaagagagagagagagagagagagagagagaaaacacaacaccaagaaatanaccaccacacacctacatgcaggaggaaataactttcctccatgcataattaagttgggc

SEQ ID NO: 39735 - DNA, 121 bp, Artificial Sequence
  Synthesized
  misc_feature (61): n=t or c
aggccactgtcttcccatgaatctcccaccaaccccaatgcttcagatcactgcctctccnctaatcttcctccccttccctccatattctagaccactgccttcccattaatctttccca

SEQ ID NO: 39736 - DNA, 121 bp, Artificial Sequence
  Synthesized
  misc_feature (61): n=t or c
aggacagtgtcccattgaaacttaatgtgaattagagattagatccaattaggtgtctganattcctaaaaggaagtcttttaagcatttgtgtgcattctaaacaaagttgttcacagat

SEQ ID NO: 39737 - DNA, 121 bp, Artificial Sequence
  Synthesized
  misc_feature (61): n=t or c
ggctgcaaggagcagcgctgctcttcctgcatcttttggggagggggcttagcgttcaggnatggggctgaatgcggctctaacctcacctctgtcccttttcttcacaaaggctatggaa

SEQ ID NO: 39738 - DNA, 121 bp, Artificial Sequence
  Synthesized
  misc_feature (61): n=t or c
gtgctttgggccaccttgcatccactgttccttcttctctctgtgcatttggtccacggtntccctcactgtctgcctaagcacgagccattggtacttgcactacaacagcatctagcag

SEQ ID NO: 39739 - DNA, 121 bp, Artificial Sequence
  Synthesized
  misc_feature (61): n=a or g
cgctctttgacaggggcgatccagggggagttgtgggcagtgagggatttggtcgtgctgnggttgagatatgtggcacatacaccaagtgcacgatggagaaacacactccatctcccca

SEQ ID NO: 39740 - DNA, 121 bp, Artificial Sequence
  Synthesized
  misc_feature (61): n=c or g
ctagaaggaggcgataattgtcgatctccaaacagtttttgtgccttttgtattcacatgnggaagaataacttgaaagattattaacatgagatatcaaaagaagttctaacgttattac

SEQ ID NO: 39741 - DNA, 121 bp, Artificial Sequence
  Synthesized
  misc_feature (61): n=t or c
tatgttgaatggctcagcttccaatatacaaatggcatgtacgcactaaaatatcactgtnttcctcatgtcccaggtatcggctgcctttacacttttgctattggttgctgtgtctgga

SEQ ID NO: 39742 - DNA, 121 bp, Artificial Sequence
  Synthesized
  misc_feature (61): n=a or g
tctgtgtagaaaccatgtgtttgctccactattttaatcaggttttaagtggaatcgatgncataaagttgtgtaaaaaatggcataacagaaagcacagctgatctttaaaaactctttt

SEQ ID NO: 39743 - DNA, 121 bp, Artificial Sequence
  Synthesized
  misc_feature (61): n=t or c
aaacaacagcattccccctgtgcagcagtgtgtgcttttccgcaacatacagttagcaaanatgaatgacactcactgcaaacacaccttagcaaataaaaaaaaggttgtgatctgcagt

SEQ ID NO: 39744 - DNA, 121 bp, Artificial Sequence
  Synthesized
  misc_feature (61): n=a or g
agctgagatttttgtcacaacgctttgaagtgtaagatcgatacatgtatttgttaaattntaagtacaagtttttggcaaacaagacgaaattttgattaacaggtagaatttgcaggct

SEQ ID NO: 39745 - DNA, 121 bp, Artificial Sequence
  Synthesized
  misc_feature (61): n=a or g
tgcagagctgatgccctgcttttggtgctgttgggtgccctctggggcagttttcatcccngcagtcagggtagagtggcttgagatcccttggataggaaaacttgtattgaaatagctg

SEQ ID NO: 39746 - DNA, 121 bp, Artificial Sequence
  Synthesized
  misc_feature (61): n=t or c
gctgacctgacagaccccatcctcaacagaggacatttcatctttaagaaacagcatcacngcctccagatgttcttaccaaaaggcagggtttatctgaggtacagagtacatccaatca

SEQ ID NO: 39747 - DNA, 121 bp, Artificial Sequence
  Synthesized
  misc_feature (61): n=t or g
ggcaatgacaaaaacagctttgactggaatagatctaacaagtctgctggcacatgaaatncaagcagaatggtattttgtagtgctgaaatgatagaagatatgggaaaagtatgttttc

SEQ ID NO: 39748 - DNA, 121 bp, Artificial Sequence
  Synthesized
  misc_feature (61): n=t or c
caagttagatttaagtttgtgaacagcctgaagcatttaaaagaggtgaacccttcatgcngcaccgtaaactctgaaacatggtggttttggtgggccctactaagggaattatgaaaga

SEQ ID NO: 39749 - DNA, 121 bp, Artificial Sequence
  Synthesized
  misc_feature (61): n=a or g
gttgctcaattccagaaacaagtttccactctgtagatcacaaatattaggctgtgctacntttctgtatttaacagtaaatgaaagcacgtccacccaaatttgcttcatttacatctct

SEQ ID NO: 39750 - DNA, 121 bp, Artificial Sequence
  Synthesized
  misc_feature (61): n=t or c
aattaaactgagttcagagagcaagaatgcagaaatactcatctttcctgctatatatcantgaattctttttcaaagaaagcttaatttctacagaaattggcgattccagcctctgtgc

SEQ ID NO: 39751 - DNA, 121 bp, Artificial Sequence
  Synthesized
  misc_feature (61): n=t or c
accacggagaacaaggcagcgtttgccagcctgaacgtccatttgtccacaggacgcaggncctcttatctacagcacaccagcatctgtttcagcacagctacttaaaaacttaaccagg

SEQ ID NO: 39752 - DNA, 121 bp, Artificial Sequence
  Synthesized
  misc_feature (61): n=c or g
tctgagcaaaacaagaaccaaagcaggggagtccataaagggaataagaaaagacaactanttttatacgtgcacttaagtatttaggtcagtatttttagaataaatagccgtgggttgg

SEQ ID NO: 39753 - DNA, 121 bp, Artificial Sequence
  Synthesized
  misc_feature (61): n=a or g
tacttgttttaatccacagactatgtactctggccattcttgtcgttagcagtagccttcnagttcaaactcacaggtgagcacccttcatccttagcagcagctctggtgccggctgtgg

SEQ ID NO: 39754 - DNA, 121 bp, Artificial Sequence
  Synthesized
  misc_feature (61): n=a or c
aattcagaggaaatgtatctattggatttttttatattaaaatgctgggatccacaataanagcttttagaaaggcagcagtcacaattcaacttaaagactggtgaattgtaccgcatcc

SEQ ID NO: 39755 - DNA, 121 bp, Artificial Sequence
  Synthesized
  misc_feature (61): n=t or g
caccgctgacctgcagggctcagttaccattggtttccatggcactgtgtctggccctggncccagcacagtccggtgagtgagggctgttgccaggaggccaggtggtgctgcatccact

SEQ ID NO: 39756 - DNA, 121 bp, Artificial Sequence
  Synthesized
  misc_feature (61): n=a or g
atgctgatgtcttaaatgtctgccagattttattgaagtaaattttattatttacaacggnacattacgtacgtctcatgaaagtgttaatttgagtgaaggctgtgtacatacctccttt

SEQ ID NO: 39757 - DNA, 121 bp, Artificial Sequence
  Synthesized
  misc_feature (61): n=a or t
caaaatggcatccttaaacacttgatttaatctactgtaatattagctgctgtattttcgntcactacacttcttttgataaattctatggaaatagggcacagagaaaaagagctgggga

SEQ ID NO: 39758 - DNA, 121 bp, Artificial Sequence
  Synthesized
  misc_feature (61): n=a or g
acagaagggctgaatgcagtgactccagggagaactgatctcctgctgccacgagggtccnttcttggcatggccgtggtgcacagtgtggcaaaggcttcccccgcattgctggcaattt

SEQ ID NO: 39759 - DNA, 121 bp, Artificial Sequence
  Synthesized
  misc_feature (61): n=a or g
attttccaagaaaatgttccaattagcgcaactttttctccttatatttgttaaatacacnaaaagaaggcgttagctagggtataagattccagcattctctctcgtattttggcagaat

SEQ ID NO: 39760 - DNA, 121 bp, Artificial Sequence
  Synthesized
  misc_feature (61): n=a or g
atatgtttggttaggaagctttactgacggacacggtgacaaacatcacagacacaaaganaggaaaaaggatatttcctaactgggtgagctgccagaagtgctccagagaagcagaacc

SEQ ID NO: 39761 - DNA, 121 bp, Artificial Sequence
  Synthesized
  misc_feature (61): n=t or c
acagaccccaaatatattgcattttaccctatcttaacagtgcttgttttatcctattatntgttaatcaccataaaaacccactgcacaagagaagtatcactaaatggtggtcttacat

SEQ ID NO: 39762 - DNA, 121 bp, Artificial Sequence
  Synthesized
  misc_feature (61): n=t or c
tagatttataatatgtttattttattttcattaattcggtagattctactggtcactttgntcttacatacacagattctggtattctgttgcttcagcagtagaaaatatacaaaacgtt

SEQ ID NO: 39763 - DNA, 121 bp, Artificial Sequence
  Synthesized
  misc_feature (61): n=t or g
agctcttatgtggaaaaacatagagctgtgtcatcaaacaggtactaattctgccaggaanagacatgctcctccatcccctctgctttgcataagtgctgtttattttattagtactgtg

SEQ ID NO: 39764 - DNA, 121 bp, Artificial Sequence
  Synthesized
  misc_feature (61): n=t or c
aagtttccagatttgaactgcttgtcacattcataagtagccaatttatttcttctcatcngaccatgtaatttcataatctgtgtacacttttttcagtatctctacagtcactgaatga

SEQ ID NO: 39765 - DNA, 121 bp, Artificial Sequence
  Synthesized
  misc_feature (61): n=a or g
gacaaaaaaaaaaacccaactccaatattctatagtttggttcagttctggatatcacagngcactcttaggaatgcgtgagttcatcctgctttcctcattattttacagtggatgatga

SEQ ID NO: 39766 - DNA, 121 bp, Artificial Sequence
  Synthesized
  misc_feature (61): n=t or c
gtcatctctctccagctccataatgagttcatggaatttaagcagggcctttcttaggagnggtgctttcaacactattgaggtgcttttttttttcatcccataaaatattcaagattaa

SEQ ID NO: 39767 - DNA, 121 bp, Artificial Sequence
  Synthesized
  misc_feature (61): n=c or g
caaactgtcccagctggaagggtactccaacaaacaatgcggaacaaagcgtttgcagganaaaaataacaccaataaacttgtttgcttcatcgctgctctgtgctcaatgcaatctttc

SEQ ID NO: 39768 - DNA, 121 bp, Artificial Sequence
  Synthesized
  misc_feature (61): n=t or c
ccctgagtctccatggggtgcatgggctctccatggagcacacgggctcttcatggaatangtggggtttccaagaaacacgtggtggtccctgggtctctatgggttgcacggggtctcc

SEQ ID NO: 39769 - DNA, 121 bp, Artificial Sequence
  Synthesized
  misc_feature (61): n=t or c
tgtacagtgttattatttaatgcaaatgtgaatgtacttttcctgtgtcaggaaaaggaanagcaagcctcgttgtggggaaccatagcaattaagtttgaattgctttctgtaagttctt

SEQ ID NO: 39770 - DNA, 121 bp, Artificial Sequence
  Synthesized
  misc_feature (61): n=a or g
tgtcacactgacagtcttaatgcaaaaaaccaccaaagctgcaaagccagagcactgcttnccacagtagttaggtccaaacgcagacatcttcaagaatttatgttgaaaacatacttca

SEQ ID NO: 39771 - DNA, 121 bp, Artificial Sequence
  Synthesized
  misc_feature (61): n=t or g
tattttgaattacctggagcatacctccaaaaaatgcaaaagcccaaatcatcatttttanataatgtcctgtggaatattttgtactaaatggagctggctccatggtccagaacatctc

SEQ ID NO: 39772 - DNA, 121 bp, Artificial Sequence
  Synthesized
  misc_feature (61): n=t or c
atcctcagaacccagagctatctatgggctgcagtcaaagaagggttttcgctttggcctntctgagatcagcatcaggtataaagtagagagaaaatgcttttgatcgtaagacttgaaa

SEQ ID NO: 39773 - DNA, 121 bp, Artificial Sequence
  Synthesized
  misc_feature (61): n=a or g
ctgtgctgcacactgaggtgcaccgcgtcacaccaggtccttgtttctattggcgatggcnagcaaggtgaaggtgggttaacaggacagagaggaagggcagcacaagaaggctgctccc

SEQ ID NO: 39774 - DNA, 121 bp, Artificial Sequence
  Synthesized
  misc_feature (61): n=t or c
aggggtacacagataagaggtgtaatcatatttagctcagagagtcaggaaaatattttanttgactccacagataagctgctttccctgagtatgaaattgtttctggactgtgtacagc

SEQ ID NO: 39775 - DNA, 121 bp, Artificial Sequence
  Synthesized
  misc_feature (61): n=a or t
aggagactaattattttccactggcaagctgattttttgctttatatattgtatcagtacnccgttagggaagacatcagtaggcaaggaagaggctcatgtcatgatttcttttcctgtg

SEQ ID NO: 39776 - DNA, 121 bp, Artificial Sequence
  Synthesized
  misc_feature (61): n=a or c
tcttctttgagaggaaaatcttgctctggagaccatctttgctctccttccttctagcttnggcctgctgctggtaccagagaccaggctgtggtggctgggacatcacacgatggggtta

SEQ ID NO: 39777 - DNA, 121 bp, Artificial Sequence
  Synthesized
  misc_feature (61): n=c or g
aatttcttcttaagacttccccaaggcatcacttctcagataggcacaatgccaccatttncactccagatcaccaccacagcgccaggcagaacctcagtgtgtgtgcgctgctttgttg

SEQ ID NO: 39778 - DNA, 121 bp, Artificial Sequence
  Synthesized
  misc_feature (61): n=t or g
gatggatgaaaagttccttggaaatgaaacgtttttaaaaaactgaaagagttgttggatnccattgcagccaccagtttgtttcccagcactgtcgttgatataaattttataatagagg

SEQ ID NO: 39779 - DNA, 121 bp, Artificial Sequence
  Synthesized
  misc_feature (61): n=a or c
ctgggtacatttcagtagagtgctgggtatttcacttcatctaccaatagccagaacatanagcccaacagagtagtggtgtgagtaagaattacacacagtgataaggattcacagacat

SEQ ID NO: 39780 - DNA, 121 bp, Artificial Sequence
  Synthesized
  misc_feature (61): n=t or c
ttatgcaggtaggaaaaaaccacacaagccaaaagcatgcaccacaaatattctgaacagngtcagattttggatattaaaaacaaccttgaaaacatgtcaacttgtagtaaattataac

SEQ ID NO: 39781 - DNA, 121 bp, Artificial Sequence
  Synthesized
  misc_feature (61): n=a or g
ctgggaatgaataatgcatgtgttggggaaacagttgccccattctggcgtggggaggatngaaagagtgggtgtgggaggtattttcctgatcaagttagcattcccaattaaaatcatc

SEQ ID NO: 39782 - DNA, 121 bp, Artificial Sequence
  Synthesized
  misc_feature (61): n=t or g
ggtactgatgtgatgctgtacgcttggatatggagggaaataccccaaatgtctgcctctntgtgctttagcatcattcaaatgcatttcattaagccgattaacccattttctttcccgt

SEQ ID NO: 39783 - DNA, 121 bp, Artificial Sequence
  Synthesized
  misc_feature (61): n=a or g
aaaagctgcttctgaattctaatagaacaaaatccaatgaagtaacgtgagtttttgaaantggaagttgtcaatttccctccataaagactaagctgaccactacagattcttacagtgg

SEQ ID NO: 39784 - DNA, 121 bp, Artificial Sequence
  Synthesized
  misc_feature (61): n=t or c
gcctgtagcaagcagccaagtaatttgacagctcttacatctctttgttctggcagtaacnaatgcagaaacttgaataaattgcactcttgtaaaagaagaaaaaataaagactgactga

SEQ ID NO: 39785 - DNA, 121 bp, Artificial Sequence
  Synthesized
  misc_feature (61): n=a or g
ctggtgagttatgcagtgtgagctgagagtttggtgtgaacgtctgattttttttctaacntggtcgtttgaagtttgatgtcttcctgacaactttacttggctcttcatagcaattttc

SEQ ID NO: 39786 - DNA, 121 bp, Artificial Sequence
  Synthesized
  misc_feature (61): n=c or g
tccacgtggcctaagtgacttttccatggaggtacagtatatacatcactgataactgagncatctgaagcatgatcagttttgtctcagtgcagtttcctaattctccaaagcttcatct

SEQ ID NO: 39787 - DNA, 121 bp, Artificial Sequence
  Synthesized
  misc_feature (61): n=t or c
caaaataatcattatggtgaaagaaataaatgcatgcttgctagcatgcaaaaaggtacangataaatagatggcagtacatactgacttcaaagcttcttggaagtaactgtttccaagt

SEQ ID NO: 39788 - DNA, 121 bp, Artificial Sequence
  Synthesized
  misc_feature (61): n=a or c
gctgcccatgttccattattggtagagattcctacatgttggctgctagggaggatttgcnaaaaggggtgattgagtggccatgctacagagttacaatcaggactttggacttattatc

SEQ ID NO: 39789 - DNA, 121 bp, Artificial Sequence
  Synthesized
  misc_feature (61): n=a or g
gtccagctgaagcagcctgcagcccctctgactgccttcttgcaccaacccaggagtgtcngttatctctgaatactgtgcagctgtggggatggatggagactattttaaagagctggtt

SEQ ID NO: 39790 - DNA, 121 bp, Artificial Sequence
  Synthesized
  misc_feature (61): n=a or g
cacattcagaaaaatgaacaaaaaaaaaccccaaccaactgcagaacagtaataacaacanatcagtttagaaatcttgtcagcactgccagaacagacacttgtaggggaaaaaaaagtc

SEQ ID NO: 39791 - DNA, 121 bp, Artificial Sequence
  Synthesized
  misc_feature (61): n=a or t
cagaaataactgttcaagttggaatttcaaaacaaagaaaagtctgggaagacagaccctngcaggcagtttcagcccagagagcccaaatttgttagctagttgctatcgaaaacagtgt

SEQ ID NO: 39792 - DNA, 121 bp, Artificial Sequence
  Synthesized
  misc_feature (61): n=a or g
atcatattgataaatgatacaatacaggtaaacaaagtatgcattgtgtaacttgtagctnatttacgttcacagctgcatataccacagctattataccatactaaaatatacattcata

SEQ ID NO: 39793 - DNA, 121 bp, Artificial Sequence
  Synthesized
  misc_feature (61): n=t or c
gacattcagcagtgagacttcaggactggctgaaccttccttctttgtgcggaagtgctgngtgcatgttgacgtgttggttttaattcagttgtctttgcagcatcgtggtattgagtct

SEQ ID NO: 39794 - DNA, 121 bp, Artificial Sequence
  Synthesized
  misc_feature (61): n=a or g
tctagtgaaattttttcacgtttttccatgtttgtcccacacagcacccttagccacctcntaccattttgtttacagttagttgtgtataaaaagcatgtcctggctctcacactacaac

SEQ ID NO: 39795 - DNA, 121 bp, Artificial Sequence
  Synthesized
  misc_feature (61): n=t or c
aaccatctgtaaaactttcagagaataaatttcatgtctcagtctaatttcctccagtcanattaaatgcagagctaagtggagattttcttctccaggaaaattcactaacatttgaaac

SEQ ID NO: 39796 - DNA, 121 bp, Artificial Sequence
  Synthesized
  misc_feature (61): n=t or c
taattcaccccagcagcaaccgttaccacatggacacctcggtgttacgttcacacacttnctaggcaataataaaagagctttaccagtaaaaagccactttgtcgccgagtttcttctc

SEQ ID NO: 39797 - DNA, 121 bp, Artificial Sequence
  Synthesized
  misc_feature (61): n=t or c
ataccccataactcccctttgaggtctgcataaggtgattgaatgtatttttttccctcgntgatttcatccttctctaagagatgtgtactaatgatgtttctgatggagccttaaatta

SEQ ID NO: 39798 - DNA, 121 bp, Artificial Sequence
  Synthesized
  misc_feature (61): n=a or g
ggcaataggaaagaagaaacagactcttcagcatggactgttgtgatagaaacaggggganattgaaggagaagagagttagactggacatatagaaggtccaatatacaataagggtagt

SEQ ID NO: 39799 - DNA, 121 bp, Artificial Sequence
  Synthesized
  misc_feature (61): n=a or g
gggttgtgactgcttgagcagcacgggggctatttgggctggaagtggtgttcacatcacnctgcacagccattcctgatgtctgtctgtctgtctgtcctgcaggaggtgcggctatgaa

SEQ ID NO: 39800 - DNA, 121 bp, Artificial Sequence
  Synthesized
  misc_feature (61): n=a or g
atgagatttagcctgggtaatcctattggaactccctttgatgtctgttgttcagaattcncacgcagaaattcaggaaaacttcagggttttaccatccacacgaactgtaacagttcac

SEQ ID NO: 39801 - DNA, 121 bp, Artificial Sequence
  Synthesized
  misc_feature (61): n=a or g
actacccagtgttgtaatagataatgttcgggcattctcagtccctgcaacaccagagcanctgtaggagtttctagatatactgggatactggtgttcctttatagttcatttagtacag

SEQ ID NO: 39802 - DNA, 121 bp, Artificial Sequence
  Synthesized
  misc_feature (61): n=t or c
cttcctcccagcttgctgtcatctacagacttactgaggattgtttaactttcctgttctntgggaagttcagagtaccattgatgttgtgtgtaagcagccccattgcagtctgcaagtt

SEQ ID NO: 39803 - DNA, 121 bp, Artificial Sequence
  Synthesized
  misc_feature (61): n=a or c
ggagcctaattatttcagttattctgtagagctcccgtcgttctcatctgcactgctttgnaatacaaaccaagactgtgattcattgctcagacttcaccgtggtgcaatcctacaggtt

SEQ ID NO: 39804 - DNA, 121 bp, Artificial Sequence
  Synthesized
  misc_feature (61): n=a or g
tcaaaagagcgaggcaggaggctcgtttgcatggagggaaaaaaaagtatccgagaaattnaattaaatctggaaagtttttctacatacgtatctatttgtgctctctgctctcctctgc

SEQ ID NO: 39805 - DNA, 121 bp, Artificial Sequence
  Synthesized
  misc_feature (61): n=t or g
tatgaacccataggaaaagaagaaatgctgagaaatagaagtttctcataggtagaagttnctcaatagaagtagcatcacgattaggaaactggaagcagaaaccagacctaaatctatc

SEQ ID NO: 39806 - DNA, 121 bp, Artificial Sequence
  Synthesized
  misc_feature (61): n=t or c
gagagcactgcagtgcacgggcaggtgaacactttggattgaggacctcagggtgatgggnaaagtcctgcctttgctcctgcagctgggacagattggagagctgagagcttgcatgagg

SEQ ID NO: 39807 - DNA, 121 bp, Artificial Sequence
  Synthesized
  misc_feature (61): n=a or c
actagtcgtattctgtgaagaatgattctgatgttctgctgaacaaatgcattgcagcagnagaaactggagaagtattggttgtaactggggctgtcaacttatgcccggttcagaaaag

SEQ ID NO: 39808 - DNA, 121 bp, Artificial Sequence
  Synthesized
  misc_feature (61): n=a or g
ttttttccctctaaggtattatgagaattctgttgtatagactcatacatacagagaagtnaaaagtggcaagcaatttctaacacaattttaactttgattatactatggatgacattgg

SEQ ID NO: 39809 - DNA, 121 bp, Artificial Sequence
  Synthesized
  misc_feature (61): n=t or c
cccccaaattttaatagtcttattaaaatagtacccagattggggtagttgtaatgcttcntttttgtgtgcatctctgatgtctaacaaaaataggttggcaggactgttggaggggcct

SEQ ID NO: 39810 - DNA, 121 bp, Artificial Sequence
  Synthesized
  misc_feature (61): n=t or c
ggttgttacagcaggcttatggcaaaaaaatatatattgatatacaatgagatgctatctnttaaaagaaaatatccaaatataagtcttcaagatttggactgcaaatacttgatgctat

SEQ ID NO: 39811 - DNA, 121 bp, Artificial Sequence
  Synthesized
  misc_feature (61): n=t or c
ggcttcccacaatatatagcagttcaatatcaacagctgaaacctaacaagcagtacagtntttaatttgaaaagtagaaataagctacagccaaacaatgaagatgaagatagaagtttc

SEQ ID NO: 39812 - DNA, 121 bp, Artificial Sequence
  Synthesized
  misc_feature (61): n=t or c
tctagcaagtgcttatctgcagatatcaagtgaagagaacaccatgaagctcagtgtaggngtttgcatgtaattactactatgcgtaatagacaaagtaggcaaaggaatgaaggtgaag

SEQ ID NO: 39813 - DNA, 121 bp, Artificial Sequence
  Synthesized
  misc_feature (61): n=a or t
agcttgccatcccactgaacaccccatgttccttgggtctagggaagaagactcacccacngcttctctttgttccactggaaaagaaagagaaaagcaacacatgatgagaagaacatct

SEQ ID NO: 39814 - DNA, 121 bp, Artificial Sequence
  Synthesized
  misc_feature (61): n=t or c
aagcaatgatagattggcaaagtcgcattcaccatcttttctccacatctgacttgtctgntgatggcagcacaagaatgacaaactatgaatgacatcatccctaaatccctcagtgtca

SEQ ID NO: 39815 - DNA, 121 bp, Artificial Sequence
  Synthesized
  misc_feature (61): n=t or c
aggtgacaacattttgtggttataaacatgcacccaaatatttcagtgagacaaataaagnagataatgaacaactcaacaaggaaacaatatggattacttccatcagtgttcattttca

SEQ ID NO: 39816 - DNA, 121 bp, Artificial Sequence
  Synthesized
  misc_feature (61): n=a or g
tatgtaactaggcttaggctggggccttggagggtcaagtcatgccctgtgtttatcctcntctgatgtcagagtgcaaaacaactgaaggaaatctttcattgcctacacactactgcat

SEQ ID NO: 39817 - DNA, 121 bp, Artificial Sequence
  Synthesized
  misc_feature (61): n=a or t
catgtgtgccacagtcattgtcaccccatgtgtgccactgtcaccctgtatgtgccacagncattgttaccccatgtgtgccacagtcactccttgtgtgccaccatcatcccatgtgtgc

SEQ ID NO: 39818 - DNA, 121 bp, Artificial Sequence
  Synthesized
  misc_feature (61): n=a or g
gtgagatgctctctgcctgggcctgaaactatttgcactgctaggcagatcttaaaatgantaactctgctcactgcaaccaagagaagattttgctgtcctgcatcagtaggggaataag

SEQ ID NO: 39819 - DNA, 121 bp, Artificial Sequence
  Synthesized
  misc_feature (61): n=t or c
cagcacagtgaggcaggaggatgtggacagtagattgcagtggggcggtggcacagacaancatgcagagcggcctgccttgtgcagtgccacaagtgctcactacaagtgtggaaaatct

SEQ ID NO: 39820 - DNA, 121 bp, Artificial Sequence
  Synthesized
  misc_feature (61): n=a or g
cttataaatggtctgtttattttatttttacctggagctcattgttttggtattagataangagttatctcttctgtaccttttccctcatagcatttggatttttgacaccttgctgagg

SEQ ID NO: 39821 - DNA, 121 bp, Artificial Sequence
  Synthesized
  misc_feature (61): n=a or g
aaaaaaaaccaacacaaattgcgcctaattgctggaaaagttaagtgttttgatgtatggnatggcttgcgcagcattagggttactcttctattgcagagtcactggttcacagtgtgta

SEQ ID NO: 39822 - DNA, 121 bp, Artificial Sequence
  Synthesized
  misc_feature (61): n=a or c
atatatcattacttagaaagtatagaacaatacattattggctctgggcagctttgtttcntctaggaaataccaatggcaaaaatacccttaagcgttataattacaatcaaaaagttat

SEQ ID NO: 39823 - DNA, 121 bp, Artificial Sequence
  Synthesized
  misc_feature (61): n=t or c
taagcaggagtccagtggctgcaccccatgctccagctgaggtgctgtgcagcgctgccangcttagctcagcagagcaccattaaacccactgcagggcacagcgcagaaccgggaggtg

SEQ ID NO: 39824 - DNA, 121 bp, Artificial Sequence
  Synthesized
  misc_feature (61): n=a or g
gttaacacctatccactacgtttaccttctgttcaacctatactcccactgaaagcaacantaaaactcccagaagccatgacctgaggtctactgaaatcaatgaatgttttcaattttg

SEQ ID NO: 39825 - DNA, 121 bp, Artificial Sequence
  Synthesized
  misc_feature (61): n=a or g
ttgtaaatctcgctttgcttttgttcacagggtaaaacatcaagtagagtacttaggtctnaaagaaaacattcgagtaagaagggctggctatgcctacaggcgggttttcaagaagttt

SEQ ID NO: 39826 - DNA, 121 bp, Artificial Sequence
  Synthesized
  misc_feature (61): n=a or g
tgaggttcaccctgagtttaagggcctgctcccagagcaccagttaagctaatgtaaagcnggcccagaacaccatctcgttgcccttgtcttgcatgttaccttaggtaggttcctgctt

SEQ ID NO: 39827 - DNA, 121 bp, Artificial Sequence
  Synthesized
  misc_feature (61): n=a or g
agaaaaaaaaaaaacaccacagcacttaagatttaaatcaatttgtattgattcaatactnaagtgtatacaaggtgaagatgggaacagaacttgaacctatccttttcataataataat

SEQ ID NO: 39828 - DNA, 121 bp, Artificial Sequence
  Synthesized
  misc_feature (61): n=t or c
cccttcaatgtaggagcgcacacttctttgctgcaccttgctgccagggcggtccctgagnttgccagctaagttattgtacagattgctagcagcttaagtccaaggattgagttgaaaa

SEQ ID NO: 39829 - DNA, 121 bp, Artificial Sequence
  Synthesized
  misc_feature (61): n=c or g
ctgaaacacacaacagaacccaggcacccccagagcctgcatcacagctgttgccaccaanagacttccagttgctttctgggagggcagcacaaacagctccttcagccacagccccact

SEQ ID NO: 39830 - DNA, 121 bp, Artificial Sequence
  Synthesized
  misc_feature (61): n=a or g
agagcagcattcccaccctgtcatctttaccctgatctgtaaggaagaaaggcaagagcanaaatgcagaacaacttgccttcatctttgagaagcacccaagcaagctgtattggggccg

SEQ ID NO: 39831 - DNA, 121 bp, Artificial Sequence
  Synthesized
  misc_feature (61): n=a or g
ctgaaggaaaacgctgcttaaacagccaggctgcatgtacatcagcccaaaaaaatgcacntgcacgaagcagttcttattattgaattattattattgaataaaaatattctacgtatgg

SEQ ID NO: 39832 - DNA, 121 bp, Artificial Sequence
  Synthesized
  misc_feature (61): n=a or g
tactacagaagactactgaattgaaggctatcatcatagttgactttccagtctctgaacnttttcttgtgatgggaccctgaggatttctatcagtcataatactccttctcaaagcttt

SEQ ID NO: 39833 - DNA, 121 bp, Artificial Sequence
  Synthesized
  misc_feature (61): n=a or g
tacagattttcctgtttcattatttttttaaagaaagccaggggtgctctccaagatgttntaggataatgcagactatttgtatgattcagcttttggggcgatatgaatgaatgcaaat

SEQ ID NO: 39834 - DNA, 121 bp, Artificial Sequence
  Synthesized
  misc_feature (61): n=t or c
gtcattctcagcatcttctataacacattatcatattcctgctggtgataccgagccttcntgtctctcttgtgctttcacagactttgtttttagacagcttattacatggcattatgaa

SEQ ID NO: 39835 - DNA, 121 bp, Artificial Sequence
  Synthesized
  misc_feature (61): n=a or g
gatgcatggtctgtaaaggggagcaggtaacactacctcaagggtgctctcagcactatgntcttatcctgctctgcctttttcctagactcaaagttggagcagatgagaggatcttccc

SEQ ID NO: 39836 - DNA, 121 bp, Artificial Sequence
  Synthesized
  misc_feature (61): n=t or c
cagtagtgcaggattatgccaggtacaatgtactagaaacctcactccagcaaaaccccangtagatctcactagaaagttgctatttcctccagtggttttctctctttcaagaggtgga

SEQ ID NO: 39837 - DNA, 121 bp, Artificial Sequence
  Synthesized
  misc_feature (61): n=t or c
atgcagctcactggctgttttttttttttttttcctgctatataaatgtgagatcataagnagtagagaaagaagaaggagctgttttttggaagacagagtaaaacccagcacatattct

SEQ ID NO: 39838 - DNA, 121 bp, Artificial Sequence
  Synthesized
  misc_feature (61): n=a or g
ataatttttctttgaggaggcaagggcacttcagctctctagaatctgagatccctccccntacatagattggtagataaacctacaccttcacactgccactgggtatgccccggtcctg

SEQ ID NO: 39839 - DNA, 121 bp, Artificial Sequence
  Synthesized
  misc_feature (61): n=t or c
attgcacaaaatcttgcaaatatttgccctcatgaaaatttccacttttacatatatatanatagctgaataacttataggtttgaaacacctacatgtggcagtacttaaagtatctgga

SEQ ID NO: 39840 - DNA, 121 bp, Artificial Sequence
  Synthesized
  misc_feature (61): n=a or g
gtgattttatgtacagctttaaatccctaactgatttaaatccctaatgatccctgcttcnccaccatctattacattttagcagctaagctcagcatggtttcatcccttacagtagaaa

SEQ ID NO: 39841 - DNA, 121 bp, Artificial Sequence
  Synthesized
  misc_feature (61): n=t or c
ttctacagagctttggaaggtaaagggagtaagctataggaactaccaaattcaaacaganttaaggacttatctcagcatctttaaaggatgtgcttcactccagcacaaaacagctcat

SEQ ID NO: 39842 - DNA, 121 bp, Artificial Sequence
  Synthesized
  misc_feature (61): n=a or g
tctgtggactgcacgtaccctgaaaatatgaaaatgtattgccattaggcacatttatacncggtttgtcgtgcaccagcctgggtgccaagagcagctcaacagtacttgcttttggtaa

SEQ ID NO: 39843 - DNA, 121 bp, Artificial Sequence
  Synthesized
  misc_feature (61): n=t or c
gaaagcaaatttaggaactagatgtcacacttataattattttcttttgctacagcaaatnggatctaacattataacatcttctaagaagtaagaaagacctcttcaggaatgttgcagt

SEQ ID NO: 39844 - DNA, 121 bp, Artificial Sequence
  Synthesized
  misc_feature (61): n=t or c
gaggtagctttggggatgaatttgaacatcctgctgggattggttcaaaactggctccccncaccccccaggcatctgcaactgaaagctgtcctgaccccatgtcatgggttggtaccct

SEQ ID NO: 39845 - DNA, 121 bp, Artificial Sequence
  Synthesized
  misc_feature (61): n=t or g
ctgcttgctgtctcagaggccacttattgcaggcagggcgcaaagctggcaccaggcattnccatagcttgacagccaccttcttttgagctccacagaagcaaaactaatgatttctgag

SEQ ID NO: 39846 - DNA, 121 bp, Artificial Sequence
  Synthesized
  misc_feature (61): n=t or c
gttagatttaggttacacagaagtgcaggaatggttataaaaatggctttgttgtgcgttntgggggaatcttccagtcctttccctcgcagaccatctcccacattcccctgcccttgca

SEQ ID NO: 39847 - DNA, 121 bp, Artificial Sequence
  Synthesized
  misc_feature (61): n=a or g
tggttttcaattggctgagtcacagcaccataaaggttagccaacttgacgtcaaaaccantggtccctcacctcccagctgtagctgagcaggttggccaatggctgtgccatccaccaa

SEQ ID NO: 39848 - DNA, 121 bp, Artificial Sequence
  Synthesized
  misc_feature (61): n=t or g
gctgcatatctgtaaccctcccttatctagaagcacaagtagaagtacactatattttttnatatagttttcagaaaaagggagatgccttgattagttatttttttagtgaatattagtt

SEQ ID NO: 39849 - DNA, 121 bp, Artificial Sequence
  Synthesized
  misc_feature (61): n=t or c
tgggaagcagatctctgcgtatccgttccctgcacagaggcacatccctgtgcagagccgnagatgaggagcagcctgcaggctctgtaagctgaggagtgtcctacgtacagcaaatcct

SEQ ID NO: 39850 - DNA, 121 bp, Artificial Sequence
  Synthesized
  misc_feature (61): n=a or g
ggaagaaatcgtgggagacaaaggtctgaactgcctcattaacaacgctggcatcaatgtnctcgcctccttggaagatgtcacagcagagacaatgctcaccatttacgagaccaacaca

SEQ ID NO: 39851 - DNA, 121 bp, Artificial Sequence
  Synthesized
  misc_feature (61): n=t or c
gtcccacactctttctcagaaatctgcttttcgatatccacactcattactgctggacccngtttctcacattcttcgacttgataaatagtcatacacccacaacagcagtgacttctgc

SEQ ID NO: 39852 - DNA, 121 bp, Artificial Sequence
  Synthesized
  misc_feature (61): n=a or g
cccagccacatcagtgccattaccacatggaaggcaatggcagcagcagctgcttgctgcnaggaactgtttccttgcgtaggcgattccttgctttagtgtggaatgcgactccaccaga

SEQ ID NO: 39853 - DNA, 121 bp, Artificial Sequence
  Synthesized
  misc_feature (61): n=a or g
atctctctgtgtggaaacaatgcaagcagatcataattacagccaatactttgtacctcangatcatgatctatctaggctgagaagagaaaagccattagaggtattatagataactggc

SEQ ID NO: 39854 - DNA, 121 bp, Artificial Sequence
  Synthesized
  misc_feature (61): n=t or c
tttgaagcgacctctagagatcatagagtccaaccatcaagcagacctactaatgcacttngatgtgcaaatactgcttgaaattaccaacgctgagcaatctagttcttcatcaggaagg

SEQ ID NO: 39855 - DNA, 121 bp, Artificial Sequence
  Synthesized
  misc_feature (61): n=t or c
gcaaaggagccaaaagcttttcatgacgtttgtagatttttcccagcatgagtatttaacnctgatcacagctaagctcctgtcctgggaaaccctctcttcttctttctttgggtgagtg

SEQ ID NO: 39856 - DNA, 121 bp, Artificial Sequence
  Synthesized
  misc_feature (61): n=t or c
actcagtgggtgctcattggactagagggagacaaaaagtcactagacaggtgtggaaganggtaaactgggataaactatgaagacttaggtctcgactcaaatcacttttgataatggg

SEQ ID NO: 39857 - DNA, 121 bp, Artificial Sequence
  Synthesized
  misc_feature (61): n=a or t
tgtataactactagttagttgtaatgaatcagccattgttcatgttgaattgcgggtttanaacatttgtcaacaacatacaggatgtgttctttttctggaatcttttttgctatatttg

SEQ ID NO: 39858 - DNA, 121 bp, Artificial Sequence
  Synthesized
  misc_feature (61): n=a or g
cagtagaagacttgttaggaaaacactgataagatgaattctcatcacaacaagatgcacntttgaattctgaaggaactcaaatacaaggcaaccaaatactaattccacctctctctta

SEQ ID NO: 39859 - DNA, 121 bp, Artificial Sequence
  Synthesized
  misc_feature (61): n=t or c
ttccagtgtcgctgctgttttgttgaagccactgtccccagacacagtgtcactatgtccntccgagtggcctctctaggtattcccttctctcccagttgctgcatcctctgacaaacag

SEQ ID NO: 39860 - DNA, 121 bp, Artificial Sequence
  Synthesized
  misc_feature (61): n=a or g
agatttcagaaaaagaaaaagaataaaacatgccaaggaataattctttattttctacaangtagcataaagtgaatgagtggtctggcgcgcattaggaaggggttacactatttatcgc

SEQ ID NO: 39861 - DNA, 121 bp, Artificial Sequence
  Synthesized
  misc_feature (61): n=t or c
tcagccaacaattcagaaggcatcatagtaaagaaaagcacgttactataggcaattttanttaagtatgagcatgtttctaaatacagaaataacaaaatgcaaaaagcatatttgactt

SEQ ID NO: 39862 - DNA, 121 bp, Artificial Sequence
  Synthesized
  misc_feature (61): n=a or g
ttgggtttaagataagctattaaaattgttctgagagaacaaacaaacgaatctgtagcancaaacagattctgacttctagtctgtgttgtgagcacacagccagcaccaaaattcaaca

SEQ ID NO: 39863 - DNA, 121 bp, Artificial Sequence
  Synthesized
  misc_feature (61): n=t or c
tggtgggctcgcaggtacctcgttcctgttgcactttgcctgcactgaggggatcatgccnatccttttctcagtgcatggtgttagaaaatctctcagcattatgagaatccaatagccg

SEQ ID NO: 39864 - DNA, 121 bp, Artificial Sequence
  Synthesized
  misc_feature (61): n=a or g
cttctctcttttactgaataagaagcaaaaacatactacatccatctgcaggttctttacncttttgccacctggagatctttgctgaagcattgacctgttctattgttgtgacttaaca

SEQ ID NO: 39865 - DNA, 121 bp, Artificial Sequence
  Synthesized
  misc_feature (61): n=a or t
attcctgtacatttaaagttagcatctctctaaacgtaaatgtctttagaggactagaaantttttatgaaaaacattgctctctaggattaaagatagtatggaacaactctaacttctt

SEQ ID NO: 39866 - DNA, 121 bp, Artificial Sequence
  Synthesized
  misc_feature (61): n=t or g
aaagatcctcaagaagcacctgttttatgatgatggtcagttatttattcaatgctcacanagtgtaacggttctttttagcttaggtaggtacaaggcatcgcttttatgaaagaaaaaa

SEQ ID NO: 39867 - DNA, 121 bp, Artificial Sequence
  Synthesized
  misc_feature (61): n=c or g
ctacctactgttactgacacaataaattggcatacttctctgaggtaccaggactcagaantgtgatgtgacattaacaggtgtaatttgccatttaacagtataaatctatcagtattac

SEQ ID NO: 39868 - DNA, 121 bp, Artificial Sequence
  Synthesized
  misc_feature (61): n=a or g
tcgctgacagcatagagatggatctatatgatacagaaggaatgctgatgctagttaggcnctctttataaattgacttgcagtttagttattaagcccagttattaatgcctatctacag

SEQ ID NO: 39869 - DNA, 121 bp, Artificial Sequence
  Synthesized
  misc_feature (61): n=a or c
atcaatatttacttcattttggacaacttcgtatttggtcatatatgctgagacccatttnaggcacctactgctgccaactacattggttgcaatggggacatccatgttcctctgcggg

SEQ ID NO: 39870 - DNA, 121 bp, Artificial Sequence
  Synthesized
  misc_feature (61): n=a or t
tgaagttcactagcaaatttttaaaaattcagttcctgtcagactagcatgaaattattcnccaaaaaacaggcatcttctccactttctgacaatacaatttgatgctcaagaagagcct

SEQ ID NO: 39871 - DNA, 121 bp, Artificial Sequence
  Synthesized
  misc_feature (61): n=a or g
tgtgtgtgtttgcagcatctgtacttgggtgatagatgttaccacgagctgcccaaatcgnctgcatctatttagtcaactgcagtaaaagcccggttgttggtttgtggttttctttagg

SEQ ID NO: 39872 - DNA, 121 bp, Artificial Sequence
  Synthesized
  misc_feature (61): n=t or c
ggattcccatgtaaagtctgttgaaatcattggaaatatctcaccaatgcttctaggaccncagataggccgtgtgagtgctgatttgtataagcattaaggaaacaacatacgcaggccc

SEQ ID NO: 39873 - DNA, 121 bp, Artificial Sequence
  Synthesized
  misc_feature (61): n=a or g
ggaaaggtgatatgagaagcataatgagaaggggactaatgcaatagaaaagtgttacaanggaaggaaaaaagacagctcacacatctccaaagatccacactcacaggggaaagctcca

SEQ ID NO: 39874 - DNA, 121 bp, Artificial Sequence
  Synthesized
  misc_feature (61): n=t or c
ttaactcttacctctgtgaaggtctgtatttctgccttatttttctactcaatgtgtgcangttgccttacaccttgagaaactaagaatcatgatagctgatgaacagtacacacttatc

SEQ ID NO: 39875 - DNA, 121 bp, Artificial Sequence
  Synthesized
  misc_feature (61): n=a or c
gaacagggatcgaaaggagggaactgcagccgagacaaataagatgctccagaagccagcnaaacaaatagcatccattgtttgtgcagcaggctggaataataacatttgctcacccagc

SEQ ID NO: 39876 - DNA, 121 bp, Artificial Sequence
  Synthesized
  misc_feature (61): n=a or g
acagaatttggggttgaagcccaacagaggggcaacaccacaacctcgttaacctgaatgnacacaatgcagagctgggttcctcactgcaaaccagccccatctacctgcgcagatgaag

SEQ ID NO: 39877 - DNA, 121 bp, Artificial Sequence
  Synthesized
  misc_feature (61): n=a or g
agtggactacaagccctcaagctaccacacgtgaatgggagttatcactcatcattaggcncctaaatgcatgctgatgccaggatgcaagtatcttaagctgagtggtccttatgatggg

SEQ ID NO: 39878 - DNA, 121 bp, Artificial Sequence
  Synthesized
  misc_feature (61): n=t or c
aagacataataaactgaaaatggaggccagaaatctgcaattgctccagtgagtgcataanctcagtgccactggacaaaagggacacagatgtactcacgtaccaagagcaggtctgtgt

SEQ ID NO: 39879 - DNA, 121 bp, Artificial Sequence
  Synthesized
  misc_feature (61): n=c or g
gctgctcgaagtgacacagacaccattgatggtgccagcaggacaggtgattttattttanttccctggctgcttccaaaattcccacctagtaccaaacaccaatgggagttagtaactg

SEQ ID NO: 39880 - DNA, 121 bp, Artificial Sequence
  Synthesized
  misc_feature (61): n=a or g
cacccccaacccaatcacaccaaccatgcagacaacaaagatctcctccaaatggagtgcngagagagtggctgttctaaaaacctgcatcactaacgtatgccacatacgaggtggtcag

SEQ ID NO: 39881 - DNA, 121 bp, Artificial Sequence
  Synthesized
  misc_feature (61): n=t or c
gacacatctgcagatgaagatactccaaggggcagtcacttggttaagggatcagcccacngctacagcatatcctcaagcagtatgtaatgcaaatcatgcagaacttcccaacactcaa

SEQ ID NO: 39882 - DNA, 121 bp, Artificial Sequence
  Synthesized
  misc_feature (61): n=t or g
gaatgtggagcatggagcaaacctgttggggaacaggcaacttacaaaatgtgttgcctgncactgaagaatgcttgagaccatttgctgaccctggcttacatgctagtatagatacagc

SEQ ID NO: 39883 - DNA, 121 bp, Artificial Sequence
  Synthesized
  misc_feature (61): n=t or c
catccatgaaaagcaaaatggggagcaggggctggaattatttagagtggtgagtttgcanctgaacaaaaaaatatgtgaggcagaaactgcttaggagtgtgtgaacgctgtaaagtga

SEQ ID NO: 39884 - DNA, 121 bp, Artificial Sequence
  Synthesized
  misc_feature (61): n=t or c
ggaaatatttctgcctaagactagataaaatccatcagacaacagctagttacaaacacanacaacaccaagcatccacaccacgtgatccacagatgggatcacatcatgcacaaggtgt

SEQ ID NO: 39885 - DNA, 121 bp, Artificial Sequence
  Synthesized
  misc_feature (61): n=t or c
gccatcggaggccagcgagcctctcccactgccagcaaactgcaggggaagagaagaggantgcatcagagcaacctgagcatccccacaccctgcactgacatgtgctgctgcatagggc

SEQ ID NO: 39886 - DNA, 121 bp, Artificial Sequence
  Synthesized
  misc_feature (61): n=t or c
tcccatgcatggggcactgcggagagcaagattgtgaagtgggaatgcatcagtgctcctncagccatttcccttgccgttcttgttccaccttgtacaagtaacaggccttcgctttgca

SEQ ID NO: 39887 - DNA, 121 bp, Artificial Sequence
  Synthesized
  misc_feature (61): n=a or g
aacatgggagctagaggcatactaattgccatcatccagctgagacagcaccagtatgaanaaggagcctcagctcgtgcctcacacacccctgtcccttgggcagcaccacacattttaa

SEQ ID NO: 39888 - DNA, 121 bp, Artificial Sequence
  Synthesized
  misc_feature (61): n=t or c
tacgggctctttttttgagataagtcacaagcacaattaacaaatttgaggtgaaagattnccaaacgctttttgctacacatatcacagcgcctgtatctttaaatggcacagctcagca

SEQ ID NO: 39889 - DNA, 121 bp, Artificial Sequence
  Synthesized
  misc_feature (61): n=t or c
acttccagagctgctcctggaaacagaattttcatgttgtctttaatgtgtacaccacgcnttctccttgtaagaagcaagtctgacgtagagagtttggtaaaagcaaattattatagct

SEQ ID NO: 39890 - DNA, 121 bp, Artificial Sequence
  Synthesized
  misc_feature (61): n=a or g
taatactgatacctcttgccttcgcagctgctcctcctcttcctcagaaagataccactcntatcagtctatccatagcttcaaataagcaatcatccagtgggttcaaattacaagtgac

SEQ ID NO: 39891 - DNA, 121 bp, Artificial Sequence
  Synthesized
  misc_feature (61): n=a or g
ctatttttttaaactaaaaaacataataataaataaggctatgattttttgtacagcttancaggaaagactactgaatatcagtatagtgttgaatgtgaatgcagggacagtctccatt

SEQ ID NO: 39892 - DNA, 121 bp, Artificial Sequence
  Synthesized
  misc_feature (61): n=c or g
ctggtgcccacgcttcagctaaccaaacggtgcgaggagatcacttactgcaacaaaccancacgtaattgtttgcaaagggagagttccggagccggaacgtatgtgagaaagctgccgt

SEQ ID NO: 39893 - DNA, 121 bp, Artificial Sequence
  Synthesized
  misc_feature (61): n=a or g
ccagcagtgccgtgcacttgaggcgctaggaattgcgatctgtcctggtgggtgtggagcnttttctgctccttggaggggttgtttcaggcccaggccacgccaactctaacagttgatt

SEQ ID NO: 39894 - DNA, 121 bp, Artificial Sequence
  Synthesized
  misc_feature (61): n=t or c
tttataatacatactagttttactagaaaagtatgaatcaaaatcatgcctaatgaccagncataaaatcataccatggctaggattggagagaaccttaaagatcattaaacttcaaccc

SEQ ID NO: 39895 - DNA, 121 bp, Artificial Sequence
  Synthesized
  misc_feature (61): n=a or g
gtaaagaaacttttgttgcaagcaattctattatatttaaactaataattatgaccttctnagagctatatatacattaggtccatttgtcagttgacaatgtcagcaatccactgaacta

SEQ ID NO: 39896 - DNA, 121 bp, Artificial Sequence
  Synthesized
  misc_feature (61): n=t or g
ttcagactggtatgcttggcccctccatttaactcttgcagctacaggagaagggacgatngggcagtttgaatgccagggtgctacctgctgcaaaatgggccactgtatatctggaaaa

SEQ ID NO: 39897 - DNA, 121 bp, Artificial Sequence
  Synthesized
  misc_feature (61): n=c or g
tacgccgcagctcgtggccacgtacctgccctgctcagcagagatgggaagcacaaagganaagggattaacatgcagggaaatgtcgaaccacttaaggtgcctccagggaagctcccgc

SEQ ID NO: 39898 - DNA, 121 bp, Artificial Sequence
  Synthesized
  misc_feature (61): n=a or g
ggtataagaaaagggtgtatcctaatatcttagttaatttgcagaggcagaataagcaggnggagtgcgaaagtggctgggagccaagatttttgctgagttctcttcctgactttgccac

SEQ ID NO: 39899 - DNA, 121 bp, Artificial Sequence
  Synthesized
  misc_feature (61): n=a or g
ggtctggacactgcatacagggctgtttctggagcagtggctcaggagagactcagggacngtccctacacaaccacatgagggagatgatcaaaaaggcaccttgtgccctcccaccctc

SEQ ID NO: 39900 - DNA, 121 bp, Artificial Sequence
  Synthesized
  misc_feature (61): n=a or t
acagcactcaagcaggacacactttatggagtaaaaataaaaatcccttttttgatcggtnctatttttacggatacagccgccgaatgcgggctgtgagacccacagcaccattaacccc

SEQ ID NO: 39901 - DNA, 121 bp, Artificial Sequence
  Synthesized
  misc_feature (61): n=t or c
acatccacaaatactttacccactgcaccctccttttattgctaggattccaaattaaagnattcaaaaactggctagcatattccaaaacaaactttcaaaacctcaagaaagagaaaat

SEQ ID NO: 39902 - DNA, 121 bp, Artificial Sequence
  Synthesized
  misc_feature (61): n=t or c
taaaacaccacttctaacactaacgctgcaagcagctgccatcttctgcctcactccagcnctccaaacacatggtttcactccttagccctgcagccaggactagcacatggctgtggtc

SEQ ID NO: 39903 - DNA, 121 bp, Artificial Sequence
  Synthesized
  misc_feature (61): n=a or c
atttcgattctcagcctcgccatgcttacatacacatattttatttctcaggtaattttgncaattgtctctacactttttcagatgagcgaactgtactctaagtacaaatattctctaa

SEQ ID NO: 39904 - DNA, 121 bp, Artificial Sequence
  Synthesized
  misc_feature (61): n=t or c
ctctgtcttggttctttcaagcaaggccttgtgtgccatcgccgtcaactgcttccaacangatgcaacctcaaaatgtgtttgttcttttaattatggtaattagcattagtgctgaacg

SEQ ID NO: 39905 - DNA, 121 bp, Artificial Sequence
  Synthesized
  misc_feature (61): n=t or c
agaagtaaacactttggtattttgaagtgtttccctcttctccaaacacttctaaaatatngttattgagaaagtaaattatttcataaaaaaggctggctattgtgttcacagaattggg

SEQ ID NO: 39906 - DNA, 121 bp, Artificial Sequence
  Synthesized
  misc_feature (61): n=a or g
tccgtgagtgacacaaaatgccccagttgcagaaatataaaagacatatttctacaggggnaatgcagcattcatatttgtgtgtggccagcattgcctttaaaatatgaaacactagggc

SEQ ID NO: 39907 - DNA, 121 bp, Artificial Sequence
  Synthesized
  misc_feature (61): n=t or c
ctccctgccctctgaagcatggactttgtccttcagctgagcactgctgggcccagtgtcngtcagtgggatacaccttttatgtctagtaatcagcctgcagtataatgtgtgcatgacc

SEQ ID NO: 39908 - DNA, 121 bp, Artificial Sequence
  Synthesized
  misc_feature (61): n=a or g
ctttgaaatatgcactccagacttggccgagaggctatagaggaagccaagaagacaccantgcacgagcaagatgccacatagaaacccattttgtgcatccttgggtgagttactgagt

SEQ ID NO: 39909 - DNA, 121 bp, Artificial Sequence
  Synthesized
  misc_feature (61): n=a or c
gctgctgcacagctctagtccagagtctgtgactaacatgtactcttctactcttctcatncttcccaaatgatagaaagaccagtgtctttcagtttctgtttctgggacttgggcttcc

SEQ ID NO: 39910 - DNA, 121 bp, Artificial Sequence
  Synthesized
  misc_feature (61): n=a or g
caagtcatacaaatgacaccgcttaaacatttagaactgttctgttcattaaaagcaaaangtactgaaatagtcggaaaaatatatgcaattttttaggaatgtatttaaaatctatgat

SEQ ID NO: 39911 - DNA, 121 bp, Artificial Sequence
  Synthesized
  misc_feature (61): n=t or g
aaggatcatgccggcagactcagggtgcatgagatgtgcatggagcagcacatgcaacagntgagcatccctgggcagcaattcgcacccacgaacacagcaacctcccagcagccccagc

SEQ ID NO: 39912 - DNA, 121 bp, Artificial Sequence
  Synthesized
  misc_feature (61): n=a or g
gaaagctgatttttgacagtcagcgtgaggatgggaacagatggaggctttgatgaattanatatcactaaatgttgtcctcctgcaaatcagcttggttttctccattagcataagaagc

SEQ ID NO: 39913 - DNA, 121 bp, Artificial Sequence
  Synthesized
  misc_feature (61): n=t or c
ttagaggacagagccaagaacagccctgtctccctggaggtttcccatagaagaacaaganactcctctcattgctcactgcacactctgcctgctcacattgctggtcactgctgtgaaa

SEQ ID NO: 39914 - DNA, 121 bp, Artificial Sequence
  Synthesized
  misc_feature (61): n=a or g
caaagacgatggagtttaatgtaaaccaagacaaaaccacaaatggtactgctatgttacnagatggaagttgtggaactgtcaataaacgatgcaagtgacaaatgtccaacagatattt

SEQ ID NO: 39915 - DNA, 121 bp, Artificial Sequence
  Synthesized
  misc_feature (61): n=t or c
aaagaagcaagtgtgtcacaggcagaggaaagctgctcaggaatccagacctgtaatggcngtgtatcaccgaggtagccactgaattatctggcaacagccaggtttgtttaaatacctt

SEQ ID NO: 39916 - DNA, 121 bp, Artificial Sequence
  Synthesized
  misc_feature (61): n=t or c
ctctgcagccatccactgctgctagcaatacctctggctattccacctgccaactcctgcnttcctgctcaggttgtagccccattcccagctgtatgggaagaagcagtgctgcggatgg

SEQ ID NO: 39917 - DNA, 121 bp, Artificial Sequence
  Synthesized
  misc_feature (61): n=a or g
cttcctttgctacttcacgttacagacaatctgaccactatgcaaagaaaaaaagggaggnggggcgggacacatacaaaattgttccttactagcaaactccttatttaaacaaccagaa

SEQ ID NO: 39918 - DNA, 121 bp, Artificial Sequence
  Synthesized
  misc_feature (61): n=t or c
ccgtatgtaagactacagtattctcagggaaatacaaagaaagtgtcttcaatcaatttanatttgcccatataagagtcattattctaagcactctaagaaaatgatgacaaggaaaaag

SEQ ID NO: 39919 - DNA, 121 bp, Artificial Sequence
  Synthesized
  misc_feature (61): n=a or t
ggtagattacatttggttaatatctatgctctaatctttctattcctcatcatataataantcagcattgcatcattctcttggcctcccattttagcaccacatatacatgtcatatgtt

SEQ ID NO: 39920 - DNA, 121 bp, Artificial Sequence
  Synthesized
  misc_feature (61): n=a or g
atatgaagaacatctttgcaacgatttttagaactagcgcatccaaaaaaagcgatgacantttataaatagatctggttagggaacttctgtgtctttactgtgggatactttcataatt

SEQ ID NO: 39921 - DNA, 121 bp, Artificial Sequence
  Synthesized
  misc_feature (61): n=a or g
gtaacaagctattaaacacaagatccaaatctgctgatggagaaaatgaacagaggagagnaatttgttcattaatgcaaatggaatgtagacaagagtagggaacacgttacaagtgtaa

SEQ ID NO: 39922 - DNA, 121 bp, Artificial Sequence
  Synthesized
  misc_feature (61): n=t or c
cagtattgctctaattcatccttgcatttaatgacttctaaaggaagatcgtactgacttnctatttgggaataaaacaccctagtctcaggccaacctagacaaagcttatgaggcctgg

SEQ ID NO: 39923 - DNA, 121 bp, Artificial Sequence
  Synthesized
  misc_feature (61): n=t or c
aatttctatttacttttgacaaatttccagaaacaacgcattttcctcatttagctttccngtttgaaagaccgcaaactgtctttattcaattcacaatccatcatataaaaatcagtct

SEQ ID NO: 39924 - DNA, 121 bp, Artificial Sequence
  Synthesized
  misc_feature (61): n=a or c
ggagggaaaacaagtaaaaaacctactgttgattttccttccataaaagccccactttctncctgtttttatttccatttcaccctagcccttggcgtcagtgaatgatgactattcattc

SEQ ID NO: 39925 - DNA, 121 bp, Artificial Sequence
  Synthesized
  misc_feature (61): n=t or c
tgtaacctccactgagagggtggaaatatcccataacaaaatgtggtggagtaagtgttanagatctgtgttaattttaaacaaattccttcttcacacttgtacacagaagctgaaaaaa

SEQ ID NO: 39926 - DNA, 121 bp, Artificial Sequence
  Synthesized
  misc_feature (61): n=c or g
tttccctcccccccccccccccctttctgcctttttaccacttccatctcctggtgggtancacgctctgtttatttcttaattaattatccatctctccccttttccctcttgatatttc

SEQ ID NO: 39927 - DNA, 121 bp, Artificial Sequence
  Synthesized
  misc_feature (61): n=a or g
tttgggctcaagcagttcatcacatgttggaatagctgacttttctctgtttatgcactgngagataaaatggagagttgtgcaacctagtgtggactactgaatttgatgtctgtggtaa

SEQ ID NO: 39928 - DNA, 121 bp, Artificial Sequence
  Synthesized
  misc_feature (61): n=a or g
gagctgcctcatgtctttgcagagcctcccattatgagaaaagaattgtaagaatgcagcntgtatggagatctgctggctgaatgaatgccattatcataaaagaaaacgagcttaataa

SEQ ID NO: 39929 - DNA, 121 bp, Artificial Sequence
  Synthesized
  misc_feature (61): n=t or c
tttgcaatcgtactaatattcttagtgtagagaagatgggaagacaacaatgtgaaggcanaactttacaagtttcaaagcagaaaaagaaacctataccttatctaaataatgtgacatt

SEQ ID NO: 39930 - DNA, 121 bp, Artificial Sequence
  Synthesized
  misc_feature (61): n=a or t
tgaccatactccttgtgacacaaaattcactatttcaactttgcagctaaaagcagcccanacccaaatcctacagtttgcatactgtgggctaacagtagcactgactgcacgctcttct

SEQ ID NO: 39931 - DNA, 121 bp, Artificial Sequence
  Synthesized
  misc_feature (61): n=t or c
atcatttcttactccctgtttcaggttctgctaacacagaacatgaccacattaattctgnagcacgtgccataagggatagctgagtacctaaattcctctctctaaggagagggtacag

SEQ ID NO: 39932 - DNA, 121 bp, Artificial Sequence
  Synthesized
  misc_feature (61): n=a or g
gagatttaaaagcaaacctaaattcatccccagctcacaggaaactcactattcttcgagnaagagttgaacttgcttatcctagtctgaaacaatcacactgcaagaaatcttatttttc

SEQ ID NO: 39933 - DNA, 121 bp, Artificial Sequence
  Synthesized
  misc_feature (61): n=a or g
aagtatgattgaaaagaccccaaatttaccactcaacctgtccagaacatccaactttcancccttaaataagcagggacccgctcagaagcctggaaggcagcacaccctccacaacccc

SEQ ID NO: 39934 - DNA, 121 bp, Artificial Sequence
  Synthesized
  misc_feature (61): n=a or c
taggtcccgaacagcatcctcattgctgcctgagcttaaaacgggcccgggcactttgagnagaggcagcaaaacctgctgttagaacatccagagcagtcagcccagcacggggcactgg

SEQ ID NO: 39935 - DNA, 121 bp, Artificial Sequence
  Synthesized
  misc_feature (61): n=t or c
ctatgcaaacactgatttatttcataaaattggagtggttttcaatggctaagcaattgangacaaataaagaggagtttgcaatctcacatacagacaaattccatttgcagatctattt

SEQ ID NO: 39936 - DNA, 121 bp, Artificial Sequence
  Synthesized
  misc_feature (61): n=t or c
ctaagtctgaaaaataacagttttgtgcacctttcccctcagtggtgcagaaatcactaancccagaagctctaatttaatgaagcataagtggaatttaaatcaatgatggaacattctg

SEQ ID NO: 39937 - DNA, 121 bp, Artificial Sequence
  Synthesized
  misc_feature (61): n=a or t
taagcacctgtgaaaacaaagggttctccttggtgtcaagaatttatgaaaactgggacanttggattaaacgtcttaacagcaactgatcttccttgaaaatctgacacacaaattaccc

SEQ ID NO: 39938 - DNA, 121 bp, Artificial Sequence
  Synthesized
  misc_feature (61): n=t or c
agatatggaattttaattattcagtttcccagaaagtcaaaatctaaatctgtttttcaanagtttgtgcttcaacccatgtttacattcttgcattcttgcagaatggacattttgaatt

SEQ ID NO: 39939 - DNA, 121 bp, Artificial Sequence
  Synthesized
  misc_feature (61): n=t or c
atcccatagtctgaagttttgcccacttgcttaattttttgtcctttatagcattgttctnttttcttcatcgtacgttgtattctttgctcgtgctgtgacaaattattgtgtatacaat

SEQ ID NO: 39940 - DNA, 121 bp, Artificial Sequence
  Synthesized
  misc_feature (61): n=t or c
ctccccaagcagagctctcaaagggtgagcctcgtctttctgtaccttttcctcatggtangcatgtataaatgccagataagttcagttttttgttgggattttgtgtgtatgtgtgtgt

SEQ ID NO: 39941 - DNA, 121 bp, Artificial Sequence
  Synthesized
  misc_feature (61): n=t or c
tgtgtcttctatcttaaattatttaccttactgtattttattactgttagggtagcttagngtttcttttttgagatcctaaccacatctatgttatacagtgatttcctcacaacagcca

SEQ ID NO: 39942 - DNA, 121 bp, Artificial Sequence
  Synthesized
  misc_feature (61): n=a or g
ccacaaagcagcccccctgtagcaggctgcacaggtaaatacaacatgcatgcctactgcnttcagcaactttcccccaatattccttcgattcccaactcttttccttcctcagaatgag

SEQ ID NO: 39943 - DNA, 121 bp, Artificial Sequence
  Synthesized
  misc_feature (61): n=t or c
gagcaggatgacgagttacatcaggttggcacagaaggcaatagcctctctgaacacaganggagatgcctgccaggtgtcagcagaatgccaccaaaagagcagagctgctccaccaggg

SEQ ID NO: 39944 - DNA, 121 bp, Artificial Sequence
  Synthesized
  misc_feature (61): n=a or g
ttacttactgtacattttttagggactgataagaaaagttgtcaaattttccagtgaaacnaaagaggattttctgggatatgctcatgaaaataccacagtaaaactgtccttgatctat

SEQ ID NO: 39945 - DNA, 121 bp, Artificial Sequence
  Synthesized
  misc_feature (61): n=t or c
attaaggaagcctgatagtctatgtgatgtaaagagaaaaatctttccagatctcccttgntgaatttcctcttcggtcttagactatgattttgttttcttcccttgttggagaatgttg

SEQ ID NO: 39946 - DNA, 121 bp, Artificial Sequence
  Synthesized
  misc_feature (61): n=t or c
ccagaataaaagctcattccaatagaaattaggaaacgtcactggaaatgttaaaggttgngtttctaggagaggctgaaaagtagacaacttttttccatttgtccttaatgtatgatta

SEQ ID NO: 39947 - DNA, 121 bp, Artificial Sequence
  Synthesized
  misc_feature (61): n=a or c
cagggttagggctgggcaatcttgcagcctccaccagcatgtgactctgtagcacagtacncttcctaccacagaagatctcattgtgggcttcacagagagctgcaaatcctggtggtga

SEQ ID NO: 39948 - DNA, 121 bp, Artificial Sequence
  Synthesized
  misc_feature (61): n=a or g
actttcacaagctgaagcttatttttgtccttcttctccccttttgcaaatctactgtgcngtacttttaactctttgagtagcttctatcaattcagttgttttccatgtacgttctaaa

SEQ ID NO: 39949 - DNA, 121 bp, Artificial Sequence
  Synthesized
  misc_feature (61): n=t or c
aaacctaggggtacatatctaatatgatctgtatggagttggcttgcttgccaactgtgcnagcttttcattttggtgagaaataaattaccaaaattattgctaccaaaagcagaatggg

SEQ ID NO: 39950 - DNA, 121 bp, Artificial Sequence
  Synthesized
  misc_feature (61): n=c or g
aaacatactgttgtacagtgtactcttaacctggattatgcaataatattttcactggggnctgttttacagcatttattgtgcctgatctttcagtaattctttacatttatgaggatgc

SEQ ID NO: 39951 - DNA, 121 bp, Artificial Sequence
  Synthesized
  misc_feature (61): n=a or t
tgctttatggtattgttgttctagtcatactggatgagtccagccaaacacagagtagtangtctctttgggattttcaatgttacatcggggattttagcattatcattaaccaaaagac

SEQ ID NO: 39952 - DNA, 121 bp, Artificial Sequence
  Synthesized
  misc_feature (61): n=t or c
aaatagaagaattctgatgacattactgttctcatctttcagaatgtattctgcctgtcangcaaactgtctgaaaactgcagtttgctatcctggctttaataaatgcattgatatgtac

SEQ ID NO: 39953 - DNA, 121 bp, Artificial Sequence
  Synthesized
  misc_feature (61): n=a or g
cttttttatgtgacaggaatcaggccactacatgttctgaatgaataattataaaatctgngtttggtttacattttcatttgttctaccaatactgtgctactaatcagtgatttttatt

SEQ ID NO: 39954 - DNA, 121 bp, Artificial Sequence
  Synthesized
  misc_feature (61): n=a or t
taaccaaataacttgtgggtgtccaacccacatgaaaatggagttggaacatagaaaaaanagattttgttttttgaaaccttgaaatctattctcaaattcctttaccaaaccagaaagc

SEQ ID NO: 39955 - DNA, 121 bp, Artificial Sequence
  Synthesized
  misc_feature (61): n=t or c
tgacagtggcattttctctactgcaaagctgtcctaatctgactaataaataaggagcccngcaaagacgattgttaggctttcactcaaaactacagctaatagtagggtttggcaaaag

SEQ ID NO: 39956 - DNA, 121 bp, Artificial Sequence
  Synthesized
  misc_feature (61): n=a or g
ccagcaatgaaagctattgaaggaggactgtgatgcttcttgggatcagcaaccacatccnctgctagcagtggaaggttcctgccgttccttaatgcctctgcccctgtagggcagccca

SEQ ID NO: 39957 - DNA, 121 bp, Artificial Sequence
  Synthesized
  misc_feature (61): n=t or c
tttctattagggccaaattgtaaagggcaaccaagtttgtcagctgtttttattgtagcgngtgcagtatatacatccctgtattggtttgcccaggtctgttttgaccaattttctataa

SEQ ID NO: 39958 - DNA, 121 bp, Artificial Sequence
  Synthesized
  misc_feature (61): n=a or g
atatttttattttagctcttatttttaaaatagcctccccatccaatttgctaaaaatcanaaaagtttataatggaaaaaatacatatcagcctaattcagaccctgcgtcacatcagca

SEQ ID NO: 39959 - DNA, 121 bp, Artificial Sequence
  Synthesized
  misc_feature (61): n=t or c
agtgtggaaaagagtgggggatttttagtacacatttcataacatagagttgactacaggntttggctgcattaatctagaacgatattgttctgcattggacccacttcaacacttcaaa

SEQ ID NO: 39960 - DNA, 121 bp, Artificial Sequence
  Synthesized
  misc_feature (61): n=a or g
caaggagaaagtttgagctttttcaagtgagtaatgtcgagttatttgggatattggtacnatgcttaacatgtgtctgtaaatttggtcatctctctaaactgggattaaaatgactttt

SEQ ID NO: 39961 - DNA, 121 bp, Artificial Sequence
  Synthesized
  misc_feature (61): n=t or c
ccttcggtgcgccccggctgccagccccgtggcaggcagacaatccctctgcctgtgtgcngtgcatcaaggccacatctcctgcataccacactggggagagccatcctcaagtgcttcc

SEQ ID NO: 39962 - DNA, 121 bp, Artificial Sequence
  Synthesized
  misc_feature (61): n=t or c
acacttggggcccatacctagcgggcgtccctgggtggggcaacgagtatttggcacaggngtgttcagcgggcaattttaccacggttgtagttaatgtcaccctgccaagagacttgac

SEQ ID NO: 39963 - DNA, 121 bp, Artificial Sequence
  Synthesized
  misc_feature (61): n=a or g
ccccacctcctgggtgcctcagaggccacttctgaccccttcagccatcatagtgggaatnaaagggtccctgcgaggtggccgtggctcttgggattgtgttcatcccagtaagggcctg

SEQ ID NO: 39964 - DNA, 121 bp, Artificial Sequence
  Synthesized
  misc_feature (61): n=a or c
cagtttgcttctaccggttcctcaattctactggttctccaattctactagctacacaganatgtcttgagaagtagcacaatgaattttgcttgggagatgcaagggattgcaaataaat

SEQ ID NO: 39965 - DNA, 121 bp, Artificial Sequence
  Synthesized
  misc_feature (61): n=a or g
atggggagggttgagatcatccatcagacagcgccctgcatgtaacacctaaatatcttgncgtcggtggcactggatggcagagagcccgtgcgatgcacctcctgctataggtgcagct

SEQ ID NO: 39966 - DNA, 121 bp, Artificial Sequence
  Synthesized
  misc_feature (61): n=a or t
cacaaatatattaaaaaaatcaagagggataacaggaagagggctatatgagagtcttttnaatgaaaatattatagtataaaagtagtgaaagccacttggctcacagtgctgaagtaca

SEQ ID NO: 39967 - DNA, 121 bp, Artificial Sequence
  Synthesized
  misc_feature (61): n=a or g
ggtcttgaaagcaaagtgatgtgcgccatgagaaccctaagaactgctgctatatacaccntggctattggttgtcttttctaccccagcatttggttgttacccttctgtttgggttaca

SEQ ID NO: 39968 - DNA, 121 bp, Artificial Sequence
  Synthesized
  misc_feature (61): n=t or c
cagaagtactgtctttcctgaaaatgaatgtagcctgtggtattttctttgacctcagaanaaaaattcaatgactcagacaatatagcaacattattgagtcattagattcaaaccatca

SEQ ID NO: 39969 - DNA, 121 bp, Artificial Sequence
  Synthesized
  misc_feature (61): n=a or t
caaagtggattactgggaacacaaaggactttgtgctcagtttcagagttagcacatgtgnaagaactaaagtccagagatctcattcatagttcccctgaagtgcttctaagatttcttt

SEQ ID NO: 39970 - DNA, 121 bp, Artificial Sequence
  Synthesized
  misc_feature (61): n=t or c
gcaacaaactgagaaccagatgttactgctacaaatttaattttagagctggctggacaangatcatttgtaaaaataaaactggtgctgtaaggaagtgcaatttagaagtaggaggaga

SEQ ID NO: 39971 - DNA, 121 bp, Artificial Sequence
  Synthesized
  misc_feature (61): n=c or g
caacaatgttaagaagtgtgttagcagacagctgtcagagccaagtgagcaagacccctanactgggtatcactggtaggtccaatgagacagacatttcaacaacgtgtattgcagtctt

SEQ ID NO: 39972 - DNA, 121 bp, Artificial Sequence
  Synthesized
  misc_feature (61): n=a or g
gcagcaggagtttggctgaggctggcttggcggccacaccgcattgctgcttccaaggaantgtgtgtttgcaaaggcagtggggctggatttgcttcggcacgcagccaagaaaactcac

SEQ ID NO: 39973 - DNA, 121 bp, Artificial Sequence
  Synthesized
  misc_feature (61): n=a or t
cctctaggtgtttcccacaggctcagacccaatgccacacactgggtatgccatgtcttancacctactatttccagagcacaggagaggagcatctggaacatgaggtctggtttctaca

SEQ ID NO: 39974 - DNA, 121 bp, Artificial Sequence
  Synthesized
  misc_feature (61): n=a or g
gcaccaagtccttgcaaacaactgcattagtccagtgtgctcattgcaggattgggcaacnaagggacaaattcaatcttattttgaccatagtttctaggatttagcccctctgacccac

SEQ ID NO: 39975 - DNA, 121 bp, Artificial Sequence
  Synthesized
  misc_feature (61): n=c or g
ccactgagcccgccctgtcccagtgacatggggccctcccaggggggacagtctcaacctncttggttggacattttggcttggacatttcatccccaaaccccttgggtgaccaaaaggt

SEQ ID NO: 39976 - DNA, 121 bp, Artificial Sequence
  Synthesized
  misc_feature (61): n=t or c
ttctgttaatattccctttgtaaaatccaaaccctgttgcttttaaagaaactacatgacnagggtcttactgaatattgtttttaaaaatgtgagttttagcctgcaaatgtttgttcct

SEQ ID NO: 39977 - DNA, 121 bp, Artificial Sequence
  Synthesized
  misc_feature (61): n=a or g
aaacctatttgcaaagtcaccctgcagcccaaatttcaagttgaattcaagcagtgagacnagaatacttccacagcagtcacgcagtgtgtctgagaaacactctgagacattgcccatc

SEQ ID NO: 39978 - DNA, 121 bp, Artificial Sequence
  Synthesized
  misc_feature (61): n=t or c
ctatatgaaaaggtctcagtatttctgagctgaaatgggtgtttaactgagtcagcaattnagaaatctgcaattctcaaatttaagcaggctggaaattttaacagcagcattacacggt

SEQ ID NO: 39979 - DNA, 121 bp, Artificial Sequence
  Synthesized
  misc_feature (61): n=t or c
cttttgccctgaatattgttcatatgtacagcagagtaactgttagctgcaaaaccatcanaaataaatcgtttgatatttctgcctttttatgaaatactgcttggttacaaggtgggag

SEQ ID NO: 39980 - DNA, 121 bp, Artificial Sequence
  Synthesized
  misc_feature (61): n=t or c
gctgctcatatacccggggagctgtggatgttctgccaggggccgaccaacaagagctttnggctgcattaatgtcctgtctttcaagccatgttaatgatgtgctcttatactctcactt

SEQ ID NO: 39981 - DNA, 121 bp, Artificial Sequence
  Synthesized
  misc_feature (61): n=t or c
acactcttataaaaactttgattttaaatttcatttaagcttccctgtgtcatgaaatgtngcactgatggggaatttaaagaccagaaaattaaaataacatctaactgaacattcatga

SEQ ID NO: 39982 - DNA, 121 bp, Artificial Sequence
  Synthesized
  misc_feature (61): n=c or g
gacttattcaaagacagtcttccctgcagccttaaagagacagaactgttggcttgaaggnagaaactgccagaagtcagtgcctcaacacattaaccaaaaccaacagagtctcatcgca

SEQ ID NO: 39983 - DNA, 121 bp, Artificial Sequence
  Synthesized
  misc_feature (61): n=a or g
atttgtataaatacagggctttcactacccagctctcacctcttatcgttcctacagtccnactctgcaaattgccatctcttgcctaggcctctatgaatacaaataactatgtctgcag

SEQ ID NO: 39984 - DNA, 121 bp, Artificial Sequence
  Synthesized
  misc_feature (61): n=a or t
gtacatgtttttgctagtttattcttgatctctgtaattagagactttttttagtctcagnttcacctgtcatttctgcattgcaggtatgaagaagctctctctgactatcatatggcct

SEQ ID NO: 39985 - DNA, 121 bp, Artificial Sequence
  Synthesized
  misc_feature (61): n=a or g
tttgactggataggatgataatgcaatctttgatggcaagatataatatgaaaatattaangcaaaatcactgaaagcctgatgtttcatctgtgcttccaaatcaatgaggctttgttat

SEQ ID NO: 39986 - DNA, 121 bp, Artificial Sequence
  Synthesized
  misc_feature (61): n=a or g
acctggttgagggcaggcttattcaaaaggaatggaccagctgggaggttaaatgctacangggcaggaggaagccctgcagcaaggcaaactgggctctgctccttatcaccggtaaggt

SEQ ID NO: 39987 - DNA, 121 bp, Artificial Sequence
  Synthesized
  misc_feature (61): n=t or c
aagaatgcagttctgtttttctgatggcagatcaaattctggctattctcaatagtccaanattgatcactaaaatggcctctgcttccccccctgcattttttaaagaaagaaaatagga

SEQ ID NO: 39988 - DNA, 121 bp, Artificial Sequence
  Synthesized
  misc_feature (61): n=t or c
ttgcttgtcatgtaaaatcatacttgacctgaataacgataccctctctggtttttactgngtgcaggttacgaattccctatccattaacacagaatatttttatacagtaggtgattta

SEQ ID NO: 39989 - DNA, 121 bp, Artificial Sequence
  Synthesized
  misc_feature (61): n=a or g
tccatatggaaattagcattttgaattgagtttctgtgccatttgtttcacgtctgaacanatctacactcaatctgtgttgttcagagtgggtcacaatcaggctctgggcaaagatgta

SEQ ID NO: 39990 - DNA, 121 bp, Artificial Sequence
  Synthesized
  misc_feature (61): n=c or g
acaggcagaaatgaatggaattaagctacctgaattttaaatatctgaactagttatagcntttctttgtagtaaataaaaagcaattgtctctttcagagcacaattcatttagccaaat

SEQ ID NO: 39991 - DNA, 121 bp, Artificial Sequence
  Synthesized
  misc_feature (61): n=a or t
atctgatacaatgttttctcttcacaggggaggcagtgtgttgcatggagttattgaacancaaagcaaggtcaagtcaggtcagtgctgcacttgcacttgtgagagctcatcctctgtt

SEQ ID NO: 39992 - DNA, 121 bp, Artificial Sequence
  Synthesized
  misc_feature (61): n=a or t
gtgagatttctgaagaggaagtgtaactgtgtaacagcattatgctggtgctgttattgtncagcagtgttgttatcttgctgctcatcgtttgctaacccaagtgctacaccataagcat

SEQ ID NO: 39993 - DNA, 121 bp, Artificial Sequence
  Synthesized
  misc_feature (61): n=a or g
gaagtgagattgctctttcaggttctgctgcagtttgtatcgttcctccttgttgccaacntacgtcacgaaggagagacctggagcaaacctgcagtcaagagaaagacagcaaaagaaa

SEQ ID NO: 39994 - DNA, 121 bp, Artificial Sequence
  Synthesized
  misc_feature (61): n=a or g
gactttctttcagtgcattcttttttgacagactaattctcagctgaatcagtttccgccnttcacttcacagcccagctcagacattatgccaaggtaatgcagcaggcaggatgagaca

SEQ ID NO: 39995 - DNA, 121 bp, Artificial Sequence
  Synthesized
  misc_feature (61): n=c or g
aaataataatctgagaggattacaaactgatatttatgattaatttactatttgcttcttncaacttaggggaacatctacatcggtatttgtaacaaagtggaactgcctaaggcaaatg

SEQ ID NO: 39996 - DNA, 121 bp, Artificial Sequence
  Synthesized
  misc_feature (61): n=t or c
agatggaaaaccaaaatcctgtttgcttaggctctttcacagtcccatagagcaggagcgntagtgttggtgtgctggcccagctccagctcaggtaattaccgtgcattctgccctactt

SEQ ID NO: 39997 - DNA, 121 bp, Artificial Sequence
  Synthesized
  misc_feature (61): n=t or g
ctgggaccagccatgccctgcagtggggccattggagttgcctggaactggctatgccctncatggggcaagcccaagagcacctccgtgaggagcctaactcaaattttgccatatatac

SEQ ID NO: 39998 - DNA, 121 bp, Artificial Sequence
  Synthesized
  misc_feature (61): n=t or g
agttcttgaccccggggccgcctgcaaaacccagacaggcattcacatccctatctaactnaaatgcaatacaaagggacacggcaggatttccccacccttgctatgaacggtgatcagt

SEQ ID NO: 39999 - DNA, 121 bp, Artificial Sequence
  Synthesized
  misc_feature (61): n=t or c
agttatcagagatctatgaggcaattcaaaatttggatccaagattctctacagcaccgantgttatttagtttctcactgcagatgaagaaactactggtaaaattcaacttcagcttgg

SEQ ID NO: 40000 - DNA, 121 bp, Artificial Sequence
  Synthesized
  misc_feature (61): n=t or c
ttttaatcgtctttaaagattaaaaaagataaaaatgggcaactttgcttatgtgttgtgntgggacgcttcagtgcctctgtatgcttatgctctcagtgttgtcacatagggacagcag

SEQ ID NO: 40001 - DNA, 121 bp, Artificial Sequence
  Synthesized
  misc_feature (61): n=a or c
ggggctccttcccttggttagtgcatgaccacgtagtgtttggcaatgggatggacctgcngatgcccagcaggcatgagccaggcttctcccccttctaacgctgttggttttacctcct

SEQ ID NO: 40002 - DNA, 121 bp, Artificial Sequence
  Synthesized
  misc_feature (61): n=a or g
ctccattgaaaagtcatggtgcaaatggtgcaagttagccaaccatgctcatgcttctgcnggagctgacttgctcctcggcagagggctgcaaagggcagctttgggccagacacagccc

SEQ ID NO: 40003 - DNA, 121 bp, Artificial Sequence
  Synthesized
  misc_feature (61): n=t or c
gacagcccccggagttagggccacctgacactgtgcattcagctgtcaggagcccggcacngagccccaacctgcagctttctttctgtgtttccaatctgtgtgcatttcccagcagtat

SEQ ID NO: 40004 - DNA, 121 bp, Artificial Sequence
  Synthesized
  misc_feature (61): n=a or t
ctgggcgcatggttcagtccttcctacaaagagttggagcccttaagaaggactgggtgangagcaggaaagatcaaatgttgaatgaagagattttgggagtggagagaggaggagaact

SEQ ID NO: 40005 - DNA, 121 bp, Artificial Sequence
  Synthesized
  misc_feature (61): n=t or c
gcagcctgcaagcatccagctgttatttatacacaccagactggctgcaatgccaggactncttccccccaaaagatatgacttcgtcttttggcctcaggaagatgaatgacagccaaga

SEQ ID NO: 40006 - DNA, 121 bp, Artificial Sequence
  Synthesized
  misc_feature (61): n=t or c
tgtgcagtctggaggaaggatgctgcaatgtcctggcatgagtagggctctgttctgccangaacactccatgtgcctcttccttcccagctctgacagctccaagccttcctccccagca

SEQ ID NO: 40007 - DNA, 121 bp, Artificial Sequence
  Synthesized
  misc_feature (61): n=t or c
aagaccccatttcaggaatcacaccacagatgagatgtatattcagccagcacatggtcangaagaagatgacaggaaagacacagcctgacatctggtgttgggatcccacttttgaagt

SEQ ID NO: 40008 - DNA, 121 bp, Artificial Sequence
  Synthesized
  misc_feature (61): n=a or g
ctgtttcaagtaggaattccacaaatgccctctaacagtactggaaacttagacaaaagcnatgctgggtgttccttcttatgttaggaatgctgtgagttggcataaacattgagcacaa

SEQ ID NO: 40009 - DNA, 121 bp, Artificial Sequence
  Synthesized
  misc_feature (61): n=t or c
cctcccccgcaggatccctctttgttgcagctgcagaagtaattccattgagtgggaagtncccccacaggaggaagctgcacctcctgctcacccggggcattgctgccatcccattgct

SEQ ID NO: 40010 - DNA, 121 bp, Artificial Sequence
  Synthesized
  misc_feature (61): n=a or g
gacctgacctgaaccaacaacgcaagccaggaaattgagtaaagtattcaggaccattttnaagtcctcccagaagaacaccttggtatgccttaatgaactatagacagagaactgtatc

SEQ ID NO: 40011 - DNA, 121 bp, Artificial Sequence
  Synthesized
  misc_feature (61): n=t or g
tgatggctgggtctgcatgtaaattgcacaccacaccatctgaacttccaacttattccanctgaagtactttggatgccttcaactgaaaggatttttcccagttagaaaactttctttc

SEQ ID NO: 40012 - DNA, 121 bp, Artificial Sequence
  Synthesized
  misc_feature (61): n=a or g
gccgacgtgagtgcctatccagagcagtggatgcagggagaggtgctccctgcttgccagngtcttcaacacatagatactttgatgccttgcagcctgccagtgcagtggtgagggatcg

SEQ ID NO: 40013 - DNA, 121 bp, Artificial Sequence
  Synthesized
  misc_feature (61): n=t or c
agacacaaatcaggtgtgacttccaataagatccctgccattcctttgtccactggatacngccacgcagatggaaactgcggtgctttattgcttctccagttgtgccagtacttctgag

SEQ ID NO: 40014 - DNA, 121 bp, Artificial Sequence
  Synthesized
  misc_feature (61): n=a or t
acccatggatagaacatagaacaccttaacagcaaacatttcctttaaattgccatggcangctaatgttcaagtacacattttctctccaagccaccactctgctctctgccactgggga

SEQ ID NO: 40015 - DNA, 121 bp, Artificial Sequence
  Synthesized
  misc_feature (61): n=t or c
ggctaaattactgccagcttggtattaaaagttctgcggtggtttctggttcaaagagtcncataaaaatcagagttaatttaaaacttagccatccatgggaatatttctcattcacaca

SEQ ID NO: 40016 - DNA, 121 bp, Artificial Sequence
  Synthesized
  misc_feature (61): n=a or c
gtgcaatccttgctttcttccttgaaggtggcccattctatctatgggtgcacaaaaaaancagagaattgagaaatgatttcaaagaaaactggcacatcaggattggagaaataattta

SEQ ID NO: 40017 - DNA, 121 bp, Artificial Sequence
  Synthesized
  misc_feature (61): n=a or g
ataatcgcagagatctatgtgctgcttctctgcctttctgaaataaactctagagataagnctgtcagaagtttctgccttccattatgcactgagcttggtatttccaagtgttcctgag

SEQ ID NO: 40018 - DNA, 121 bp, Artificial Sequence
  Synthesized
  misc_feature (61): n=a or g
taaacatgaaaaaagtgactgccatgtgcatttaagctaatcttttagcaagaatgctttntgattagctaattctactttttggggctagatggtgacttaactacagtgtaaagtctga

SEQ ID NO: 40019 - DNA, 121 bp, Artificial Sequence
  Synthesized
  misc_feature (61): n=c or g
tccaaagcgctgggctgggaagggcctcctggggtaggctgccattcagagtggagggggntcttaccagctatgggcacacttcatgcagcagagccatctctgtgcttcactctgtgct

SEQ ID NO: 40020 - DNA, 121 bp, Artificial Sequence
  Synthesized
  misc_feature (61): n=t or c
aataaaacttgcttcttcaaagttattcagcaaatgaataacaaagcctgtaacagaactnttttcatcattaacagaagttcccatgtgctatcctgggactgtttgtctaacttgtttc

SEQ ID NO: 40021 - DNA, 121 bp, Artificial Sequence
  Synthesized
  misc_feature (61): n=a or g
atactcataagcaattccacatcaagacttccctttttcccctcaagggaatctgtatagntgttgccctgttttattagcttatccaccaaaggagcagctgcatcatcaattcagttgc

SEQ ID NO: 40022 - DNA, 121 bp, Artificial Sequence
  Synthesized
  misc_feature (61): n=t or c
tttatgttcttaatatgagttttatatgaataaaaccttcaactatttgactacttgtcangagtggtgctttctttgggggcttctgcatccaccctctgctgggagattgttggtgatt

SEQ ID NO: 40023 - DNA, 121 bp, Artificial Sequence
  Synthesized
  misc_feature (61): n=a or c
atcatacatcagtttgtactttcacctcctacatgcccagaaccctccaaaagatctgctngatgtggttagtagagtagtgggttacaaaatagtaaatagcatcagtatttcttcagaa

SEQ ID NO: 40024 - DNA, 121 bp, Artificial Sequence
  Synthesized
  misc_feature (61): n=t or c
gtgaatagaaaggggaggctgtcctggttgccactgctttggagattggataaagatctcntgtgggctgagctgcacagtgctgcagggatctgggacagatgtgctctcttttggggct

SEQ ID NO: 40025 - DNA, 121 bp, Artificial Sequence
  Synthesized
  misc_feature (61): n=t or c
tccagtcttatgctttagagtttatcacaaacagagtatttgcgcattgatatgtaggatngcaatgctgttattattagttatcttctctagtctttccttcatctgcagattttatcag

SEQ ID NO: 40026 - DNA, 121 bp, Artificial Sequence
  Synthesized
  misc_feature (61): n=t or c
agttacattatacaaagttccagaaagagcttggcaagcctgtacttcataatatgatatngccattgctggtaacaggtcacaggctttgtaccaagtctgtgcaacctcaaattgaggt

SEQ ID NO: 40027 - DNA, 121 bp, Artificial Sequence
  Synthesized
  misc_feature (61): n=a or g
aaggacacttgccagcttctgcatcaatatttcaccaaggctctgtgctctagtgacactnggattctcttcttcgccacttggctctaacgtcaaaaagggatatactgcattaacgagt

SEQ ID NO: 40028 - DNA, 121 bp, Artificial Sequence
  Synthesized
  misc_feature (61): n=t or c
agaactcaacagctacagttcaacatgggaggatgagacactgagtagcttgagcatggcnggagccagtgatgtccagaagtccttgccaatctcgggcattctgtgacccagacagtct

SEQ ID NO: 40029 - DNA, 121 bp, Artificial Sequence
  Synthesized
  misc_feature (61): n=t or c
tactaaatattcctcttaccacactcctaaaaatgccttttcttgtatgccaaagcaacangtcctgttgactatccctgcccataaagggttggtgtccacagtatgatctgaaatgatg

SEQ ID NO: 40030 - DNA, 121 bp, Artificial Sequence
  Synthesized
  misc_feature (61): n=t or g
tcttccttttaataaagacatgcttgctgtgtttaaatggctgcagttgggagagttgttntgcagtcctttgctttcattctttgtctcaagtgaaagtattgcaatcttcagattaatc

SEQ ID NO: 40031 - DNA, 121 bp, Artificial Sequence
  Synthesized
  misc_feature (61): n=a or c
gtggtagagtgggaataggaggaatgctgtttggcacctctttgctctacagctgagcaanaggatttctgaatgttgtggcacttatagcacactttggaaacagcaaaaaaatgatgat

SEQ ID NO: 40032 - DNA, 121 bp, Artificial Sequence
  Synthesized
  misc_feature (61): n=c or g
ttttgttagaaaggatagcaggattttaccaaaggaagctctgtatgagctaaaaaccaantgttcacaagtcctttgtaaataatgactgaatatgtgaaatcaggacaaaatttaattc

SEQ ID NO: 40033 - DNA, 121 bp, Artificial Sequence
  Synthesized
  misc_feature (61): n=a or g
tttgtgctgctagtgctctccaggggccagactctgatggacacatggaaatttttagatncaattttattagatgtgcatcaatggagtgatgtgttttctccaaacctgtgttgtcagt

SEQ ID NO: 40034 - DNA, 121 bp, Artificial Sequence
  Synthesized
  misc_feature (61): n=t or c
gtcttgttctatctctgggcaccaccagaagagtctggatccattctcttaaaaccttccnttcagatactcacacacatttatcagatccctcgtgagccttttcttctctgaaacagat

SEQ ID NO: 40035 - DNA, 121 bp, Artificial Sequence
  Synthesized
  misc_feature (61): n=a or g
tggtgagcctacagaatggatcaaaccccactgaccatcacttgtttcccagctcctggcntaccagaataagatgctcacctgtatttcaggggctcaccctcgctgcagcctgcacaga

SEQ ID NO: 40036 - DNA, 121 bp, Artificial Sequence
  Synthesized
  misc_feature (61): n=a or g
accttgaaaagaattccatgcaaaacatttataaagtacaacatttcattggaaaaacctncacgaaacgctcctacttccaggtagaaaaaaaggcaaaagagcacttggtcagcacaag

SEQ ID NO: 40037 - DNA, 121 bp, Artificial Sequence
  Synthesized
  misc_feature (61): n=t or c
tctaaaacacacactgtagtaactacacatattttcttaccctgtaattacctgcccctgngcagggcaatgggagttctctgtctgtttgcttacacacttctaacagcagcagtctcaa

SEQ ID NO: 40038 - DNA, 121 bp, Artificial Sequence
  Synthesized
  misc_feature (61): n=a or g
agatttttaaaaggctaaagtggtcatccaaaccatatactctatcctcaacgaaagtgcnaatgagaaaaaaagttgaccaaaacagaattatacttaaatccacttgaattaagcagat

SEQ ID NO: 40039 - DNA, 121 bp, Artificial Sequence
  Synthesized
  misc_feature (61): n=t or c
cctgctttgataaaaggggtgcgggaaggttggaaaggcatgtgcaagcaggcaatgggangtgtctgtgaaaactgcttacaatgcaagagcagaatctctttcctgcaggagctgttgt

SEQ ID NO: 40040 - DNA, 121 bp, Artificial Sequence
  Synthesized
  misc_feature (61): n=t or c
gaaggttattggagttttcttgtctgtttagactttgctagttttcatttgtaaacatttngttaagaagactgaatttgtggcaaagtgattaagcacattattgaatttctctacacag

SEQ ID NO: 40041 - DNA, 121 bp, Artificial Sequence
  Synthesized
  misc_feature (61): n=a or c
gcaggtaaaacaacctgattctgctctagcaaacagaatttaaatgtgaaggttgattgtntaagctgcgaagttctgctgctaatggaagtacttgctttattttgggcacttctatgcc

SEQ ID NO: 40042 - DNA, 121 bp, Artificial Sequence
  Synthesized
  misc_feature (61): n=t or g
agcatttttcattttaggttgagaatgttcatgtcacaggacttgtggaactctcaatgtncatatttttgtacgacttgtagtcttctgagggagaaaagtgggtggctttctctgagct

SEQ ID NO: 40043 - DNA, 121 bp, Artificial Sequence
  Synthesized
  misc_feature (61): n=a or c
agcagggagccggggctgtgttatgttttgctgatagtgaaggtatcagaggcaggtcatnccaaaacagctgcatcaccttccccttgtagaaggccacaggaagtgtttgggaaggcac

SEQ ID NO: 40044 - DNA, 121 bp, Artificial Sequence
  Synthesized
  misc_feature (61): n=t or c
attttgttaattaatttgtaaatataatgaattattttaaaagtttgaataattaattatncagacaaaaatattccagatgcaaaatatatttgacagcagtaaggaattgcttataaga

SEQ ID NO: 40045 - DNA, 121 bp, Artificial Sequence
  Synthesized
  misc_feature (61): n=t or c
gcaagctgccctgactgagaaaggatctggagtagaggtaactcaagtgaaaaataaatgncagggattgaggagcccacctgggtttgctcacggatgagggcagctccaataatagctg

SEQ ID NO: 40046 - DNA, 121 bp, Artificial Sequence
  Synthesized
  misc_feature (61): n=a or c
gaggggcaaagaaaaaaagcatattaaacatcaggaactgatgttggtagctagaaaattnaatgtaccaatggaatcttgcatgtgatcttgatgccttcgcatgcttttctaggctacc

SEQ ID NO: 40047 - DNA, 121 bp, Artificial Sequence
  Synthesized
  misc_feature (61): n=a or c
gtgccaaaatactgacaggaactcttggtgagggaagataaattagaggtctgactcctgnatcagaagaaagaaatcaacattgcttgaaaggagccgtgctgttcaaagtggtgtgaac

SEQ ID NO: 40048 - DNA, 121 bp, Artificial Sequence
  Synthesized
  misc_feature (61): n=a or g
gttggttggttgtttcctaatctattttcctacctgactgtggagtccttaaaagtgaacncacctgatttctctctatccagtcaattcctaaagcaccagtagctattgaaagggctgt

SEQ ID NO: 40049 - DNA, 121 bp, Artificial Sequence
  Synthesized
  misc_feature (61): n=t or c
aacagggcacttgattaggcactcttttcctggctgaggatgtctcctttaatgaaaagangggcagctcttaaattgacagccttgacagctctaattcaatctcagatgtcagctgaag

SEQ ID NO: 40050 - DNA, 121 bp, Artificial Sequence
  Synthesized
  misc_feature (61): n=t or c
ccccaccccccagacagaatggcaaacacaattcccttaactagcatcaggtgtggacagnaagtaagtgtcacgctattacttaggattaaagcaaaatgtctcagggcaagttatcata

SEQ ID NO: 40051 - DNA, 121 bp, Artificial Sequence
  Synthesized
  misc_feature (61): n=a or g
gttatcatttttccaaggctctggcttggaagcagaagcaaatattttgtgttgttcttcntcaagtccaataagctggctgaaattggatcagtgcaggaatgggaagcctttgtgggct

SEQ ID NO: 40052 - DNA, 121 bp, Artificial Sequence
  Synthesized
  misc_feature (61): n=a or g
ttttttcttttgcgtaaacacttcacaaagattagttcacatgcacagagagactccaagntgaggctatgccttcccttcattaagagagatggtgcagatctccttcagcaagctgtga

SEQ ID NO: 40053 - DNA, 121 bp, Artificial Sequence
  Synthesized
  misc_feature (61): n=t or c
cttgaaaaaaagtctgagaatgcattatgccatcagtagatttcatttaggaaatctaagntgtttggcagctgaatccactatttacattagattttcagattataaaacaatatcaaat

SEQ ID NO: 40054 - DNA, 121 bp, Artificial Sequence
  Synthesized
  misc_feature (61): n=t or c
tatcgctcacaacttttctgtcatggaaaataaacaacatgtgtgtcttacaaagtttgcnatacaacatttttaaaaagtggacaaaagtaaatgttacatcaaagtgcaacttgaaaca

SEQ ID NO: 40055 - DNA, 121 bp, Artificial Sequence
  Synthesized
  misc_feature (61): n=t or c
agcataggaagatagcctttgtatttttgacagaagacaataattctattgataaaaacantaaatagcaaaaaaaaaggccttcaaattctagcaaagtatacctctgcttttacatatt

SEQ ID NO: 40056 - DNA, 121 bp, Artificial Sequence
  Synthesized
  misc_feature (61): n=a or c
tttttttccagttttattttacttaacaaagatctgagggcagtaaagtgctgcctgcacntatgggtagtaatgcaggcactgcctgctagttcatagccatggcagaagttgggactgt

SEQ ID NO: 40057 - DNA, 121 bp, Artificial Sequence
  Synthesized
  misc_feature (61): n=a or g
ctgttagtactacctctgtcttttgtaaggcagtgtttcattgcaggacgcagtgcgaatnctgacttaaatagtgtaagagccatgcaaactgatagcaatgaagctacaagcaagtcct

SEQ ID NO: 40058 - DNA, 121 bp, Artificial Sequence
  Synthesized
  misc_feature (61): n=a or c
ttaggtttggcaattggattaacacagagaggaaacaaaaaatgttcatgtttggtgactncaccttgtccaggacaaattgatccatctgctgggcagacacttttatttgcttcttact

SEQ ID NO: 40059 - DNA, 121 bp, Artificial Sequence
  Synthesized
  misc_feature (61): n=a or c
taacaaccctttctttacatcttagttcacagaatcagccatgatagaatggaagtcatgnacttaccctctgtgctggaatgggactagtcatctttttttcagcattcaaatctatgaa

SEQ ID NO: 40060 - DNA, 121 bp, Artificial Sequence
  Synthesized
  misc_feature (61): n=t or c
ggttcctggcatctggtggctgtttgatggtgtatattgagtgaacagtcgttctcactcngtgcctcaaactggcaggtacaacaagtatttggtgattatcttaagcagtcagataaag

SEQ ID NO: 40061 - DNA, 121 bp, Artificial Sequence
  Synthesized
  misc_feature (61): n=t or g
tggtttgaaatgccacagatgttacggtgtggtgtttgtatctacaggaccttcactcagnttcctttttgtattaagagatgaagcgatgtgtggaaataagtcagagggaatttctgtt

SEQ ID NO: 40062 - DNA, 121 bp, Artificial Sequence
  Synthesized
  misc_feature (61): n=a or g
agtccccggaatgaatccgtgaacacatttatggaataaatttctgtgtctagattccaanctgtgcaaatgatgaagttacaatttagcagatagatttgggttactgggtctagatgac

SEQ ID NO: 40063 - DNA, 121 bp, Artificial Sequence
  Synthesized
  misc_feature (61): n=t or g
cactggaagacaattcagaggtaactgctttctacatttctattagtacagctttatgctntacatgaacactatatgcagaccttcacatctttacagtgtaagaataggtcccatccaa

SEQ ID NO: 40064 - DNA, 121 bp, Artificial Sequence
  Synthesized
  misc_feature (61): n=a or c
ttcaggtgagcttaagagataagctatggtgttttcttgccctgcaagcattaattctacnctcctctctaaatttgtctccttgttctttcccctcattttcaatccaacttccagtcac

SEQ ID NO: 40065 - DNA, 121 bp, Artificial Sequence
  Synthesized
  misc_feature (61): n=a or g
gccttgaaaacagaatgctctttttcacgggaggattttaggattggttttggggagggangcaaggagcttgttgagaggtaaagggaatatctcattaatgatttactaatgagctgta

SEQ ID NO: 40066 - DNA, 121 bp, Artificial Sequence
  Synthesized
  misc_feature (61): n=t or c
atatcaaaaatactcctgatggactaaggagttacttatgtcagtagtttgaaggttaagntctttgtgctttctatgctagagcctgccatatccataggattgtgaggactgtgtgctt

SEQ ID NO: 40067 - DNA, 121 bp, Artificial Sequence
  Synthesized
  misc_feature (61): n=t or c
gctcattgctgcagatctgagccttggctccttttaattaccaaccagcagctctgggggntcagtctgccctggactccagggtccgataggtgacactgtcccataaagtggcgccacc

SEQ ID NO: 40068 - DNA, 121 bp, Artificial Sequence
  Synthesized
  misc_feature (61): n=a or c
aacctcttataagcctttggggagcctcttgatgcttcagtcccagatgagccaagtttcntcccagattttggcatcccacagattttaccctaagccttgacccaacagctctgcatca

SEQ ID NO: 40069 - DNA, 121 bp, Artificial Sequence
  Synthesized
  misc_feature (61): n=a or g
gtacttgtttgacagaacaactgggtgatttttgtgttctgccttacttttgtgggggacntctgcagtctttctgctagctgtttttattcctgtctgcacagaaagtggcttacaaatc

SEQ ID NO: 40070 - DNA, 121 bp, Artificial Sequence
  Synthesized
  misc_feature (61): n=t or c
gccttcatttcctcagtagcctcctttataagaacagaatctggcctggcagtcctccttnataaaatgtagtaggacctgactgacactacaggagttatcacatttgagttgcagcttg

SEQ ID NO: 40071 - DNA, 121 bp, Artificial Sequence
  Synthesized
  misc_feature (61): n=a or g
tccaattgtgcatctttacccgaggaacattctaggtgttttgtcacatcatgcataagtnattttaaaatttttaactaaagtacctgtcccgtgtatatcccagtttaggttctgtata

SEQ ID NO: 40072 - DNA, 121 bp, Artificial Sequence
  Synthesized
  misc_feature (61): n=a or g
tttctttggtttagtgtacataaaactaagcaaagcatagctgaaggaaatgagtgtgatntttctttagttgtacccatgtgaagaagtagaaaaacaaaacactcaaaattaagctaag

SEQ ID NO: 40073 - DNA, 121 bp, Artificial Sequence
  Synthesized
  misc_feature (61): n=a or c
atcagttttctttgcaacccctgttatctctcctctttctgcattatttcccctttgggantagattttatatcccattacctttatggacagtgtaatcacaatgctactgctgtttgac

SEQ ID NO: 40074 - DNA, 121 bp, Artificial Sequence
  Synthesized
  misc_feature (61): n=t or c
caagttattaagaaagaaaatctccagtgactttttgttataaatattctgtgtggtaaanttagtttttattttactgcagaagtaagcaatccagaacaagatctgagagaataggact

SEQ ID NO: 40075 - DNA, 121 bp, Artificial Sequence
  Synthesized
  misc_feature (61): n=t or c
ttgtcttgccctgtgtaattgtctattgcttaagctctttggtcatgcatatgtagagagntgaagaccttcaggccatgaacaatgggagatgtatttggggataatttccctaagtaaa

SEQ ID NO: 40076 - DNA, 121 bp, Artificial Sequence
  Synthesized
  misc_feature (61): n=a or g
gaggggcgggttgggaaacgcacagggtgagtgttcttgcatgatttgccagaggctgcancctcttgtaaaagggttgttttaagcggttgatgttcatgggggctaacgtatggcagac

SEQ ID NO: 40077 - DNA, 121 bp, Artificial Sequence
  Synthesized
  misc_feature (61): n=t or c
aaggattagggaacagctatttgggtacatattaagaattctgaagagatatgagaagaangtctgcaaggttgtgttttattgggcaactgtttgtttttaggcacctgtagagccctgc

SEQ ID NO: 40078 - DNA, 121 bp, Artificial Sequence
  Synthesized
  misc_feature (61): n=a or g
ctttaaacctaaatgtaggctgagactaaagctgcagaacacgacagtgctcttggtgaangaacgtacaggcagtgcctttactgcctgtgtgagccacttgttagacacgctgtccctc

SEQ ID NO: 40079 - DNA, 121 bp, Artificial Sequence
  Synthesized
  misc_feature (61): n=t or g
aaattgcaagggaaaatgtttgagctaacagtaaggttacaaaaacttgctacaggtgaanaaggatttaatataactgtacacatcatcttctgtctggatcttcaggtgagatgcattc

SEQ ID NO: 40080 - DNA, 121 bp, Artificial Sequence
  Synthesized
  misc_feature (61): n=t or c
tagggcacattggtgcagcagctgtgagctcatcaatgcagtcattacgtgcagctacagngaagggggcaaatttacagccccggggtcaataagtcagaggtaaccccacttcatggga

SEQ ID NO: 40081 - DNA, 121 bp, Artificial Sequence
  Synthesized
  misc_feature (61): n=t or c
tttgtagtattacctactggatggacttttatgtcattcagacgtgtggaagtgctccccntaggttttggcttgtaacttaagttgttggaagaatttgtgcaatgctgttggtatcgca

SEQ ID NO: 40082 - DNA, 121 bp, Artificial Sequence
  Synthesized
  misc_feature (61): n=a or g
caacgttggttctgttcgtttgccatcagtactgtagtcaggatttgcagaatgctgggancacccaggagggcattaacgagaactgcctggaagcaatgagatgatgattctcagaatt

SEQ ID NO: 40083 - DNA, 121 bp, Artificial Sequence
  Synthesized
  misc_feature (61): n=t or c
tccgcgtgccccttgggaccggggaaccgcaccgcaccgcaccatagcgctgccacgatcntcagggaacgacatcgtggagtggctcatccagaagtacggcatctcggaagagggtgag

SEQ ID NO: 40084 - DNA, 121 bp, Artificial Sequence
  Synthesized
  misc_feature (61): n=a or g
tgccactgggtgcccctgctctgtgcttggagacctctgcaaggatgctgggatgcataangggtgcagacatccccagcgcctggacaggatcatgcaccctgcccatgtgagtgccgag

SEQ ID NO: 40085 - DNA, 121 bp, Artificial Sequence
  Synthesized
  misc_feature (61): n=a or t
ctgtgtgcaggacccagcagcctgggtcagctgcagcgatgagtactgggacacgacctgnacatggcagccactctcggtttgaaagggcttctctgtagtcctgagcaggttcagctct

SEQ ID NO: 40086 - DNA, 121 bp, Artificial Sequence
  Synthesized
  misc_feature (61): n=a or g
ttacagacccttcaggtactgaaacccagaggagctcctggaaaggcacacagacttgggntgcacatccttggggtgctgactttagcctcagcaaggactgatcttcggcatttataag

SEQ ID NO: 40087 - DNA, 121 bp, Artificial Sequence
  Synthesized
  misc_feature (61): n=a or g
ggtcttgtgtttattccagtatttctaaccttttttggatactttggcaaatcactccccnttactgaaactaaaatactaggtcttagatcttttagcaaatctggaattcaatatgtta

SEQ ID NO: 40088 - DNA, 121 bp, Artificial Sequence
  Synthesized
  misc_feature (61): n=a or g
agcattgaagtgggaagcttgggaatagaggaaatggagtggtgggcctggtagtaagtgnggctgtgttggtgtgcagggagctcctgggtgggctgagcaagccctgaggagtacttgg

SEQ ID NO: 40089 - DNA, 121 bp, Artificial Sequence
  Synthesized
  misc_feature (61): n=t or c
aggttagcctttggcttttggtgggctcagctaatcctgtgagcaggtttcagccacgcangatcccacgccagcagtgaccactgaaatctcactgttcaactttattggctgaattatc

SEQ ID NO: 40090 - DNA, 121 bp, Artificial Sequence
  Synthesized
  misc_feature (61): n=a or g
cgcattttgttggctatagctcacatccgagtggactgctccatgtctttaggacaaaacntgtttaaataaaaacattctccaatacgttcactctacttcccaactcaaaaattgggaa

SEQ ID NO: 40091 - DNA, 121 bp, Artificial Sequence
  Synthesized
  misc_feature (61): n=t or c
attaaaccatggaaacttaggctgagagtatcagttggggggaccttctgttcatcatcangccctctttaattcacttctgtcttgagataggcagtgaagtgctgttagcactgcttgt

SEQ ID NO: 40092 - DNA, 121 bp, Artificial Sequence
  Synthesized
  misc_feature (61): n=t or c
accgctgggactgctgtgggtcaccctgccgtacgtcctccgctattttccccgtcttcanatacatccgaagagcggaaaatccgacttactcggacatcaccctccccccgccgccatc

SEQ ID NO: 40093 - DNA, 121 bp, Artificial Sequence
  Synthesized
  misc_feature (61): n=t or c
cggtgcttatatgtcaaagtaattattttaccttccaataacttttataaaacaggatcangtttttaaaacatcactctccgtgcacttcaaaacctgaacattttttggatgtctaaac

SEQ ID NO: 40094 - DNA, 121 bp, Artificial Sequence
  Synthesized
  misc_feature (61): n=a or g
aagattttttaatcactctgacaggatttcaacatcatagtacactaccaaactgaaaagncaaaagacttgagactaaaatgattaaatatgaaaattcctgtcagtttcagaattagta

SEQ ID NO: 40095 - DNA, 121 bp, Artificial Sequence
  Synthesized
  misc_feature (61): n=a or g
gaattatgggctattttattattacaatctatcacattgctcttcagcctgcactaatacnatgccattgtggaaatacatctgaagacgactaagcttcaagagaaaggccttgagctag

SEQ ID NO: 40096 - DNA, 121 bp, Artificial Sequence
  Synthesized
  misc_feature (61): n=t or c
atactgttagatggctgctagaattagacaattcagaataatggtacattgaatcaaaagnctgtgtttgggtgtttgttattttttgtttgtttgtttgcaaatctttcagtgcaggctt

SEQ ID NO: 40097 - DNA, 121 bp, Artificial Sequence
  Synthesized
  misc_feature (61): n=a or t
ttggaagagaagaatttcggggattacggctgggacctgagtccctccacagtccagcaanataatattgcctttgaaacacctcaggcctcccactgacatgtcagcagtcatactacaa

SEQ ID NO: 40098 - DNA, 121 bp, Artificial Sequence
  Synthesized
  misc_feature (61): n=a or c
ttcagaacagaacagaaacagtgtgaaactgcttaaaagttgagttttcagaatagcagcngaatacagtgtgacgcctcagttactctgcgctaccagggaagcagcagcaaggaacgtg

SEQ ID NO: 40099 - DNA, 121 bp, Artificial Sequence
  Synthesized
  misc_feature (61): n=a or g
caacagtgctctcagaagagcaaatccctttcacaaacaaagccctggcactcgaggaacntttatttgtttccaagcttggacacaactcagagaatagttatgaatgcaacgaaaatga

SEQ ID NO: 40100 - DNA, 121 bp, Artificial Sequence
  Synthesized
  misc_feature (61): n=c or g
ggtgccaacctctttgcaacaacaaagtttcagttggatcaataatacataggatttctanttcatttaaatgtattgttatttttatcaattggtctttgagaaaaatcagtgcttgaga

SEQ ID NO: 40101 - DNA, 121 bp, Artificial Sequence
  Synthesized
  misc_feature (61): n=c or g
tatctgaattttaataaagcctttgacattatctcccactgtatttggctggagaaaccgnctatttgtggcttggaaaagtatgcagttcactgggcaaagaagaactgactaggcggcc

SEQ ID NO: 40102 - DNA, 121 bp, Artificial Sequence
  Synthesized
  misc_feature (61): n=t or c
ctttaagcaccctccagtaatgctgtgccatgtgtgcactttgaagttggccctcatgtangtgactaccaggtgtcgggaaattacaattaggtcagcaagagcctcttatgcgtgctgt

SEQ ID NO: 40103 - DNA, 121 bp, Artificial Sequence
  Synthesized
  misc_feature (61): n=c or g
tctgttgtaatgcagtgcagaagttcctagtgggcagtcatgaaggagaaactagaagcantccctgagcacgtgccctgcttcaatttcaggcacctgatacacaccactggatactgtt

SEQ ID NO: 40104 - DNA, 121 bp, Artificial Sequence
  Synthesized
  misc_feature (61): n=t or g
ccatgcggatatcgcgacacctggaatgtttaaagccttctgcaaagcacatgggtgacgngaaggcttcagacacacattattttcctactcttttcatgattaaagtaaaatgctagaa

SEQ ID NO: 40105 - DNA, 121 bp, Artificial Sequence
  Synthesized
  misc_feature (61): n=t or c
acatttaagaacttggactactagattaccaaggagaaaaacaaaagactcttaaagcganagccttaaatagatcttgaagtgcttagctaaaagtaccttttaaatatccaccttcatg

SEQ ID NO: 40106 - DNA, 121 bp, Artificial Sequence
  Synthesized
  misc_feature (61): n=t or c
ggaagggtagtccagtccacatgttaacagagaatacaaccatgttgtgcacactgttaancagtttgcatttacctgttcattcattcatgcacaggcagcactacagtttaagcttaga

SEQ ID NO: 40107 - DNA, 121 bp, Artificial Sequence
  Synthesized
  misc_feature (61): n=t or g
tttcatctacaaaatatacagagaatgacaaatcacacattaagttcctcataattcttgncttaaatattacttttcagctctctagggtgataggaaataagaatgtatcattgatcaa

SEQ ID NO: 40108 - DNA, 121 bp, Artificial Sequence
  Synthesized
  misc_feature (61): n=a or g
cagcagcaacacgcaagtgggtattggtagctggctgggatttcattgagcacagatgganttgaggcaggcaaagcctgatgcaaagtgtttccagtccttgtttcccttggggtccaca

SEQ ID NO: 40109 - DNA, 121 bp, Artificial Sequence
  Synthesized
  misc_feature (61): n=a or g
aatgagacagacttggttatttggtgagagctgggctatgaaagttgaatctccaccagcntggctgtcagcaaagctggagctgcacatcagctgggtgaaatggtctaaggtcatttta

SEQ ID NO: 40110 - DNA, 121 bp, Artificial Sequence
  Synthesized
  misc_feature (61): n=a or g
acagaaagagagcacctgctcatctgaagtgttcacttcaaagggcagacctccttgaaantattggctcataagcatcagtgcaggtaaaaactgctgaaattagttgatttcagaaatt

SEQ ID NO: 40111 - DNA, 121 bp, Artificial Sequence
  Synthesized
  misc_feature (61): n=t or c
acaccaacacctcagccaagcaccacttcaaacctttgcatcctgccacctgaaattcccntcccaggatttgggatctgctttcccatgtctcaccccacctaacgcacctgcagcgttc

SEQ ID NO: 40112 - DNA, 121 bp, Artificial Sequence
  Synthesized
  misc_feature (61): n=t or c
accacccttcctccctcctaaactccaaaaccacggagcttcttggaagctgatgagagtncactcagcataaacactcaccttgtcactcagattccaagccatccaccaggacgtgaca

SEQ ID NO: 40113 - DNA, 121 bp, Artificial Sequence
  Synthesized
  misc_feature (61): n=t or c
gacctagtcattactttcccagaagtagtttccaccagatcagtcttcctacctctttaantgtttgagtggatgactctgaagtgcctccagctcattctgataattaggtgtttccacc

SEQ ID NO: 40114 - DNA, 121 bp, Artificial Sequence
  Synthesized
  misc_feature (61): n=t or c
cgacttttgtgcagcagcctgtggaaggtgtattttccttaatgcatgcatcttgttttanttggacgttgaaggagctgaactttttctgacttggttactcctgtatatgtatcacact

SEQ ID NO: 40115 - DNA, 121 bp, Artificial Sequence
  Synthesized
  misc_feature (61): n=t or c
agcagcctgttaccacttgccttgatatataatctcacactaaacattattttttgttaangcttcttgatgtggaatagcaggggtggaaaggttttcttattatgacagaggcaagttt

SEQ ID NO: 40116 - DNA, 121 bp, Artificial Sequence
  Synthesized
  misc_feature (61): n=a or g
tctgatggaaccaatttgggtaggaaatgcctttgctcctgcataaaaagactgcctgggnaatcctttcccccaaattctgtctctgtgtgcgtggtagggaagctgtgctcatcttagg

SEQ ID NO: 40117 - DNA, 121 bp, Artificial Sequence
  Synthesized
  misc_feature (61): n=a or t
cagttttgcagacattcaaaactacgctttgagatgcaatgttcattattagacccaaagngcagcattctaagttcacactgaaatgtgccattgggcaacaagagccagtcaacagata

SEQ ID NO: 40118 - DNA, 121 bp, Artificial Sequence
  Synthesized
  misc_feature (61): n=a or g
caaaatctgtaccaatggaggtgacctgctgtttccactgctgaaacgtaccactcactgncatccactgtttgatctttgtgaatattcggtgagtgttggtgaatgtctgtgggtgcca

SEQ ID NO: 40119 - DNA, 121 bp, Artificial Sequence
  Synthesized
  misc_feature (61): n=t or c
ggataaaacttgatattagcatgtatttatttctcaccctcctcttcccacaagcacgtcngccgcgctcccgcagacaaaccagcatgcagagctgtgctctggaggaacagctgcacta

SEQ ID NO: 40120 - DNA, 121 bp, Artificial Sequence
  Synthesized
  misc_feature (61): n=t or c
atgccaccagacgttcctgtgtaggtgggattttcctatatgtgactggttggtctggtcnttgccaaattgtgcctttgtgtgcagtgcgctccttctgatgtatagcagctttacatgc

SEQ ID NO: 40121 - DNA, 121 bp, Artificial Sequence
  Synthesized
  misc_feature (61): n=a or g
cttcttattttaactgctcataatagctatttcatgcatgattttcagctattgcagttancttatttggtgccactgctttgcagctgctattttgtgtaatacttaatcatttatttgc

SEQ ID NO: 40122 - DNA, 121 bp, Artificial Sequence
  Synthesized
  misc_feature (61): n=t or c
ttctgcttacatgcaggtaaggtttcaaactccatgacaaaatttatatttgcagatatantgtaagctaacactaaccaggcagataacctttgtgccatatgaaaagcttggattgttc

SEQ ID NO: 40123 - DNA, 121 bp, Artificial Sequence
  Synthesized
  misc_feature (61): n=t or c
cctactaacacacaaaatgttctagtggattattcaaatttcttttcacaatcagcaccgntgatgaggaatcatttgttaaccaatgtggattagtgttccaactatgaattaaggtgca

SEQ ID NO: 40124 - DNA, 121 bp, Artificial Sequence
  Synthesized
  misc_feature (61): n=a or g
ttcctgaatggaccagttacctcagaccagaatgctgacagccttctgtaccacaaacacnttgctgatttattgccaacatgttcatgaagattctcacagtcttgcccatcaaaatgtt

SEQ ID NO: 40125 - DNA, 121 bp, Artificial Sequence
  Synthesized
  misc_feature (61): n=t or c
caaccaggcagttctattagaaacaaaacacaaacattttcactcctagaaaaactcactncgaacaactctgccaactcttctcaccaaacagcagatgaacacagaagggatcattgca

SEQ ID NO: 40126 - DNA, 121 bp, Artificial Sequence
  Synthesized
  misc_feature (61): n=a or g
caacaaaaaaaataatgggccagaagtagcatcctactttctttctctagtttttttctcnatgataaaagcaaagatattcagagacaagaagctaacagataatgagctgtctgccggt

SEQ ID NO: 40127 - DNA, 121 bp, Artificial Sequence
  Synthesized
  misc_feature (61): n=a or g
atgtgctaatgcaatagggcaaagcgtggtgggtttctgctcaaagatattcatcagaccncaagaactggagaagtgtggctccgcagaaggaatttctgactttctgtgggtgaaagtg

SEQ ID NO: 40128 - DNA, 121 bp, Artificial Sequence
  Synthesized
  misc_feature (61): n=t or c
tgggaaaggggaagactgagaaaagggttagccaattataagtcagagtctgaccaactgngggttgctgcaagttatttacctatgggctggacatccaacttctcatctactagttgct

SEQ ID NO: 40129 - DNA, 121 bp, Artificial Sequence
  Synthesized
  misc_feature (61): n=a or g
agaggaacctgaaagcaaaacactgaaaacgcagttgtactacacaaagagctcatttaantgagactggattcactaagctacagagacaattaatgtgttttaggctctgtaaaataat

SEQ ID NO: 40130 - DNA, 121 bp, Artificial Sequence
  Synthesized
  misc_feature (61): n=a or g
ttgggttcagacactattggttgattatctaaagtttagtcatgcagagttcataatcaanatgatgtccttcatgttaggtgattgtgacttacttcctgctttaataaatcctacaaat

SEQ ID NO: 40131 - DNA, 121 bp, Artificial Sequence
  Synthesized
  misc_feature (61): n=t or c
ccgctgcgcgggacggccgggggttttaatacggtggtggcgatgatggtgatgatgcgtngttactgctcggaaacggggctggggcaaaacccgttccgagctcctcgtggagatggga

SEQ ID NO: 40132 - DNA, 121 bp, Artificial Sequence
  Synthesized
  misc_feature (61): n=t or c
gggcagtagccaaatgagagctccattgtactgcttgcaacgtttgttttgttcattgggngtaagtctcaacattttaccttagcttgctgtagtaaaaaaatcggctccatttgtagaa

SEQ ID NO: 40133 - DNA, 121 bp, Artificial Sequence
  Synthesized
  misc_feature (61): n=t or c
attctactgtcttgctgaaattcagcatgtatttaagaaatataggtagacatttaggtangagaaaaatcgaaatctgtatttcttttttcatacaaaaaaatgcatatcttcaatgtca

SEQ ID NO: 40134 - DNA, 121 bp, Artificial Sequence
  Synthesized
  misc_feature (61): n=t or c
aaaactccaatatcaagattaaatgctggcctttggaatggacgtctccctgtcgcctttnacaaagctgatctttggagaaggacaaaaccattttcaaactaacttcgtggtttaagat

SEQ ID NO: 40135 - DNA, 121 bp, Artificial Sequence
  Synthesized
  misc_feature (61): n=t or g
tgcacaggcacagctttaggattttgggtgtgatgtgaccccactgagtgtctctggctgnggacaaggtgctgtcctccatctgtgatggccccattgctggttgggcatcagcagcttc

SEQ ID NO: 40136 - DNA, 121 bp, Artificial Sequence
  Synthesized
  misc_feature (61): n=t or c
aaagctcagtaataactcctcttcatctcatctcctttctcctcacaactttttcagcagngatgttccaaatggatcggccttgacacaagaaaacatcagcctcctgtcaaacaaggca

SEQ ID NO: 40137 - DNA, 121 bp, Artificial Sequence
  Synthesized
  misc_feature (61): n=t or c
ccgtgaacttttcaaatcttctttacaagagcagccacgctcaatttgttctctgaaaaangagacaaaatacccttctttttattggcaaatctcagtggtgacaaccagatgtgttgga

SEQ ID NO: 40138 - DNA, 121 bp, Artificial Sequence
  Synthesized
  misc_feature (61): n=t or c
ataagcccttgtgacaaagcaaaagccatgcataaaagggaactgataatgcttttaattntatgaggccccacagttctttggagtctgggaataaaccaaggtttgaggggaacggcag

SEQ ID NO: 40139 - DNA, 121 bp, Artificial Sequence
  Synthesized
  misc_feature (61): n=a or g
tccatcctgatctgcatctcatgtttgggtcacaactgtccttgcatgtctgtcagctgcncagatctgcctcccattgcctttgcagctcccccggtgggagctgagcttccatggaagt

SEQ ID NO: 40140 - DNA, 121 bp, Artificial Sequence
  Synthesized
  misc_feature (61): n=a or c
ttccagtacttcactatactcagagtgaaaattcttgtattttttccaaacgttcaacttnaatctgttgaacctcaacatgtggccattgcttcttgcttatcagcagactcacctgagg

SEQ ID NO: 40141 - DNA, 121 bp, Artificial Sequence
  Synthesized
  misc_feature (61): n=a or g
gctgtgattttcagatctccccttgaatctgcataaaactgctgtcataacatgtgtggtnaggatatcccatgtccattgcctcctacacgaagaagccccttctaccgctcgctttgag

SEQ ID NO: 40142 - DNA, 121 bp, Artificial Sequence
  Synthesized
  misc_feature (61): n=a or g
gcaagtctggaaaagacacaatataaaaggcaaacgacaccaaatgtagaaagaggaactngaaggccttcctctgtgacagcattggtccccagcccaggagttggccatgaaaaattgt

SEQ ID NO: 40143 - DNA, 121 bp, Artificial Sequence
  Synthesized
  misc_feature (61): n=a or g
accagaccagaacgatgcaggtgagggcaatagatggagtagtgggaggataaaggcctgngcctaacgaagggcccacctttcagctgtctcacagagacgggagattttaaagagcaga

SEQ ID NO: 40144 - DNA, 121 bp, Artificial Sequence
  Synthesized
  misc_feature (61): n=t or c
taggacctaacttttcagccctctttcaaactgcagttctacagtgaagtatttcagcctnacttgcagtgcacagggagaggaaagtacctgaaggaggatccacaaaaataaacatttt

SEQ ID NO: 40145 - DNA, 121 bp, Artificial Sequence
  Synthesized
  misc_feature (61): n=t or c
ttcttcacttaaaaataggactcactcatcttgtaatatcaaatactctgtttccaaaggnttgcaattctgtttgcgtagtcaaagcagtttatcattcaattagggactgatataaatc

SEQ ID NO: 40146 - DNA, 121 bp, Artificial Sequence
  Synthesized
  misc_feature (61): n=t or c
cagagaaagactgtatttatatttaactcgaaagcgaagcatccgaagactccaaacgctntggagctttttaaagagcttaacttctgtgttgcctgcacagaactttccccaactcaca

SEQ ID NO: 40147 - DNA, 121 bp, Artificial Sequence
  Synthesized
  misc_feature (61): n=t or c
attctggaacggcatttaggctggttgtttgttttcatgaaagttctgctttcaagaacantcaaacacccgctaatgaggaaagaggtgctcagaggtaggctacaaaattccgtagtat

SEQ ID NO: 40148 - DNA, 121 bp, Artificial Sequence
  Synthesized
  misc_feature (61): n=t or c
gatccaccacttcctgtggtaaaatgatgttttcaaaaacatctcactgcagactttgcangtcacacatcctaaattctgttacctgcagcagtattttcacaaggggaaaaaaaaggca

SEQ ID NO: 40149 - DNA, 121 bp, Artificial Sequence
  Synthesized
  misc_feature (61): n=t or g
ctttattgggtgaaatattacttactggtaacatttgtgtgagacaatgggattttttccntgtgagtgctgtaggcagctaatagcaaattcttttgagtagtatgtaattgttaacccc

SEQ ID NO: 40150 - DNA, 121 bp, Artificial Sequence
  Synthesized
  misc_feature (61): n=t or c
tacactgcttttaagatcacagcagtcagcagaagtggcttgaacacttaacttcagccangtagagcatagttgtatctgatcttacggaacagattgtttcacatgatatatgtgtgag

SEQ ID NO: 40151 - DNA, 121 bp, Artificial Sequence
  Synthesized
  misc_feature (61): n=a or g
cttccgatcttttgattccactacagatggttcagtagaaggccctataatgacaaaatgnaagtgcacaggaaccgttttccctcaaaaaaaatgactacctattaaacacaaataattc

SEQ ID NO: 40152 - DNA, 121 bp, Artificial Sequence
  Synthesized
  misc_feature (61): n=a or g
gtgtgtggaacactatcaaatttgacattgctgcaggccccttaacagagcagaacatcancaagaaaatgattgtgcatggtatgtgaattgaatatattcctgcaggcttagttatgaa

SEQ ID NO: 40153 - DNA, 121 bp, Artificial Sequence
  Synthesized
  misc_feature (61): n=a or g
catcttacagagtaagatgcctgatcacacagataaacatcatctgttgggaagaagtcancatggcttccataaaagaaaaggccatttgaagagcttactgaagttctatgaagggagt

SEQ ID NO: 40154 - DNA, 121 bp, Artificial Sequence
  Synthesized
  misc_feature (61): n=t or c
acattaaataataatatatgcaagaagataatgtatatctcaaaatacagaatggatagtngtatagagggttaagaagaaaaagctaggatagttctccatatgaatctctgtacaagcg

SEQ ID NO: 40155 - DNA, 121 bp, Artificial Sequence
  Synthesized
  misc_feature (61): n=a or c
gttcctagttcacacactgttagtttcagtccttcacagaacattctttactggtgctaantctactttcctctacatgctgtttcctctcctctttcaaattctagaaatacgcactagg

SEQ ID NO: 40156 - DNA, 121 bp, Artificial Sequence
  Synthesized
  misc_feature (61): n=a or g
tcagaagtcccttgaaacaaataaaacctgtgacagaaaagacaatctttttgcaaaacantatggtctcatctgccaagtgattcttgagctagtgagaaacgtgccatctttgatctcc

SEQ ID NO: 40157 - DNA, 121 bp, Artificial Sequence
  Synthesized
  misc_feature (61): n=a or t
acccataaggataagggcagtgtatctagagatatctcttccttgtacatcttgttaatcnctgccctttatctctagtcttctcaaaatatgttatcagagcagacttctctctcaagaa

SEQ ID NO: 40158 - DNA, 121 bp, Artificial Sequence
  Synthesized
  misc_feature (61): n=a or g
aagatgatgtatcatttggtcctggcagggttgtcttcccagcagggcttttcattctgcnttttctcacagcgctgtcactaagcatgaaggttcttgacgagtttgtgattccacgttt

SEQ ID NO: 40159 - DNA, 121 bp, Artificial Sequence
  Synthesized
  misc_feature (61): n=a or g
gggggtatgtctggggacttgggagggggtatttacaaaggaaagggatgttggtgatctntgccttgaaaagaggttaaatgggagtgaggcacctcgtattcaaactccctgagatgct

SEQ ID NO: 40160 - DNA, 121 bp, Artificial Sequence
  Synthesized
  misc_feature (61): n=a or g
gggtgtagttgtacctgaactgcaaggtctcagagcagcctgtcatatccttcccgtggtntatttatgggtaaagccgagctgctttttgcttctcctaaggctggaattaggctataaa

SEQ ID NO: 40161 - DNA, 121 bp, Artificial Sequence
  Synthesized
  misc_feature (61): n=t or c
tctatgaggtgatttctggagctgtgcaggatcgtgctgcattgaggaggtacccagcaanatttctggcaagaacaaacactgcaggacttaccaaagcattccagtatttgtagagaaa

SEQ ID NO: 40162 - DNA, 121 bp, Artificial Sequence
  Synthesized
  misc_feature (61): n=t or c
tcaaaataataaacacaaccactgcaactttgaaaagcaattgcaggcaggaagcttcatntatagaaattctctaagtgaattagttacagatttaaacatagtagtagaatacaaaaaa

SEQ ID NO: 40163 - DNA, 121 bp, Artificial Sequence
  Synthesized
  misc_feature (61): n=a or t
ctaggatttcacagaacaggttcttcttcaaatcagttatataaaattttgcttttcattncatctggattttgtatccatgcatttcaacaccaagagtcttttgtccagttcacttctt

SEQ ID NO: 40164 - DNA, 121 bp, Artificial Sequence
  Synthesized
  misc_feature (61): n=a or t
ccagcaagtaccagcttcatcacactgtctggctttgaagataccactgtcctcgcattcnggattgtaaatgccaccatccagcagcttaacccaaggtctgtaggagagcttcacagca

SEQ ID NO: 40165 - DNA, 121 bp, Artificial Sequence
  Synthesized
  misc_feature (61): n=a or g
tgtgagtgttctaatggttgacaggaatcccacgctgtgttttcagaatgttttttagaancactcatgcacagtgctcctggtttggtcccatctctgctccagcagagccacccagagc

SEQ ID NO: 40166 - DNA, 121 bp, Artificial Sequence
  Synthesized
  misc_feature (61): n=a or g
aggattctttgttatatttttaagtgccagggcgtgaaactgtaaatccctccttcctacnctcctgtctcctgcaaaccgctctccaagccaaccagatagaggattggccataactgga

SEQ ID NO: 40167 - DNA, 121 bp, Artificial Sequence
  Synthesized
  misc_feature (61): n=a or g
acatgctgccctgtcaaagcagagccaacggagtgagcagcgtgaggggaaactaatcccntgtttatattgaatcatcttgcatagctgtctttgagagggactaagagagaagtgaagg

SEQ ID NO: 40168 - DNA, 121 bp, Artificial Sequence
  Synthesized
  misc_feature (61): n=t or c
cagtgtttgaacattgtggcattccaaaaaagaagtttgacatactatttgggcacccaangtccacacaatgtaggatgctcttgccattagagagctgcagatggagcatgcagcacat

SEQ ID NO: 40169 - DNA, 121 bp, Artificial Sequence
  Synthesized
  misc_feature (61): n=t or c
cccttcactctccttctctgcttttggaaatgtagatgcagattttaatgcaaatgaaccnttcagtggctctagggccaattcaatgcaagtgaagcacttggattatcggatgtggaaa

SEQ ID NO: 40170 - DNA, 121 bp, Artificial Sequence
  Synthesized
  misc_feature (61): n=t or g
gtattccccatcatcacccatcatcactttttacaaatccagcagttcagacatcattctncagacatcattgtctcagattttcagttccatgatttttgggcagctggcaggaaaaggc

SEQ ID NO: 40171 - DNA, 121 bp, Artificial Sequence
  Synthesized
  misc_feature (61): n=t or c
gtgttcttttatctttgacatgtaagagaattttaggaatgggaaagtcctgacccttttntcaccacttcctctcttaccacaaaaagcgaaagaatctcactgaggcatatttaggcca

SEQ ID NO: 40172 - DNA, 121 bp, Artificial Sequence
  Synthesized
  misc_feature (61): n=a or g
acaagacacgatcacttgaaaataccacatcacaatcacaaaataaatcactagtacaatnaacaatgaaacatttcatgcacaggaccgcaactaaaatttggagcacggtaactataaa

SEQ ID NO: 40173 - DNA, 121 bp, Artificial Sequence
  Synthesized
  misc_feature (61): n=a or g
ttcagacagtatgaagcttggaatctaacacctcagctgatcagtcacaggttttatcccngatagccttggaatggatgtacaaaacattctgagaaagtaactagtgaccttgagcttt

SEQ ID NO: 40174 - DNA, 121 bp, Artificial Sequence
  Synthesized
  misc_feature (61): n=a or g
atatgtacacacctgctgctatgctctacgtctgtttagggaagacaaacctgtagctgtnggagacatgccagcagcttcgggtaggtaaagaatcagctggagaaagcattcacgaagc

SEQ ID NO: 40175 - DNA, 121 bp, Artificial Sequence
  Synthesized
  misc_feature (61): n=t or c
attcagtgagcaaagcatgttcagtgaaaaacgtacccgtaacgatggatttatgaacccncaaaaaatcttaatcagtgttcttgcaagactgtgtggagtaccttgaactggtaaatct

SEQ ID NO: 40176 - DNA, 121 bp, Artificial Sequence
  Synthesized
  misc_feature (61): n=a or g
gggtgtttggtgctgtgtttgctttggtggagagcttcctcctgtgtggtttccactgccncttccatagcacctgtccccggctgtgacctttccaagtgacttttatagcacaacttgt

SEQ ID NO: 40177 - DNA, 121 bp, Artificial Sequence
  Synthesized
  misc_feature (61): n=a or g
acatgtggcttggcttggggactcccaggttatgcttgtgaggaaaggccaagctgtgganctgatgaaaccccacaaaccagatcgagaggtgagaacggcctgttttaaatctacctgg

SEQ ID NO: 40178 - DNA, 121 bp, Artificial Sequence
  Synthesized
  misc_feature (61): n=a or g
tattattctgtggagcaagcttagtagtggatttgtaatgcttagaggcaaacttcacctntacagttgtctcgccgtgcttggtttcttctttgtcagtgcaccaccagctgaccacaga

SEQ ID NO: 40179 - DNA, 121 bp, Artificial Sequence
  Synthesized
  misc_feature (61): n=a or g
accactcaaaataaacaaactggggagagagcacagaaacctttgctgatctttctctganaggtgtgaagttatacttacaggaatacagaaaataaaatatttcccattacaaatgcat

SEQ ID NO: 40180 - DNA, 121 bp, Artificial Sequence
  Synthesized
  misc_feature (61): n=t or c
agagatggttggagagcacagattgatagggcagctgtggccaagccaagagcctgtgtgntcctaccaaccaggagggtagggatgcttcagtaaatccatctcctgctacttagctcta

SEQ ID NO: 40181 - DNA, 121 bp, Artificial Sequence
  Synthesized
  misc_feature (61): n=a or g
gcacacacaggatgaccatccacttctggcaccaacaaatcacagtcatgagttctttccncagagaaatgtttttgtgcaaagagaagagctcagaatgttcccagaaagcaaacaaaga

SEQ ID NO: 40182 - DNA, 121 bp, Artificial Sequence
  Synthesized
  misc_feature (61): n=a or g
acattactggaactcccaacagaacccaccagtacctctttgtgtcccttctgaaacatanagagacaacaaaagtcagtccctgaatgcctgatcattttaacaaagccattcacagcag

SEQ ID NO: 40183 - DNA, 121 bp, Artificial Sequence
  Synthesized
  misc_feature (61): n=a or c
aggaggctttggaggtgtgtgaccagcagaaggtggcctttatttttgaggataaagaccnggttcctgggtaaagcactgcctgatgtgggctgtgcagcacctgatgttcagatccgct

SEQ ID NO: 40184 - DNA, 121 bp, Artificial Sequence
  Synthesized
  misc_feature (61): n=a or g
tctcctactttatttatgggtcagacataatcggaaccaaaacagctttcagtttttgttntgctcttattcgagaatcaagggtcattctaaaagatcctctttagagtaacttacttat

SEQ ID NO: 40185 - DNA, 121 bp, Artificial Sequence
  Synthesized
  misc_feature (61): n=a or g
ttttgtttcaatgtcaccacctccccgttttgactgatggcgagtgagttttgttaaaacncaaggggtgatagcgtatgctccagtgaactttccctcctctcagcaccagagacaaaaa

SEQ ID NO: 40186 - DNA, 121 bp, Artificial Sequence
  Synthesized
  misc_feature (61): n=t or c
agagtgtgtagacagtaactataaattttataaattgagctactgttaatccccaaataantttcatttccatcgtttgacattagatacaatggtcgatctggttattcaggatcaaagc

SEQ ID NO: 40187 - DNA, 121 bp, Artificial Sequence
  Synthesized
  misc_feature (61): n=t or c
aagcgggagttaattggggctggaagagagcaagggagagtgaacagggaactttaatctngttaaattcaccttgagaggctgtacctggctcccagcggtgtggccaagaggagcctct

SEQ ID NO: 40188 - DNA, 121 bp, Artificial Sequence
  Synthesized
  misc_feature (61): n=t or c
actttgtttaatatcatcatagtaactatggtgctactcagcttttgtgtcataatgcaantgtaaaaatattcaaccaggaaatgatatattttgttattcaactttaatggaattgact

SEQ ID NO: 40189 - DNA, 121 bp, Artificial Sequence
  Synthesized
  misc_feature (61): n=t or c
ccactcatggacaacctatgttggaataaaagggtccttattctactatatctacttttcnttccattaatttcccatttcagtaggagaagctgtgattcactcataactgcagccctgg

SEQ ID NO: 40190 - DNA, 121 bp, Artificial Sequence
  Synthesized
  misc_feature (61): n=t or c
ggtctttcttttgaggggtcatgtttactctttacaagtctggttcttcaagtatgcaaantatttctttagatactgttaagaatcacataaatataaatatattttaaaaatataattt

SEQ ID NO: 40191 - DNA, 121 bp, Artificial Sequence
  Synthesized
  misc_feature (61): n=t or c
aacagcgtatttcgggctatgccgtacagcccaacaaacgcaccgaactctcccgcgcacngctacgcattactttccggcagtattttgttgtcggctgtcctaagcacagcgaggctgg

SEQ ID NO: 40192 - DNA, 121 bp, Artificial Sequence
  Synthesized
  misc_feature (61): n=t or c
ctgctctgaaacaccacaggtaccaagcctaaaccactcagaaacatgggctgcagcctcngtgcaagcccacaataggttaattggactccaagcattcacctggaaactgctggtcaac

SEQ ID NO: 40193 - DNA, 121 bp, Artificial Sequence
  Synthesized
  misc_feature (61): n=a or g
aatcccgcagttcagaccccctcatgaagagccatccattgctccaggacatctaccagcntggcaggcggctgctcatcctccatccacaaaccaaccctcatctcctcctgctgaggca

SEQ ID NO: 40194 - DNA, 121 bp, Artificial Sequence
  Synthesized
  misc_feature (61): n=c or g
tgctgcaaatgtccagcagcatgagaaggaggacatatggaagcacctgtcttttgatgcntgcaaatttattgcagagacgaagcaaaagctaagaatgtcacagaagtgctcatgtagg

SEQ ID NO: 40195 - DNA, 121 bp, Artificial Sequence
  Synthesized
  misc_feature (61): n=t or c
gtctcaggagcatggttagattttccttcctttctcctttgattgcagcatttcacacttngataagtatgaaatttgataacacatttataagtgttaagtaataataattgtttaacgg

SEQ ID NO: 40196 - DNA, 121 bp, Artificial Sequence
  Synthesized
  misc_feature (61): n=a or g
acacactcctggatatgcaccaaccctgacctggctcagccatgtggagggggaacgtacnagaaggaacttttcccattgctttcttataaggcagagtcaaagaatctcttcttaaaag

SEQ ID NO: 40197 - DNA, 121 bp, Artificial Sequence
  Synthesized
  misc_feature (61): n=c or g
gaagtcaggtaccaagtaagaattttattttccatttgcctttgctggggaagaggagagntgcacagtgagagcaggtcgtgttgtatcctcttccatagcgtgaacacttctctcttct

SEQ ID NO: 40198 - DNA, 121 bp, Artificial Sequence
  Synthesized
  misc_feature (61): n=a or g
caggtcggatgtagaagctcgacctctttctacatcagatctttcatgctctgtagttttntgccttttcctgtaaccatgaaacctgtacaacctcagtgtgttaaggtattagatcaaa

SEQ ID NO: 40199 - DNA, 121 bp, Artificial Sequence
  Synthesized
  misc_feature (61): n=t or c
tcttcgggttctctttctagcataatgaaataacttcaaaaataatcatatattattgtanccttgcgcccagtatataagaataagctgccatgagttttcctctattgtcttacttcgt

SEQ ID NO: 40200 - DNA, 121 bp, Artificial Sequence
  Synthesized
  misc_feature (61): n=t or c
tgtgcctggacatcttcctcctgctttctcttttttccacccccatctacacctacagcanaaagcccacagtgcagagcccaagggagcactgaatctggcagagtccttattttatata

SEQ ID NO: 40201 - DNA, 121 bp, Artificial Sequence
  Synthesized
  misc_feature (61): n=a or c
agagccaagaaaacatttcttacatcgtatagttttagtaaaaaagagtaggttctggacntgcagtttattttacaacttgctttctgggtgtggcttacacagagaccaccatcccaac

SEQ ID NO: 40202 - DNA, 121 bp, Artificial Sequence
  Synthesized
  misc_feature (61): n=t or c
aaatttatttttatccataccgagttcatgtggtttcccacagaattaaaacaaatgttgnctgaattcaaagaagtaatgatcatctctttccctattacactgcaatatccgagacctt

SEQ ID NO: 40203 - DNA, 121 bp, Artificial Sequence
  Synthesized
  misc_feature (61): n=a or g
tcaaaatggtacaggaacatttcaatttttaatttcagtgagggaagaataaattacagantaactgagactggaagtgtctgtaggtcaactactacaatcaccaaagcagggcaatcaa

SEQ ID NO: 40204 - DNA, 121 bp, Artificial Sequence
  Synthesized
  misc_feature (61): n=a or c
ttgctggtgaatgtatctaagcatacagttttgtagtccttttgatgataccaatataagnagtgtaatattttttcttcccactcattcctttgtctctactcccacacagtagtttaaa

SEQ ID NO: 40205 - DNA, 121 bp, Artificial Sequence
  Synthesized
  misc_feature (61): n=t or c
tatgagaaggaaccagatggaaacaacatgctcaactcaagttggacctgatgatcctcanggatcccttccagtttaggatgctatggggttctaactccccgcacagaggttccatgaa

SEQ ID NO: 40206 - DNA, 121 bp, Artificial Sequence
  Synthesized
  misc_feature (61): n=a or c
acagctcagaaaataatagtgcaattttcctagctaatagaatggtttaacacctgaatanactcactcgcctgattaaacactaacaacataaacccatgaaagaagattataagttgta

SEQ ID NO: 40207 - DNA, 121 bp, Artificial Sequence
  Synthesized
  misc_feature (61): n=a or g
aaaataaaagtatttttgttaatgttctttaattgatgaattacatgaaagtgggggattnccagttctggatatattctgagtcagttcacaatgatgtgtgtaacatctctaatcactc

SEQ ID NO: 40208 - DNA, 121 bp, Artificial Sequence
  Synthesized
  misc_feature (61): n=t or c
gtacctggaagggcagcaggaagaagtttgggtttggcaatgtgtgatgtgtctgtagccngtgccctgcatggggaaaatagtgacacctgagggttctgatagccacgatcctctgtac

SEQ ID NO: 40209 - DNA, 121 bp, Artificial Sequence
  Synthesized
  misc_feature (61): n=a or g
gccaaatccctgcatctgatttgcgtaactttcagacaacctcatcaattatggatgcccnggaagcgagcgcggtgcgcgctgcggccggcacgggccccacaaactcttactccactct

SEQ ID NO: 40210 - DNA, 121 bp, Artificial Sequence
  Synthesized
  misc_feature (61): n=a or g
tggctttgactcagtgctgagcaaacatgagatcttcccttgaccccgtggagtttgcacntttgcatcctccagctggaggatctcgccctgcttgctgtggacaattccttgaacagcg

SEQ ID NO: 40211 - DNA, 121 bp, Artificial Sequence
  Synthesized
  misc_feature (61): n=a or g
tgtttggcattttgcaagtaggacaaaattgtgcttatgtgacctgctggcatctttatcntttttgggatccttcaaccgagtcttgagcctctacctgagaccagatgttgactataga

SEQ ID NO: 40212 - DNA, 121 bp, Artificial Sequence
  Synthesized
  misc_feature (61): n=t or c
gccgggtctgtgctgctcatgctgggggttgggtttgtggctggggaaggaggcagcagtntgctccgtttgcacctgcttcctctttgcctgttctgggctttctttggggtggttttac

SEQ ID NO: 40213 - DNA, 121 bp, Artificial Sequence
  Synthesized
  misc_feature (61): n=a or g
ctattatattgttttatcttttagactatatagctttaatattagatatctgatgctaatnttagatatctcatctggtttaagatatctacctttggaaagaggagttgagctgtaaaag

SEQ ID NO: 40214 - DNA, 121 bp, Artificial Sequence
  Synthesized
  misc_feature (61): n=a or g
gccttcaagtaccacaacagctgtttttcttgctaaaatacaacattaaattttttggacngctggatgcttccttgatgaaaatggaataaggggctcttttcctccttccttctccttc

SEQ ID NO: 40215 - DNA, 121 bp, Artificial Sequence
  Synthesized
  misc_feature (61): n=a or g
ggggtagctaaaggacatataactatataacacaaagaaaaggctgggaaaaattaaactnttctgaagcacttctttagtcttcaaatttcatgtagacttgggcagattattatccttt

SEQ ID NO: 40216 - DNA, 121 bp, Artificial Sequence
  Synthesized
  misc_feature (61): n=a or g
taatttgtgcgtagaagacagtaatcaaaaacatctttatttccctgcaggtcttccatcnttggtttaccaaaagtgaagagagacaagtattctgtatttaatttcttaactctgtcag

SEQ ID NO: 40217 - DNA, 121 bp, Artificial Sequence
  Synthesized
  misc_feature (61): n=t or c
gctccgggatggcagccgtaaatctgggcagctcctgagatgtggaagcttttaatgggcngtaattgaaacgtgccaacccgagcgggagcagatcctacgccagcagccaaagcggctg

SEQ ID NO: 40218 - DNA, 121 bp, Artificial Sequence
  Synthesized
  misc_feature (61): n=c or g
agattctgaaaacagcaatttgtagctcagtaacacttatttagccagtgtcaaaaaacanttatttagccagcgattttgcacttttaatgataatttgagctttcctttcagcactctg

SEQ ID NO: 40219 - DNA, 121 bp, Artificial Sequence
  Synthesized
  misc_feature (61): n=t or c
gtcttgtttagggagatacctgaacactgagtatttctgctcttggtagtcattaagagcnggtcacaaacctcccatcactccccacaccacaaggccatagctccaaaccagaatgttt

SEQ ID NO: 40220 - DNA, 121 bp, Artificial Sequence
  Synthesized
  misc_feature (61): n=t or c
ttaaaattgatttccagcttaagctttgtaaatacactgatccataacaaacttgggtcangttcatgtggatgggaggagggaataatcaagcggggatgtcaagatgaaattgtggggg

SEQ ID NO: 40221 - DNA, 121 bp, Artificial Sequence
  Synthesized
  misc_feature (61): n=a or g
ttcatattgctgtctaactgaaggtctcacatggcagtacttcttagctctctttcaggcnaataaacagaaaattgaaaattcaataaaagtgtaatagagtctcatctgttcaggtgat

SEQ ID NO: 40222 - DNA, 121 bp, Artificial Sequence
  Synthesized
  misc_feature (61): n=a or g
caaagctatcatctttaactagatgaagagaagaaatactcttctgcagcacctctgcctnaaacgatgtttcccagacttggatttgttttaagccacagtgagagtggcttcagctcac

SEQ ID NO: 40223 - DNA, 121 bp, Artificial Sequence
  Synthesized
  misc_feature (61): n=a or c
agggtgtcctttatggagtccctcaaagcagaccaatgaagaaaggcagaaacgacacagngcagtggcagcactgtttagatatcagtcccaactggtgtgtgacaaacaacactaatac

SEQ ID NO: 40224 - DNA, 121 bp, Artificial Sequence
  Synthesized
  misc_feature (61): n=a or g
gctaacgtgatggttgtttcctccaattatgtgtctctgaaatgcttacaagaaaaaaaanaaaaacaaaaactgtgtgggagctccacaatctcagtataaatattgtctgctcacagat

SEQ ID NO: 40225 - DNA, 121 bp, Artificial Sequence
  Synthesized
  misc_feature (61): n=t or c
tgtggttagtaaatatccaattggtatgcatgaaatcaggcccatacctgcaggtaagcangaagagttttccaatattagttaatttctgttaaattggtaacaatgatgtcacctttct

SEQ ID NO: 40226 - DNA, 121 bp, Artificial Sequence
  Synthesized
  misc_feature (61): n=t or c
agtaataaattattttttcttttggacttccatattgcatccaacagctatacgtggatanatacacgtgtattacgttcctgatcacatccgtgcttttggggcaaagcacttattagct

SEQ ID NO: 40227 - DNA, 121 bp, Artificial Sequence
  Synthesized
  misc_feature (61): n=a or g
cccatcctgtctgaacgcacatttacatttgcaaatactaatgcttttgaaacaccttacngtgtgcactaggtatgattttaaatttggatattgcaatattgatggcaacaggctccca

SEQ ID NO: 40228 - DNA, 121 bp, Artificial Sequence
  Synthesized
  misc_feature (61): n=c or g
gaaggacgctgtggttcagcagaatattttgtgattttctgttgtcagccttcgcctctgngtgggactctgcccacagcgggactttgtgtatgccattattgttactgtaaatatttta

SEQ ID NO: 40229 - DNA, 121 bp, Artificial Sequence
  Synthesized
  misc_feature (61): n=t or c
caaggtccttagagaaactgcttcttaagttttgaaagggtgggcaaacaaaaaaaattgngttagttcaagtattttactctgaaggaaaaccaataaacagaaaggcacagatatctac

SEQ ID NO: 40230 - DNA, 121 bp, Artificial Sequence
  Synthesized
  misc_feature (61): n=t or c
gatggggctgacaccacagttgcagggctgtggccatgcactgccctcttacttgtacctnctggaaggccacagctccctctcagcacatctcctgccctagcccagtggcagccgtgca

SEQ ID NO: 40231 - DNA, 121 bp, Artificial Sequence
  Synthesized
  misc_feature (61): n=t or c
gagaagaggaactgctgctgccccaggtgagatgcagggcatggggcatcgcgtgggttgngctgatacggtgccaatgggacgcaaagccactgctgaaactgctgcccaagaggaggcg

SEQ ID NO: 40232 - DNA, 121 bp, Artificial Sequence
  Synthesized
  misc_feature (61): n=t or c
catatcaggtaagactctcagctcctgcagcagggccatttctctatcggtgcacgacttnttaatacagttgaactcttcatctaattacttgttcagtccagtttaaaattttctcagt

SEQ ID NO: 40233 - DNA, 121 bp, Artificial Sequence
  Synthesized
  misc_feature (61): n=a or g
tgatttcctttagaaaagagttggagattttggatgcgtgctgcctgttgggtctgctctnccccttcctgtttggatcaccttgctggattacggggttaagcgagccgttcccagcctg

SEQ ID NO: 40234 - DNA, 121 bp, Artificial Sequence
  Synthesized
  misc_feature (61): n=t or c
aacactaggcatctgatttccagatactcaaaaatttaattatttcaattctgttcgactngatttctattgaaaattaccaggcatatttttctgctaagctgtgtttctttgtcctgac

SEQ ID NO: 40235 - DNA, 121 bp, Artificial Sequence
  Synthesized
  misc_feature (61): n=a or g
gatgatcatgaataggtgattcaaggattcaataattaatataacagatgcataaaatacngactcacaaaaaagatgctccagcacagttcagcaatgattcttgtacgtatgatatttg

SEQ ID NO: 40236 - DNA, 121 bp, Artificial Sequence
  Synthesized
  misc_feature (61): n=t or c
atttcactacagacaactgtcctttcacggatagttgaggttaatggcagaactaaaccangtgcaagttaaatgtacagaacatcgataacccctcttgtagcaggatgaggggacatag

SEQ ID NO: 40237 - DNA, 121 bp, Artificial Sequence
  Synthesized
  misc_feature (61): n=t or c
tctttcatttcatattacatagaaacttaccagtaaggataagtcaacatgtgacaatttnggaaatttgcatagtttctttaggaaattgttaatttttacatgaaaccaaatttaagtt

SEQ ID NO: 40238 - DNA, 121 bp, Artificial Sequence
  Synthesized
  misc_feature (61): n=t or c
gctaggccgtgtgtggcctacagactgttgggtggccatgtctaagctgttattactgctnatgtaaagagaaataaacattggccaactaatggtaaaattcacggttttcatatgttga

SEQ ID NO: 40239 - DNA, 121 bp, Artificial Sequence
  Synthesized
  misc_feature (61): n=a or g
ttttataattgcatacatgttttatattatctgtgggcagaggggcagtatggatagcctntgaagctgtagttgaaaaaacatttattagaaggatattaataaaatctcctgaattgac

SEQ ID NO: 40240 - DNA, 121 bp, Artificial Sequence
  Synthesized
  misc_feature (61): n=a or g
ggatctgcattccctgctgggctatggctggggccctgcattgctgttcattgagaagacnatgcttttctgattgtttggcaccaggtccacgcacgtgtgagctgcgggtgctgcagga

SEQ ID NO: 40241 - DNA, 121 bp, Artificial Sequence
  Synthesized
  misc_feature (61): n=a or g
ggcattcttttaaatctgtattactgctgacattttttccaatcaattataagaataaatntttttaaccacttcctagtctgtgctagtcacttgaaatgggcagaagttgtcctttagt

SEQ ID NO: 40242 - DNA, 121 bp, Artificial Sequence
  Synthesized
  misc_feature (61): n=t or c
ctccttcagagcaggcactttattggtctatgccacttttcacaagagttggcaaatactntccctttctgttctctctggaaactatttccatcagttcttcttttacttatatgtgtca

SEQ ID NO: 40243 - DNA, 121 bp, Artificial Sequence
  Synthesized
  misc_feature (61): n=t or c
cctctttcagaacctctcactagtgaaatcggaagcaattccaaacaaaaaagagacccantggagctttgcagcacctttgaaaggtgagggattgagctagggctcttctgtgcagctt

SEQ ID NO: 40244 - DNA, 121 bp, Artificial Sequence
  Synthesized
  misc_feature (61): n=t or g
aatcttgcatttaattaaagttttcctgcttttaatcagttttccaactaagtctgatcangctgaagtagttagggtagtatcagggtggaatgaatgtttttactgttgtttttttttt

SEQ ID NO: 40245 - DNA, 121 bp, Artificial Sequence
  Synthesized
  misc_feature (61): n=a or c
aatctaagctgccctcaacatccacaaacagaccttgtcctttaagtgaaatatttttgcntttgcagtgttagaagaggacttgcacccagcttagggcatccgcagagccaagcctggt

SEQ ID NO: 40246 - DNA, 121 bp, Artificial Sequence
  Synthesized
  misc_feature (61): n=a or g
ttagcaaggtttggaggtgttttctttcctttgccctgaagatgaacttcatttgtagccnggctgccaaatacatttcattgtaaagaaatttgttttctaaactagacacccccaggga

SEQ ID NO: 40247 - DNA, 121 bp, Artificial Sequence
  Synthesized
  misc_feature (61): n=t or c
gcgaatggactgtagctaggaagagcctactttccagcaaggctctatgcatgtgccacangctgttagaggcctgtgctccctggtatagcaacttattggaaatgctgtgccagacata

SEQ ID NO: 40248 - DNA, 121 bp, Artificial Sequence
  Synthesized
  misc_feature (61): n=a or g
gatggtccaaagaataagggctgaattgacagaagatgccagggacagacttctctccttntctagcacttggctgaactgagcctctttgataaagagcctgggcccaggtcaccaataa

SEQ ID NO: 40249 - DNA, 121 bp, Artificial Sequence
  Synthesized
  misc_feature (61): n=t or c
caaacaaggaaccacaatgctaattattttcgttgcttatttaactcttgatgggtgccangagccaattaaaatcaccactgttacttagaggtggcgtgaaacctaaatgaggaagcag

SEQ ID NO: 40250 - DNA, 121 bp, Artificial Sequence
  Synthesized
  misc_feature (61): n=t or c
gaagaaagcttacgcattcaaaagcttgttcaacttgtcttcccagtgataatagttagtnattaaacaacgtaaccttaatctaccaacactgacttacaagttcatacattacataaag

SEQ ID NO: 40251 - DNA, 121 bp, Artificial Sequence
  Synthesized
  misc_feature (61): n=t or c
ttcctgaagtactacaatatgttgtcagtaaacaagatcttgacaaaagttttaaaactanagtattttatcaaagacttcctaccttgaaacttcttccctataggcaaatttgattaaa

SEQ ID NO: 40252 - DNA, 121 bp, Artificial Sequence
  Synthesized
  misc_feature (61): n=a or t
ttgcagaaattcatgctattgaacaaggtacaagtcacataagagtaagactaaatgaagnaagacttctttaaatgcttttctagtttaggaaaaccagttttttcctcaacctgtatct

SEQ ID NO: 40253 - DNA, 121 bp, Artificial Sequence
  Synthesized
  misc_feature (61): n=a or g
catttacaaaagcaggatggaagctcagaggcgtggtttctagaaagtgcagtggttgggnacctgcaaagttgggagtagaatgagggacaaagacagagaaaggcaaagctgtagcagc

SEQ ID NO: 40254 - DNA, 121 bp, Artificial Sequence
  Synthesized
  misc_feature (61): n=a or g
actaccaaatctatgccctctatagtgctgaaccagcactataaatttgattctaaacacntgaacataattccattgaattacccaaagcatgcaatacaaactctatgttagctgtggg

SEQ ID NO: 40255 - DNA, 121 bp, Artificial Sequence
  Synthesized
  misc_feature (61): n=a or g
acaaactaaggaaaagtagctcaaacgactgaagcttttctatttggcaatcactgctacnactccagagggctcacacatacacagctttgttgcactgtcccaccacactcaaggctaa

SEQ ID NO: 40256 - DNA, 121 bp, Artificial Sequence
  Synthesized
  misc_feature (61): n=a or g
cgctgttaattgaaactcatgcagatatcctgctttaccctttctcctgtcactctcatcnggtaggtgccagcacaatctgactcgctccacctgacccaaccccagaagtggagtgtat

SEQ ID NO: 40257 - DNA, 121 bp, Artificial Sequence
  Synthesized
  misc_feature (61): n=t or c
gctgggctctgtgcagcagtttggtctgcctggagctgaggagtccagcactgggcacagngctccagctgtgccctccccaaatttgcaaatcttggacgatgctttgggtccctccata

SEQ ID NO: 40258 - DNA, 121 bp, Artificial Sequence
  Synthesized
  misc_feature (61): n=a or c
tcaccctgatggcctgtctctgtggtctgaacacagctttcctgacctagcacagcaggancagcacgccaggtgagcttgtgatgtccacacaaaggtgtccaagccttcccatctacac

SEQ ID NO: 40259 - DNA, 121 bp, Artificial Sequence
  Synthesized
  misc_feature (61): n=c or g
aggttatcttcttttgccttatttctgttgtcttttcaaatacaatgtctcctctccctancttgatgctcaaaagtttttatcttttgaaactgtaggtggtaagcaacatgccagcctt

SEQ ID NO: 40260 - DNA, 121 bp, Artificial Sequence
  Synthesized
  misc_feature (61): n=a or g
caactataaaaccatccccagagctatgctgataaaatgtcatggtcaaagtcagctcttnagacacgagatggagctcactgtgcatgctccagagcgagataccatttgcggcccttcc

SEQ ID NO: 40261 - DNA, 121 bp, Artificial Sequence
  Synthesized
  misc_feature (61): n=t or c
tcaggctccaaaacagcagggagagggctttgggaaggacgaagagcggggcttctccgcnctgcctcatcactagggaaggtccagcttgggaccccacctttcagggaaggctccagct

SEQ ID NO: 40262 - DNA, 121 bp, Artificial Sequence
  Synthesized
  misc_feature (61): n=a or g
ccaaacacaaagccattacaggagaacagccccttggtgctagagcttacatctgccagcntaggccacctactaccagccattttctgtccctcagggtttgctttgaccctgcccagcc

SEQ ID NO: 40263 - DNA, 121 bp, Artificial Sequence
  Synthesized
  misc_feature (61): n=a or g
aactaataataccaacattttaaggctgcttcaggataggaaggttcaggcaaacatcaanatgagcttaaaagccctatgggctttgtgctcaattcttaaaattttgcaaaatgtattt

SEQ ID NO: 40264 - DNA, 121 bp, Artificial Sequence
  Synthesized
  misc_feature (61): n=t or c
tctcaacagctctactcttgtagcttcctatgttttcttttataatattcagaataaatcntgcaggcttcctaaagatttaataactatggactatttagatagcaaatgagctgtttta

SEQ ID NO: 40265 - DNA, 121 bp, Artificial Sequence
  Synthesized
  misc_feature (61): n=t or c
attggtagagtttaaatatattttcctacactttagattgaggctgttaaaaatggaaganggtccaatcttattctgtattattcagaaggtcaaagcattcctatctattattttatta

SEQ ID NO: 40266 - DNA, 121 bp, Artificial Sequence
  Synthesized
  misc_feature (61): n=t or c
agcgtggcacagccacattcttctggcagctcagctggggtactgacagttcttgaacttnttgatgtctctttgcagaagggaagtccaaaagagttttctgatattctctcgttttgca

SEQ ID NO: 40267 - DNA, 121 bp, Artificial Sequence
  Synthesized
  misc_feature (61): n=t or c
gcccaaagaaatgcagcatttgacttactaaattcctattcaaggccctcaggctgtctgnatttttaagagggtgcaggagtgtacagctcccacagatactgcaaacaaagagcaagaa

SEQ ID NO: 40268 - DNA, 121 bp, Artificial Sequence
  Synthesized
  misc_feature (61): n=t or c
ctcctcctggtcagcttttccaaatctcaccagaggaggctgataaagaagcaggtttccntcacaaagaccagataaggctgcagacatggtgtgtctgaagggagctctgctgcactcc

SEQ ID NO: 40269 - DNA, 121 bp, Artificial Sequence
  Synthesized
  misc_feature (61): n=t or g
gggagagggaaggagccaggactgagtgggtcagagctcactgacatcccttgtgcccaangctcgggaagctggagggctgcatggatggcagtgggacgtggggctgtccccatacccc

SEQ ID NO: 40270 - DNA, 121 bp, Artificial Sequence
  Synthesized
  misc_feature (61): n=t or g
taaccaggcacttgaagttaaaactggaaaacaaatcaaaaaagccatttggagatgacangaatattgctgaaggcaatgaagtccatgaaatacattcccagagacaaggataaagtta

SEQ ID NO: 40271 - DNA, 121 bp, Artificial Sequence
  Synthesized
  misc_feature (61): n=a or g
aattaatccttgacagataatcgcacagttaaaaatagtgccagtaagtgctagggggcanttaacttaggctttctagccttgcttctaaccagtttgttttggaaagagatggttttag

SEQ ID NO: 40272 - DNA, 121 bp, Artificial Sequence
  Synthesized
  misc_feature (61): n=a or c
gtcagtacatacatttctacagaccgggactgcagagcaaataagccattttccagctttnataatgcacttatgataatttgaacattaaaaaaaaaaaagaaaaatcgaaactcctcaa

SEQ ID NO: 40273 - DNA, 121 bp, Artificial Sequence
  Synthesized
  misc_feature (61): n=t or c
ctgctgcaagcagagtgttcccatgcttgcatagaaggctgcgagcctggggcagatccangcccaatttatgccctaatagcatctcttggtcctgtcccatagatggaatactatggga

SEQ ID NO: 40274 - DNA, 121 bp, Artificial Sequence
  Synthesized
  misc_feature (61): n=t or c
cttggccaggtgtgatggagatagtgatgcctttctgcccaggtgtcccacggggacaagnaggacaagacacatggtcacacaggaggacacagacgtgtgccacgtgctcaccatcaat

SEQ ID NO: 40275 - DNA, 121 bp, Artificial Sequence
  Synthesized
  misc_feature (61): n=a or g
ttgcatccctgcagcaggataaagggctgcttgggacctcacccttgtcatggttgtaagnagcgcccaaagaatgctgcagtcctcgaggtctcacccaaaatccatcatttccgaaggg

SEQ ID NO: 40276 - DNA, 121 bp, Artificial Sequence
  Synthesized
  misc_feature (61): n=a or t
attgagcaaacactgtaaaacgcaacaaatggatctcagaactcaaacagaagatgctatntttgtccttaaaatgtgcaagatgataattttacatctgtagatttcacaggagaaaagt

SEQ ID NO: 40277 - DNA, 121 bp, Artificial Sequence
  Synthesized
  misc_feature (61): n=t or c
cagtatctgcctgttgcctctctgctggaagtccatcctgctcttaccaaaatcagttacnagtgtcactgggagacgcgtcaggtatcatattcaggctggtgtttcaaattgcaggtta

SEQ ID NO: 40278 - DNA, 121 bp, Artificial Sequence
  Synthesized
  misc_feature (61): n=a or c
attacttagtttttcacagtagcagaagatataattatgaagagttgcagaagtgtgtctnaacactaggtgataaaagcaatacagtttgcaaacaggaataaaaacatgaaacttctga

SEQ ID NO: 40279 - DNA, 121 bp, Artificial Sequence
  Synthesized
  misc_feature (61): n=a or g
tgatctttacctgtgaagaatgtagctttaaaggcacttctttcaagcaacattaaaggangtgagtgtaagggagatccagcagcttcttttgggccactgattctctgcttcaggctca

SEQ ID NO: 40280 - DNA, 121 bp, Artificial Sequence
  Synthesized
  misc_feature (61): n=a or g
taaatgaagaatgaaaatgaaattcactgttgaaaaatagaaggaaatgcacttgagaaanaacagttgttacatatacgatgacaaactgacctgcacctgtcagaaattagatcatgaa

SEQ ID NO: 40281 - DNA, 121 bp, Artificial Sequence
  Synthesized
  misc_feature (61): n=t or c
attttttatttgtctatcctgttttaccaggtgctctggaaatacaggtgctgattcttgnagtgacaagttaaaaagggaaaatagctcaaatgaaatttcattccacacctttgattga

SEQ ID NO: 40282 - DNA, 121 bp, Artificial Sequence
  Synthesized
  misc_feature (61): n=a or g
gtgttccccagctgagatcaagttgggttggtgtcactgatggcaaagcagcaatgggacngtccctgttgtgccaggcttgtgccacttgtgccaccagtgctggcaccaagcagggagt

SEQ ID NO: 40283 - DNA, 121 bp, Artificial Sequence
  Synthesized
  misc_feature (61): n=t or c
ttaaaatgattaaaatttcagttgttcatacttcttttaaaaggaattgaatattactttnagttttgagtacagctgaaacaatgatactctcatcctactataaatactagcatgggtg

SEQ ID NO: 40284 - DNA, 121 bp, Artificial Sequence
  Synthesized
  misc_feature (61): n=a or g
attcacagctgcaatttctgcacttcttcttatgaaatgtagagttcatttccataacctnaatgtgtcttcacctgcttattatctcacctgcttattatcctactataaggatatgttc

SEQ ID NO: 40285 - DNA, 121 bp, Artificial Sequence
  Synthesized
  misc_feature (61): n=a or g
ccattctggctggtttgctgggcacattgcaagacctccaggagtgtcactgcccagggantccatttgccatctccatgtaggacccatatctcagggggcacagaccccgcagagctct

SEQ ID NO: 40286 - DNA, 121 bp, Artificial Sequence
  Synthesized
  misc_feature (61): n=c or g
aattgagcagcagatgctctgccactgtgctgtcccctccctttcaaccaaggttggtgtnagaggaggtgtgggagcttcctcatggtggcttccggcaggaggctgtggaaaaagacct

SEQ ID NO: 40287 - DNA, 121 bp, Artificial Sequence
  Synthesized
  misc_feature (61): n=a or g
ttacatccatcaccctcctgaaatttgacatctggatatttggaccatatactcaaggacntggatatgacaaatattcaaatctaagtagcaggtagatcaggaatttcactgtgacatg

SEQ ID NO: 40288 - DNA, 121 bp, Artificial Sequence
  Synthesized
  misc_feature (61): n=a or g
gtttacacaaagctttgtgaacttaactagattttatatgaataaaaaaactctcaaaatntgcacttaccctcactttacaagttacatgatagtagagaacagaatcatagaatcacag

SEQ ID NO: 40289 - DNA, 121 bp, Artificial Sequence
  Synthesized
  misc_feature (61): n=a or g
tccccccaatccccctctcctccaggctgctaacatctgtgtagtcccctgaagtcagacnttcgcctcctgcaaatggttctgctgcagtgagtggtgttcccaggcaaggaaaaaggct

SEQ ID NO: 40290 - DNA, 121 bp, Artificial Sequence
  Synthesized
  misc_feature (61): n=t or c
aaccaaaccatctgtgtgttagtaacattgcctcagctgaaaataggacagccatcaaaangggccacaagaactgtgatacttttacagaactgcttacaaaggactaagaaatcataca

SEQ ID NO: 40291 - DNA, 121 bp, Artificial Sequence
  Synthesized
  misc_feature (61): n=t or c
tggtgtcacagccacatgcagaacaaaggacccaaaccttttcccatctgcagctgccagngatgctggcgaggatactacctgttttcctaaagaaggtgtgagtgaaacacaagccgtg

SEQ ID NO: 40292 - DNA, 121 bp, Artificial Sequence
  Synthesized
  misc_feature (61): n=a or g
ccccctgcagcccaccctgtgcccccgctcggtggtggccacggcgaaggcagaccccacntttggggagctcttccaattcgacatcccagtgctgatgtgggaccaacacttcaacccc

SEQ ID NO: 40293 - DNA, 121 bp, Artificial Sequence
  Synthesized
  misc_feature (61): n=a or t
aactgtgataaaacagaatattgagcttccctgatcctgccactgaaaaaaacattacaanagagattgtaaaggcagagcaaatatgtcaggactgcgtgaccatcacccagagctgcca

SEQ ID NO: 40294 - DNA, 121 bp, Artificial Sequence
  Synthesized
  misc_feature (61): n=t or g
ctgagataatgaagtctctctccaatacaaatggagtatactttggtaaaggtggtgaaancataaaaaataagtcccagagaaagctgaaaaattactaacaattacagactttgctttg

SEQ ID NO: 40295 - DNA, 121 bp, Artificial Sequence
  Synthesized
  misc_feature (61): n=a or t
ataattttctcattatgcctttttctctaaactgacaacgttaggcaccaaacaaggtgcnttagtgagagaggcatttgggaatctctatatttcttccagttctgggaatgtaggagtg

SEQ ID NO: 40296 - DNA, 121 bp, Artificial Sequence
  Synthesized
  misc_feature (61): n=a or g
tatagtaagcctattaataggctaagaagtgttattcagaatgtgtgcatagccatgactntgtactaattgtctttctatacgtgtggtaataggaatttggggcgttgcacatgcacat

SEQ ID NO: 40297 - DNA, 121 bp, Artificial Sequence
  Synthesized
  misc_feature (61): n=t or g
aaactgggagaagtcctggtgctgaattcacagatcccttgcaaatcttcaagagccagtntttaaaccctgtgaatcccatctgcaggtgagaaaataacaagcaccagaatcagtcttg

SEQ ID NO: 40298 - DNA, 121 bp, Artificial Sequence
  Synthesized
  misc_feature (61): n=a or g
ttgtgcacttcagtttgataagcaaaccccttccaattgcacttcaagcagtcaggctcancatttgtcaagtacatctggaacacctcagccaggaaccccattccacaagacaggtatc

SEQ ID NO: 40299 - DNA, 121 bp, Artificial Sequence
  Synthesized
  misc_feature (61): n=t or c
atcacagggctgaatgtggaatgctgagggtctctccatatgtcagtttctatgtgcttgnaatattgagtatactgagtacagcattcaacctgtcttctctcagtttctatcaaaagag

SEQ ID NO: 40300 - DNA, 121 bp, Artificial Sequence
  Synthesized
  misc_feature (61): n=t or c
tctaataaaatttcaacatctccaccgttggccaaatctactgcaggaatatggcccctcngatgggttgggatgcttccacctccaacaagctctgggagatgggagaaatgcaatgacc

SEQ ID NO: 40301 - DNA, 121 bp, Artificial Sequence
  Synthesized
  misc_feature (61): n=a or g
tgttttgatgcagtgagagaatttgggcagctttctgcagccaagagctgtcagattttcngctcttgtaaggttgcagagcagtaagaggatgaaaaggatgcttgcaccacagctctgc

SEQ ID NO: 40302 - DNA, 121 bp, Artificial Sequence
  Synthesized
  misc_feature (61): n=a or g
ttaaccgcaggttcaagggcgtctgggggggggggaaatgcactccatcaatattaaaaangatcggttttgagagctctggctctgaaatagctgcctggtgctgggcaggggatgcccc

SEQ ID NO: 40303 - DNA, 121 bp, Artificial Sequence
  Synthesized
  misc_feature (61): n=t or c
aataacaattaaagtaatttttaagactgcttttccgaggcctggtgtctcaagttatacntgacttaccttacctctgtaaaaaggctatgtttcaacaactgtgtgtggtctagataca

SEQ ID NO: 40304 - DNA, 121 bp, Artificial Sequence
  Synthesized
  misc_feature (61): n=t or g
tccaataaagtaccatattcactcttatggcttagcacaggaacaaatttcatgattactnctagggtgcaaaaagaaaagtttctgatgactgttcaggccattaatcaaatcatacaca

SEQ ID NO: 40305 - DNA, 121 bp, Artificial Sequence
  Synthesized
  misc_feature (61): n=a or c
tctgttgagcgctttgcaggagcttacaggacactacctacaaaaaaagtaacctaacaantgagaatgagttttcggtgttgtgtgctttgtgagcttggtgttgcttttcagtgctaaa

SEQ ID NO: 40306 - DNA, 121 bp, Artificial Sequence
  Synthesized
  misc_feature (61): n=t or c
gagacagtaggatatatatgcatgtcacaacaccacacttaattgctcagtgaagattaantgagcctaaatctttctatgcaccctctccagctatggctcagaactggtgagtaattgt

SEQ ID NO: 40307 - DNA, 121 bp, Artificial Sequence
  Synthesized
  misc_feature (61): n=c or g
cccccagctgccacagtcacagcacccacaccctgcctgggcaaagcaaaatggcctcctnctgcgattcctccccaggagatacatttgcaagtaggatttacaaaagcaaagcacagct

SEQ ID NO: 40308 - DNA, 121 bp, Artificial Sequence
  Synthesized
  misc_feature (61): n=t or c
cttctcagttgtgcaaagcagggagagctcagtactgctaccaacaggactcagctgttcnggaggagacacagatgttttggatgccagataaggacatcttctgacctaggggaagttg

SEQ ID NO: 40309 - DNA, 121 bp, Artificial Sequence
  Synthesized
  misc_feature (61): n=a or g
gagggccgtgaagtggtgctgaggaaagcatcaccatgggacagagccgtgcttttagctngcgctcctggaggagttcctgcacggagctgactgatgccagtcctttgctgcatgggca

SEQ ID NO: 40310 - DNA, 121 bp, Artificial Sequence
  Synthesized
  misc_feature (61): n=t or c
tgatgaagtggaaggagaggaattcatgagacaaaagctgaaacagctgtacaaattcttnaggtgcagcaaaacttgactaagctgggttgtgcttccagggcagccatggcctcatgga

SEQ ID NO: 40311 - DNA, 121 bp, Artificial Sequence
  Synthesized
  misc_feature (61): n=a or g
gaactctgtgctatgccggcaagtctgagaacagtcagaatgctttgacctggacactggnggaaaaaaactgatatttttgtttcaggtgagaaattagaaattaacttcagtgtaattt

SEQ ID NO: 40312 - DNA, 121 bp, Artificial Sequence
  Synthesized
  misc_feature (61): n=t or c
gaaggcctctccacactgaagacacctctaattatttattattttggcagcaatttattcngggatattcagcctttgtttattcctctgtttttaggtagctgtgcttttaaattagcac

SEQ ID NO: 40313 - DNA, 121 bp, Artificial Sequence
  Synthesized
  misc_feature (61): n=t or c
ctgctgttcagagctcccatgtgactctgagttctctcccctcactggataattgagcatngactgtgcatgaagggggaccttctgttagaaactgttgcaacagactcatccaaaagaa

SEQ ID NO: 40314 - DNA, 121 bp, Artificial Sequence
  Synthesized
  misc_feature (61): n=t or c
tcccttttctgaagagagcagtagcagtggggatagctaagatggtactgggaaatgcctntccatggcactgtgatgccctatctaatgcttcagaacaaacatcggaggaccatccacc

SEQ ID NO: 40315 - DNA, 121 bp, Artificial Sequence
  Synthesized
  misc_feature (61): n=t or c
taataaaatgcattctttcctactcttttcctttctgttcttgcttttcatcttaatattngtctgttagattttattcatctctcttttcttgctttttgtagctttatgataaccttaa

SEQ ID NO: 40316 - DNA, 121 bp, Artificial Sequence
  Synthesized
  misc_feature (61): n=a or g
gcttcactgcaggactgtcataggactgtgccactgggcacagaagacattttgcctatantggacaatatagaatgctgttaaataaatacagaaatttcagccaaaaaaatcctaaaag

SEQ ID NO: 40317 - DNA, 121 bp, Artificial Sequence
  Synthesized
  misc_feature (61): n=a or g
tctccacagtcacttgacgctgtgtacttcatgtgtttgcatgctactgattctgcccacngtttataaggccaaaaagatgtttaccaaagcctatactaagtacttgctgttttgtaag

SEQ ID NO: 40318 - DNA, 121 bp, Artificial Sequence
  Synthesized
  misc_feature (61): n=t or c
aataatcacatatttcatatggattagttatgaaagcattcatacactcatactagacaangaagatgtttttcaactgcagagaacaccattttcacctaggcacgttgttggaacatta

SEQ ID NO: 40319 - DNA, 121 bp, Artificial Sequence
  Synthesized
  misc_feature (61): n=a or g
tagggcagaacaagcgtttttcagcacacaagtctgattgccagcatggtgacccttggtntcttgcattggggaccttctgtccatgagctgtcccctgtggaggacaaggggttgaggt

SEQ ID NO: 40320 - DNA, 121 bp, Artificial Sequence
  Synthesized
  misc_feature (61): n=a or g
gttccaagtccgaacctagaggatcatgacaatgaggaaaaacactttcttgtttctcccntttctagctgttggatacagcttctccctggtctgtctatttagggttgctccctttcct

SEQ ID NO: 40321 - DNA, 121 bp, Artificial Sequence
  Synthesized
  misc_feature (61): n=a or g
tttctttctgagaggctctgagtgcagcacctccccacaggtttctctttaaactcccggncttacattgaaatgaaacaacattctacttgagttgttcaggaaaactgtgctgtccctt

SEQ ID NO: 40322 - DNA, 121 bp, Artificial Sequence
  Synthesized
  misc_feature (61): n=a or g
agcccttttaattatgggaagtacagtggagagcaccctataatgcagcatgtaaaactanttaccagctgccttaaatttctaaagggtaagaattgacttccaaactgatacaagttgt

SEQ ID NO: 40323 - DNA, 121 bp, Artificial Sequence
  Synthesized
  misc_feature (61): n=a or g
aatgcctccagtgaagagcactgtggcagcagaagtgcggcagttccacttagcaatgatngaacaatatttgcaaggaatttttacaggtcatgtaaacctatgcactgtgaaatcctct

SEQ ID NO: 40324 - DNA, 121 bp, Artificial Sequence
  Synthesized
  misc_feature (61): n=a or t
ttccaggaataagacagtgttctagtttgcaacacatacaaaacagcaagtccatagaaantattaaaagacatatcagttacaattctttcttctttcctttctttagcgattacacagt

SEQ ID NO: 40325 - DNA, 121 bp, Artificial Sequence
  Synthesized
  misc_feature (61): n=a or g
attcgcaaataatatcccttcaaaactagaactgaagtgaactgcaactaaacactatttntgaaataatttatttacattccttttccctctgtcaaattttcagtaacactgggaatct

SEQ ID NO: 40326 - DNA, 121 bp, Artificial Sequence
  Synthesized
  misc_feature (61): n=t or c
gtaggcctcatccacagctcagcctcgtcttctgcagcccgttccagtggataactgcttnctgctctctgctgagcatgctttagatggtgagaactgctgttgatcatgttggcgtgat

SEQ ID NO: 40327 - DNA, 121 bp, Artificial Sequence
  Synthesized
  misc_feature (61): n=t or c
ccactttctgtacaacgtttcccagaatttttcagttgattaggtaggatggcaattcttnctgcctctcttttgatatccagagctaatatgtttgcccttctcacttaggagttcatac

SEQ ID NO: 40328 - DNA, 121 bp, Artificial Sequence
  Synthesized
  misc_feature (61): n=a or c
caagtaggatctgtgagggaggatcatcagctcccagctgatgactacaggtcatgcagtncagggcaagaggaacttgtaatctcaagctgggagcagacacagattttgctacatttgg

SEQ ID NO: 40329 - DNA, 121 bp, Artificial Sequence
  Synthesized
  misc_feature (61): n=t or c
ccccctgctctgtccactccagacacagtcccaaatggggtcctttgcacagttccctacngccctacagcccgtgttgctcctgccatagggctgtgcccagtgacacgccgtgccatcg

SEQ ID NO: 40330 - DNA, 121 bp, Artificial Sequence
  Synthesized
  misc_feature (61): n=a or g
ccacctttaaatatctgtagggattttttgtttatacatttttaatgaccatctctatctnaacaacgcatagtgataggacagaagttcctcaccattgcttggacgcccttaatttgga

SEQ ID NO: 40331 - DNA, 121 bp, Artificial Sequence
  Synthesized
  misc_feature (61): n=a or g
tccatacagttcattttttgtaactgagttatgcattgtgtgtctgtaagattttaagatnttgcctgtaggtcagggataataagtaatggtgaataatcattacctttttttcccctat

SEQ ID NO: 40332 - DNA, 121 bp, Artificial Sequence
  Synthesized
  misc_feature (61): n=a or g
tcccaaaggatcagaagcgtttttattctataactccacaatgagttggagcggctcctcnggcaggaattgttctgctccgtagactacttaatgcttcctataaactactgccaagtta

SEQ ID NO: 40333 - DNA, 121 bp, Artificial Sequence
  Synthesized
  misc_feature (61): n=a or c
attctgtcttaatgcctgaaacaaataactttcctttaaatttcaacagaaatagctgccnttttttttgcagcaaaaggtaagctgaaagtaaaaacgttataagagcttcgaatttatg

SEQ ID NO: 40334 - DNA, 121 bp, Artificial Sequence
  Synthesized
  misc_feature (61): n=t or c
ccgctgtacatgtggcatttcattcatcagtttttccaaacggaagacttgtcatttaaanaaaatgagtgtatgtgtcgttttactgcttctgaatgccctgtgagagaaacacagcaga

SEQ ID NO: 40335 - DNA, 121 bp, Artificial Sequence
  Synthesized
  misc_feature (61): n=t or c
ttgcttcaacatctctggggcagcaaagaaaaccctgagcactgtctgtttcacactggtngaggttgctctggcagatctgtctgtaacctcaccttggtaacacacaccatgccctctg

SEQ ID NO: 40336 - DNA, 121 bp, Artificial Sequence
  Synthesized
  misc_feature (61): n=a or g
gtgcaatgactgtgaacagaaacacaatgataggctgaggtaagctgcacaatatttaatntatgtttccagaatgtctaccagaactgatatttaatagcttaacttctatagaaggaaa

SEQ ID NO: 40337 - DNA, 121 bp, Artificial Sequence
  Synthesized
  misc_feature (61): n=a or g
atctggttcttggtttacagacttagagaacaaaagtcattcaatccattgttttggggtntgttttctttcttcaattaaaagaagggggaagggttgctattcctttgactaccactca

SEQ ID NO: 40338 - DNA, 121 bp, Artificial Sequence
  Synthesized
  misc_feature (61): n=t or c
gcacgagagtctgtggctttgtgctggagccaccaacatccatatggaaatgccactggcntcaggcaagccaactgagaaagaagtgggtctaaaagccaggtgttaaaagaaatgtgtc

SEQ ID NO: 40339 - DNA, 121 bp, Artificial Sequence
  Synthesized
  misc_feature (61): n=t or c
ctgttacgtgctaatttatggtgagagccctaatccaaatggcgtaaaggctttggagaantaattgatgtctgggtttgttttggaggaaagttgctaggcactttctagtttgggtttt

SEQ ID NO: 40340 - DNA, 121 bp, Artificial Sequence
  Synthesized
  misc_feature (61): n=a or g
cagggaatactatttaagattagtcatggttgggatttaggaggtaggctcatgtttgtgnagtactgaacaattctttatactcttgcattacttatgtggctgctagatgttaccatct

SEQ ID NO: 40341 - DNA, 121 bp, Artificial Sequence
  Synthesized
  misc_feature (61): n=t or c
atgacaaaggcaggctaaaacatatcttcaaacacttgtccaagtaatcctcaattgctgnagctgctcttcagttaataacttcccttcatttagggcacgttcctctttggtagaggtg

SEQ ID NO: 40342 - DNA, 121 bp, Artificial Sequence
  Synthesized
  misc_feature (61): n=t or c
aaaatggaaaaaaaaatccattattattttctgtgaaaatattccaaagctttcccatttncaagaaaatatataacttgaagggggaaaaaatggtaaggccaactccatccttacattt

SEQ ID NO: 40343 - DNA, 121 bp, Artificial Sequence
  Synthesized
  misc_feature (61): n=a or g
attttcctggggtttttttttttgaatgtttacagttttcttttgatgtctgaaagatgcncagagaggaacctgacattgattatcaaaatagggaagcatcaaaactgtgtaaacatga

SEQ ID NO: 40344 - DNA, 121 bp, Artificial Sequence
  Synthesized
  misc_feature (61): n=a or c
atgaatcaatcttattggcagcatgttacagtgcatctcacgtttccagctatgttacagngagatctggatccagaaataattgtttgactgaataacaatgttactgaaataggagacc

SEQ ID NO: 40345 - DNA, 121 bp, Artificial Sequence
  Synthesized
  misc_feature (61): n=a or c
aaggctccagaactgacttctttagtcagttcagtgtattcatcaattatgttttcttccngtcacgtttttcaggtaaaagttatctgactaattgtccccgttccaatattcagtttgt

SEQ ID NO: 40346 - DNA, 121 bp, Artificial Sequence
  Synthesized
  misc_feature (61): n=c or g
ttacgactatacgctgtttccataaagagtatataaaacaggtcaggttttataggtaagncataataaacagtcatacccattgatgccataaacgtgcagaaaaaaaaaaaaaaaaaga

SEQ ID NO: 40347 - DNA, 121 bp, Artificial Sequence
  Synthesized
  misc_feature (61): n=a or g
ggcatagccaattattgcagttaaacatcagggtaatagctattacagtagactgagcagngggaaaatgcatatgtttctcccattctgctacataattcaatgtgcaatttctgctgct

SEQ ID NO: 40348 - DNA, 121 bp, Artificial Sequence
  Synthesized
  misc_feature (61): n=a or c
tgtaaaggataaggaatcctattagaggaccttatcacatcccattgctgtaaacatttgntgattttttacagcttggcatatccaggttaggaaaaaaattacatttgttgtccatgtc

SEQ ID NO: 40349 - DNA, 121 bp, Artificial Sequence
  Synthesized
  misc_feature (61): n=c or g
atcccattaaatgccacatatgctatgcactgcagtacttcctatggtacagagctgcttncttgccctatctccttcatgcaggatgcctgtacccatctttaggtgttcagcagggact

SEQ ID NO: 40350 - DNA, 121 bp, Artificial Sequence
  Synthesized
  misc_feature (61): n=t or c
aagctttgagcccctgagctcctctgagcagtggttggtaacacagatccaggaagattcngataaccaaaaaaaactctttttggatttgaagactgcgccaaatgccagggagctgctg

SEQ ID NO: 40351 - DNA, 121 bp, Artificial Sequence
  Synthesized
  misc_feature (61): n=t or c
ggattgaggctttttttgggtcttcagaaactaatcagtggcacttagctgcagagaaganggggccctctgagaactagtcacagggcttggagtatgaaggactgttatattttgactg

SEQ ID NO: 40352 - DNA, 121 bp, Artificial Sequence
  Synthesized
  misc_feature (61): n=a or t
ttttgacacccactgtggatgttaattggctgtggccatacagaacttgaaaaatcttttntaacccattcattggtatgaacacttgaaattagcatttgcaagtgtttttcacagagtc

SEQ ID NO: 40353 - DNA, 121 bp, Artificial Sequence
  Synthesized
  misc_feature (61): n=t or c
tatttagggaatacggtgcctcctgggaagcgtggggcaattccggtggaaacaggaacanaaatacctttaaaatgcaatttgatagatttctggaggaattatgtggaaaaaacagctg

SEQ ID NO: 40354 - DNA, 121 bp, Artificial Sequence
  Synthesized
  misc_feature (61): n=t or c
tttgtataaacagcaatccctgtcaccacagttaccactgccactgtgcttttcattaaantcagtgactgtgcaatgtgcacagatcaggcctgcatatgggtctttttggatacctatt

SEQ ID NO: 40355 - DNA, 121 bp, Artificial Sequence
  Synthesized
  misc_feature (61): n=t or c
gtctaacttagtgaaactgcagtttctaaagcataactgctggttttccagctacactgantatttcatcacctctgcacattagtataaattgagaaactggatgatacatcagcatcag

SEQ ID NO: 40356 - DNA, 121 bp, Artificial Sequence
  Synthesized
  misc_feature (61): n=a or g
ccaaaagagtgatgaatttttttgtatatttgggactccatttttagtcgacataaatacntttcctacaggttttcaaatggaacgtgcagttgcaatcagatattgtactaaaaaaatt

SEQ ID NO: 40357 - DNA, 121 bp, Artificial Sequence
  Synthesized
  misc_feature (61): n=t or c
attcttgaaaacttggttttcaagtgatgtttaatttagttttcaagtgcaattagataantgtaatcagtagggttgtgtttctgattttgattttcagctttcaaagttgagctccgtc

SEQ ID NO: 40358 - DNA, 121 bp, Artificial Sequence
  Synthesized
  misc_feature (61): n=a or g
tatgggggaagtttaggtgaggaaggagcacaggagggtgttttgtcatctggaagctccngtttagcctgttgctgtgccagaccagtgattcaacagctgctaacaaaacgcatttcta

SEQ ID NO: 40359 - DNA, 121 bp, Artificial Sequence
  Synthesized
  misc_feature (61): n=a or g
aagttcacttgcaggcagctagatcccaactcagatttctcagctgtgaaatcctgtgaanagcaaggaagaaactacataagatcagtgtttgaaaggcaccttgtgattttttagggaa

SEQ ID NO: 40360 - DNA, 121 bp, Artificial Sequence
  Synthesized
  misc_feature (61): n=a or t
cagcaagcagccatgcattgctgttggttccttgctgtctagacagagagaagccagagantggaaaggttggaatgctcattatgttcctcaatgaaagagctgggcactaaaatatttg

SEQ ID NO: 40361 - DNA, 121 bp, Artificial Sequence
  Synthesized
  misc_feature (61): n=a or g
agtgcagcgcgctaacagcctgatcccccctgccagaaaatggggcactacacttggtagncagcatgaaaaaacccaggccgccaaaatatgtgctcccaaagatctcttaaaaatatct

SEQ ID NO: 40362 - DNA, 121 bp, Artificial Sequence
  Synthesized
  misc_feature (61): n=t or c
tcaaattggaattgcttctgtagggtttaagtcgtgggtacagatggtgctgtttggtaangcgcagcaaccaccgccccgccagcacggcagacgtgtggagaaaacaatgtttccatgt

SEQ ID NO: 40363 - DNA, 121 bp, Artificial Sequence
  Synthesized
  misc_feature (61): n=a or c
attgatggagaccaaacagtggatgtgagcacagcgttgtggtaagtggtacttttcagcngtggtgacagccgtgcatagctatcacatcgtgaaatgaagtgtctcaatcagctcgttt

SEQ ID NO: 40364 - DNA, 121 bp, Artificial Sequence
  Synthesized
  misc_feature (61): n=a or g
gtgagataggataagggtgccaaaagacactgagaattcctggttagagatatctgttagntaaccagtgctaagtcccagggagctcagtacagctggaaggggctgggtgtttggagtg

SEQ ID NO: 40365 - DNA, 121 bp, Artificial Sequence
  Synthesized
  misc_feature (61): n=a or g
gtttataaagttctgattaattttattgcttggattaatgaatgtcctgagatgtatgtcntcttacattgcactactgcagctaacattaataaatatgcagtggaatacttcagtattg

SEQ ID NO: 40366 - DNA, 121 bp, Artificial Sequence
  Synthesized
  misc_feature (61): n=t or c
ctgaatggttactgctcatttgtactgcccctgtctgtacagagtcctgacatgacagtcnaagttcgcatagttaccgctaaatttagggtgcaggtctgagtagtttgagctcctggtt

SEQ ID NO: 40367 - DNA, 121 bp, Artificial Sequence
  Synthesized
  misc_feature (61): n=t or c
tttgaatctgttgtctagtgttcttctcatgtgctttgtgagtagaaaccatagggtttcncacactgcagtgaattaggtggttcttgcttctgcttctctgtcgtgattttgctgctgc

SEQ ID NO: 40368 - DNA, 121 bp, Artificial Sequence
  Synthesized
  misc_feature (61): n=t or g
ctgcaggtggactttcatcacttcactctttgccttgggttaaagcacaacattcagcacnttcgttctgatgaaaaaacaatttgggaacagcactcacacaagcaaaacatccctaaag

SEQ ID NO: 40369 - DNA, 121 bp, Artificial Sequence
  Synthesized
  misc_feature (61): n=a or g
gcaaccccatgggctgtagggggacagccttcttcactgtgggcatctcctgggccgcacnaaacttctgctctgcgcccagagcaccccttctgcactgaccttgatgtctgcagggctg

SEQ ID NO: 40370 - DNA, 121 bp, Artificial Sequence
  Synthesized
  misc_feature (61): n=t or c
tcagccccgtggaactccgatccattaataataatgcttctgtgctaggctgagcctcagncattagcttagaattaattaatttttgctaggagctcccggatccctttggcgaacccag

SEQ ID NO: 40371 - DNA, 121 bp, Artificial Sequence
  Synthesized
  misc_feature (61): n=t or c
tgggatttatatgcaactaatgctttaggataggacatttagttgctgtatctgagaccgnggtgtagaacataaggatctgttctccctctctgacataaccacatcttgtgaggtcttc

SEQ ID NO: 40372 - DNA, 121 bp, Artificial Sequence
  Synthesized
  misc_feature (61): n=c or g
tgcctttgtgggttgacatttttgagtacaatatttctagctctacctgtgaatttttgtngtgaatcttctctagatctttcttgtcaagtgatttgtttgtgactgcaaactctgacat

SEQ ID NO: 40373 - DNA, 121 bp, Artificial Sequence
  Synthesized
  misc_feature (61): n=a or g
atgactgcaaaacttctcctgatattactgcagaaggagtttaatcagaaataacagcacncatgcaaaggctcccagcaagataaaaattctccttgatctgctgatagaaaggaatcta

SEQ ID NO: 40374 - DNA, 121 bp, Artificial Sequence
  Synthesized
  misc_feature (61): n=c or g
atgtgaaaatataacctgtttacgaatgatcaactggtggagcattcttggagaattattncgatgctatctcagtgctgccagtaaagaataccttgtttgacagtaacagaactttgct

SEQ ID NO: 40375 - DNA, 121 bp, Artificial Sequence
  Synthesized
  misc_feature (61): n=a or g
gcggtacgtgctccttgtgtgccctataggggccatccggcagtcagcatttcaaagcganttgtggaactgtcgtccttgccatgctggcagtaatatcctgcttgcacagtctgtgaca

SEQ ID NO: 40376 - DNA, 121 bp, Artificial Sequence
  Synthesized
  misc_feature (61): n=t or c
aactgcgatgtcagtttgctcaaaaatagttttttaaaagtattgttctgcacaattcttntgtgtaaaacacttgtacaaatgttgttttctctgtcacttctggccactttagctatgc

SEQ ID NO: 40377 - DNA, 121 bp, Artificial Sequence
  Synthesized
  misc_feature (61): n=t or c
cagagaactcctccaattcactaacagaattttttatttgctacccaaggagaatatacangtaatcttgaccataaatattaatcaagcattatattaagttagcaaatcctaagtaccc

SEQ ID NO: 40378 - DNA, 121 bp, Artificial Sequence
  Synthesized
  misc_feature (61): n=a or g
gactgtctctcaggtatgcactagcactctttaaaagcaagtatttcatatagcaccttcngattaatatgtatgcaaataacattttacagattaattagtatgcaaattaacccatgtg

SEQ ID NO: 40379 - DNA, 121 bp, Artificial Sequence
  Synthesized
  misc_feature (61): n=c or g
agaagcgtgaaagagtctgctaagcacatttgcttacaaaaatgctgcagtctactttacngtggggccatcagaataattagggatgagtgggtcaggaaatttggctcaccaggctggg

SEQ ID NO: 40380 - DNA, 121 bp, Artificial Sequence
  Synthesized
  misc_feature (61): n=t or c
aagtgaattaatttttcacttttttttgttgttgttaagaagtgtttaagcctgatgtagnctttttgaaacagatggagagtaagactttgtcatagggcattgggagtgtattttgagc

SEQ ID NO: 40381 - DNA, 121 bp, Artificial Sequence
  Synthesized
  misc_feature (61): n=a or g
gaggtcttttccaaccttcttgatcctgagttgtgaaaatagcttgggttcaacatcccanttctcccatgaggatcgggatgtttgggatccatcccttcaatcctgctgccactagtta

SEQ ID NO: 40382 - DNA, 121 bp, Artificial Sequence
  Synthesized
  misc_feature (61): n=t or c
cagatgatgtcggtcattatgtttatgagtcccgtgaatgaatctgcaaaggaaagccacngaaactacatgaaaagaagtgcagttatgctgcagaggcaggaagggcccttgggatgta

SEQ ID NO: 40383 - DNA, 121 bp, Artificial Sequence
  Synthesized
  misc_feature (61): n=a or g
actgttgcatttgtgttatgtgatttgacagtaagccctctggggcagaaatattatcccntttgattatcgagggctacagttcatgggtttataaactaggaattatgagtgctttaac

SEQ ID NO: 40384 - DNA, 121 bp, Artificial Sequence
  Synthesized
  misc_feature (61): n=t or c
gttattgttaagaacattacagaaattaagatcaacagctctttctaacaatgaatgcganacaattacctactttattgatgagacaccttctggctaaggtctcaaattgggaaggaag

SEQ ID NO: 40385 - DNA, 121 bp, Artificial Sequence
  Synthesized
  misc_feature (61): n=a or c
ctatgcatgactatttcaagaggaaaatattttttagattatattaatgctcacagatacnatcttgtgccttccatatatattaaatagctgagaaacacaatttgaagtaagcaatcag

SEQ ID NO: 40386 - DNA, 121 bp, Artificial Sequence
  Synthesized
  misc_feature (61): n=t or c
catgtcatgtcattgttccctcattttggaaacagagaaagagcaatacagaaggggaaanggctctcttgaagtgaccaagaggcttgagtcagaccagctgaagtacatattgcgccat

SEQ ID NO: 40387 - DNA, 121 bp, Artificial Sequence
  Synthesized
  misc_feature (61): n=t or c
gcagatgtttctaaccattaaagcaaattatacacatgctgctgggctcagtacaaggctnggggaggcaaaactcacccggcctttcatctataggggatttagtgcctaaatccatcct

SEQ ID NO: 40388 - DNA, 121 bp, Artificial Sequence
  Synthesized
  misc_feature (61): n=a or t
gctttatgcttggttgttggctgcttgtagctgcctggaatctgggaacaagtccccaganctactgtttggtggagcggaaattttcatactacaaaagaacgaaaacagaaacaacatg

SEQ ID NO: 40389 - DNA, 121 bp, Artificial Sequence
  Synthesized
  misc_feature (61): n=a or g
gagttgtggctgcacaatacagcgttcagcttctcaaagaaagaaagatgaacacgtgtcntgttcactgagctttgaaaggatgctggctctcatggaaagtagtttaagtcagtatctc

SEQ ID NO: 40390 - DNA, 121 bp, Artificial Sequence
  Synthesized
  misc_feature (61): n=a or g
gattaaaagcttctactgagcagaactcaaaacatttctgtaaattgaggatcattactangcaagtgaaatgctagtgaaggctgctgtttaacacctctatcagtgctttgaaagaaag

SEQ ID NO: 40391 - DNA, 121 bp, Artificial Sequence
  Synthesized
  misc_feature (61): n=t or c
cactgaattttacatgaacctgtcaatgtagtacgtaatgttacaattacggtgctcctcngagacttaaatcagcatgacatcgcctcctcgtttactgtaacagaaatcttttgtctaa

SEQ ID NO: 40392 - DNA, 121 bp, Artificial Sequence
  Synthesized
  misc_feature (61): n=c or g
atgaccccatcctctactcagtgatgataaggctgcacctcaagcactatgtccagttttngactccatactcccaggctgacagagttcagtaagaaggcttccaaaattgttcttggtc

SEQ ID NO: 40393 - DNA, 121 bp, Artificial Sequence
  Synthesized
  misc_feature (61): n=a or g
agaggggctcactggctgtcatgcagcatagatttctctggtattgcaaattctggaccanttattcttgcttgactcatgcaaaattcagagaaattggctgtcagagcaaaacccttct

SEQ ID NO: 40394 - DNA, 121 bp, Artificial Sequence
  Synthesized
  misc_feature (61): n=t or c
tattttacttgagcaattcattttcaatacaatatgatcacactaacagatgtacaacacngcctctttaaacaaaatcttaataacttttctaaattgtagatgaatgagggaatgagtc

SEQ ID NO: 40395 - DNA, 121 bp, Artificial Sequence
  Synthesized
  misc_feature (61): n=a or g
gacaagtaactgtagagaatatgacagctgtgcagtcatttttctaaactgtgtttgtcangagttctggtacccttttgtacagcctcagaaaaagaaaataaaaagaaaaaaatactac

SEQ ID NO: 40396 - DNA, 121 bp, Artificial Sequence
  Synthesized
  misc_feature (61): n=a or g
aaaagaaaccacttgccttctgtctgtgaagaatttagcttttgtttaagagaactgtacnttatatataagaaacaaattcttggcccatcaccagctccatatgatatataaatgtctt

SEQ ID NO: 40397 - DNA, 121 bp, Artificial Sequence
  Synthesized
  misc_feature (61): n=a or g
gtgtacaggtttttgaacatttcctataaaaatataacactttggatgactcgcttatttntcatatgttttgttgggagtgcaagattaatttcattatagttcagttctttcttacatt

SEQ ID NO: 40398 - DNA, 121 bp, Artificial Sequence
  Synthesized
  misc_feature (61): n=t or c
caactcggaacgggacgcattttgcaaaagcagagcgcagcactgcagcatgcaaagcaangcagggccaatgcaagctgaaatgcagcgctgctgcattgccctgcatggcgctgcacgg

SEQ ID NO: 40399 - DNA, 121 bp, Artificial Sequence
  Synthesized
  misc_feature (61): n=a or g
aaatagatagatagatagaaaggaaaaggaaagataggttactttactaattcttaataangtaaccatgtaagtagcacattttccacaatgatcaccactctaccactctgactggcaa

SEQ ID NO: 40400 - DNA, 121 bp, Artificial Sequence
  Synthesized
  misc_feature (61): n=a or g
gcaagtggtggttcaattcaattaaacataggtaaatgccatttagcctgaattattcccngagcccagaaatgccgtatgaagaagagagagcaaaggagaactttccaagtctcatggc

SEQ ID NO: 40401 - DNA, 121 bp, Artificial Sequence
  Synthesized
  misc_feature (61): n=a or g
gagtaaggataatacatagacacagatgcccttattcctggcagacatcttgaagacttangaaaggatatatttttctgcctttatgttttggagtgttcaatctaacaggcatcttcag

SEQ ID NO: 40402 - DNA, 121 bp, Artificial Sequence
  Synthesized
  misc_feature (61): n=c or g
caaatttcccaggacaaagttgttcatatccaggattctaggtactctgctgatgctaganaacattaccctcttccctcaaaaattatcatgagcagctttctacagaaagaacacttca

SEQ ID NO: 40403 - DNA, 121 bp, Artificial Sequence
  Synthesized
  misc_feature (61): n=t or c
ctccattgcagaaaacaagaagattggtcaagaacaatttcccttttgtaaattctgactntgtaaatgctgactatttccagttaccttgtcattcatggtgggttctcattcagaatac

SEQ ID NO: 40404 - DNA, 121 bp, Artificial Sequence
  Synthesized
  misc_feature (61): n=t or g
tttttattcagtgacacacagtgcggtagcttccttcttaaaattcatccaactccggcgntgatggacggaggacagcctcatttacatcgctagatgggccgattagggctgtgaaagc

SEQ ID NO: 40405 - DNA, 121 bp, Artificial Sequence
  Synthesized
  misc_feature (61): n=t or c
tctattcccttaatggaataaaatgatattgttgtcaacaaataaactgacagttcatctnctacaccaactgtgcaattaatgcatgtcatcgtatttactaggacaagcaaattgacaa

SEQ ID NO: 40406 - DNA, 121 bp, Artificial Sequence
  Synthesized
  misc_feature (61): n=t or c
ggttctcggtcatctaaaaatcactgtggttacaccctagccttgggacttcccagggcantcttatttctctaacctggctctgtcttgactgcaccacattttcctctcacggaagaaa

SEQ ID NO: 40407 - DNA, 121 bp, Artificial Sequence
  Synthesized
  misc_feature (61): n=a or c
gtatttagggacccggggcctgttttacctcgagaaaagcacagctacaagaactaatagnaagaggttgaattggcagcaggacctggctggcagccgataccttttagtgattgctgtg

SEQ ID NO: 40408 - DNA, 121 bp, Artificial Sequence
  Synthesized
  misc_feature (61): n=t or c
tttaccaaagcagtccaagacatctcaagatataggtccgtggaagcttaaattgactgangttgaagcctctctgttgctgtccctttgcgtgtacatttttgcagcctccttagctcta

SEQ ID NO: 40409 - DNA, 121 bp, Artificial Sequence
  Synthesized
  misc_feature (61): n=a or c
gtttctaaagtctccccacacagaaacctgacaagatgtaaatctcaagcaaggagacctncagctttcagtgtaaacacaaaactgtatcaacagtggaaaggctcacctccagttcatt

SEQ ID NO: 40410 - DNA, 121 bp, Artificial Sequence
  Synthesized
  misc_feature (61): n=t or c
ataacttaaagatgaaatgaaatgacagcatattctttagatcaaacccaaaatttgtgtnttcaaaatggagcttgcatttttactcacacacatgctaacagtgtcaggatatataagc

SEQ ID NO: 40411 - DNA, 121 bp, Artificial Sequence
  Synthesized
  misc_feature (61): n=c or g
caaccgcgtattactaactgtaagctccatcccatccagcccgccagtacatgtagcaccnccatcccatctcacctgctctgcatctccggcctgcagagcccagagccatccatcacac

SEQ ID NO: 40412 - DNA, 121 bp, Artificial Sequence
  Synthesized
  misc_feature (61): n=a or t
ccaaactgtttgtagagctgtaaatacttaatgccaaaattctcttgtaattaatggaatnctggctcttaaagtagcaggtacgaggcaaaaatatctacaaataaactagtttggaagt

SEQ ID NO: 40413 - DNA, 121 bp, Artificial Sequence
  Synthesized
  misc_feature (61): n=c or g
gaatcttatgacagaaattcctcttttgtggtagttgattaaaaaatcctatttcccaccnacaataaagcaatgctcatttaaaaccaattaaactagactaaagctgagtgttcactca

SEQ ID NO: 40414 - DNA, 121 bp, Artificial Sequence
  Synthesized
  misc_feature (61): n=t or c
gacgtcacagaagggtacaggctcttttttttttaagattaaaaatatgctaaacaaatgnttcctggccttaaaagcaaattcattttttaatgaaaatgtgaggacaatagataggagg

SEQ ID NO: 40415 - DNA, 121 bp, Artificial Sequence
  Synthesized
  misc_feature (61): n=a or c
aaactcagggggaaaagaaagggaagaagccatcatttcagctgtttttaagactctgaangtggggctgcatacagactgcagcagctccaggggtacggggtgcagcaggactgcatca

SEQ ID NO: 40416 - DNA, 121 bp, Artificial Sequence
  Synthesized
  misc_feature (61): n=t or c
aaaaaatttccacatatgagagaaatctaatatgctctttctgtgtcagaaatacagactnggttggtgtatttccggtaggcatacacaaatacgatttattatacataccattacctac

SEQ ID NO: 40417 - DNA, 121 bp, Artificial Sequence
  Synthesized
  misc_feature (61): n=a or c
aggaaggactgatgaacttttgccatatctagaaacactcatttctgtgtttctcctcagnaggtcttaaatattagcagttcatcaataaaaatatgacacaatgatctgatattgataa

SEQ ID NO: 40418 - DNA, 121 bp, Artificial Sequence
  Synthesized
  misc_feature (61): n=c or g
ggtgcaagggcacatctgattgctgatgatatacagatgagtagggcatttcactttcagntcacatttaggtctgaccatgcctacccctctctgtgctgactctgaaggctctttccct

SEQ ID NO: 40419 - DNA, 121 bp, Artificial Sequence
  Synthesized
  misc_feature (61): n=a or t
aaacctgaccttaaggacaagtttacatagttttgtgctctccggcaactgagatttactntacgtggctgtgtctgtagcatttgcaatttgcagtttggaaatctgacctcccagcacc

SEQ ID NO: 40420 - DNA, 121 bp, Artificial Sequence
  Synthesized
  misc_feature (61): n=t or c
aaaaagaaaacactcagacatttatttccagacctgcagcaaatacgttagcaatatcttntaaaaagacaaataattagttttccttacctctctaagatgtatgttttccttctccttc

SEQ ID NO: 40421 - DNA, 121 bp, Artificial Sequence
  Synthesized
  misc_feature (61): n=a or g
agctgttgcattaagtgtgtacggattgaaattccattacataacactggaccaaatctcnactcattaattgtaattaaactgtattcatcattcacttgtttcaaattgcattgtaagt

SEQ ID NO: 40422 - DNA, 121 bp, Artificial Sequence
  Synthesized
  misc_feature (61): n=a or g
tgtgtttcctaagttccatctgacttccctggactcctcaagtcctactcaattaactgtntaagtaagcagctatacattattttatttccattatcatatgtcatggttttatgatttt

SEQ ID NO: 40423 - DNA, 121 bp, Artificial Sequence
  Synthesized
  misc_feature (61): n=t or c
gaagaaggaggcctgctgctggtttcagaacccacactgacctcacagctaaaaccatatntgaagaaaatgttatatcactgaacatttacactcagctacagcccagaggccctgatca

SEQ ID NO: 40424 - DNA, 121 bp, Artificial Sequence
  Synthesized
  misc_feature (61): n=t or c
gtgaaatttgaggacttctggaacacacatcaactaatccttaaaaagagcaggttggtanaaaagacctaaaaattcttgctgtcaatgaatttttgggaaacctattaggaaaatgtta

SEQ ID NO: 40425 - DNA, 121 bp, Artificial Sequence
  Synthesized
  misc_feature (61): n=t or g
tgggtcactctcagctccatcagggtctcaacttccacctggggaaaaagctgagatcctnacattgtccccagctgcttacgttttgacatcgtgcctcctaaaccagcttagaacacaa

SEQ ID NO: 40426 - DNA, 121 bp, Artificial Sequence
  Synthesized
  misc_feature (61): n=a or g
ttaatatttctcagataacatgtttgtcatctgagaaatcattttaaataaaagaaactantggatgagatttctaggttatttcactacatttagatacatttcttctaccacagcaagc

SEQ ID NO: 40427 - DNA, 121 bp, Artificial Sequence
  Synthesized
  misc_feature (61): n=a or g
aaataaggcaacactacatgatgttaaaaaggcatttcttttgtaatagccaaagattttnttttctacccaatgaacagtcaagccactcaaagcgttgctgtcatgtttaaaacccagt

SEQ ID NO: 40428 - DNA, 121 bp, Artificial Sequence
  Synthesized
  misc_feature (61): n=c or g
tcattactgttggtgccacaaaaaagcatggaattatagatattatggcagcttcactctnatgagcaggtcttttaaaatcaagaagtttgatattcagaacccctagattctaggtgcc

SEQ ID NO: 40429 - DNA, 121 bp, Artificial Sequence
  Synthesized
  misc_feature (61): n=a or g
gtttgcagccatcttttctgtttctccataagctctcacaagagagatgggaccaaagccntatgtacacaccgggtcccaccgctcagcagctgtgtgagcccctcgttcatggagaatg

SEQ ID NO: 40430 - DNA, 121 bp, Artificial Sequence
  Synthesized
  misc_feature (61): n=t or g
aaattcagacggaatgccctctattccagtttgtgctcactacctcatgtcctgctctgangcaccaaagagcctggatctatcttcttgacactctccctttaggcatttgcagacattg

SEQ ID NO: 40431 - DNA, 121 bp, Artificial Sequence
  Synthesized
  misc_feature (61): n=a or g
ttcaaaatggaaagctgtgtaactatttctaaaaccacatttaaattgggcagattgcccnaagtactcactgactgcaatgggaatgacaaatgctcagtattcttgaaaatgagccatt

SEQ ID NO: 40432 - DNA, 121 bp, Artificial Sequence
  Synthesized
  misc_feature (61): n=a or t
ccaatgaattttagggttttcagaaagagctgtccctctcaagtttcttgcaataatactnttttttttctaattactaaattcatccctgtccacttctaatatcttctacctttttttc

SEQ ID NO: 40433 - DNA, 121 bp, Artificial Sequence
  Synthesized
  misc_feature (61): n=a or g
tgttctgccttgctgcagatggccattgaagcatattggtgaatgcacaggctcggaggtncaaattacatgtaagagcagcagaagctgctgcccacgaagacttaacagaaccagatac

SEQ ID NO: 40434 - DNA, 121 bp, Artificial Sequence
  Synthesized
  misc_feature (61): n=t or c
taaattagttgactccagtttgagttcagctagtttagttttgtgacatggctaaattacntcagtcagaatcctgtgctacttggctaatagctaaatatttgtgtccaatgcacagaca

SEQ ID NO: 40435 - DNA, 121 bp, Artificial Sequence
  Synthesized
  misc_feature (61): n=t or c
ctttttatctgtccttgatgtgcattttttttaaggggttctaattgtatgagaacccttncttatgctccatcagtgttgccacctttcccagctatgcagctagataagaccagagagg

SEQ ID NO: 40436 - DNA, 121 bp, Artificial Sequence
  Synthesized
  misc_feature (61): n=c or g
aactgaaatatccactttccacaatatattgaataaagcctttgctgcagcctaatttgcntaatttacatttactacagtgggttttagttgtgatcctgaaactgacattacaaaagga

SEQ ID NO: 40437 - DNA, 121 bp, Artificial Sequence
  Synthesized
  misc_feature (61): n=c or g
acagtttttggagggactgcgctataaaacagagcaaaaaaccctgtcatggccccggatncccctttccaagggctttcaaagaacctaggccatctccctggctcgatgtggcagccta

SEQ ID NO: 40438 - DNA, 121 bp, Artificial Sequence
  Synthesized
  misc_feature (61): n=a or t
cagagcacgcttcatgcggtcggagcggttagagagtaatgactcaaagctgctcaaaggnaggagcaaacagagttgattttcctaaggaacggggtccacctgtctgctggctggggat

SEQ ID NO: 40439 - DNA, 121 bp, Artificial Sequence
  Synthesized
  misc_feature (61): n=t or c
gttttacaaatacattaacagtaagaggaaggctggggacaacctccatcctctactggangcagtaaggaacatgaccagtttgtctgggatgtctgggatggggaacctacaatgagac

SEQ ID NO: 40440 - DNA, 121 bp, Artificial Sequence
  Synthesized
  misc_feature (61): n=a or t
aaccagattgaaggctatgagcagaaaatttgcattgctttgtatacagtaacatcttagntggataatttcataaaagaatggttagatatctggaataggatcctgttatctgtaagaa

SEQ ID NO: 40441 - DNA, 121 bp, Artificial Sequence
  Synthesized
  misc_feature (61): n=c or g
gctcctgggcacatctttggtttggttgggagagctccaggtgacatttgggctgagctgngtccaggcctgtaggacttgggaggtaaagggtgtggagctgtatgtgcagcaggatgag

SEQ ID NO: 40442 - DNA, 121 bp, Artificial Sequence
  Synthesized
  misc_feature (61): n=a or g
tcagcaaacttgctgagtttaacatctgtccttgataccaaaggtcccaccatcagctggncagcaagtgaccaatctgaaatcagttggcctgtgcccaaatttaattaaacttctctct

SEQ ID NO: 40443 - DNA, 121 bp, Artificial Sequence
  Synthesized
  misc_feature (61): n=a or g
aacagatcaaagtcttcaaaaagagagagagaaaggatgaaattgcacagaaataaaaggncccactggagaattcctccatttactctaggtttgcttcctttaacacgcttgtaaagta

SEQ ID NO: 40444 - DNA, 121 bp, Artificial Sequence
  Synthesized
  misc_feature (61): n=a or t
agaaaaacctctcccctccataacccatgcttctatttatacctccatccttttaacagcngcagtagaaaatttaagtttgggcagttgacggaatttgtcctttgctccttcatgaagg

SEQ ID NO: 40445 - DNA, 121 bp, Artificial Sequence
  Synthesized
  misc_feature (61): n=t or c
cagaaattcttcaggctcaatgaaatttcatgacctgcacctgctgtacaataaatggcanatgtatcttagaacatcattacttagtcaccataaagataacacctcacaagttagaaga

SEQ ID NO: 40446 - DNA, 121 bp, Artificial Sequence
  Synthesized
  misc_feature (61): n=t or c
atgatcatctaaaagaaccctttgataaatgtgacaattgctttaaatagaagaagcaagnggagggagagggaagcatttctgaccggactaactggggagaagtgggcatctgaaagcc

SEQ ID NO: 40447 - DNA, 121 bp, Artificial Sequence
  Synthesized
  misc_feature (61): n=a or g
gcttgagctcaggcacagcagttcacattacagacccttgcagacagaagatccagaaggnatgcctaccacagccggcaagattctgcccctcggttcatacttgtatttaccgggcagt

SEQ ID NO: 40448 - DNA, 121 bp, Artificial Sequence
  Synthesized
  misc_feature (61): n=t or g
acaaaattggttcccaaatggtcccagaatgtagacagcacggccatggctctaattgtcnctctttagaccctgtctcttcatctaaaagcctgtccttagtgtgaagatggaacacctg

SEQ ID NO: 40449 - DNA, 121 bp, Artificial Sequence
  Synthesized
  misc_feature (61): n=a or g
atgactcattggcaggattacaggagatggtatctgtttaccggagaccggtccctaaaanagccaggattattccactgcacagggccatttggaacgacacagcgctgctctgtttgtt

SEQ ID NO: 40450 - DNA, 121 bp, Artificial Sequence
  Synthesized
  misc_feature (61): n=a or g
ggcagcagaatgaattgtacagtgtttctgagctgtatctcgtccaagattttgctgccanaaagatcttgctgcagcaaatacgttttcagcaatgtgttaagagctggctttgcagtgt

SEQ ID NO: 40451 - DNA, 121 bp, Artificial Sequence
  Synthesized
  misc_feature (61): n=t or g
agttttggtacacactattgagttgcttgccagaagctgagccacttgctttcattataanctgagtatctcagtgaatttggagagtttaagtaagagtagcatcatacctaggtgagcg

SEQ ID NO: 40452 - DNA, 121 bp, Artificial Sequence
  Synthesized
  misc_feature (61): n=a or g
ggggagggcacgtgagagaaagtgttgtgtcacaagttcattgcctgtagtcatttactcntgctgagttgtttagtgcttctgtaccaaagccagtattacccagatgaccatttctagc

SEQ ID NO: 40453 - DNA, 121 bp, Artificial Sequence
  Synthesized
  misc_feature (61): n=t or c
gtttggatcctaagcagggaggcccacgttgtctgtagcatttttagggcattgggtctgntgtctctagattttttgttcaggtcccacaaggtttcagagtctctttgtcaacccctgc

SEQ ID NO: 40454 - DNA, 121 bp, Artificial Sequence
  Synthesized
  misc_feature (61): n=t or g
cctttttccttcctccagtgcctgacttctatgtccatctgggggaacaaggactcactcngagctgacctggtcacagatcatgcgcatacacacacaaactgcatatctctgcaatgca

SEQ ID NO: 40455 - DNA, 121 bp, Artificial Sequence
  Synthesized
  misc_feature (61): n=a or t
cattttgtgattctgcacatgaataacagaacaagacagtgcataaatctccattacaaanccatgctggttgcctttacccggtctctcctttgccaacagatggaaacatccatcatct

SEQ ID NO: 40456 - DNA, 121 bp, Artificial Sequence
  Synthesized
  misc_feature (61): n=t or g
ctgttacttagatgataccatagttctttatgtcatatcattgccacctgacttagaatanctgggaaatgggccctgattcgttaaaccacttaaacactctccctaagaccctttgatg

SEQ ID NO: 40457 - DNA, 121 bp, Artificial Sequence
  Synthesized
  misc_feature (61): n=t or c
taagacaaccctgcgctgagtttacttcctcactcaagttttgtaatagctggcacggaangcctgcaggcctttcatttgaagccttcacacctttttaaaaccacttctaagcactccg

SEQ ID NO: 40458 - DNA, 121 bp, Artificial Sequence
  Synthesized
  misc_feature (61): n=a or t
tcaacacaccaggaatctctggagattatctggtccctctccctcttcaaagtaataccancttcaggactccccttctttcttccggaactggggagttcagcattacctttctcaaatt

SEQ ID NO: 40459 - DNA, 121 bp, Artificial Sequence
  Synthesized
  misc_feature (61): n=t or c
atcaataaaagaatctcagaaacaccctgagcatcaccagatcatggcatggatatatttngtataaaggacactttccacatagacacagaactgagatttccagcaagtttagagaatt

SEQ ID NO: 40460 - DNA, 121 bp, Artificial Sequence
  Synthesized
  misc_feature (61): n=a or g
tagttcaggtggctgggttcagtcaggaatttttctcagaaatagcatgcagctggatatnagaaataaaactgaaacatgcatgatatttctattgtaatttcaacagaaatgcatcaat

SEQ ID NO: 40461 - DNA, 121 bp, Artificial Sequence
  Synthesized
  misc_feature (61): n=t or c
cttaatatgagtatcttggaaatcttttgagagctgttgtaaatgatacaatctggccggngcttaacttggcttttaaattttataatagtatttgttgttgttaaactctgcatgcttc

SEQ ID NO: 40462 - DNA, 121 bp, Artificial Sequence
  Synthesized
  misc_feature (61): n=t or c
gtggtagtaatatagttcttgggagtttgagtttaaaggataataaatcacataacattanacaaagatgatgtctataatgattggcctcaaatgcaagaccagagatattgtactgttt

SEQ ID NO: 40463 - DNA, 121 bp, Artificial Sequence
  Synthesized
  misc_feature (61): n=a or c
caccatgtgatgaggtaagtagcacttcatagttttcaaagaacgagaaaaagtttatttnatgttataacaactcttcttcagtaatgtgttctttccatattacagtaaaatataatct

SEQ ID NO: 40464 - DNA, 121 bp, Artificial Sequence
  Synthesized
  misc_feature (61): n=t or c
tcatggccaagcacgtcctatgcatgggggctgacctcatgcgagctgctgcagttctttntcgtttgaggattttttgtggggttttcatttttttctttctttttcaggcctttaaaac

SEQ ID NO: 40465 - DNA, 121 bp, Artificial Sequence
  Synthesized
  misc_feature (61): n=c or g
aggggagtgcacagtcctgagaacatacagagaagatgtagagaagttcaaatcatatcangtatgttatgcttatacgttaacagcaagttctgtgtgttgactgagagacgcttctgtg

SEQ ID NO: 40466 - DNA, 121 bp, Artificial Sequence
  Synthesized
  misc_feature (61): n=a or t
cagttggatagtaatcaaaacaaataatcagctatcattacagccataattttaggatttnctcattcacctcaaactgccatttcattgtttgcatttctgttgcaaaagattgcttcac

SEQ ID NO: 40467 - DNA, 121 bp, Artificial Sequence
  Synthesized
  misc_feature (61): n=a or c
acctactggtattgattcttcagacagttaacatatccagaatctctattgggtacacgangtttgggcataatgaaccacttgctcctttttttttctaaaaagaaggatccagcttttg

SEQ ID NO: 40468 - DNA, 121 bp, Artificial Sequence
  Synthesized
  misc_feature (61): n=a or g
cggatttgcactatgacactgatgccacgtgcactcagtaacaaaccctcctgcagaggcntggtcacacaaggccacaagtaagtctcactgctacctgggccactttaaagccacaggc

SEQ ID NO: 40469 - DNA, 121 bp, Artificial Sequence
  Synthesized
  misc_feature (61): n=t or g
cactagacccagtatttagagtacatttgctctcacatatttatgagaacctggatgtctntctctctctcctttaagcatttatgggattcacatttaaggcagagaaatatccaaactg

SEQ ID NO: 40470 - DNA, 121 bp, Artificial Sequence
  Synthesized
  misc_feature (61): n=c or g
ccagaggaggatatttacagtgctgcatcttattttctcctccgttctgtcacaattttcnacaaaggaatgagaatttttaagctatcagctcaaactgttgttaattgaatggcctgca

SEQ ID NO: 40471 - DNA, 121 bp, Artificial Sequence
  Synthesized
  misc_feature (61): n=a or g
aataatccctcagaaagcccacctaaattgttcactacctaaatatctttccaaatctgcntcacgatccctaaattcatttgaggagatgccgacgtggtcattctcacagctgcacatg

SEQ ID NO: 40472 - DNA, 121 bp, Artificial Sequence
  Synthesized
  misc_feature (61): n=a or g
caacttagcaattagcagtggaaggtgcataaatgatgaaaatgttcttattacattctanttagtaggcatttgagaatacaagtgcagccactctgctggctaatacagtgacagcagg

SEQ ID NO: 40473 - DNA, 121 bp, Artificial Sequence
  Synthesized
  misc_feature (61): n=t or c
agactgtatttgcaaaaagtaactggatgaggatacagtgagtaaaagtgcagaaacatancccctgatatcgctgtagtgttttgtggcagctgcacgcctgggcttaatgagactagct

SEQ ID NO: 40474 - DNA, 121 bp, Artificial Sequence
  Synthesized
  misc_feature (61): n=t or c
cctctcctattaccatatatgtaacaactggatttggcatgacagaatattcaccagaatngcagtaaaaatcttggaagatggtacaggacagcaactaccatcatagagcaggtcagct

SEQ ID NO: 40475 - DNA, 121 bp, Artificial Sequence
  Synthesized
  misc_feature (61): n=c or g
gcacattcactgccactatgcagaagctggaattattaaacatagcactgctgtcccctancagttgcaaagaatttaaaatgacacactgctggagttattacaatgggaacatcctggg

SEQ ID NO: 40476 - DNA, 121 bp, Artificial Sequence
  Synthesized
  misc_feature (61): n=a or g
tatgtgcatttcgttagcaaagaggggatactacaatggaaaggaccaggaggagacttcngtagtttccttaatttcttttctggatgactgttgctagaaatagtgtgattacagggta

SEQ ID NO: 40477 - DNA, 121 bp, Artificial Sequence
  Synthesized
  misc_feature (61): n=t or c
tagcatattttcaaagattttctgttttactaagtcttccatgcaattctgaccacaaatngtatctttatttatgccctctctcttttcagtttttacaaaactctcttgaaaccactat

SEQ ID NO: 40478 - DNA, 121 bp, Artificial Sequence
  Synthesized
  misc_feature (61): n=t or c
caggctcacaagttctgttctgttcagcctgtgtgctgtaagggtctatcacaacttagtngctgcctgaaaaatgtcattttagcagggctatggactgtggaagtgttcaataggcacc

SEQ ID NO: 40479 - DNA, 121 bp, Artificial Sequence
  Synthesized
  misc_feature (61): n=t or c
acgtaagcacatgaagagataaagtgcaactgataaattttaaaaactagttttactattntgagatttaaacaattagagctaactgtggaacttagcactacctcttggtaatacgctt

SEQ ID NO: 40480 - DNA, 121 bp, Artificial Sequence
  Synthesized
  misc_feature (61): n=t or c
gctctctctgtcatttttcctaccagctggctgccacatctgccaatctaaagctgacccngattcttgttaacaccctatagctgtcaggctcggtgacaggcagcacacccgctgctgg

SEQ ID NO: 40481 - DNA, 121 bp, Artificial Sequence
  Synthesized
  misc_feature (61): n=a or g
tttaaagagaaacttttctgaagaaaaacactcacacaccctgaaatgcaaaaacaaaccntaccaaaataagacattcgtctgttcacttctcagaaagaagctgagagaacatatgaca

SEQ ID NO: 40482 - DNA, 121 bp, Artificial Sequence
  Synthesized
  misc_feature (61): n=c or g
tgactcacaaatcctgacatgactcaaagtgtatcagttgtgccatttggtatctgtgganaatctagtacaattaaaccatacagtaagtcagagagatgtgagaaaccaactgaagttt

SEQ ID NO: 40483 - DNA, 121 bp, Artificial Sequence
  Synthesized
  misc_feature (61): n=a or g
aaacattaaggaagtcttacgtgaataataataatgataaatattttccttaggataaacnaaactgttttcagtataccggattgcctaagaatattttgtagccattcacttatgcaag

SEQ ID NO: 40484 - DNA, 121 bp, Artificial Sequence
  Synthesized
  misc_feature (61): n=c or g
aacacagatgtagagacaaactggggatgctctcctgcaggacagccctcattaacactgncacagcccggagactcgaatttgcaatgtgtgaagggaactgtgcctccaaacacccgtc

SEQ ID NO: 40485 - DNA, 121 bp, Artificial Sequence
  Synthesized
  misc_feature (61): n=a or c
tgaagattacagagataaagcaactgttgggcagtctgcagtcccacatggtacgtggcancactgtgttggcaggtaacaaacttcttcaatatgggaatttgaagcatcatgctaaggt

SEQ ID NO: 40486 - DNA, 121 bp, Artificial Sequence
  Synthesized
  misc_feature (61): n=t or c
cttggtatgctgcagattttaaaagatcccttagtaaaaatatgacatatactttacattngaaagacagtgggagcactttctttactgaaataatagcacagagtcaaacagcagccaa

SEQ ID NO: 40487 - DNA, 121 bp, Artificial Sequence
  Synthesized
  misc_feature (61): n=a or t
ggaataaagtgtaaaattaaaaacagatttaacttcaggttaaattttcaacatgtcattntacagaggagcaatagttataggaataatgagaagtgcaaggcaacacaggactcaattt

SEQ ID NO: 40488 - DNA, 121 bp, Artificial Sequence
  Synthesized
  misc_feature (61): n=a or g
atatttggacttttatttatatcagcaagatgaagccttcagaagacttcataggtaggangggactcttatggcatttgattcttaatcacagtccaaataaacatgcaatgtccagaca

SEQ ID NO: 40489 - DNA, 121 bp, Artificial Sequence
  Synthesized
  misc_feature (61): n=t or g
cccgtggtgcacaggaagctggaactggggtttggatcctcttcctcggttctgggtctgngttggatgcttctttctgccgcccatctataccatctgcagttctcggggccgttgcact

SEQ ID NO: 40490 - DNA, 121 bp, Artificial Sequence
  Synthesized
  misc_feature (61): n=a or g
gtgtcttttccttggtccgtgtgggcactgacttatctctgggctcttggtagactcttgntagctgggccctgagagcagaaaccgccttgctcctgcctgctgctcctgatgctgtccc

SEQ ID NO: 40491 - DNA, 121 bp, Artificial Sequence
  Synthesized
  misc_feature (61): n=t or g
ttacaaaaatatttatctttcccatctcattgtctttatgccaggaaatcaaaagaaaaanaagtttatacatttaatcttgaactttttcccacttctaatattacaagctgaaaatctg

SEQ ID NO: 40492 - DNA, 121 bp, Artificial Sequence
  Synthesized
  misc_feature (61): n=t or c
tacatttgtctcatgaaactgagaaagtggtgggtttagagatgctgtgttttgcttcatntctttctaatagatgactttggctgtttttaggtttctacttggatggaacagctttaat

SEQ ID NO: 40493 - DNA, 121 bp, Artificial Sequence
  Synthesized
  misc_feature (61): n=a or g
cctcacagaaagggccagaaccctctgctttcagtggtggccatgcacattctgtgccccngggaggctgtatgaactgcactgtgcagaaaataatgcagtcagagttcatctgcacact

SEQ ID NO: 40494 - DNA, 121 bp, Artificial Sequence
  Synthesized
  misc_feature (61): n=a or g
caaatcagttttgatgtggtcagagtattctcaaggctggtgatgtgttgtaaggacagcngcatctcaactggaaggggggctgcttatgtcgtgacacacaaaaacagcccacaagaat

SEQ ID NO: 40495 - DNA, 121 bp, Artificial Sequence
  Synthesized
  misc_feature (61): n=t or c
tagagctaaactctttgtgaagtggctttgtgttgcaaagtttttgcagcttgtgggagtntgctgcacttcattttggttgatggtattttatgctgctggtttcagcaattagaacaca

SEQ ID NO: 40496 - DNA, 121 bp, Artificial Sequence
  Synthesized
  misc_feature (61): n=t or c
ttgcctttcctctgtttaaattggtacaaaaatataattagcatctcactaggatcacctntgaggttcccaagagaacctcatttattatatttgacataaatctagaacatcaaagacg

SEQ ID NO: 40497 - DNA, 121 bp, Artificial Sequence
  Synthesized
  misc_feature (61): n=a or g
tttgagaggattcaactctcacctcgtctgttttttttggctggcagagttatgagcttanctggaatagcagcattgcaaagtgtcatctttactatagaaaggctttttataaagaggg

SEQ ID NO: 40498 - DNA, 121 bp, Artificial Sequence
  Synthesized
  misc_feature (61): n=a or g
ccagcattatttttgaaacattattagctctaatactctgcaaaagacaccacaaatggcntgctgtgaatgaagattaaaaaggctgaactcagaatttgattataaagttaatgttggg

SEQ ID NO: 40499 - DNA, 121 bp, Artificial Sequence
  Synthesized
  misc_feature (61): n=a or g
tttgttgggtcttttggacaaaaaattgcaaataaaggaagatttttaatacgtataaaantgctcattagactgtcttcatcaggagacagaatagttgcagcaatcagtactcagggac

SEQ ID NO: 40500 - DNA, 121 bp, Artificial Sequence
  Synthesized
  misc_feature (61): n=a or g
caatttacacagggattggctgagaggcagcacggaggccttgagcccacacaagaatcancgttgatcttaggaaggtacccccactccactaatagccactaatagctatctctaattg

SEQ ID NO: 40501 - DNA, 121 bp, Artificial Sequence
  Synthesized
  misc_feature (61): n=a or t
cttcatacagtagtagttacagagagaggtgaactcttcatggtaaagttaaaatggtttnattgcaattgctaaatgttttcaaaggaaacatgaatttttaagtatgatatagcaagaa

SEQ ID NO: 40502 - DNA, 121 bp, Artificial Sequence
  Synthesized
  misc_feature (61): n=t or c
aaccatcagcagagaatgttagctcttatctgtgtacatccagaggaaataggaagtagancagatactttgaatctggtctctggcagtgcttcactcttcttatctttgtgccaatgtc

SEQ ID NO: 40503 - DNA, 121 bp, Artificial Sequence
  Synthesized
  misc_feature (61): n=t or c
gtggagtatattcccttttctgtgagataatcttctgggggcatatggcccggatgtcacngccactcaagaaaacttctttcttgagaaaaagacaaggaatatccagcaaggtcagtga

SEQ ID NO: 40504 - DNA, 121 bp, Artificial Sequence
  Synthesized
  misc_feature (61): n=a or c
tttgcccttttcataacttttcttgtagctcagctcacctttcggtccacctgatgccatnagctctgcctgtcatcaagagacgctgaagtatatgggagcttccccttgctgcccccat

SEQ ID NO: 40505 - DNA, 121 bp, Artificial Sequence
  Synthesized
  misc_feature (61): n=t or c
agatgtacaggtcaccttaaaatgactaggaagacctgaactgttttttccagttctcacntattcttacaaaaaatgctctttaatatgattaggaaacaaaacccccaaaagaagatat

SEQ ID NO: 40506 - DNA, 121 bp, Artificial Sequence
  Synthesized
  misc_feature (61): n=a or g
tatcaattaaacagatttgagatccgagtgctgatgtgtgggaccgtacgttgtcacacgnttatgggttcgtgccctcctgttgtatggctgtttatagggctgtgggcagggtgcttgt

SEQ ID NO: 40507 - DNA, 121 bp, Artificial Sequence
  Synthesized
  misc_feature (61): n=a or g
ctcaaaaataaaaattaaaagcaatttagctgcacattgatcaggacacagatgcaatganctggacaaatggtgctgacctgctggcatggtgtggatgtgggtttgtgtaagcaggagc

SEQ ID NO: 40508 - DNA, 121 bp, Artificial Sequence
  Synthesized
  misc_feature (61): n=a or g
atgctattaatttgaatgtatgaaaacataaatgcctaaatttcttcaagaagaacttacngagattggcccagcccttcaggagaatgtagcagacatcccattcctgtcacgtgaattt

SEQ ID NO: 40509 - DNA, 121 bp, Artificial Sequence
  Synthesized
  misc_feature (61): n=t or c
ctagatttacttttcacaattctgttttaaactgtttcatgctgcaagctgacaaaatganttttgcaagtatacatatgcaactaaaattaagtatcatctgaactgggattagaacgta

SEQ ID NO: 40510 - DNA, 121 bp, Artificial Sequence
  Synthesized
  misc_feature (61): n=a or t
gcattatcaaatctcaagtgcctcccaattttgtagatcctgaaacagctattagacattncagcctaacagattcaagcgctgagtaattcctctgcaggcacagatgtcagtctgagtt

SEQ ID NO: 40511 - DNA, 121 bp, Artificial Sequence
  Synthesized
  misc_feature (61): n=a or g
gtcctgcttcctgcacccagcgtcacagcaatccatctgcatcatctgttgctacagctgnaacagaatgcagtcagcagcatttgaattgctggaaatacttgagcctagttaatatcct

SEQ ID NO: 40512 - DNA, 121 bp, Artificial Sequence
  Synthesized
  misc_feature (61): n=c or g
tttgttattgctgcaagtggattgtggcgctgactcgcggtgcccatgaagctgatggcantgtgtgtgtcctctgattggattaagttgtggatttacagtttcattcggggaaacaata

SEQ ID NO: 40513 - DNA, 121 bp, Artificial Sequence
  Synthesized
  misc_feature (61): n=a or c
gtctgttctggcatctgttctatggctcctgaagtacgctttatgcatttatttaaaatgntccagaatgccataatgttgtaagattaaagacatttacgagaaagatgttagatccttc

SEQ ID NO: 40514 - DNA, 121 bp, Artificial Sequence
  Synthesized
  misc_feature (61): n=t or c
aataaaacacccagaggaagaaaaagtatgtatgttctaaatgcaaatatgttggtaatanatgtcataagtctttttaatactgagtacatacacagaagcaaaattccaaacatttaat

SEQ ID NO: 40515 - DNA, 121 bp, Artificial Sequence
  Synthesized
  misc_feature (61): n=t or c
aggaaggtataattctactggtgtcaaaaatgctctgtcagttcatgccagctgagactcngctccccatattttaccttttatgtgtattttatgttgcatcttcatccccagcttccct

SEQ ID NO: 40516 - DNA, 121 bp, Artificial Sequence
  Synthesized
  misc_feature (61): n=a or g
gactcatttgcaaataggttgcactgatggcaggcttcataagcttgtgttgttactgttngcttggcttgagcctagctctgtcgctaggtggagctgcaaaccgatgtccatcttaact

SEQ ID NO: 40517 - DNA, 121 bp, Artificial Sequence
  Synthesized
  misc_feature (61): n=t or c
agagtgtgcctggtcacttagaaactgatgtcaggagcactgtgtatgtgaacgccacaanggagacaatacagaaatcgaattacatcttcataaacattgtgtgttgtggtatagttaa

SEQ ID NO: 40518 - DNA, 121 bp, Artificial Sequence
  Synthesized
  misc_feature (61): n=t or c
aggcagggcgcgtcagagaacatgaacccttgtgctctaatgggaactgttggagaggttngaatgaaattgtatcatgcaggaggtgctatgcagaaagaacacagggggacagattcat

SEQ ID NO: 40519 - DNA, 121 bp, Artificial Sequence
  Synthesized
  misc_feature (61): n=a or g
gatgctccaaggaagatatttgaggcagctgtgtaagcagctgagtttaccttaaaggganatcttcccatctcctggagtgtggcatacagtttgtaatagtgggatggattggacaatg

SEQ ID NO: 40520 - DNA, 121 bp, Artificial Sequence
  Synthesized
  misc_feature (61): n=c or g
tttactggacagcagttcagaggttatcaccattgcctcccacgttgttctccattgctgnagtgctgccatttctctaattctcgcagttgctttcttagtcaccacagatgtcagaaca

SEQ ID NO: 40521 - DNA, 121 bp, Artificial Sequence
  Synthesized
  misc_feature (61): n=a or g
cactgcctgggcagtgtcactgcggggtgagatttgtgacatcagtaacacagaaaaggcncggggctgcctcatgttgaagtgtttagtttaaaaatacaacaacgcattccctgctgta

SEQ ID NO: 40522 - DNA, 121 bp, Artificial Sequence
  Synthesized
  misc_feature (61): n=a or g
actagatgtagagcagctaggagcacatattcaggtatatatatgtacagaaatgtacgcnttaagttggcacatttgataaatcacgtcatgaagattggttttgagaatgaaatgacag

SEQ ID NO: 40523 - DNA, 121 bp, Artificial Sequence
  Synthesized
  misc_feature (61): n=a or t
tatttaagaatcagcaagatgttattacagtgttagcaagaataaacattttaagaaaaantgcagaaatttctatacattattcatgtctgacttagaaaggtccacataggctataatt

SEQ ID NO: 40524 - DNA, 121 bp, Artificial Sequence
  Synthesized
  misc_feature (61): n=a or g
tacagctgactctcaataactataggtttacacacaacagttgaagtacctataaaaaganaagtaaaagacagggttagcatcactttttggggggggatcagctgttgcagtgttattt

SEQ ID NO: 40525 - DNA, 121 bp, Artificial Sequence
  Synthesized
  misc_feature (61): n=t or c
caagaaatacgtatgcataagtgttacgttgggttgtatatgcatttccaggtccctgggnatcctgctattctgcaactgaagaatttaccacagaattcaacttcttgctaagttctaa

SEQ ID NO: 40526 - DNA, 121 bp, Artificial Sequence
  Synthesized
  misc_feature (61): n=t or c
agacaatctgatttcatttacactgtttccttacctgataaataagtttgttcagctgganttgagattacattacagacaaagaagtaatctgtatagatactggagaacttcctgaagg

SEQ ID NO: 40527 - DNA, 121 bp, Artificial Sequence
  Synthesized
  misc_feature (61): n=t or g
tatctattttaataatatttggtgtgaatttgattatgctttcttacaggcaaaatacttncactgatttattacttaaggaaggaggtgaaagtattttcctctcttgttaagagtgttt

SEQ ID NO: 40528 - DNA, 121 bp, Artificial Sequence
  Synthesized
  misc_feature (61): n=t or c
taggatttaaaaaagttgttaggcattttattatttgcgtcatttgtcttgcctttctganagtttatgctatgctatccgtttgccccaacagtaatgaatctatacaagatcaagtttg

SEQ ID NO: 40529 - DNA, 121 bp, Artificial Sequence
  Synthesized
  misc_feature (61): n=a or g
tttcatactgcccttaagctagtcctagacattgcctaaaaggaaggttgtttcggcttcnacccatcctgtagaggattaccagcatttgtgaaatgaaagaaacaaacacgatcctaac

SEQ ID NO: 40530 - DNA, 121 bp, Artificial Sequence
  Synthesized
  misc_feature (61): n=t or c
ccaaacccttcatgatctccatagcccttcctcagatgctctcaagcacttttatgtcctnctcatattgcagtgcccaaaccagcacccggtgctggatatgaggctacaaagcacagag

SEQ ID NO: 40531 - DNA, 121 bp, Artificial Sequence
  Synthesized
  misc_feature (61): n=t or c
tctttgatctccaatgaaggctaatcattatgactgtcattctcaggagaaataacaaganatgggccagagaggttaatatctgatgtgtctgagtgactctggacagcagatattaaat

SEQ ID NO: 40532 - DNA, 121 bp, Artificial Sequence
  Synthesized
  misc_feature (61): n=t or c
atggggactccaatttaatttttacctccccccgccaaaccctgagtctgccaaagggaangctcattttggcagctaaggtctcccaaaagaaaagttgtagccaaagtgctggaggtgg

SEQ ID NO: 40533 - DNA, 121 bp, Artificial Sequence
  Synthesized
  misc_feature (61): n=t or c
ccggcccatccagtcctcccatagcctcaatttgcacagaacgaagcaaaatactttgagntgcgccagtgccgggtgttattaattccttggagtgagcaagagcgctggggttcctgcg

SEQ ID NO: 40534 - DNA, 121 bp, Artificial Sequence
  Synthesized
  misc_feature (61): n=a or g
ccttcaactattttgctgactcttaattggtgcaatctactgttagctgtggtcagaaacncgaccttcagctactatccaggtatctatttctgaccactttgcacttaagtacgtactt

SEQ ID NO: 40535 - DNA, 121 bp, Artificial Sequence
  Synthesized
  misc_feature (61): n=a or g
tttctctttcatcttttcgatcaatatttttgtttcttcttgttttttaatagcagaaatntttcagaaaagcaagacctaagtagaagcatctactcaggacacacaataagagaacaca

SEQ ID NO: 40536 - DNA, 121 bp, Artificial Sequence
  Synthesized
  misc_feature (61): n=a or g
tatttacaagtctccatcactgggcctccaagtagctgtcagagctggcgcttcctagacntggtcaggggaatggtgttgtattcaacatgcagcacgtatggtacatttgcagatggag

SEQ ID NO: 40537 - DNA, 121 bp, Artificial Sequence
  Synthesized
  misc_feature (61): n=t or c
taatgtcatgaaagggttcttctgctcatgcaggagaggatgatatcacatactctgccantactattattccatcagctgggagtcaaaacatgagtcaagtcccatggagcccatggca

SEQ ID NO: 40538 - DNA, 121 bp, Artificial Sequence
  Synthesized
  misc_feature (61): n=a or g
actcttagcatggggaagttaagtgcctcagctgccctcctccttcaaggacttggtgtcncttggctctgcataggaaactgaagcagcctccagcttacagccctcttctgcaaaggag

SEQ ID NO: 40539 - DNA, 121 bp, Artificial Sequence
  Synthesized
  misc_feature (61): n=a or c
gagagctttgtagggtggagatgtagatgtaaaaagggaacatcctccctgggggaagaantggtgggcagaaaatacagtgctgtgagcagacagtgtatgtgagcgcagtgagacagtg

SEQ ID NO: 40540 - DNA, 121 bp, Artificial Sequence
  Synthesized
  misc_feature (61): n=t or g
taaatagtgtccggatgttagcgatgattcataaaagcaattaaaaaaggaaagtgccttnctgctgggcgtaatgtcttgaagatgtccttaagagtgtgtaatgctgcagacagtggtc

SEQ ID NO: 40541 - DNA, 121 bp, Artificial Sequence
  Synthesized
  misc_feature (61): n=a or g
tttgaaacttaggaaaaaaattgccaaggaaaagttcaactttcctgaccatattttgcanctgcattttgctccaaaaacacatttttgtttagttagattatatgctccttgccagcac

SEQ ID NO: 40542 - DNA, 121 bp, Artificial Sequence
  Synthesized
  misc_feature (61): n=a or g
gaagggaccaggtcctcaagaggctgctctcaaaggtcctccaggtattggcacgtgctcncctgtcaccaccccagcattcatacagagtgtgaggtactggacccagctccttacaagc

SEQ ID NO: 40543 - DNA, 121 bp, Artificial Sequence
  Synthesized
  misc_feature (61): n=c or g
tacctccgggaggactttcctatttgtacgtgttgctgttgcctgagatgtgtgtggaatnagaccaccaaccactctgaaaggtcaaatacctccctagtccataaagcagaacagcttt

SEQ ID NO: 40544 - DNA, 121 bp, Artificial Sequence
  Synthesized
  misc_feature (61): n=a or g
gcactgttcttttgcacccaagtactattttcctcatttatatccagagattttctctcanacatcaaattttagttaacactatgactgaagagatcagaaatatacgaagggataaaga

SEQ ID NO: 40545 - DNA, 121 bp, Artificial Sequence
  Synthesized
  misc_feature (61): n=a or g
agtaacttggtgtggactctttattctggttcctgctaacctactttagtaacggagcaangagagcagtgcactgactgttataataagcctggatttagcagctgctgaaggcctagag

SEQ ID NO: 40546 - DNA, 121 bp, Artificial Sequence
  Synthesized
  misc_feature (61): n=t or c
tctgtgaacacatagtattcctgatttgtcagctttgtaatggcccagcaagtcctccctngtaggtgataaaggcattggacagagtattgcctgctggctccctaaaacctccatctct

SEQ ID NO: 40547 - DNA, 121 bp, Artificial Sequence
  Synthesized
  misc_feature (61): n=a or g
tcactgcccccacagcaaatgtcatcacttcatcagcgtgccatcaaacagatgaaggacncacgcactcccacaggaacatgtttgctcatcagtgaggaacttctctgaccacccgtcc

SEQ ID NO: 40548 - DNA, 121 bp, Artificial Sequence
  Synthesized
  misc_feature (61): n=a or g
cctgagacacaggagggaggaaagcccaggggaggcagcaccaaaacatgccaggagcacngcagatgcatggccccaaagcacatcatacagatggccagcactgcatccagttctacac

SEQ ID NO: 40549 - DNA, 121 bp, Artificial Sequence
  Synthesized
  misc_feature (61): n=a or t
gggtagcaatgtatgaagcttgagctcatgctgtacttaacttccacaaaagtgcactaancattttcaaatgcactatctgcagtaaactgccactgtaagaaagtggaatctaaatata

SEQ ID NO: 40550 - DNA, 121 bp, Artificial Sequence
  Synthesized
  misc_feature (61): n=t or c
tatatgaaaaaaggtcacagataacggcaatgtacactaaagaccacatcactgctcttanggtttttctccagccagattttaggataaacagaaccagaaatttcactctaattaaaca

SEQ ID NO: 40551 - DNA, 121 bp, Artificial Sequence
  Synthesized
  misc_feature (61): n=t or c
ttgtgtgcagccctctgtacatatggctgggctgaactttccctcagtttcaaatgtcccngtgtaacgcaggcaaaatgggaggaaggaccatttgtctcttttttttgagagtctttat

SEQ ID NO: 40552 - DNA, 121 bp, Artificial Sequence
  Synthesized
  misc_feature (61): n=a or c
caaagcagtgtaacagagtgcaggttaatcaatttgaaggagatctgaacaatttccaaanagaatagttttcatattttcttctccattaaaggaggaaggaagccattcagcatttcat

SEQ ID NO: 40553 - DNA, 121 bp, Artificial Sequence
  Synthesized
  misc_feature (61): n=a or g
tgaaaaaaaaaaaaatcttttcccttctttgctgctgcttccaggctggaagccttccaanatgcttcaacacttgctcttttataatgccaggaaacaacaaaaacctcagtttctcctc

SEQ ID NO: 40554 - DNA, 121 bp, Artificial Sequence
  Synthesized
  misc_feature (61): n=a or g
ccaatgatggttttttatctcccttccataagcactgaagggagaagttataatgccattntagcaatagcagagaagttataatgccattctgcatgctttctgacggcacttctgtggc

SEQ ID NO: 40555 - DNA, 121 bp, Artificial Sequence
  Synthesized
  misc_feature (61): n=a or g
accacttattggtgatcttcctgctgacatggagtttggggaggatctcctgggctcccanacggcttctacccaggaagcttcggttcttcggcccccagactgggatcagtccaagcaa

SEQ ID NO: 40556 - DNA, 121 bp, Artificial Sequence
  Synthesized
  misc_feature (61): n=a or g
tgtatagctttaggtactgtttagtcatattgagccattgaggggaaaaaagcaagaattnttattatagaagtgattaaatgtgacaaagaactactgtaagccaaagtatgtaatgtaa

SEQ ID NO: 40557 - DNA, 121 bp, Artificial Sequence
  Synthesized
  misc_feature (61): n=t or c
attcctgtatccataatgtcttacagagcagagagacctcacatttgtagggatcccatcntttgtgagaccaggtgacacaaaagtggactagattttaggcacacaaaactgtgtgcta

SEQ ID NO: 40558 - DNA, 121 bp, Artificial Sequence
  Synthesized
  misc_feature (61): n=t or g
attcttgctgtccttggtcagaacgtgtgagacacaagactaaggttcaaatcacgaaganaacacttattcctttttatttacagcattaactctcttgtgccacccagctgctttgaca

SEQ ID NO: 40559 - DNA, 121 bp, Artificial Sequence
  Synthesized
  misc_feature (61): n=t or g
tgtacatgtagaagatgtaaaagatttacatcctgtgtgatggtgagaggaaggacatatntcatacatatatactaacttcctaattacactcagtccttgctaagactgatgtaatagg

SEQ ID NO: 40560 - DNA, 121 bp, Artificial Sequence
  Synthesized
  misc_feature (61): n=t or c
ccagtagccccattcctggaaatgaatctgtgcattccacaaagccagtgacaatgggagntgctgttgggccgcagaggaggtgcccagtggtgtggtgcagccccatggttgctctggg

SEQ ID NO: 40561 - DNA, 121 bp, Artificial Sequence
  Synthesized
  misc_feature (61): n=a or g
ttcaaaagcacaaaattgaagcttggcactagtcacagcttgaatattttctttgtttcgntatttttatctgctgttttgctgaactttctaaattgaaaattaaatataaaaataaatg

SEQ ID NO: 40562 - DNA, 121 bp, Artificial Sequence
  Synthesized
  misc_feature (61): n=t or g
tggcctctgaacttgcattgcttgatctgacatattctgtcactggcaccatgataatcanaattgccttacttggcctctagggctctggccacaatgactacaaatgatgaagggacac

SEQ ID NO: 40563 - DNA, 121 bp, Artificial Sequence
  Synthesized
  misc_feature (61): n=t or c
cctccatgagggagcagggataatccatcattcaattttggaggaagaagttaaccacagngatgtccccagactcgtctagggaataaagctcttttgtcctgacctaatttctcagcct

SEQ ID NO: 40564 - DNA, 121 bp, Artificial Sequence
  Synthesized
  misc_feature (61): n=t or c
tggcccagggttcctcaaacttgttcctttatcatatgttatctaatacacacatttttantttatgtcatcgttttaaattgtgctaaaaaaaaagcgtggctctcattgtttgctctaa

SEQ ID NO: 40565 - DNA, 121 bp, Artificial Sequence
  Synthesized
  misc_feature (61): n=t or c
accgcagaatggcctcaggcatacagaaaagcgagaaaacaaacacccttacgtttcaggngccttgggatggatctaaaaggctcccctgacaccaaagcccaagaacaccaagtaagcc

SEQ ID NO: 40566 - DNA, 121 bp, Artificial Sequence
  Synthesized
  misc_feature (61): n=a or g
tataacatgctgaaaggccacgatagaagcagatgaagctcctgttcgagctgggcactcnggttcttgttgttgtgcaggagtgagagctgctgtccttgagccttgctttatgcagtag

SEQ ID NO: 40567 - DNA, 121 bp, Artificial Sequence
  Synthesized
  misc_feature (61): n=a or g
cctgtgaaagagctgaagtgcacatcctactctgtaaaatgccagcgttcatgaaatcagngcatcagtcacatccagaaggtgtagctgtctttcatcacaatacggcacacaagaataa

SEQ ID NO: 40568 - DNA, 121 bp, Artificial Sequence
  Synthesized
  misc_feature (61): n=a or g
cagctttttgtgtaggacagaggaacagcttcacaaaatgaggatcattcatttcactttngaaaataatccttttgtattttgtttctgtaaaaacaggctgcacatgccttctaaacct

SEQ ID NO: 40569 - DNA, 121 bp, Artificial Sequence
  Synthesized
  misc_feature (61): n=a or t
actccacagttgcttgctcactcagacctgcagcaagaaacatgaatgcaggtagagaacnggaaaggaccgagacagagaaatcaggcatggtccttgttattcttgttttcctttcttt

SEQ ID NO: 40570 - DNA, 121 bp, Artificial Sequence
  Synthesized
  misc_feature (61): n=a or g
aaacagaaaataggggaaaaaaaaacaactgtgaactggaaatccaaatgatcttctgagnaaagaggtagaaaacaagtatttctcattggacttccaatttccataaaatccaaagatc

SEQ ID NO: 40571 - DNA, 121 bp, Artificial Sequence
  Synthesized
  misc_feature (61): n=a or g
tttttgaaatacagaattcttttgtgcctcattgtactgccaagccttttccctataaatntgatagggactgcaaaactagtttatcatatctaaatatcataaccagaattgtttcctt

SEQ ID NO: 40572 - DNA, 121 bp, Artificial Sequence
  Synthesized
  misc_feature (61): n=t or c
aacaaacagttttgtgaagatatcagtgatcagagaaggcttggaggttttctttgcccantttgcacagatatttgtaaaaaaaagcccaaatgtattcttatcctggcatttaaaagcg

SEQ ID NO: 40573 - DNA, 121 bp, Artificial Sequence
  Synthesized
  misc_feature (61): n=a or t
agcactataaagtaaggagattattcattaaacaataaaaagcagggtaggtaatttgtgntagtgttagctcttcattaatttttattctagtaaaaaaaaaaaaaaaaagaagtttatg

SEQ ID NO: 40574 - DNA, 121 bp, Artificial Sequence
  Synthesized
  misc_feature (61): n=a or g
ggctttgcattagtggataaacactcagtctccctctcaagagacgttaaagcttgaatcngcactattaagcatctgaacaacggagaagtgaccatttgaggaaaagatattatgaact

SEQ ID NO: 40575 - DNA, 121 bp, Artificial Sequence
  Synthesized
  misc_feature (61): n=a or g
agatgcagcttttcattatgtaacttcatggtatttttccatgctgtagaatatcctgtanggtgggttttatatcaaaatcattatgtacaatgtacacatactgcatctccacattcta

SEQ ID NO: 40576 - DNA, 121 bp, Artificial Sequence
  Synthesized
  misc_feature (61): n=a or g
cacggtgggcagaggaatagcacaggtgtgagcaagccccagatttttatagtgacatcanaacgtactccatttctttatatgttttctaaagcccaactttttaagttaagtgcaccct

SEQ ID NO: 40577 - DNA, 121 bp, Artificial Sequence
  Synthesized
  misc_feature (61): n=a or g
aagactacttactgcacagctttcactgttgtcttctctgtgaggtacaatgaaagataangcatcaagagatccttcacacttcaaaggagtttcagaagtatttttacaagtagtcagc

SEQ ID NO: 40578 - DNA, 121 bp, Artificial Sequence
  Synthesized
  misc_feature (61): n=t or c
ggatattcagtcaggcaaggtgcatagctggtaggcatctactgccttgtgacagcaaccnttccctgacaatcaaggaatgagtcagggctatttcacttatcttcaaatcagagttatc

SEQ ID NO: 40579 - DNA, 121 bp, Artificial Sequence
  Synthesized
  misc_feature (61): n=t or c
taccccaaataacaaacatgttatcttctatcactataaaaatccttgcctaaattcaccnacttctagcaaaagttacttcacttttaaactagcagtgttgagcagacagagtcattgc

SEQ ID NO: 40580 - DNA, 121 bp, Artificial Sequence
  Synthesized
  misc_feature (61): n=t or c
ccataaatgaggaaatgtctggctccatacctctgcccatgtttacccatcacaacagcangtcttgtttttggggtgctctctgggtgagcagtttgggggttgccgctgcccttacaac

SEQ ID NO: 40581 - DNA, 121 bp, Artificial Sequence
  Synthesized
  misc_feature (61): n=t or c
ggtatgaatggctaatgtactgagctacagatgtgagctctccttggcgcgaggagggcantgtgatgtgggagtcaaacaacaggagctggcaattgcaggttaaatatctctttgacac

SEQ ID NO: 40582 - DNA, 121 bp, Artificial Sequence
  Synthesized
  misc_feature (61): n=a or c
aatacacttataaatgccttctctgagagtgataaggataatttcgaggtactgactctgncttgagctaaaaagaaattttccagacattttacccgactttacatggtttacatgactt

SEQ ID NO: 40583 - DNA, 121 bp, Artificial Sequence
  Synthesized
  misc_feature (61): n=a or g
ttggtgctcgcagaactgtgtttctggtacctaaaaaatatatttccatacattgaattcntccaccaaaatgagacgttggtaggagaaagctgaaatgagaccagaaggtaatgataaa

SEQ ID NO: 40584 - DNA, 121 bp, Artificial Sequence
  Synthesized
  misc_feature (61): n=t or c
ttgaaaaaagcttatcaaagttttttagatttctgagtgaagtgttctttcactagtttcnagtgtctcactggtcaaaagagctatctgccactccctatgaaagatatgctcaagatca

SEQ ID NO: 40585 - DNA, 121 bp, Artificial Sequence
  Synthesized
  misc_feature (61): n=a or g
aagatgagaaacaagctcaattttggttctgatggacaactcagtagtcctggctgaactnctccccagttggggagccaatgatatccagctcaggccaaagcaacagtgataaaattcc

SEQ ID NO: 40586 - DNA, 121 bp, Artificial Sequence
  Synthesized
  misc_feature (61): n=a or c
ctctttagcatgtagttaagtcattacttttatcatcactactattacttttgtcttcttnaagaagagtgggagcaacaatacatccacagatatattgggaaggatgttttgtttaaga

SEQ ID NO: 40587 - DNA, 121 bp, Artificial Sequence
  Synthesized
  misc_feature (61): n=a or g
tcaggggcccaatgatattgctagatgctatgataacattacttaaagggttagaatacantatgtggaaccatgatgggagagaaatcccagatacgttgtttccttacatatttagctt

SEQ ID NO: 40588 - DNA, 121 bp, Artificial Sequence
  Synthesized
  misc_feature (61): n=a or g
cttcttttgcttttcaaaagttgacgtcaaaccattagaagatagaaatgaattagttccntttttgctgtatctgtgtaaagacacggaaattgtctcataatcagtagtcttaaatgtg

SEQ ID NO: 40589 - DNA, 121 bp, Artificial Sequence
  Synthesized
  misc_feature (61): n=t or c
gagaggtttggccgctgcacgcttaatgcttcacatttcccagtgccaattctctggaagntcccagttctgttcggtttggctctttcttttttactacctatgcaccaacactgcggca

SEQ ID NO: 40590 - DNA, 121 bp, Artificial Sequence
  Synthesized
  misc_feature (61): n=t or c
ccccagaactcccccagccattaccagcactattagggatgcagtatcttgccatgcacangcccatcgatgcattcagctcaggcacggataacgacgtctccctgctcagcacccccgg

SEQ ID NO: 40591 - DNA, 121 bp, Artificial Sequence
  Synthesized
  misc_feature (61): n=a or g
caaattaacaacacggtgaaattctcagccaaaggagactgaaacacaattactcttatcnttatgacttctgaacctcatgttactgctttgtgtttctttcactctgataaatgtttca

SEQ ID NO: 40592 - DNA, 121 bp, Artificial Sequence
  Synthesized
  misc_feature (61): n=t or c
ccataagctggtgaatgtcttgtttctctagggtccagacttaccatttcattagctgtcnagtcaagaccctgcaggaaagagatctttttctgcccgacttacaagtgtgagtgctgta

SEQ ID NO: 40593 - DNA, 121 bp, Artificial Sequence
  Synthesized
  misc_feature (61): n=t or c
tgtcaaagaatgactacaggaggaatttttttttttaagactaaagctgttggtcaaaccnatgctgtaattaatgtattgtaactgtatgttcctagcttcaacttcaggcagaaggata

SEQ ID NO: 40594 - DNA, 121 bp, Artificial Sequence
  Synthesized
  misc_feature (61): n=c or g
cgttctgctgatgtcacctgcacagctgttgatccaaccttagaaagagaatcaaaaatgnttgagtacctgctgttactgacaagtttgacatttctatctaaccaagataaacgtatga

SEQ ID NO: 40595 - DNA, 121 bp, Artificial Sequence
  Synthesized
  misc_feature (61): n=a or c
tgtgccctgcatctccctgcactgcgacaatctcagctttctgcatccctagtaagtaccntcattagtctccaattggttcaaacgggctgctcctgcaagatgagctttgactaataaa

SEQ ID NO: 40596 - DNA, 121 bp, Artificial Sequence
  Synthesized
  misc_feature (61): n=a or g
gtcgtgatggctatcagaaaacaacactttaacagtcccattaaaaatagatggcctttcntgatggagttacaacatcagtggataaagaaagagcaactgttgccatctacctggactc

SEQ ID NO: 40597 - DNA, 121 bp, Artificial Sequence
  Synthesized
  misc_feature (61): n=c or g
tttcatttgttttacatgatatttttgttaaatgctctttgaagtgtcttgtacattgatntaactagagcactgtgatcttaacctctggaacagaggtgaccggctgtcaataaaaact

SEQ ID NO: 40598 - DNA, 121 bp, Artificial Sequence
  Synthesized
  misc_feature (61): n=a or g
tttcaaaaacactttatttaaataaagatgtttccgttctgtctaaagccaagatgacccnttttagggactctttccctacccgcagccttttctgttactgtgaattaacaacttgctg

SEQ ID NO: 40599 - DNA, 121 bp, Artificial Sequence
  Synthesized
  misc_feature (61): n=t or c
cccagcagcctgaggaacggcttagcagagcaccagcaaggctgaggagcctgaggccaantgggctgtgctgcctgaggaaagggctgagaaactatcccaaatgacctgctggctgtca

SEQ ID NO: 40600 - DNA, 121 bp, Artificial Sequence
  Synthesized
  misc_feature (61): n=t or c
tactccccaggccagctgatcaaggaaaagcattaatcagacgaggaggaaacattttgcnactgaaaaaggaaaagaactagcttaaccatggtgacacatcagggacggacaaattact

SEQ ID NO: 40601 - DNA, 121 bp, Artificial Sequence
  Synthesized
  misc_feature (61): n=a or g
cagcatcacatgtctctcctcctctctgctgagtgctggatcctggagcatcactacgtgnctcttggagcagagtgatgtagatcttacacctgagggatgcagaaccctgacaaaagga

SEQ ID NO: 40602 - DNA, 121 bp, Artificial Sequence
  Synthesized
  misc_feature (61): n=t or g
cactgaaattagaagctcacactaattgacctgtgcaaaggatcaaagcgatccagtgggnttttagccagccactgattcaaacatcccaattagatcctgtgctatcagcatgaattag

SEQ ID NO: 40603 - DNA, 121 bp, Artificial Sequence
  Synthesized
  misc_feature (61): n=t or c
actaagaccacactgctgaccatggctgaaggaatgagacctctaacaccactgcctgttncaactacctgtttcaatttaggctccaggctgagcattttcatgctacaccagaaaggag

SEQ ID NO: 40604 - DNA, 121 bp, Artificial Sequence
  Synthesized
  misc_feature (61): n=t or c
attatctgggaagagtttggagaccaattaaataatgtgacagaggctgaaaaatcgcccngttaccatcattgcacccactgtcagtagctcctgcacagtccttgtgcctttcctttct

SEQ ID NO: 40605 - DNA, 121 bp, Artificial Sequence
  Synthesized
  misc_feature (61): n=t or c
gctcaaaattgagcagccattggatttgctgacacccagcttgagatagtccaacgctacngacagggctgtccctggggatcctttccatcagtccagctcacagctctggctaatttcc

SEQ ID NO: 40606 - DNA, 121 bp, Artificial Sequence
  Synthesized
  misc_feature (61): n=t or c
gggatggttccatccaacagctttcctttcattaagtgctccatagatacccttaatgggnatcactcatgctagcacagaaacaaaagcaagctcttctgaaaactaacccccaaactca

SEQ ID NO: 40607 - DNA, 121 bp, Artificial Sequence
  Synthesized
  misc_feature (61): n=t or c
tgaaaaaactgtctctctctatgtgtcagattttcttagctgcacaatttcaaggagatgngaaggtggtccccagacctcccagagcatgcatattatgtgaatagtaacaacatcttaa

SEQ ID NO: 40608 - DNA, 121 bp, Artificial Sequence
  Synthesized
  misc_feature (61): n=a or c
taggcctagcctggtctttttacagtcaaaattctaataatgcacataaaaaatgatgcanaatacaactggctttccaaatctggaagccagcaatggcatatttctagctgtaagtatt

SEQ ID NO: 40609 - DNA, 121 bp, Artificial Sequence
  Synthesized
  misc_feature (61): n=a or g
ataaccttccaaagtctgttctgggtgtctcagagaagaggggaccttcctcaaaaggcanatgtttttattaagcacggaaccattggctcagagtcaagtgactaaggaaggataccca

SEQ ID NO: 40610 - DNA, 121 bp, Artificial Sequence
  Synthesized
  misc_feature (61): n=a or g
tgaaggaggtagctccaaagtgtcatcttgatctgaaaaaaatcatttctagatgtttaantgcagaggaaatctttaagtgctttctctttcctcctgaaaagatactttatgtcagagt

SEQ ID NO: 40611 - DNA, 121 bp, Artificial Sequence
  Synthesized
  misc_feature (61): n=t or c
agctcctccatgtcattcttgttgtaagggagaagcagaagattgttgtcaaatatttagnccatcgctcatagcagaactgttgggctgctgtaggatgctaatactgtgcgtctttgct

SEQ ID NO: 40612 - DNA, 121 bp, Artificial Sequence
  Synthesized
  misc_feature (61): n=t or c
ggggcagaaccgctttgcgcttaactagtatctcagctcgtaggaaaagcacagctctacntatcaattaagttcagtataaaagctcaagagctatgtacccgccctgcagaaaacacca

SEQ ID NO: 40613 - DNA, 121 bp, Artificial Sequence
  Synthesized
  misc_feature (61): n=a or g
gtttaaattattaacaagaaagtcttaaaactcactgtggagagcactgatttacacatcngagtatgtgtgaggtgagtgacacagaacaggctttaaatgggtatactgggatatttgt

SEQ ID NO: 40614 - DNA, 121 bp, Artificial Sequence
  Synthesized
  misc_feature (61): n=c or g
atacaggtgtttgtgtactctgggagtatttatgcaagtcaccatgcttccatgaaccctngttgagtttccaggcggtctgagatttttcacccctttatttttcttgtcaaatttacaa

SEQ ID NO: 40615 - DNA, 121 bp, Artificial Sequence
  Synthesized
  misc_feature (61): n=t or c
ctgtagtgctgctgcgctcctgggaggcatttttcaccccatgttaccttccttccccttnttaaaccaaaatctgatttcagtggaaacatctacagcttccaaactcggtcctttatcc

SEQ ID NO: 40616 - DNA, 121 bp, Artificial Sequence
  Synthesized
  misc_feature (61): n=t or c
ttggtatctattatcatgtattcttttattttcttccgacatatacataaaggaaattaantcaatattcattgctattggactgaagggctcaaaaggatgggaaaggagcacccgacct

SEQ ID NO: 40617 - DNA, 121 bp, Artificial Sequence
  Synthesized
  misc_feature (61): n=t or c
ccacatattctcaattacacttccatacacaatcagaacagtttgtcccttcaagatgcgngagttaatgcagtttttcaactttggagaataccctgcacttagtcacaagattagaaca

SEQ ID NO: 40618 - DNA, 121 bp, Artificial Sequence
  Synthesized
  misc_feature (61): n=a or g
gagaaagttaaaagaacagttcatttaatctgaacctacttatactagcactcactccaantgcaagcagcagataccagcttgaagcacaggaattgtgaaaaatctttcctcattctat

SEQ ID NO: 40619 - DNA, 121 bp, Artificial Sequence
  Synthesized
  misc_feature (61): n=t or c
ataaaattctgcaacctattcacacacagtttgctatagccacagcaatctgtttcctgcngcagcatcgaatacatcagttaagttttacatgtgcatcagaataatttttattcaatac

SEQ ID NO: 40620 - DNA, 121 bp, Artificial Sequence
  Synthesized
  misc_feature (61): n=a or c
tggtcctgtcacacactgaactgagctgcccacagagaacagaacatgactgagctcaatnagaaaaatctggtccttgttcatgttcctgtgtgttgaacagctctgccctgcaggacac

SEQ ID NO: 40621 - DNA, 121 bp, Artificial Sequence
  Synthesized
  misc_feature (61): n=a or c
agaagtctttttctagagcacttctctatcaccttaagatcaaattattccaacaatattntcagaaaactcattcatcatactcagaccttcctaccattctatgcaggctttcaaatac

SEQ ID NO: 40622 - DNA, 121 bp, Artificial Sequence
  Synthesized
  misc_feature (61): n=c or g
ccacaagttgccaaagttatacattaagcatcagaaaagctcaagaaggttactaaagccntgggctaggggacaaagaacacagataacagtttttgttgtatttattgtcacgtatttt

SEQ ID NO: 40623 - DNA, 121 bp, Artificial Sequence
  Synthesized
  misc_feature (61): n=a or g
ttcaggatcacgtcatgagcactgtcatttacaacatagaataagtaaaacctggtggaantagacctctaacaccaagaaaaccattagctctagctctgaactatagcttcctgattga

SEQ ID NO: 40624 - DNA, 121 bp, Artificial Sequence
  Synthesized
  misc_feature (61): n=a or g
ggaagaggagagcttcactgaggagattttagagtggttagcaagccagggaaggctggcngcatgggttgcagaagggttcgtgtaaccaaggtactgtgaacatttctaaccagcacct

SEQ ID NO: 40625 - DNA, 121 bp, Artificial Sequence
  Synthesized
  misc_feature (61): n=a or g
aacaaaaccaacctattccattagcatccaagaaacaggagaacacagacacacctctatnaacaattaccatctatttttgtaaacattctgctgatagacaaaggtttttaaccacgtt

SEQ ID NO: 40626 - DNA, 121 bp, Artificial Sequence
  Synthesized
  misc_feature (61): n=t or c
ttacttgatgctaaagcagggacataatattctccttactgtaccctattatttcctactnttatttttgctcacttgtgcaaagacagaaaaaaaaaagtagcagctgggcagaaatttc

SEQ ID NO: 40627 - DNA, 121 bp, Artificial Sequence
  Synthesized
  misc_feature (61): n=a or g
agaaaacctccccttcgttcttccctgtatttccagagacaataatattaacttaaccccntgtgccacgggaccaagttgccaaattttactctgattagttgcttttatcccttcctac

SEQ ID NO: 40628 - DNA, 121 bp, Artificial Sequence
  Synthesized
  misc_feature (61): n=a or g
agcccctaccctgtactgtactacgtaattattcttatacagatgtaggagaatatatatncccttgttaaacatcattagtttcctgtcctaactcaccctctcatctctgacttccttg

SEQ ID NO: 40629 - DNA, 121 bp, Artificial Sequence
  Synthesized
  misc_feature (61): n=a or g
aactgaggagttcctccttgccaaaacatgtgttagccctgtccagaagataagagtttgntctccgtggtggaaatgatagccattgatctctgttgtggtcctgccaacagtgacatca

SEQ ID NO: 40630 - DNA, 121 bp, Artificial Sequence
  Synthesized
  misc_feature (61): n=c or g
agaaggggagaacagacttgagattaaatgtttttggtatgtgataccccagctcctcttnttaaatttgccttgaatctttaccaaacatcctcaaaatgttatactattttggaaggat

SEQ ID NO: 40631 - DNA, 121 bp, Artificial Sequence
  Synthesized
  misc_feature (61): n=t or c
caaccttggtgtttctatgattctatgattccatgaacaaggttacttcttttaatacttnaaaaaattatgctggaaaggcaacactcctggtgttttgccagtttttatatttgatata

SEQ ID NO: 40632 - DNA, 121 bp, Artificial Sequence
  Synthesized
  misc_feature (61): n=t or c
gccttacagtacaatgtgtaagatattttgaagttaaacttaccaattattttaaggtgantgtctacctaggaggtatttatatttcaggctttatatttgcagaccccataaatattca

SEQ ID NO: 40633 - DNA, 121 bp, Artificial Sequence
  Synthesized
  misc_feature (61): n=a or g
aaccttatcctagagagttgcaagggatatgaacaatgaatgtttaaacccacacagagtnttaagacacaaggaatttagattctaaatcagtaagcactgtaaaaagcaaaatagtaag

SEQ ID NO: 40634 - DNA, 121 bp, Artificial Sequence
  Synthesized
  misc_feature (61): n=a or g
tgaaaatcccaaagagctaaaataagacaagtacctctgcccacttgtttacagcctatcntgccacccaacaaaatccaaataaatggatttctacctgtatatacatacatttaaatgg

SEQ ID NO: 40635 - DNA, 121 bp, Artificial Sequence
  Synthesized
  misc_feature (61): n=a or g
ttctttatgatgccaaccattgcaccgagcgtggcgatagctcataggctgccttatctgngtgacgtggtttggtgctgctgcttggcacggccattgcccacatgatcctgtgagtgtg

SEQ ID NO: 40636 - DNA, 121 bp, Artificial Sequence
  Synthesized
  misc_feature (61): n=a or g
aaaaggcatgttctgcattacttacatgtcccatattgcagcactttggtgagagtgggcnatacaggtcctggtgtgactcctagctggtgctgcttcaggcaaacctggcaagctgaga

SEQ ID NO: 40637 - DNA, 121 bp, Artificial Sequence
  Synthesized
  misc_feature (61): n=a or g
gcacacaggccttggcagctgatccagggggtaacacactggagtacacttgatggttacntgacgttttccattttggaaaagttatttgggaaaaataacttctcttacaggtgccaca

SEQ ID NO: 40638 - DNA, 121 bp, Artificial Sequence
  Synthesized
  misc_feature (61): n=a or t
ctgtgaaaaccctggaggatggagattgtctctctggaggaacagcagtgtgaactctcangttacagtgccctcccactgaaagaggttttccgtgggtctagtccaaacccctccaacc

SEQ ID NO: 40639 - DNA, 121 bp, Artificial Sequence
  Synthesized
  misc_feature (61): n=a or g
ccaggcacttatttttctcacttcttattttctgctttactctcccaaacttgttcttctntttcatgggaggttgcttctggctctgcttaattctgcttaactcttcatagctatgaca

SEQ ID NO: 40640 - DNA, 121 bp, Artificial Sequence
  Synthesized
  misc_feature (61): n=a or g
aacaaaaaccctctgcctttttgcatcaagttgaacattactctcagtctgcattgaaaanaaaatattgtggttactgataggtaaactatttttttggcagatgcccctgaagtttcag

SEQ ID NO: 40641 - DNA, 121 bp, Artificial Sequence
  Synthesized
  misc_feature (61): n=c or g
gttaaaatccagcagttcccacaagaagcactcttagtgactagaaaaagttccacggtcnagcaggtctgtggttactgcataccccatatacagatacctctgacatactctgctacag

SEQ ID NO: 40642 - DNA, 121 bp, Artificial Sequence
  Synthesized
  misc_feature (61): n=a or c
aagttttagctgtggtctctgtctgactgcatgtgacttttttagtgaatgccaaagaggnattaattctttcagtcaccttcgtgtcacctattgatatctctcactctacttgaatagc

SEQ ID NO: 40643 - DNA, 121 bp, Artificial Sequence
  Synthesized
  misc_feature (61): n=a or g
tcaagtgagaacataggttccaattcttctggacttaggacaaataatcagcttagatgtnggaagatggccctctggttaaaatgccattgtgcttgtgtgcacttacactggactgata

SEQ ID NO: 40644 - DNA, 121 bp, Artificial Sequence
  Synthesized
  misc_feature (61): n=t or c
cagacataataaaatacttccagaacattaatatcctgttttaagtattatcaaataatangtcttttggattatcctatgctctatttttttttccacattcagcatttattccttccta

SEQ ID NO: 40645 - DNA, 121 bp, Artificial Sequence
  Synthesized
  misc_feature (61): n=t or c
aaaagtaattgaaaaaagtaattttgaaacaggtacatgaaggaacaagtgtcagttttcngtatttccttcctaattaatagagataaaatagtgcagcacttggtcccagattacagag

SEQ ID NO: 40646 - DNA, 121 bp, Artificial Sequence
  Synthesized
  misc_feature (61): n=a or c
accaaaatagcttaaaccattcatatcatagaagtaatatgaagagcaccttgagtgttcngaagcaattacgacagtgataactgcagatgaaatgaagcaaaatgtgaaaaatttatct

SEQ ID NO: 40647 - DNA, 121 bp, Artificial Sequence
  Synthesized
  misc_feature (61): n=t or g
caatgataccgcaacaccttgccccaacatgagggaccggcgtctgctacccagaaggagngtggctgagagcagcttgccttccttacacaatttcacagatccacacagcttgtttctt

SEQ ID NO: 40648 - DNA, 121 bp, Artificial Sequence
  Synthesized
  misc_feature (61): n=a or g
gttctttagctgaagcctcctataacacagcatgcaaaccctaacgaaaggcatttgtacnccagtgcgggtcgataccatagtttaacacagagcagctttgtgaagggagaacaaggat

SEQ ID NO: 40649 - DNA, 121 bp, Artificial Sequence
  Synthesized
  misc_feature (61): n=t or c
ccgagaggaagaggaagaaaacgatgatgacaacagcttggagggagagacattccccctngaacgtgatgaggtgatgcctccgcccacccagcatccccccagcgaccgcatcacctgc

SEQ ID NO: 40650 - DNA, 121 bp, Artificial Sequence
  Synthesized
  misc_feature (61): n=t or c
aaaaaggatgatgttgaaggactgtaaagcaattaaggattttatgtgttgtttctatggngtcagtagtcagctttcacccacagactcagaccatgtcttgatgaaaatactgaaaaac

SEQ ID NO: 40651 - DNA, 121 bp, Artificial Sequence
  Synthesized
  misc_feature (61): n=t or g
accagcataagaagaagtgatcagtgtggtaacctcattatctatctcaggctgaaacaangctattatgagtcagtactgttagaggcactatagttttggtaaagtattggagaaacaa

SEQ ID NO: 40652 - DNA, 121 bp, Artificial Sequence
  Synthesized
  misc_feature (61): n=a or g
gtaggaaactgctttgctttgtcaggctttcattcttactttgtcatagcagtcatctctntaatatttctcaagtaatcttaacttaggtggagccacgtccttccagtccatcacctgt

SEQ ID NO: 40653 - DNA, 121 bp, Artificial Sequence
  Synthesized
  misc_feature (61): n=t or c
aaaatttctggcattccaactaaaaaaccccaatcaaccaaatcaaaccaaaccataaaanggtgtttgagaccttattacttcaggacctctatgggggtagattctccccagaaataga

SEQ ID NO: 40654 - DNA, 121 bp, Artificial Sequence
  Synthesized
  misc_feature (61): n=t or c
aggagcacagttgctggttacagaattcaaatgcatttgggacagattctctcctggtagngagtgcccatctaaagactccagcctttggttacttcgcatctcaggctggcttctgttt

SEQ ID NO: 40655 - DNA, 121 bp, Artificial Sequence
  Synthesized
  misc_feature (61): n=t or c
atgtagagatagcagaaactggaagaaaatgaggtattgtttgagctctaaactagacatngaacttcgtagattcaattgctaagggagccttgagattttaacatagtatctaagtaga

SEQ ID NO: 40656 - DNA, 121 bp, Artificial Sequence
  Synthesized
  misc_feature (61): n=a or g
agaaatgagattttttggggggggcccacaagcttacagagctcaggagagctgctatccnccacgaggctcagcctgagacacaactgccttcaccagctcatggctatctgttccccag

SEQ ID NO: 40657 - DNA, 121 bp, Artificial Sequence
  Synthesized
  misc_feature (61): n=c or g
cagattatgaacaacttaaaagtaagcctctttgttattttaaagctaaaaataaagaaanaaaagaacacacaaacagaatttaccttacatcacccagaagcttcataatctcatctga

SEQ ID NO: 40658 - DNA, 121 bp, Artificial Sequence
  Synthesized
  misc_feature (61): n=a or g
tctaatattttggcttgtcctcagtagatgtaggccaaggcccccacaaatttaagtgcantttagagtaacacacatgggtaatgatctcttcctaaagaacatgtttagtatgttgtgc

SEQ ID NO: 40659 - DNA, 121 bp, Artificial Sequence
  Synthesized
  misc_feature (61): n=t or c
ctgaaaaagatgggaagaaaattacagatatttttatttttgaatttcaagtttccatttnctgcatataattacactgaagcgcgtgaggaaggaggtcgtggcttagcagttagctgca

SEQ ID NO: 40660 - DNA, 121 bp, Artificial Sequence
  Synthesized
  misc_feature (61): n=a or c
ataggcaccgccgcccaactcctcttaacgcagccgagggctgcggccggtgcaattcccngcattaatggacactctctgagcagaagcacttcaaagcaccctccccaggctcaaaagg

SEQ ID NO: 40661 - DNA, 121 bp, Artificial Sequence
  Synthesized
  misc_feature (61): n=a or t
acaagcagcttttctcagactccttcatcatcaatttggaacagatatgagatccctggcnacagtttcacgggattgtgcaacactttcactgtaggagtacaacattttggtggaataa

SEQ ID NO: 40662 - DNA, 121 bp, Artificial Sequence
  Synthesized
  misc_feature (61): n=a or c
attttgagtcgcttttctgaaacctcttgcatcatctttaaggcaatgtgtagcataaagntgattatttcacttttcctttttcccatttacttgcatgttactgaaattgcttttatgt

SEQ ID NO: 40663 - DNA, 121 bp, Artificial Sequence
  Synthesized
  misc_feature (61): n=t or c
acagtacaaaggatttttctctctgcttcctccttcccccattacctatcattaattaagngtaatttttgcttttcctgctttggcatatctctgcttaatgagagaaagcctgcaatga

SEQ ID NO: 40664 - DNA, 121 bp, Artificial Sequence
  Synthesized
  misc_feature (61): n=a or t
tggaggttttctgctctcagtactagcaggagacaaacaggtatttatcactgaaaaaaanatatatatctaacattagaaatgccagcagcagcctatctccaacagattcaactcagtg

SEQ ID NO: 40665 - DNA, 121 bp, Artificial Sequence
  Synthesized
  misc_feature (61): n=t or c
ctctctgctagttttattttacttgctctccagttatcagagaatctttcaaaatagtcgnaattgaagtctgtgtaataacagagaaaatacagagaaatatttctgtgtgtgttcattg

SEQ ID NO: 40666 - DNA, 121 bp, Artificial Sequence
  Synthesized
  misc_feature (61): n=t or c
gacctatggcagacttgtaacattttgttggcttttttaaagttgtatgtggatagacctnttttgacatctgaatatgactcatgctctatcaatgtgacaagtgaggaggaactgtgag

SEQ ID NO: 40667 - DNA, 121 bp, Artificial Sequence
  Synthesized
  misc_feature (61): n=t or c
ctgcccctataccagtctgtatggctacaccatgcatcgagagacagactactgctctccntcattaccagaacaaaaatgcattgcacgcacatcacttgaatttatccaacttctagag

SEQ ID NO: 40668 - DNA, 121 bp, Artificial Sequence
  Synthesized
  misc_feature (61): n=a or g
tcacactattcaagaaaaaaaatcctctttcttttaaaaacatcttaaccacttcctgagngggaaggatatgcaatgtttttcagataacaactgagtatctggtttcaaaactgctggt

SEQ ID NO: 40669 - DNA, 121 bp, Artificial Sequence
  Synthesized
  misc_feature (61): n=a or g
tgctccctctggctgacatttctctagcaagtaagtggtgcaaataagctgccatgtgtcntgttttccggatcagtgtaagcaactgttagatactgcagcactcctttgtattttgtct

SEQ ID NO: 40670 - DNA, 121 bp, Artificial Sequence
  Synthesized
  misc_feature (61): n=t or c
tatgattactacaagtgcctttaaaatgccttgtgtttatcaacctgaacaaaaacggcangcttatagatggttatttcaaccgtgattgtttaggtaaagacaccttactgtaagccct

SEQ ID NO: 40671 - DNA, 121 bp, Artificial Sequence
  Synthesized
  misc_feature (61): n=a or g
tgggaaatgtgtggcaacagctcctgctgcttgggcaaaaatggtatcacttctttgtatntggatgatagagcaggttttagggctttctgtttgtaaataatcctgctgagcactaatc

SEQ ID NO: 40672 - DNA, 121 bp, Artificial Sequence
  Synthesized
  misc_feature (61): n=t or g
ctcacttccagaggcagcttctttaagtcagcttgagaccgaattggcgtggttttctatnaaggaaagaaaacccagaaagtgaagaaaatgagcaaacagtttgcccgtttcaaaaaag

SEQ ID NO: 40673 - DNA, 121 bp, Artificial Sequence
  Synthesized
  misc_feature (61): n=t or c
tgtgaagagcaaagtaattccctagcaaaaattattagcatctctgagctttccagtcctncctgattcaccagagctcttaaagtcatttaagtcctcttgatttcatagaatcacagaa

SEQ ID NO: 40674 - DNA, 121 bp, Artificial Sequence
  Synthesized
  misc_feature (61): n=a or g
cagacaattacatgcatttatccattttgttccttaagaatatttttttccaaaacagagnagtcttagctttgccaacccctcttctaagatgtttctataaactctgaggtcttggttt

SEQ ID NO: 40675 - DNA, 121 bp, Artificial Sequence
  Synthesized
  misc_feature (61): n=t or c
acactgacaccctgagcaggagatgagtgaaacgtgcagaaggtcgctcacaagaggtggnatatgaccacagggtgtgggataatttgagtgatgatgaacatcccgtcctaccagaaga

SEQ ID NO: 40676 - DNA, 121 bp, Artificial Sequence
  Synthesized
  misc_feature (61): n=c or g
gctatattcactctcagtgtaatgggcaattggcattcgaagtaatgaaaaaactggcatnattgaaacgtgtacaatgtttcccctgcaaacagattgtattaacagtgttatttctgtc

SEQ ID NO: 40677 - DNA, 121 bp, Artificial Sequence
  Synthesized
  misc_feature (61): n=a or t
acaagcaatcatcacagctacagaagttgtaaaattaaatttgaaaagccactttcctgancttttaaaatgattaaattataacagaatcagtgctactttttattagaaatgcttttac

SEQ ID NO: 40678 - DNA, 121 bp, Artificial Sequence
  Synthesized
  misc_feature (61): n=t or c
acatattatgcctacacaccatattagcgtgatgtattttggttgcatcaggtcaacctcnccaagaaagtaacttgtgaaaagcccatggttcactgttgagattcttttcagctctgga

SEQ ID NO: 40679 - DNA, 121 bp, Artificial Sequence
  Synthesized
  misc_feature (61): n=t or c
tcaggatttggtcctcacataatgctgttagcaactggcatggatgtattctaagtctgtntataaagtcttgcagctgcacagatcaggagctgggcacaaacagcaagataagtcagtc

SEQ ID NO: 40680 - DNA, 121 bp, Artificial Sequence
  Synthesized
  misc_feature (61): n=a or c
agaagactttattcatcatttgatgaattaattgagctgccacattctgtatgttattatntatgtatctttttagcaatagatttcctgctcaagggaaagggggacgcatatatatatt

SEQ ID NO: 40681 - DNA, 121 bp, Artificial Sequence
  Synthesized
  misc_feature (61): n=a or g
gcatatgtaacacaggtatgtaccagtatacaacgtacagattatactatttcaagcctgnagtagaaacacgagtgacaaggtagttcttaaggtgactgagctgtccctactgagaaag

SEQ ID NO: 40682 - DNA, 121 bp, Artificial Sequence
  Synthesized
  misc_feature (61): n=a or g
gatagttttttttaaacaaacaaacatgtagtggaacaaaattacacttgtacacgttacnttgtcctgaatactttataacgcttacatttttcacttacctaaatttcatttcttggca

SEQ ID NO: 40683 - DNA, 121 bp, Artificial Sequence
  Synthesized
  misc_feature (61): n=t or c
gcaaagttacctaggtcttgctagatttccccagtgcctactcaatattgccaaaggctgngtgcaccctgtggatgctttattcttcagttaaacccagatctctctctttcaaagtatt

SEQ ID NO: 40684 - DNA, 121 bp, Artificial Sequence
  Synthesized
  misc_feature (61): n=a or t
acaacatgtgagaaagtttctaacatgaagcagaggggattatgtaagtgagggaagaacngaggataccagaaaagcctgctttcatccttaagcttgtgtcttacacaaacctgaagga

SEQ ID NO: 40685 - DNA, 121 bp, Artificial Sequence
  Synthesized
  misc_feature (61): n=a or c
cttagctgaactgctccttcaggaggcaaagaagtaacagcagagcagtaccaccctgctnagggatctaccacagaaaccttcaccagggcctcaagagttgggatggacaaaaacatgc

SEQ ID NO: 40686 - DNA, 121 bp, Artificial Sequence
  Synthesized
  misc_feature (61): n=t or c
taaaacaaaaagaaataagtcttgttcaccgatggaccatgtcatactgtgggggaagcantgcagatagaaagctgcagtgtggaacccctcacagtgagtttcagaggccactgaagga

SEQ ID NO: 40687 - DNA, 121 bp, Artificial Sequence
  Synthesized
  misc_feature (61): n=t or c
ttacacagtcactggaaaaggcacacagcaaactggccagcagtgtgagtgtgtgttaganggccagtctgtgctgtggaacagataaaagcccaagcgtagcagctgccagataaataac

SEQ ID NO: 40688 - DNA, 121 bp, Artificial Sequence
  Synthesized
  misc_feature (61): n=a or c
ggactctgcacgtgaggaactcattctctgtgctgttctttttcaacaacaaatccataantattagatagtacattggatttttcttgagagctaagctgattagccacactttgcattg

SEQ ID NO: 40689 - DNA, 121 bp, Artificial Sequence
  Synthesized
  misc_feature (61): n=t or c
caacccaggccattctatggttctgtggtatgcttaagtgtggttacagtaccggagtacntccaggccctggcacaaataacactgccagttcctatgaccaaaaatccgagccatttct

SEQ ID NO: 40690 - DNA, 121 bp, Artificial Sequence
  Synthesized
  misc_feature (61): n=a or g
gagaggtgtgctttagcttctaacgtgatgtgtgcttgcagcttcgtgcagggggaatgcncttttgacagttttgaaatgtgaactattgcaagccagattttgaaattggaagtgtctc

SEQ ID NO: 40691 - DNA, 121 bp, Artificial Sequence
  Synthesized
  misc_feature (61): n=t or c
actggttcacataaagcagtcttgaagatgttttttgtcaaacactgttataactctgaanatttcatctcttataacagcattttacagaagtagatgaatattaccgttctcatttttc

SEQ ID NO: 40692 - DNA, 121 bp, Artificial Sequence
  Synthesized
  misc_feature (61): n=t or c
ccactactgaacaggccagtgtcttgaggtatctgcattttcttcctaccctgccacgganttcttctttggtgaagtgggtaagtcaagccctgaccttctaatagagataaatacctat

SEQ ID NO: 40693 - DNA, 121 bp, Artificial Sequence
  Synthesized
  misc_feature (61): n=t or c
gcccaacagagacaccaggattccatcccagcaaggtagaacatcagcaggatgagtcctnaaccctgaagcggaagcaagagaccattagatctctctgaacatgatgaggccacagctg

SEQ ID NO: 40694 - DNA, 121 bp, Artificial Sequence
  Synthesized
  misc_feature (61): n=t or c
aaaccccacaacctcagctcttagacaggtttaggattttcctctgtcaacactatggctnagaatgaagcttttcctaaataagccacactaatgctcaccattgacacagagcatctga

SEQ ID NO: 40695 - DNA, 121 bp, Artificial Sequence
  Synthesized
  misc_feature (61): n=t or c
ctcaagttctaactgacttgctaatgtaatttccagagtttaattgaaatcatcctcatcnatgaggttaacagaggagacaatttgatgcattaaatattaaaaaggcaaacctctttga

SEQ ID NO: 40696 - DNA, 121 bp, Artificial Sequence
  Synthesized
  misc_feature (61): n=a or g
tgggtaatttctgtacaccacaaaagggaaagagtatatacaaaaagctgtgtacttatgntgtaaaatgcatacaccattcacatccatcagtacaaagcaatctgtcatttagggtaaa

SEQ ID NO: 40697 - DNA, 121 bp, Artificial Sequence
  Synthesized
  misc_feature (61): n=a or g
tcagcccatgtaaaaggatggacacggcacaccaagcactcatctaacaaaccttgcgccnttttctagacagggctttgcatactgctatgagtatgatttttataagcagaatgaagat

SEQ ID NO: 40698 - DNA, 121 bp, Artificial Sequence
  Synthesized
  misc_feature (61): n=a or g
actttgcctaatgccatttcatttctgccagctgcacgtgagttgctttttatctggcacncacttcgttatacattattaaacagccaatcagcttggccccagagttagcatcgtgccc

SEQ ID NO: 40699 - DNA, 121 bp, Artificial Sequence
  Synthesized
  misc_feature (61): n=t or c
tatatgcagccccacagagaggaaggaaatggaaatagttaagcacccatttttagaagangtcgtggtctttaaatgcagttgcacacttgctgtgctagtttatgatttagtgcatgca

SEQ ID NO: 40700 - DNA, 121 bp, Artificial Sequence
  Synthesized
  misc_feature (61): n=a or g
ctcaccatctattcttttttcctctcctctgacttacctatcccctcagtgatgtctaatntatctgcctctcccgaattaagatcaaatttcattcaagtttaccattgatccaagcctc

SEQ ID NO: 40701 - DNA, 121 bp, Artificial Sequence
  Synthesized
  misc_feature (61): n=a or t
caggatttcactgctgatgtcactagaggatgctgcagaaatcaggtgtcaaaaatgtganttttttttcacccagtagggaaaaagaaataaattgaaaagtacttctggttgtatgacc

SEQ ID NO: 40702 - DNA, 121 bp, Artificial Sequence
  Synthesized
  misc_feature (61): n=a or g
cttctcgtccttcaaatcctcaggattaagctgggaagttttgacgaggatccaccaagcnagggactcgatattcaaatggatcacccaaggaaacgccagatggatgcgccatcgggca

SEQ ID NO: 40703 - DNA, 121 bp, Artificial Sequence
  Synthesized
  misc_feature (61): n=t or c
ccccagcaattactttctggcttaacacaatgcccaaacgcttctaagtctgataagaganagacgtgttccccccaaaacttgtacagttccctgaccaaattaccaacacaaacaattc

SEQ ID NO: 40704 - DNA, 121 bp, Artificial Sequence
  Synthesized
  misc_feature (61): n=a or g
ggaagaattcaattatgctagagagaaagaggccttgtttgtgtatccctttcacgctgcngatttttgcacacggcatctaaacataactgtatctaccagcacttatgtctcaacacag

SEQ ID NO: 40705 - DNA, 121 bp, Artificial Sequence
  Synthesized
  misc_feature (61): n=a or g
tgggaggagaaatgctgacattcaggcccagatgcctcagagcctgacctttccttctgcnagcacatttcaagggacaaagtcactgagaaactttagccctttccatctactgcctcgc

SEQ ID NO: 40706 - DNA, 121 bp, Artificial Sequence
  Synthesized
  misc_feature (61): n=c or g
aggcgtttgaagctgagcgtgaggaccaagaagcagtgaaggccctcagatagtccagccnagttctggaggtgacgacccgctctgattgggactttgggctgtgtacatctctgctgtg

SEQ ID NO: 40707 - DNA, 121 bp, Artificial Sequence
  Synthesized
  misc_feature (61): n=t or c
tgaatttacttgataaattcatgttgtttgggtccacccaggatatactttcacatgtacnaagaggataaagaggacagaactggaagcctatctataccatcagcatgaaaagaatgaa

SEQ ID NO: 40708 - DNA, 121 bp, Artificial Sequence
  Synthesized
  misc_feature (61): n=t or c
caactttctcagtacagagatttagaaaatgtgtccattctttggagatcatctggaatantggtcatatcctctacatcaactgtaacctctcccaggtcagcatcttgatcaaagaata

SEQ ID NO: 40709 - DNA, 121 bp, Artificial Sequence
  Synthesized
  misc_feature (61): n=t or c
tgcatagatgagatggacctcttctgttggttgtgcaaattttgaagttggggtcatgctnacctggaattcctcgggcttggacttcactcaggggtatgaagagtgcccactggtttcc

SEQ ID NO: 40710 - DNA, 121 bp, Artificial Sequence
  Synthesized
  misc_feature (61): n=a or t
tatttctgaaccagtgtgaattttaacaaatagccaaattgaggaaactggggctcagacngttcttacatgtaaattaatatggttttcaggcttagttcagctttatgtgtgttagaat

SEQ ID NO: 40711 - DNA, 121 bp, Artificial Sequence
  Synthesized
  misc_feature (61): n=t or c
ttctcctccagcttatccagccctttgcacgcgtattcattggcagtggatactaaaaagnccccggaaaagaaaaactcagatgtgtgaccccataacgctcaccagccccgcatctgcg

SEQ ID NO: 40712 - DNA, 121 bp, Artificial Sequence
  Synthesized
  misc_feature (61): n=t or c
ttatagccaatctaaatctgttccagtttgaaacctggaacagatttcaagatctgtcccnttccttaagctgccttacagctcctgcttttagccacactgtgttctaaccaacttgttc

SEQ ID NO: 40713 - DNA, 121 bp, Artificial Sequence
  Synthesized
  misc_feature (61): n=a or g
cctttagacaacacccaaatattgtagaaatttataaagctgttaacaaagctttgcctgnatgtgttgccctatctgaagctgaactgggtcagagactgaagctcctgagcactctccc

SEQ ID NO: 40714 - DNA, 121 bp, Artificial Sequence
  Synthesized
  misc_feature (61): n=a or g
cagctctcaatctgcctttgctttgctgaggctgacacaatttgaagacagatgggctacnggccagtcagcagtgttgccagttgccaaggcaagaggccagacaaaacctattcactgt

SEQ ID NO: 40715 - DNA, 121 bp, Artificial Sequence
  Synthesized
  misc_feature (61): n=t or c
tgtctgttatgtccttggaaattctcccttaaaataaaatgcctttgttctaattttgtanctaaaaaacaccttacaatgagcagaattaaaggtatgcatactgtaagagtcttctgca

SEQ ID NO: 40716 - DNA, 121 bp, Artificial Sequence
  Synthesized
  misc_feature (61): n=t or c
ctgtcagatctctgcagcaagccatttctcaccctcttttcctgcagctccactttagccngcagttcatccctccgggctctcagctcctgcactctggctttcaatctgtcgagcttct

SEQ ID NO: 40717 - DNA, 121 bp, Artificial Sequence
  Synthesized
  misc_feature (61): n=a or g
cctgttttacaggagcttttctctggttcttcccttgtctcaaggcttcaaaaccatgtancaaccattgggtacagtgccagtgaaaaatgagattaaacattcatggctgtgggagcat

SEQ ID NO: 40718 - DNA, 121 bp, Artificial Sequence
  Synthesized
  misc_feature (61): n=t or c
gaaggacgtccttatctgccactgcttattgacacagtggaaatgcaggggaccaaaaggngaaaggcaagaaatggagaagaaagaccttgtctggaaggaaagatgatgaaacgaaggt

SEQ ID NO: 40719 - DNA, 121 bp, Artificial Sequence
  Synthesized
  misc_feature (61): n=t or c
cttcgtgtgatgctttaagtgatgactctgtaatgccatctccccatagctggctcgaggngggggtcgctcggttaatgtacgtctccatcttcattgcctttttaacttgtttttaatc

SEQ ID NO: 40720 - DNA, 121 bp, Artificial Sequence
  Synthesized
  misc_feature (61): n=t or c
taagcagaaaggatcctgtcctactttgcagccagtgccattactgcagtaaatgtcacantgtgatttctcacccatttgagacctcggtgtgtgatactgtagcattgaggtagatgga

SEQ ID NO: 40721 - DNA, 121 bp, Artificial Sequence
  Synthesized
  misc_feature (61): n=t or c
agacttgactcaaaacaactcaagcattattgcaaggctgcaaggtttactgagatagaanccctctgcatttgaatattaagacaattatagcagtagaaattttctcagtggtagaaat

SEQ ID NO: 40722 - DNA, 121 bp, Artificial Sequence
  Synthesized
  misc_feature (61): n=t or c
cccggacacacacagtcaggcaactctgcacctgggatgataagtgatggaattcagtgcngcatttcctgagaaaaaggctcaggctggactgatgtctttttcaaggccttcccaaact

SEQ ID NO: 40723 - DNA, 121 bp, Artificial Sequence
  Synthesized
  misc_feature (61): n=t or c
aagccagcagcttggtgtgtaaagaaagcaagcctaatgtgaagcaaacagctaatggccnacaagtgctgggcctcatgcaaacaaatattcctgtagatgtgagaggtttgcttcaatc

SEQ ID NO: 40724 - DNA, 121 bp, Artificial Sequence
  Synthesized
  misc_feature (61): n=a or c
gcaaccaccagaggcacagctacgttctcaggtacagacacaggtatagctcattcagctnatgctcttaaccatcaggacgtcttctgatctgcaagcactgtagctgacttactcagac

SEQ ID NO: 40725 - DNA, 121 bp, Artificial Sequence
  Synthesized
  misc_feature (61): n=a or g
tgaaggcttccatcagaggatatgatcacctgatgttgcacgcatggcaccaattctacanttttatttgaaaccaaaattgcagtgttcaccacagaaactttcttatggtcatagtcct

SEQ ID NO: 40726 - DNA, 121 bp, Artificial Sequence
  Synthesized
  misc_feature (61): n=t or c
atgatttcatgttgacagataaatactattatgcaccatcaaaaagttcaattgattctgntgtggaacacctataatcaaaaagcagaaatctctttattgtcattctgaagaaagagga

SEQ ID NO: 40727 - DNA, 121 bp, Artificial Sequence
  Synthesized
  misc_feature (61): n=a or g
gtctttcattacctgtactataaattataaataactaatctgtagctttattttctgttcnttaacattgttgcatcctattctaatcagggaaatgtgcaggtatttctaaatacttacc

SEQ ID NO: 40728 - DNA, 121 bp, Artificial Sequence
  Synthesized
  misc_feature (61): n=c or g
gattggctgcagtgcacagggctccaactttctgcttactgtgtctgtgaccttggatgcnacgatcaaggatcctttttgctgaataaaaaactggctgaggggttgggcacagagagtg

SEQ ID NO: 40729 - DNA, 121 bp, Artificial Sequence
  Synthesized
  misc_feature (61): n=a or g
ttccctgcagggcctttggctgaagtccgttcattaccacacgtgtagtgttcttagatcnaaattcctatttcaaagggataaaatgtaattgaaattagcattagttagcacaccccta

SEQ ID NO: 40730 - DNA, 121 bp, Artificial Sequence
  Synthesized
  misc_feature (61): n=t or c
atttctgcagatacctcgccttcccaggccacttcaatcaagctgtcatccacttatcccncccggattcttgtggtctcctgtgtactatttgtacctcctgagattgccagctcactga

SEQ ID NO: 40731 - DNA, 121 bp, Artificial Sequence
  Synthesized
  misc_feature (61): n=a or g
caggtcatcttggtggtgttggtggcagtagcattaattgcagttgatttgcaatcctgangattgcagagggctcagtgcctttgtaactgctggtcaggggcaggttcagtgcttgggg

SEQ ID NO: 40732 - DNA, 121 bp, Artificial Sequence
  Synthesized
  misc_feature (61): n=a or g
aaaccaacagcttgatggaaaaaaaccaacagaatgagatattgtccacataaggattgtnctcagaagcagctgtttcaataagaagcagaacatttttttccactggatgttccatcaa

SEQ ID NO: 40733 - DNA, 121 bp, Artificial Sequence
  Synthesized
  misc_feature (61): n=t or c
tcttctcctgcagctcttgtgcagctgatgaactcttcctcatgattgtaggcccacatangaatggggaaaataggagggtctgtgatttcagcttgtcctaaccgctcagaggtgatat

SEQ ID NO: 40734 - DNA, 121 bp, Artificial Sequence
  Synthesized
  misc_feature (61): n=a or g
aattctgtctttgattgttttggtctgttcttcaaaagactgtggaggcagatgtagagancttttgaaagtaagctttaattacgagctgtatttattttttaagcacaaaacagtgact

SEQ ID NO: 40735 - DNA, 121 bp, Artificial Sequence
  Synthesized
  misc_feature (61): n=t or c
agcccaggaggagcagcaaggagttttgcaaggctgaggtgtaagaggagctgcttcctangtcgggctgcccatgaggagtcaccactttctcatcctgattaatgaccctcgttaggaa

SEQ ID NO: 40736 - DNA, 121 bp, Artificial Sequence
  Synthesized
  misc_feature (61): n=c or g
ttgttgttgttttttcctttcagggttgcagttctttttcttcagaaaattgcagactggntttgtcatcttgtatgcttcatactctcaaattggcacagaaagacagagactgctgcca

SEQ ID NO: 40737 - DNA, 121 bp, Artificial Sequence
  Synthesized
  misc_feature (61): n=c or g
tgaaaagtctgcaatgatggaacgtgcacagactgcccaggttgcctagttccaactgttncccatcccctacataaagaaacttttgccttatagccacagtgaatctcttgcaccagct

SEQ ID NO: 40738 - DNA, 121 bp, Artificial Sequence
  Synthesized
  misc_feature (61): n=a or g
ccatctctgaacagacctgaggtaatacacaactcatacagttataacaggataaagcaangctctccaaactttctccccactagaaaatttgattacattttctaaacaccttccattt

SEQ ID NO: 40739 - DNA, 121 bp, Artificial Sequence
  Synthesized
  misc_feature (61): n=t or c
tgctgcattagtaagtgcatcagggtatgtgaagtctgttagagctatttatatatctccntgactagagatgatgaaggttattaaacccagatgaccactactcaggtacatcttcaag

SEQ ID NO: 40740 - DNA, 121 bp, Artificial Sequence
  Synthesized
  misc_feature (61): n=a or g
atttgtgagttaaacaccaatccaatttacgcagattccagccctacagttttttagtcantttacccacagagctcagtattttcctgaaatcataccttgatgctaaataacactgtgg

SEQ ID NO: 40741 - DNA, 121 bp, Artificial Sequence
  Synthesized
  misc_feature (61): n=t or c
ctaaaacatgattccacaggatacacatggaaaggcactaagtgtagcctaaccaactttngggcttgaataagcagttggcgattatttattgtccctttttctattagccttatattca

SEQ ID NO: 40742 - DNA, 121 bp, Artificial Sequence
  Synthesized
  misc_feature (61): n=t or c
tccactgtaggagaggagcatttgttgatatatctatgaaaggtgctgaagattagcctangtcttgttgctcttcaaaaaagggaggtcacaggcttgttctggaaataatagcaatatt

SEQ ID NO: 40743 - DNA, 121 bp, Artificial Sequence
  Synthesized
  misc_feature (61): n=t or c
ttgaagcaaagctgcgtcacacgagtttatgttgcgaggataaaatccccatgtggctgtngctcattttaggagcagaacccatcccaacccatctcaacccatccccacccatccccac

SEQ ID NO: 40744 - DNA, 121 bp, Artificial Sequence
  Synthesized
  misc_feature (61): n=a or t
tcagcctgcagttagcagctcacaccctgactgtgccaccctcataccagcggccatcgcnctgatgtaccttaggtcaccctctctggttccaccaccctgcttttttcttgcttttagc

SEQ ID NO: 40745 - DNA, 121 bp, Artificial Sequence
  Synthesized
  misc_feature (61): n=a or t
tactctaatttttcaggaactctgatggagtatagtttaataaatcatctggagtatgtcnctgtacacattcaagtgcacagagatgtagactacagcttgtgatgagtagcttttgaaa

SEQ ID NO: 40746 - DNA, 121 bp, Artificial Sequence
  Synthesized
  misc_feature (61): n=a or c
ctgtaattctacatcctacaaaacaggaaatcaggttaaggagcatgactgaaacttaatntagtaaaactagagaatacagtatacatttaacaatgtgcctccaattacaggttgcttt

SEQ ID NO: 40747 - DNA, 121 bp, Artificial Sequence
  Synthesized
  misc_feature (61): n=a or g
cattttcccccccataaatagatttaaatggaggtgacaagatgggagttgaatgacaaanaattatgactaatttagggcaaaataaaactgcctgcaaaagtgcccagaagcaggagat

SEQ ID NO: 40748 - DNA, 121 bp, Artificial Sequence
  Synthesized
  misc_feature (61): n=a or g
agcaatgatggagaaggctgctaagtaccagtatgcacttgcatggctgtcatccattcgntcagtcctatagcaaaattgagtttggagacaaataaagaaggaagtctccctccatttt

SEQ ID NO: 40749 - DNA, 121 bp, Artificial Sequence
  Synthesized
  misc_feature (61): n=t or c
ttccccctgcccataccacatgtgccctaggttaacgtggaattgctaatgctgaaactcntgtcatgtttgctctcactgcagagctcgtttttccctgctgactcagggagcagagcag

SEQ ID NO: 40750 - DNA, 121 bp, Artificial Sequence
  Synthesized
  misc_feature (61): n=c or g
gacttagcagagcaatccaaaggtagttcatgttggaatggactcgtagtgcttctggggnatctgagggtaagatcaccttatataagatcacctgccagctgcaatgaggaatcttgtg

SEQ ID NO: 40751 - DNA, 121 bp, Artificial Sequence
  Synthesized
  misc_feature (61): n=t or c
cacttttatactctttcaaagactgctggagaaaatcatcctaatgtcagcaaagccaggngtgcgttcctgggagggatggactccagataatgactgacgtgttaataaggctcagcac

SEQ ID NO: 40752 - DNA, 121 bp, Artificial Sequence
  Synthesized
  misc_feature (61): n=a or g
ttttgtctccctttttcctcttttctcctttcttcattttggatggattttctgtacctcntgatttttggctgttgcaaaacaacacttttctgcagtacctgcagtggtttcccatgtt

SEQ ID NO: 40753 - DNA, 121 bp, Artificial Sequence
  Synthesized
  misc_feature (61): n=t or c
actaattagcgttaatgaagagctgacgggtaccgcgaggaggagaggctgacagaggagngagcgcttctggtgcagaaagaaacccttctgtgaagagcagtcacaagaggagatgacc

SEQ ID NO: 40754 - DNA, 121 bp, Artificial Sequence
  Synthesized
  misc_feature (61): n=t or g
ctgtttcaggtaggtttttgcatcctgtgattaggtataagactgaaaactggttttccanaacctagtgtgccatagctccttgtgcacacatatcatacaatcattgtatggtttgagt

SEQ ID NO: 40755 - DNA, 121 bp, Artificial Sequence
  Synthesized
  misc_feature (61): n=a or c
gcttaaaaccaaagataactgtgttcctatgagacagaaagtacaacttacggctcccccnccacccttaaccacacacacctgcagggcagggtgctggagtgccctgttctgtgctcag

SEQ ID NO: 40756 - DNA, 121 bp, Artificial Sequence
  Synthesized
  misc_feature (61): n=t or c
gagtgcaaagtgcatgcagagagtgtgaagggaacatgcaaagtgcatgcaaggagcatgnaaagtgcatggaggaagcatgtaaagtgcatgcagggtacgtgcagtgtgcaaagagcat

SEQ ID NO: 40757 - DNA, 121 bp, Artificial Sequence
  Synthesized
  misc_feature (61): n=a or t
caaattgctttcaatgctcgagtgtcagtgccatcagaattccagcaattaaaaatacaanttttttaagtttttaatcaaaataatcttggcaatttatctaaaattcccaccatgtagt

SEQ ID NO: 40758 - DNA, 121 bp, Artificial Sequence
  Synthesized
  misc_feature (61): n=a or g
aagcagcctcttctcaatgagtgcggtgatggaaaggaaaacataatttcctttctgttgnatcagacacattttgctgttccaccgaatgaaaatgaaagctttggggcggggggggggg

SEQ ID NO: 40759 - DNA, 121 bp, Artificial Sequence
  Synthesized
  misc_feature (61): n=a or c
acctaacccttgatcctatgcaattggccagatgctataggtgctctgtgtgttatttganttttcttcacatttggtcctctgagaaaagaccacagcaaccttccccatcttcaaatac

SEQ ID NO: 40760 - DNA, 121 bp, Artificial Sequence
  Synthesized
  misc_feature (61): n=a or g
tgggctgcgaggaggagggggctcgaggtgatggtggttgggtgcaatgcgtggggctgcnatgtatcccccgtgatctctgctctggttttggggctgtgcggtggtgttgagcgcagtc

SEQ ID NO: 40761 - DNA, 121 bp, Artificial Sequence
  Synthesized
  misc_feature (61): n=t or c
cagctgtagcttctcttgttactgaaaagtcctacttgaccaccagcaacaactcaagaantatagggcatatctcacctctagaaatgaacgtgggaaaaacaaactttgattctgtttc

SEQ ID NO: 40762 - DNA, 121 bp, Artificial Sequence
  Synthesized
  misc_feature (61): n=a or g
cacttcaggtctatgatgaagtgaaaacactacagcctttctgccttattaaaaagcacanaagtaccagatttcttcgcagactttcagctgacccaactcaaacaggcattgccctcct

SEQ ID NO: 40763 - DNA, 121 bp, Artificial Sequence
  Synthesized
  misc_feature (61): n=t or g
gaaaggaacattttaattagctaaaaccagtctgtttcaaacaaagtcccccccctgattntgacatagttaccgattctcccaactgatacagactggatggctgaaccacaaccatttg

SEQ ID NO: 40764 - DNA, 121 bp, Artificial Sequence
  Synthesized
  misc_feature (61): n=t or c
cccctgtttctgcaaccatctggaatttctttggtatcactaaacattcaaaattgaaaanaaaatcacattaaaagcccggcagtattcttgtggtatcccctctgcctctgtacctctt

SEQ ID NO: 40765 - DNA, 121 bp, Artificial Sequence
  Synthesized
  misc_feature (61): n=a or g
ctaacatgcaaaacataaggtgataatctgcacctgttaacagaacacaagccactgagantttacatggaagatcatacacagtgtccacagacaactgcccacagcatggctaaagcct

SEQ ID NO: 40766 - DNA, 121 bp, Artificial Sequence
  Synthesized
  misc_feature (61): n=a or g
ttacaggctatttacttggacacttagaattttaaatcttcaactgtgtgagggcaaaacnagagcaaccagaacagctgcggtgattttggtggaaggactgaaacttccagcctgagct

SEQ ID NO: 40767 - DNA, 121 bp, Artificial Sequence
  Synthesized
  misc_feature (61): n=t or c
caggcaaggggaacagtacttattcccaccaagcaagatgtgtttatgttaatgaatggangagggctgccatgttgtcctctactttgcctattgactgctggttcatgtagcccgttac

SEQ ID NO: 40768 - DNA, 121 bp, Artificial Sequence
  Synthesized
  misc_feature (61): n=a or t
tgtgcagaaaagcttggcttctcactgagtgaactgactgttccacttgtttccagccacngcagtacatggtaccccttccagggaaacttaatttaatcagctgagtagcagcaaggtg

SEQ ID NO: 40769 - DNA, 121 bp, Artificial Sequence
  Synthesized
  misc_feature (61): n=t or c
ctttcatccaactcagattcacaaggcaactttgcagtccctctgttacagctgcactgangcagtcagagggtctgcacgtgcagtaggtgaccatctactgaagaatcctctctccagg

SEQ ID NO: 40770 - DNA, 121 bp, Artificial Sequence
  Synthesized
  misc_feature (61): n=a or g
cgccaactctgcaacaaacagaaatggatctttctgtcaacatgatgctggccaagctaanctgttggtctaaatcagacgttttgagttaccactttgtaagagagtaacaagccccaat

SEQ ID NO: 40771 - DNA, 121 bp, Artificial Sequence
  Synthesized
  misc_feature (61): n=t or c
ctgtgtgcagacagctgatttctcaggttaaattccctttctgcgacagacagcattttgncctcgtatagagaatatcgagattatcttcccatttgaaaatgttttttgttttttttta

SEQ ID NO: 40772 - DNA, 121 bp, Artificial Sequence
  Synthesized
  misc_feature (61): n=a or g
ctcagagcaaagccagcttcagtgtcgggtcctcgtcctccagctgtgtgcttgcaaatgnggggctgggccggctagtccttaagctcagggaccggggaacgggttccagcagtgctgc

SEQ ID NO: 40773 - DNA, 121 bp, Artificial Sequence
  Synthesized
  misc_feature (61): n=t or g
gtttggaactatggagatcttgcatatctttagatgtctgatttattttcttctattgtcnttatgcacatatgtgcatatatatttattaaaaacaaattatagaaaatgttcttggcag

SEQ ID NO: 40774 - DNA, 121 bp, Artificial Sequence
  Synthesized
  misc_feature (61): n=t or c
gtggccttcagcctcgggcacagatcacttcacacagggaaagtgttggctgcatgcccangggccgtctctttgcatcccatttgcattcatgcagtgttggttatgctcgcgcaggcag

SEQ ID NO: 40775 - DNA, 121 bp, Artificial Sequence
  Synthesized
  misc_feature (61): n=a or g
tgttcttggctaaccttacaactttgaaaggagcaaagttcactgagcctaagttagaccnacccagtgagtaaggtgtgtactttctcttatgtcagtcaatcctgacttgtgagaactg

SEQ ID NO: 40776 - DNA, 121 bp, Artificial Sequence
  Synthesized
  misc_feature (61): n=t or c
acatttttcaagctcccaaaccatactgtaagcaatggaaaataagatgtcaaatggtaanatttattattttgaggagtagatagtcactcatctttaaacaccttctctaataggcttt

SEQ ID NO: 40777 - DNA, 121 bp, Artificial Sequence
  Synthesized
  misc_feature (61): n=t or c
ttagcagtttttccccacactagtcctggcatgttgaccttggccaattgcaagccacctnctagcctctctctcgctccccatcctcaacaggacagagggaaaaaataaagagagaaga

SEQ ID NO: 40778 - DNA, 121 bp, Artificial Sequence
  Synthesized
  misc_feature (61): n=t or c
aaccagttggatgctatgtgggttcccagcaggggacagataaatctcagcttctctctgnctccagaaagcccagacttgcatctgggggtttggcttcctgcagcctgggacagggcct

SEQ ID NO: 40779 - DNA, 121 bp, Artificial Sequence
  Synthesized
  misc_feature (61): n=a or g
taccacaaggttcctgctgctaaatactgtcaattttaggaagttactgcaaatgaagctncatggactgagggctccgatgagattttctgacctgtcatggtattctagtggaagccac

SEQ ID NO: 40780 - DNA, 121 bp, Artificial Sequence
  Synthesized
  misc_feature (61): n=a or g
ttaatacgctgcattttcacattccatgcttactgcttaatttgatttcaaatggtgtatnttacgacagttccactgaagtcaatggaaagagtccaatttacaccatgtacgaagctgg

SEQ ID NO: 40781 - DNA, 121 bp, Artificial Sequence
  Synthesized
  misc_feature (61): n=t or c
ccatagggataaggctgggactgtccaaccccacagctctggtgcccaatgatgatgagangttagtggtgtagaactgtaggatcagagaattgcaaaataaccagagtaggaagggacc

SEQ ID NO: 40782 - DNA, 121 bp, Artificial Sequence
  Synthesized
  misc_feature (61): n=a or g
atccattttaatttacagattttcattgtagtctggagtataacaagctcaagaaaagtcngatttcccagcataagctttcttggtaaggacagaggtgaaacaaagccctcaggcagat

SEQ ID NO: 40783 - DNA, 121 bp, Artificial Sequence
  Synthesized
  misc_feature (61): n=t or c
cgcttataaattagacagaaatatatattgtattgcagttctgtggtgtttatctgtcagnatagtctctgacaagtttttctcagtacaactagtgcttttccagtgtttgcacatggct

SEQ ID NO: 40784 - DNA, 121 bp, Artificial Sequence
  Synthesized
  misc_feature (61): n=c or g
cgagctttccactacttctatctcaaaatttcctttttcttagaaatgaccatgatcaaantgggagagaaatttttattaaagcttcttgccaagtgcaagtacaaaaacagatcaatta

SEQ ID NO: 40785 - DNA, 121 bp, Artificial Sequence
  Synthesized
  misc_feature (61): n=t or c
gtgattctatgattctcactgggacatcagctcttccaaagccctcagaatgaagtgtacngagaaataaatgagaggagaagagatctgggatggggtcacgtcttgagaaaactgtatg

SEQ ID NO: 40786 - DNA, 121 bp, Artificial Sequence
  Synthesized
  misc_feature (61): n=t or g
atacatttcatactctgcccttttattttggcaggggaattgctgctggaggaaagctttnccatccctgcgtgggagtcagagccaatagccatgctttggtgcagggaagggatcaggg

SEQ ID NO: 40787 - DNA, 121 bp, Artificial Sequence
  Synthesized
  misc_feature (61): n=t or c
ttgggtacaactcctccaaaagcattgaatttctttcctgagatgcgccacctcgctgggnctgtgcgctctaattgtgattgctccgtaccctgaagctactgccaggctagatcttgac

SEQ ID NO: 40788 - DNA, 121 bp, Artificial Sequence
  Synthesized
  misc_feature (61): n=a or g
ttttccttatctaaatagagaataattggaaaaatggatgaagatttggtggctgctcgtnggtggttgcctggaaattcttttttattcttttccccatacgcccataaaagtaattaca

SEQ ID NO: 40789 - DNA, 121 bp, Artificial Sequence
  Synthesized
  misc_feature (61): n=t or c
gcagggctatgtcaagcctggaaagagtcttaggtagacatctaacaatgctgttacccgnttcgccataactcttggtgatggtctgtgtttctaaaatgtgagacaaagacccaggtgg

SEQ ID NO: 40790 - DNA, 121 bp, Artificial Sequence
  Synthesized
  misc_feature (61): n=t or g
ttctcaactattatgttgagacaatgttttattgtaaagcagttatttttagaggaattgntttttttgccatcctcaagttagaaactttgaagaacaggcaatttgtctgaacatgatc

SEQ ID NO: 40791 - DNA, 121 bp, Artificial Sequence
  Synthesized
  misc_feature (61): n=a or g
tgccttcaacctgggggatgtttttgtacaaagtggcaccacttactctccctactggagnacatggaagaccagggaagctctgctgatgtccttttgtatccactgattcatggtctgc

SEQ ID NO: 40792 - DNA, 121 bp, Artificial Sequence
  Synthesized
  misc_feature (61): n=t or c
gtgcacgcacagagcctgtgtgcagcagcgtgtgcatgcactcacacctgtaaggatctgnacacacaattgtgcacacactgacaggctcatgctctcatgcacaaaactgtgcacggag

SEQ ID NO: 40793 - DNA, 121 bp, Artificial Sequence
  Synthesized
  misc_feature (61): n=a or g
aattgccaagggcacaaagatgacggatgatacaataatgacagacttattttcattccanttctaaatttttgtgaatagaacatttttatttctaagttcaacttactgcacgcatcaa

SEQ ID NO: 40794 - DNA, 121 bp, Artificial Sequence
  Synthesized
  misc_feature (61): n=c or g
tacttgcagcaggtggctgcagttttggtatgtgtggcctgtgactatgggcagactgttnttctccttgctctgttgtgctgtttccagaagtttgccttgaggccttggaggtgtgtct

SEQ ID NO: 40795 - DNA, 121 bp, Artificial Sequence
  Synthesized
  misc_feature (61): n=a or g
ttgcagtttctgcttgatatttgtgtgagccaaggagtttacagggaaatttggcggtganttaaactagaagggccaaaagggtgttgctaagaaagcaaaagctgtggaatcatgtgaa

SEQ ID NO: 40796 - DNA, 121 bp, Artificial Sequence
  Synthesized
  misc_feature (61): n=a or g
ctttttttttgtttgtctctgcttttctgagttttacagaaatgttccagcttgttttccngggaaattatttgtttacctgatgttaatttttcttcactgagcagaaagtcctccaagt

SEQ ID NO: 40797 - DNA, 121 bp, Artificial Sequence
  Synthesized
  misc_feature (61): n=t or g
tactgttaactgtctaagacagcaaggaatgacacattataaataggaggtggcttcaganagattccagaaatggatggtgagcaatcactgtggcaaatcaatgctccagcagcgagca

SEQ ID NO: 40798 - DNA, 121 bp, Artificial Sequence
  Synthesized
  misc_feature (61): n=t or c
ctgataatcaaccagtgaaacttccaaggagaccatactctgtgagctgaagaaaacaganctgtcctccactaagccccaagtcactgcattgagctgttaacatcagcagagaaaaatc

SEQ ID NO: 40799 - DNA, 121 bp, Artificial Sequence
  Synthesized
  misc_feature (61): n=t or c
gttttctgcaggcagtcagaatggtgacaggaggtatggccacaccaggcaaagcatccangatcctctcaccctgagatctccagctgatgtaaatccattgacttctcaatgactatct

SEQ ID NO: 40800 - DNA, 121 bp, Artificial Sequence
  Synthesized
  misc_feature (61): n=a or g
aaagagaaaagaatgtttcacaaaagagcaaaaaaatgccctttggcatgctggaaaaagntaccttttgtatgagtaaggtagaccaagcttctgatagagggaagagctaagaatttgt

SEQ ID NO: 40801 - DNA, 121 bp, Artificial Sequence
  Synthesized
  misc_feature (61): n=t or c
aggagaaatctctattgcaaacccctgtatgtcatgatctggctcagcccacagagttatntcagaacacagaattgtgttctgaattttctttcagtaacactaaaacagaatgtatgat

SEQ ID NO: 40802 - DNA, 121 bp, Artificial Sequence
  Synthesized
  misc_feature (61): n=a or g
tccttattcccagtctagggatgatctagaacctgactctcacacaacaaactagcccacngcctcttgcaccttttgccacattccaaggtaccaccatgagcagcacttacaccacagc

SEQ ID NO: 40803 - DNA, 121 bp, Artificial Sequence
  Synthesized
  misc_feature (61): n=a or t
ctccgagaggctcctgctggagtcaccaagaaggaattcaacctcacgtacccacataaancacagcatttgacacacaaacagcacgtgccatttccatatcccaaatgtcctaataaaa

SEQ ID NO: 40804 - DNA, 121 bp, Artificial Sequence
  Synthesized
  misc_feature (61): n=t or c
gaaaccagcataacaaatatttttattgctactattcagttatacactactctactagagnactgatatattctctcctgttcttactgtccctcctcattcttaatattttatgtgcttt

SEQ ID NO: 40805 - DNA, 121 bp, Artificial Sequence
  Synthesized
  misc_feature (61): n=a or c
aattactgttaaaagatgtaattagtagcttctgttcccagctctactttgtattgagtgnattaggaaagatgatatgctactatgtgtcctgctagaaatgggatacataggaaataga

SEQ ID NO: 40806 - DNA, 121 bp, Artificial Sequence
  Synthesized
  misc_feature (61): n=a or g
acagtcaacacagtcatgcagtggctaagttttcaaagtcatcagcagttgcatttaatancaatggaagttactaattttggaagggttttcagagagctcctgaagaaaaagctgggca

SEQ ID NO: 40807 - DNA, 121 bp, Artificial Sequence
  Synthesized
  misc_feature (61): n=a or t
taacaaggaggttattttgtgagatacgattttatgtgatcacaaatggtaaataggcacngaatatgtagctcatccttagaagagcgggtttttgaaagaaaactcattgaaattatac

SEQ ID NO: 40808 - DNA, 121 bp, Artificial Sequence
  Synthesized
  misc_feature (61): n=t or c
aggaagtatgtatgacaaaatgttgctatgattgcttttaactctacagcagagcaaaaanttgttgaaaagactgtttttaaaaccgtgataaaacatagcagatttattttagttttgt

SEQ ID NO: 40809 - DNA, 121 bp, Artificial Sequence
  Synthesized
  misc_feature (61): n=a or g
aaaagccatgtgcaagcagtgcacaagcaggagagcacagaaagaaggcatgtcccctccntgcactccctctggcatgcagtgggtttcatttacttggggcctctcaaggtgctgtaaa

SEQ ID NO: 40810 - DNA, 121 bp, Artificial Sequence
  Synthesized
  misc_feature (61): n=t or c
cagtctttgccatttaatcaaggaatcctgacagaggaagcaggcacctttttcttttatnacagggtcattttgtgcactgactagtgctgaagcacaaagtgtacacatgtcagtgact

SEQ ID NO: 40811 - DNA, 121 bp, Artificial Sequence
  Synthesized
  misc_feature (61): n=t or g
atagcgattcggctccttgcggtgctgcaacagctgctggtgcccctagagttagaaatanggcatggctgctattttagactgcaccagcgctgctattgatgcctgctaggtaaagcga

SEQ ID NO: 40812 - DNA, 121 bp, Artificial Sequence
  Synthesized
  misc_feature (61): n=t or c
aggatccacagtgtctttcctttttggtagtccaagtagatcaggtgcttttttttagacntccaagccaggaggacgttatggaaaatccctattctggcacagcagcatcagaacattc

SEQ ID NO: 40813 - DNA, 121 bp, Artificial Sequence
  Synthesized
  misc_feature (61): n=a or g
tgtgagtttggcaattattctacatatttaagtgcctcctaattgcagacacagtagcatntttcagcaaatcaaaataatttagcaatgcatattaaaaatttgactttgacctcagatc

SEQ ID NO: 40814 - DNA, 121 bp, Artificial Sequence
  Synthesized
  misc_feature (61): n=t or c
gaaaaaaaataatgattgggcagtgtcagttttggttttcagagcaccaaggggacacatntccaaatttcagtttgaaactactaggaatagttttttcccttttgatttgtccttccag

SEQ ID NO: 40815 - DNA, 121 bp, Artificial Sequence
  Synthesized
  misc_feature (61): n=a or g
tacattcaccagcatctgtgaattttgagtgttgactatgtggtttcaccccctttttcanttggaaaaggaaattaactgctgatgtggactggatatctcaaagaatatttgaaaccaa

SEQ ID NO: 40816 - DNA, 121 bp, Artificial Sequence
  Synthesized
  misc_feature (61): n=t or c
gcacgtcagcacccagccccagtgcgggctgatcccacaaagccaacgtgctgaaacacgncccgcgtgaagatgcttcagacgtgaagctggaggtgggcgttgtgttactgggagcagt

SEQ ID NO: 40817 - DNA, 121 bp, Artificial Sequence
  Synthesized
  misc_feature (61): n=a or g
gcgacaatgagcacagcaggctcaggcagtgatagggcactgctggggacagctgctctcngtggcttttcttttcctttggattgggtgggaatttggcatttcatgtgggtaacgtgga

SEQ ID NO: 40818 - DNA, 121 bp, Artificial Sequence
  Synthesized
  misc_feature (61): n=t or c
ggtgctaaaatcttgatgtgtttgcagtcagagcttagaatttgccagcttgaattattcntgaaaaaataatcaacctgctttccgtgctgtgtggtaccctccattctctgcctaaatt

SEQ ID NO: 40819 - DNA, 121 bp, Artificial Sequence
  Synthesized
  misc_feature (61): n=a or g
caacaaggatgcagaagggataaaaaattcctgtgaggggagtgtcagtagagagaaggangaagaagaataaatgcatttgtgtgaaacattgctccttgtttgagtaaatagtactggt

SEQ ID NO: 40820 - DNA, 121 bp, Artificial Sequence
  Synthesized
  misc_feature (61): n=t or c
tcatgctaatgctacagacataagcaaggcatagaaagaaaatcaattatttatttcctanttctgggatagagctttcctgttgtaacaagatcaccaaagttaaagataggaagtgaaa

SEQ ID NO: 40821 - DNA, 121 bp, Artificial Sequence
  Synthesized
  misc_feature (61): n=a or g
aggttgggcaaacccagtggtgggcggttggaccctgttgccctgactgccaacccagtgngttgagccagcccagaaagcaacagcaaagagcagcactgtcagagcacacagggcatat

SEQ ID NO: 40822 - DNA, 121 bp, Artificial Sequence
  Synthesized
  misc_feature (61): n=a or g
gcatgctatgtttgagcacaagtgcaaggaagaactgaaacagcagcagagagctgacgangaacctgggctgctcgcagtgacaggtcagctgctgggacccttcggagcacaaactctt

SEQ ID NO: 40823 - DNA, 121 bp, Artificial Sequence
  Synthesized
  misc_feature (61): n=t or c
ctcctgtgggtggaaggatgcagaaaacagcttgcaaaaggagaaatccaatttctaatgnatattagaaactgttagggtattttacttaaaaacaaccaagacagtatgccactaacaa

SEQ ID NO: 40824 - DNA, 121 bp, Artificial Sequence
  Synthesized
  misc_feature (61): n=t or c
ccccacagttcccccatcccagagaacaccccacctccatcagaataggctggcaggacangtctatttaatcctatccaacattaagatctgagagccattaagatgagatcttaggcta

SEQ ID NO: 40825 - DNA, 121 bp, Artificial Sequence
  Synthesized
  misc_feature (61): n=a or g
cgtgatggagagcttcctgaaaatccagctgggaaagtgtagcaaagggatgggaatttcntggagatggaaggagtagggacaacacactgttgtttctcagttgtacatcagaacgctt

SEQ ID NO: 40826 - DNA, 121 bp, Artificial Sequence
  Synthesized
  misc_feature (61): n=a or g
ttcatcttcatgaccacagctcaaagaccaacaggatactcggccataacttaacacaacncagactaagagtcattagcagaacacaaagataattcataaaatttaaatgaatcagtga

SEQ ID NO: 40827 - DNA, 121 bp, Artificial Sequence
  Synthesized
  misc_feature (61): n=a or g
gaaatgcttcgtaaagtcaaagattgagagcgtccgcagagcgcgaggcagagttattacnccggaaagctgtacatcaagatttatgagcagcgttgtgtgtaatgaaggctaattgtaa

SEQ ID NO: 40828 - DNA, 121 bp, Artificial Sequence
  Synthesized
  misc_feature (61): n=a or g
tggtctgcatttgcaagacacaaaccagaatttgtctaggatgagggcctgacctctgaancagtgtgttggcatagggtacacagggaaaatcctgtattccatgagtggtgtcactaac

SEQ ID NO: 40829 - DNA, 121 bp, Artificial Sequence
  Synthesized
  misc_feature (61): n=a or g
aatactcaggctcccacctcctcatctgaggcagaggtgctgagtgctcctgagccacagnaccccccagcagcgcttagctcgatggcttttattggttttttttggaccacatatcctg

SEQ ID NO: 40830 - DNA, 121 bp, Artificial Sequence
  Synthesized
  misc_feature (61): n=a or g
ctagatttttatttgtcttttctcttctgttacatatttccaagcctgttttgccaaaagnaaaaaaaaagtgcttataactttgtttctaaatgcaagccaagagcctccttcacatgtc

SEQ ID NO: 40831 - DNA, 121 bp, Artificial Sequence
  Synthesized
  misc_feature (61): n=a or g
tagaccatgccagtttcaacaaccctaccactgcactgttaaattgtcagtgctgtgagtnggataatgagacagttccctaaaatgtcctgaggaaattgcacactgtcccatacaaccc

SEQ ID NO: 40832 - DNA, 121 bp, Artificial Sequence
  Synthesized
  misc_feature (61): n=a or c
acatcttttagtggaacattaatgcacactgtttgcaatttacaaccatagaaagaatttnttctgcagagttactgcaggtaacattttaatctcgtgagacaaaacacctgagtccggt

SEQ ID NO: 40833 - DNA, 121 bp, Artificial Sequence
  Synthesized
  misc_feature (61): n=a or g
tgttttcttaagtaagaatctaagtgccgtttgaaaaagttgtgctttttaatgagcagtncactttataaataataaggttgtatccattttcttttacgaagttagtcatcttttgact

SEQ ID NO: 40834 - DNA, 121 bp, Artificial Sequence
  Synthesized
  misc_feature (61): n=t or c
caatggtgttgagctttccagagaagagcaccagctgcggggagagcacacaggtcacagngtgtaaacacatcagggaagtcccataaaggggcacacaacatgggcacgaagcccaggg

SEQ ID NO: 40835 - DNA, 121 bp, Artificial Sequence
  Synthesized
  misc_feature (61): n=t or c
ttgggatctttctgaacttctctgccaacaagctctcattttacaatgccaaaaagaaaanagctttgtacacttttaccagtattggtggtagcagactggaaaggaaatttgttccctt

SEQ ID NO: 40836 - DNA, 121 bp, Artificial Sequence
  Synthesized
  misc_feature (61): n=t or g
aacgtattccacatactttaaatcaggttcctttcactattgcctttggtctttagcttgnttaaacaaatctgttttcatttggttgtaccttacatagtctctttaatactctggattt

SEQ ID NO: 40837 - DNA, 121 bp, Artificial Sequence
  Synthesized
  misc_feature (61): n=a or g
tgttactactgattcttttttttaattgtatgcaaaaagattgctgtccaagaacatcacnggtttggtaagacaatctgaaaataactgttgctatcaaaaatgtatgtctggaggaatt

SEQ ID NO: 40838 - DNA, 121 bp, Artificial Sequence
  Synthesized
  misc_feature (61): n=t or g
gtaggttatccaataccttctggtaaaatcagaattaaaattcaggagcctctaatttctncttctctctttagttggaacaatcacattcttatttaaagaggtgatcttcttcaaaacc

SEQ ID NO: 40839 - DNA, 121 bp, Artificial Sequence
  Synthesized
  misc_feature (61): n=a or g
atagctgcaaaaccagcagctaacagcttcatgctatgcttcatctgcagaccttaacaanctgacagctgcctttgcttccagtgacgcttctcaaagctgaagccttttatggcctcat

SEQ ID NO: 40840 - DNA, 121 bp, Artificial Sequence
  Synthesized
  misc_feature (61): n=t or g
ctgacttaagctttgacttagtttcttcttctcctaaaactttctcagttttaggaggtgnctgtggacaactgggaaatgcagaatttgcaacttgccacagaaatatttcgatccttaa

SEQ ID NO: 40841 - DNA, 121 bp, Artificial Sequence
  Synthesized
  misc_feature (61): n=a or t
tgatggtatttaaacaactagctatagcactaaaagctttcttctagccacaactctaccntatgtaccagcttagagtaggtacgtgaaaaacaccattacatgcttgagttcaaggaat

SEQ ID NO: 40842 - DNA, 121 bp, Artificial Sequence
  Synthesized
  misc_feature (61): n=t or c
tgcatcgaatctagaacgcacggtttaggtttcttaggtggagtgtctttcatatcttgangtatatctcaaaatatagtaagtacgataacttcagaataatatttttttcatttaacaa

SEQ ID NO: 40843 - DNA, 121 bp, Artificial Sequence
  Synthesized
  misc_feature (61): n=t or c
gtgagatgtttatctgttgctggagttacaggttgtgatatgggttgaagcttttccctanattcacagttcctttgctacaaataccatttctttttatttttcatgaaaaatgattctg

SEQ ID NO: 40844 - DNA, 121 bp, Artificial Sequence
  Synthesized
  misc_feature (61): n=t or g
tataagatttataaggtttacaagttctgctttgtttaaattcaaacaccagaagaaaacntgcagaggaacatgtttatgcattaactggaagaggaatgctaacacaggccactgtgaa

SEQ ID NO: 40845 - DNA, 121 bp, Artificial Sequence
  Synthesized
  misc_feature (61): n=c or g
ctgtctcagaggtgaaaattggcccatctgcctcttcttgcagcacaggtagcagctgctnttcatacactgggagggcgactgaggaacgcagtatcttaaatcagtgtattacagacat

SEQ ID NO: 40846 - DNA, 121 bp, Artificial Sequence
  Synthesized
  misc_feature (61): n=a or g
gacatagaagcagcccgagccactgcaccctctcctctgaaaatacctgggcaaatacagncaagctgttacttactggtgagacagctatgtaaatgaacatgaatggttactagtgaca

SEQ ID NO: 40847 - DNA, 121 bp, Artificial Sequence
  Synthesized
  misc_feature (61): n=t or c
ccattattatttcctccagaaaggatcaggctgagctggagggaggcagcaacatctaacnactgcctctttcacagactgtgaaatacgacttcaggtcagagaatcagaaagttgagac

SEQ ID NO: 40848 - DNA, 121 bp, Artificial Sequence
  Synthesized
  misc_feature (61): n=a or g
atcgctccactgcagcgaaatcagctcctgatttaatccctctgtggcagatcctgccccnctgccacccacatcccttgtcccttatcccacctcccttggcctctccccactttgcgtc

SEQ ID NO: 40849 - DNA, 121 bp, Artificial Sequence
  Synthesized
  misc_feature (61): n=a or g
attcttttccctcttagcataaacaaaatgaagcctttcggtaccgatgcttcctgctgtntgctaagagaagtcacatgaagaaataaaaacctttaaaaaaatgggaaaagacaaaagc

SEQ ID NO: 40850 - DNA, 121 bp, Artificial Sequence
  Synthesized
  misc_feature (61): n=a or g
gttgtcatcagcttctgtttgtccatcagtttgtaaactttgtaaactcgacagctttacngaggtattcctacaagaatttcccttgaaaacaggtagtttagaatgaatggacatagct

SEQ ID NO: 40851 - DNA, 121 bp, Artificial Sequence
  Synthesized
  misc_feature (61): n=t or c
tagattatgggcataatcttaatctattgggattggaagccagtatcattcccacactttnctctggtaccagaaatgaagagagccaaaaccagaaagctgggtcatttttttcatagat

SEQ ID NO: 40852 - DNA, 121 bp, Artificial Sequence
  Synthesized
  misc_feature (61): n=t or c
tattgataaatactgcttagatggacaaaataaaacaaacttaaatctaaagtagggcacnttgtgcaacaggaaatagacctttttatgaatatcaagaatgtttgcaatgagatgagca

SEQ ID NO: 40853 - DNA, 121 bp, Artificial Sequence
  Synthesized
  misc_feature (61): n=a or t
gttgaatacttgggcagcgctgtttctggagtgcaggtgtgtacttgcagcaagtaagccncacattcagtaagctttcttgaatccatctgcttttctgtgcatttgtataaaaccttgt

SEQ ID NO: 40854 - DNA, 121 bp, Artificial Sequence
  Synthesized
  misc_feature (61): n=a or g
caaagccaaaggctaaagcggtcttcttcagcagggggtcatcattcagatacaggtatgnaggaacatcatacacttattgaagctgaattgcttgtatcttaggaaatgaactcagaag

SEQ ID NO: 40855 - DNA, 121 bp, Artificial Sequence
  Synthesized
  misc_feature (61): n=a or c
tactttaattatgaaaactgccttgtcaagtgtctctgtagtcctccatttgccacctganaaacaaaataattgtgcgtatgttgctgaggtgtcacctgctaattcaaatcagcccata

SEQ ID NO: 40856 - DNA, 121 bp, Artificial Sequence
  Synthesized
  misc_feature (61): n=t or c
attactaagagtggtcagaggctgctgctgatgcaagagacagaccttaaagaaaaacagngtttgacacagaggataattgaggctggcagggggacctgtgaagggctctagtgcaacc

SEQ ID NO: 40857 - DNA, 121 bp, Artificial Sequence
  Synthesized
  misc_feature (61): n=t or g
tggctccaccccttcccagaccttatttaagggttggcagtgaaggcaaagatatcttatnggagattcctgtgtatcagaggcctctcaaaagtaagtagggttttttttttcccccccc

SEQ ID NO: 40858 - DNA, 121 bp, Artificial Sequence
  Synthesized
  misc_feature (61): n=a or g
atttaagctgtagctcccaattttgatgagacctcagtcataatttttggaatattttcantgagcaataccataaactcacttccattaacagaacatggaaattatcagaaacacaaag

SEQ ID NO: 40859 - DNA, 121 bp, Artificial Sequence
  Synthesized
  misc_feature (61): n=a or g
gctatcaattgtaccatcacaatgctgcgtatatgctgatactgcctgttagatgatgcantatcatccctagaagggcccttgcttggcctgtcaagctggtcaatggtggttgccaatc

SEQ ID NO: 40860 - DNA, 121 bp, Artificial Sequence
  Synthesized
  misc_feature (61): n=t or c
ccgaaacgagcgcgccattcggtttgtggtcatggtcacccctgaagatctcaaggctaangcaggtaattccttagaaccgatcccagaagtgatgagcccaatgtggtccccccccccc

SEQ ID NO: 40861 - DNA, 121 bp, Artificial Sequence
  Synthesized
  misc_feature (61): n=t or c
tctgagctagcacagagctgcatattgcctgaggtattttggccttgcacctgaggagacngctaatgaaatagaaggctctatttccaaccccgctgaggaaatggaaccttcatacaaa

SEQ ID NO: 40862 - DNA, 121 bp, Artificial Sequence
  Synthesized
  misc_feature (61): n=a or g
ggtggtgaacaggagagcatggtggtgaggaacaccttcagccttcaacctcctacagctnggggtagcaagagaggtctcccctcctttcacttcctgatgcctcaccagtaacgttgcc

SEQ ID NO: 40863 - DNA, 121 bp, Artificial Sequence
  Synthesized
  misc_feature (61): n=c or g
atcattgaagccaggctaacacgtaattatttagtttaggtgtaacttaattcttggaaangctttttcatgaatttaacatcaaattgttgtttaaaaaatgaattggctgctgaaaatg

SEQ ID NO: 40864 - DNA, 121 bp, Artificial Sequence
  Synthesized
  misc_feature (61): n=a or g
ttttcttgggatgggagctttgatatttgcttgtggtataaaaagagctttcctggagagncaccagaaagagtagtctgaatgatgcctccttctcctgcacttcctgtcattctgcaac

SEQ ID NO: 40865 - DNA, 121 bp, Artificial Sequence
  Synthesized
  misc_feature (61): n=a or g
ggttcaaaatatataatggagtcaaaatgttacccaaatggtaaataagagaattttttanaatataatagctctctgcttcccagcctgcaggcacacaaatcaggaaacctccccaaac

SEQ ID NO: 40866 - DNA, 121 bp, Artificial Sequence
  Synthesized
  misc_feature (61): n=t or c
aaatgtgtggcaggatcaaacagcacaactcagactgccctggaaatctgctgtagataanataaattcacaggcacctacacaccaaacacagcaaagctggcaggatttaaatcaattc

SEQ ID NO: 40867 - DNA, 121 bp, Artificial Sequence
  Synthesized
  misc_feature (61): n=t or c
ggttattggtggctgggttagggttggggtatggttacggttagagttaagctattagggnttggggcagggttaggattacagttatatgacttttaggatcagggctagggtttggatt

SEQ ID NO: 40868 - DNA, 121 bp, Artificial Sequence
  Synthesized
  misc_feature (61): n=t or c
gaagatttctcctccactcctctcctttcctcaagtggaattccagcttgacatgccatanatttctgttttcccctagaagtatgaatctgtgatggttcctacacaagacccaaagatc

SEQ ID NO: 40869 - DNA, 121 bp, Artificial Sequence
  Synthesized
  misc_feature (61): n=t or c
gtagtcacagccacatttgtctccttcaagggtgtgcataatatgctccagtatttcatgnttgcagttgtaaaattactattttgtgtaagaactataaaatagcaacataagaacttct

SEQ ID NO: 40870 - DNA, 121 bp, Artificial Sequence
  Synthesized
  misc_feature (61): n=t or c
ttgtgacagcgaagtgagaggagagccaaaattcttttatctttgtcttaactcttccgcnaatgtaatacatcttgatcaatctccagtgagaataaattagaaaccactttagctgata

SEQ ID NO: 40871 - DNA, 121 bp, Artificial Sequence
  Synthesized
  misc_feature (61): n=a or g
ggtaaggaaaggtttgtaggtttctcagactgagggttggcctgggggcagttctgcctgngacctgtggtggtccctggacaatgctgcaggacatcagaggggggtgccaggcagggag

SEQ ID NO: 40872 - DNA, 121 bp, Artificial Sequence
  Synthesized
  misc_feature (61): n=c or g
tttcccaaagggagagcctgggcaaatactttttactcttttatagcgagaatacaaaatncatgaggaaaatatatatttcattcaccataatttcctctaatatgtagtcctccctcat

SEQ ID NO: 40873 - DNA, 121 bp, Artificial Sequence
  Synthesized
  misc_feature (61): n=a or g
atgtgtctaagtctgatgcctagagatatggtcaatagtttggttatgtctgggcatatgnatgctccattgttactgctcttggctgtcaatttcaagatgtcctactttcagttaatat

SEQ ID NO: 40874 - DNA, 121 bp, Artificial Sequence
  Synthesized
  misc_feature (61): n=a or g
acgtgacgtttttaattcaggaagtaagagaattgcactttgaggtaaacaactacaaccntgcaccgtgaactgctctaatgttaagccccagtcccctgatgcacccacagctcccagc

SEQ ID NO: 40875 - DNA, 121 bp, Artificial Sequence
  Synthesized
  misc_feature (61): n=c or g
accaaaatactcctcagtttttctttcataacgtctggaatggggcagtgggtaataacantcaatcctacacagatgtgtattcagctctcataaggcatgcctcacctgttcaaaccct

SEQ ID NO: 40876 - DNA, 121 bp, Artificial Sequence
  Synthesized
  misc_feature (61): n=t or c
gcaagaagcgcgttacatattgaactcctacccatgaacagagctgtgacaccaattaaanggtctgccaccaacatctgcatcttccttcgggtgacaacatagtgtgaaggctttccat

SEQ ID NO: 40877 - DNA, 121 bp, Artificial Sequence
  Synthesized
  misc_feature (61): n=t or g
gaatttatatttgcaacaatttgcattttaaacttttcctatctaatagccaggttaaagnaaggcaaagttaacacaagcaaagtgtctaacatggagcagtcctcagtgtggcaccttt

SEQ ID NO: 40878 - DNA, 121 bp, Artificial Sequence
  Synthesized
  misc_feature (61): n=c or g
tatcttgttcaacagtatgaaaaacctagaataaataatgagagcactgtactgcaaatanatggggaagaaaaatatcagaagaaaaatatctcccttaaagtgtactgcaaaagccatt

SEQ ID NO: 40879 - DNA, 121 bp, Artificial Sequence
  Synthesized
  misc_feature (61): n=a or g
ggtttgatttgcttgggtttcaccttgtataactttctatttttgtgttagacacatagtnggatatctttactcaagcaagcctggaagaaagctgagctcagctagaagggaggcaaag

SEQ ID NO: 40880 - DNA, 121 bp, Artificial Sequence
  Synthesized
  misc_feature (61): n=a or g
gtgggggtgagactcctccctgcaccttaggcaagtctttgccttgtatccccctttgcanaggagttcactaatatggaaacagggagatggggagattctgcacttcccaatgaagaca

SEQ ID NO: 40881 - DNA, 121 bp, Artificial Sequence
  Synthesized
  misc_feature (61): n=a or g
ctttagttctaggagcctcacgcgctgggcagagattaactgctctcaacccagaaacacngaacatggaagaagtgtattagaggtatttaaatataaatcttacaaatagcttagtagt

SEQ ID NO: 40882 - DNA, 121 bp, Artificial Sequence
  Synthesized
  misc_feature (61): n=a or g
actccaccaccactggccatccctgctaagaggtcatcgttgctcttagtctgaaagaaangtaagatgcagcttacagacagctggctgacaagtttgcatagccaacatttcttctgtg

SEQ ID NO: 40883 - DNA, 121 bp, Artificial Sequence
  Synthesized
  misc_feature (61): n=t or c
ttgggttcccttccagcccgagccattctatgattccatgtagggttcataggacagaagngatctctatgattagaaatatctcattcaaactcgaaactgaatgtgaaaacactgctgg

SEQ ID NO: 40884 - DNA, 121 bp, Artificial Sequence
  Synthesized
  misc_feature (61): n=a or g
aaccccgctgtgtgctgttagctctgctaggtggatatgaggcaaagaaatgaatcagaangaaatgttgatagaaagcacctcatctgtggtgaggagttctgacctctcattgaaaaca

SEQ ID NO: 40885 - DNA, 121 bp, Artificial Sequence
  Synthesized
  misc_feature (61): n=t or c
agcctcgcctgagcgagaggccttctgcgtttggctgtgctggacttcagtgaaatcaacntcttcctttcattccttcctgaggaatctttaactgaaaaatcctgtccatgttctgctc

SEQ ID NO: 40886 - DNA, 121 bp, Artificial Sequence
  Synthesized
  misc_feature (61): n=a or g
agcctttggtgctggcagcggccggtggtcctcactctggtcgttgtgacaactgacttcntgtcctgcagctgcatggcactgtttcttttggcacttgtaccagctcgtttctctgagt

SEQ ID NO: 40887 - DNA, 121 bp, Artificial Sequence
  Synthesized
  misc_feature (61): n=c or g
gctacaaagtcacgataggaatcccttccctttttaaagatatggtggcttggagaagtgnaagctcatatttattctccatatggattattttctgctcctattacatctttccttctga

SEQ ID NO: 40888 - DNA, 121 bp, Artificial Sequence
  Synthesized
  misc_feature (61): n=a or g
gaaccctcccagtttaacacgccagacctaaaggcagatcagccctcacacatgcagaacncagcctctgccctttcagtctgatcgcagcagcatagggaaaatccctcaaaaccaaaag

SEQ ID NO: 40889 - DNA, 121 bp, Artificial Sequence
  Synthesized
  misc_feature (61): n=t or c
ggggagtgaagttggggatttgagggtcctggtcctgcctggtcccccttgatgttttggnctccttaaacaacacattaccgtgaatctgaagatgctgtgttgtgttatctaactctct

SEQ ID NO: 40890 - DNA, 121 bp, Artificial Sequence
  Synthesized
  misc_feature (61): n=a or g
tctatactgtacacttgggcatgtggctatggtcaagggagaaggaggaaacaggcacaanctggtgacaattctggacctgcaattacaggtaccaatttgcatcactttgttttgtccc

SEQ ID NO: 40891 - DNA, 121 bp, Artificial Sequence
  Synthesized
  misc_feature (61): n=t or g
ttaattaaaaacaacaaaaaagttaccacctaaagtccctcctccatcaccaacaaactgnctctaaacaacagcttggtttgacttgtcaaaagaaaaggaaagattgcaaggaataaat

SEQ ID NO: 40892 - DNA, 121 bp, Artificial Sequence
  Synthesized
  misc_feature (61): n=t or c
acagacagtcacacaagtggaaatctgtccaggaatagaaagaacatgctaagcaaaaatntgtgtcagaacgtaagttagctactgccactgttctgataaagaaacaacggtacagaga

SEQ ID NO: 40893 - DNA, 121 bp, Artificial Sequence
  Synthesized
  misc_feature (61): n=t or c
catgtgacatccctcagtaccaggggacagctacaaagaggatgctgttgtactgccaatntggtctgtaagaacagcatggtctgtttaggtttgaacatatttgcagtggaaaaacaaa

SEQ ID NO: 40894 - DNA, 121 bp, Artificial Sequence
  Synthesized
  misc_feature (61): n=a or g
ataagttagattcatttcctgttctttccactggctgccttcgttttgttgaaaaatctcntctaggcagcattctcatggtactgagaatgtggaatgatgctggataacaatcacaaac

SEQ ID NO: 40895 - DNA, 121 bp, Artificial Sequence
  Synthesized
  misc_feature (61): n=t or c
tcctgtcttcacaaggctttttatcttgtttattctcctgagccatgataaaacaaagcangcagatgtgccccaagtgcttactgaattcagccatacgtgctaaagggttttgcctgag

SEQ ID NO: 40896 - DNA, 121 bp, Artificial Sequence
  Synthesized
  misc_feature (61): n=a or g
aatctggggaatgtagatgctatcaattgatggattagttataatctcataacaagcactntatgaatagactatttgaaatgtgacatttggaatagatttcttggcttgatggcctggt

SEQ ID NO: 40897 - DNA, 121 bp, Artificial Sequence
  Synthesized
  misc_feature (61): n=t or c
tgcactgaactgtttctatgtgttgaggagaaaacctcaatatttctctcaaggctgttangtccactttgacagacagaaatagtggtgcatatatatatatatatatacacatatacat

SEQ ID NO: 40898 - DNA, 121 bp, Artificial Sequence
  Synthesized
  misc_feature (61): n=c or g
gagaaaaaaaacagtatctataaaagtatcatgatatagaaaagatcacagtaaaagacantagcagaattaatgccaactgatctgcatagttcctttgaaagtctacatttgtcgaccc

SEQ ID NO: 40899 - DNA, 121 bp, Artificial Sequence
  Synthesized
  misc_feature (61): n=t or c
ccaagtctcctcaagatactgttcattcaaaaagttttcaataccaactctatttctaaanatacaattaacaaagaagtagactgagattccaactcagatgatgttaccttactcacat

SEQ ID NO: 40900 - DNA, 121 bp, Artificial Sequence
  Synthesized
  misc_feature (61): n=a or g
acctctcccacaccggctaagccacatcccacctgggtttgctgtgtccactgggcaagcncatcccacccacatgggctgagtaaagcagcctttagagtgggcagccaaggaggacccc

SEQ ID NO: 40901 - DNA, 121 bp, Artificial Sequence
  Synthesized
  misc_feature (61): n=a or g
ccagattccactgccaaggaattcaaagcacaaacagcagcacagatgctgttacaccagncagcttgcatacgcacagcccaacagtatgctggtcctcagaggtatccatcagaagcac

SEQ ID NO: 40902 - DNA, 121 bp, Artificial Sequence
  Synthesized
  misc_feature (61): n=c or g
ggaaaacaatagcagtattctatggtactgagaagctatggagtatgcttaaaagcttgantaatttttatggtgaaaaatatcaggatgcaattcattatgtagaatttctgttcattga

SEQ ID NO: 40903 - DNA, 121 bp, Artificial Sequence
  Synthesized
  misc_feature (61): n=a or t
ataagaggagatgctgcctgaattatattttaaaaaaataatattaatctaagtttctcantaagtctgcattcaccacatggcaagttacatatccataaaacactagctcaaaatgcat

SEQ ID NO: 40904 - DNA, 121 bp, Artificial Sequence
  Synthesized
  misc_feature (61): n=t or c
gggaaagtttgactgaattttaaccatctgaaagctgtatttctgatataaccttgattangtttcctttgaaggaggaactgctctaaaggcaaattttagtacctcaaagagtggtctt

SEQ ID NO: 40905 - DNA, 121 bp, Artificial Sequence
  Synthesized
  misc_feature (61): n=a or g
attactaattattttttcataaaattggttaggcttatttccctagtatataaaaaataancataaatcctacatgctagttaaaatctcagcaagaactacattttcacatacaatcaca

SEQ ID NO: 40906 - DNA, 121 bp, Artificial Sequence
  Synthesized
  misc_feature (61): n=a or g
tcctctggctatgaatgatctggttaatgatcccaacatctgggagttgtgtcaagagtgntgggacaaactgatagcaaaaacctgtgtgtgaaatagttcttgctacggttctggcctt

SEQ ID NO: 40907 - DNA, 121 bp, Artificial Sequence
  Synthesized
  misc_feature (61): n=c or g
gttcttcatgtgactaggaggatagttctgataggaatctcctccaaatttttatcatttnaggggaaaaaggcaattcacacaaattccttattacaggtaaagtaaaaatttaatacat

SEQ ID NO: 40908 - DNA, 121 bp, Artificial Sequence
  Synthesized
  misc_feature (61): n=t or c
gctacacaaacatatgtgtgttcctctagcagtcagcaacaaaagtgaaatagactcaatntttataagcatcaaacactgcccacatacttgagttacataaaaatgtttggcacagtac

SEQ ID NO: 40909 - DNA, 121 bp, Artificial Sequence
  Synthesized
  misc_feature (61): n=c or g
gcctgaactattgagtcaccttgatattctcaatgttagtcttgtgtcctgcacaaccaangtatgtcctgttttcctctagttttcccatactcaatgcccttccaaagttgaggacttt

SEQ ID NO: 40910 - DNA, 121 bp, Artificial Sequence
  Synthesized
  misc_feature (61): n=t or c
gggtagtgaattctttctctacaaactcggattttaaagccttccccatttgtgatggtgntcttctcaggtttgtgaacgtgtgccacacttacgttcttgtgagctgtcatgcaggcgt

SEQ ID NO: 40911 - DNA, 121 bp, Artificial Sequence
  Synthesized
  misc_feature (61): n=a or g
atgtagtaaaattgccataagtaggtcaatgctgaaaaacagttgagtaaaataagccacnttaactaacagaattagaagataatcaaatcttgaaaatgcagcataaatcacagaacca

SEQ ID NO: 40912 - DNA, 121 bp, Artificial Sequence
  Synthesized
  misc_feature (61): n=a or g
tcttctttgtcaggcttgatttctaccaactcctcttttatcactttcccaggttaaacancacgttgattttgtttctcttaatgttacttcaacaaccagattccatataatgattcat

SEQ ID NO: 40913 - DNA, 121 bp, Artificial Sequence
  Synthesized
  misc_feature (61): n=c or g
gtcttcatccactgcatcctttcagctccaaactattcagcacatgaaataagttgaattnagttctggaattgttatctgagcaagcatatgatacagtaggactgaaggaattattgca

SEQ ID NO: 40914 - DNA, 121 bp, Artificial Sequence
  Synthesized
  misc_feature (61): n=a or t
ttttctctggcacagaaacataatcttttagcctttattgatgtcaatacacatgttaacnaaagatcattctagggtctgttttcattttatctggacattgtccagtcatggcacagta

SEQ ID NO: 40915 - DNA, 121 bp, Artificial Sequence
  Synthesized
  misc_feature (61): n=c or g
acttgaaggctgtcagactgttgtgaattatgtggtagtttataaacaaatctggtcaacntttaaaagcaggctaatttacccagcctataaacctctctctatctctgttccttccttt

SEQ ID NO: 40916 - DNA, 121 bp, Artificial Sequence
  Synthesized
  misc_feature (61): n=a or g
tggtgccgacacaagggtaaaaaaaaagatatgtcaaacatccttgtggctgtcaaaacanaggtcagtaatgtccctgattttgtttcttttgacatcatgttataaagccacccccagc

SEQ ID NO: 40917 - DNA, 121 bp, Artificial Sequence
  Synthesized
  misc_feature (61): n=a or c
gccctgctggatgctctttccttggctttcccttgctcatttgttgcttgggtgctttgcnattgcattcattaatagggtgtgaagtgtggggttggggtccctgacctcctccaaatac

SEQ ID NO: 40918 - DNA, 121 bp, Artificial Sequence
  Synthesized
  misc_feature (61): n=t or g
atttctgatgtttttctttttgctgtagtatatattggataagtaaataggaaatgttctntaaaactaaatcataaaacttccttccatcaccagtgaccagcaagatagggatgcatcc

SEQ ID NO: 40919 - DNA, 121 bp, Artificial Sequence
  Synthesized
  misc_feature (61): n=a or g
aatcatttaggttatgaaaacagtatctggaacactgcaaatatctggttacattaacacncattccagcatactttatgaaattaaaggaaacagtatccaaagaaaaataattactgtt

SEQ ID NO: 40920 - DNA, 121 bp, Artificial Sequence
  Synthesized
  misc_feature (61): n=t or c
tttgccttcaatactcttttttacttctgataaatatcagcttgtagctgatattgactgntgtcatcacaaccctctgaaaatggcataggcttaatttggaacaaacctcaggatagag

SEQ ID NO: 40921 - DNA, 121 bp, Artificial Sequence
  Synthesized
  misc_feature (61): n=t or c
ccctttccaaagacatgactggctccttctgcagcagggatctggagtaacagctcagtgnagttcacagcaacacagcccaatcctcagggtggcagaggtatctgcccaagacctgggg

SEQ ID NO: 40922 - DNA, 121 bp, Artificial Sequence
  Synthesized
  misc_feature (61): n=t or g
agaagctcttggctaagtgagtaggttgaagagcagttattttggcaggacagctggcttncttaccttggggagcttcatgatgaaatcataagcattagcttccttggtagctctttca

SEQ ID NO: 40923 - DNA, 121 bp, Artificial Sequence
  Synthesized
  misc_feature (61): n=a or g
ttgctgcagcttgttgacttgctatctactaaggaagccacttcagactagcttgtggaancttatagacttcttatagaagaaacaacaaagtacggacgttgtgccaaatccttctcat

SEQ ID NO: 40924 - DNA, 121 bp, Artificial Sequence
  Synthesized
  misc_feature (61): n=t or c
tagtaacatttatctcactgtgctgggacttgaaatcttccctgccatcagatgctaatanggttatattattgtggcaatatgggagctgagcctaagtacagttgttacttgttaccat

SEQ ID NO: 40925 - DNA, 121 bp, Artificial Sequence
  Synthesized
  misc_feature (61): n=t or c
tcttctgttaaagtcatccccttcattggttctgcctttttgtgttgatgccttcaagaanaggttcttagaggaggacaaaaaatcagctcctctatttatacagtgctcagcaaaacaa

SEQ ID NO: 40926 - DNA, 121 bp, Artificial Sequence
  Synthesized
  misc_feature (61): n=a or g
caataatgctataaaagcataccgcatgtgacattggtaaaagctggctttttaatggcanccactctgtttataaacttggcaacaaatttcttgacctccacttctaaaatagtgcagc

SEQ ID NO: 40927 - DNA, 121 bp, Artificial Sequence
  Synthesized
  misc_feature (61): n=t or c
ggctactgtggatgtatcactgaagaaatacagtaaacagaatcttgcactaaaaaaaganaacaaaatcacttattttgtctatcaatagcgcacatcctagaaagattagggttgactg

SEQ ID NO: 40928 - DNA, 121 bp, Artificial Sequence
  Synthesized
  misc_feature (61): n=a or g
cccttttggaattttcagatggatgtgcaggctggagaaataacggggatacaacttggcngaagtcagcttgtgcagagagtgctccggtgtgtggtgatacgggctttgtgcacctcca

SEQ ID NO: 40929 - DNA, 121 bp, Artificial Sequence
  Synthesized
  misc_feature (61): n=a or g
actttcaaatcaacaaagcatatattaaagggattaaattcagtttacatgataggcttcntggcagttttgagcagacgttgagtaggtatattcataaggaaagccctcctggctcttg

SEQ ID NO: 40930 - DNA, 121 bp, Artificial Sequence
  Synthesized
  misc_feature (61): n=a or c
gcacccagctgttatctttactgtagtgatgcaagcagagtcccacaggaatgaagtacanagcccaaaatcttgaccagagatgcacagagccacctagggaagggaagaacagctctgc

SEQ ID NO: 40931 - DNA, 121 bp, Artificial Sequence
  Synthesized
  misc_feature (61): n=t or c
ttcagaatgaagaaattaaatcagctgcttcttgcaggtgccttggaagtgttctgttttngaacaaagccaccatgcctatgaagttcgtgatcacacagctgatgctttgatgcactgg

SEQ ID NO: 40932 - DNA, 121 bp, Artificial Sequence
  Synthesized
  misc_feature (61): n=t or c
ttctccatccgcgattaaagcccttttatttcctcttctgatcaggacgcactcggcgtcngctgcggcttcttttagacagaccttcctgatggagaacacacctgaaaaaggtgcaacc

SEQ ID NO: 40933 - DNA, 121 bp, Artificial Sequence
  Synthesized
  misc_feature (61): n=t or c
aatagaaactcatagagctacctgtagaaacatatccttgctccatttctctgatggatgntgcccaggcagtcagtgaaaacatcatgggaattccattgcaactcgacaggcaatgcaa

SEQ ID NO: 40934 - DNA, 121 bp, Artificial Sequence
  Synthesized
  misc_feature (61): n=t or c
aatttccccacctttgcatttccttcctgcttctccataactccctccaaccttttttttngtggttttgcttatgcagtgtcactgtttttcagggcaatcccctcatttattcaggact

SEQ ID NO: 40935 - DNA, 121 bp, Artificial Sequence
  Synthesized
  misc_feature (61): n=t or g
tcagggagctttggatttagttcttctgccttcaaagtagctaaagaatgttggtgtttgnagaccaaacataggacgttgttatttgtcggatatccaagtaatatatttcaaaatggta

SEQ ID NO: 40936 - DNA, 121 bp, Artificial Sequence
  Synthesized
  misc_feature (61): n=t or c
actttaaatctcagctaaatgcaaaatctcttaaagcaacagaaaatattcttgtagtatnaatatgttcctcttgacttgaatgtttaagtctagtgaaatttagtcctcagaacattct

SEQ ID NO: 40937 - DNA, 121 bp, Artificial Sequence
  Synthesized
  misc_feature (61): n=t or c
agtgagtctgattacatgccatcagataaccttgatcgcacactaaaagggcaacctctantccttgtgctgaggcaatatggtaaggagctagttttgcatgtgggtatcataaaggaag

SEQ ID NO: 40938 - DNA, 121 bp, Artificial Sequence
  Synthesized
  misc_feature (61): n=a or g
acagtctcttcaaagtaagtgctggatggtagaagtaactgctgacctcagagcagacacnacctggaggacagcacaacccatctgcttttatgttagacttgatcagtttatagagact

SEQ ID NO: 40939 - DNA, 121 bp, Artificial Sequence
  Synthesized
  misc_feature (61): n=t or c
ttttctatctgagctcttctgatgttggtgtttgtgcagcccttctttgacttggtatcangcatggttctttttatctcctaaacgttgatgcagcgagtctctgctcttgcagtgtttt

SEQ ID NO: 40940 - DNA, 121 bp, Artificial Sequence
  Synthesized
  misc_feature (61): n=t or c
gcagatgctgtgtcatcggctctgggccagcactagacccactacatcaagctgacatggngtgccaacattcatcatcctgtataattctgttgtatcgtgacctgtctgagaagtaaag

SEQ ID NO: 40941 - DNA, 121 bp, Artificial Sequence
  Synthesized
  misc_feature (61): n=a or g
agcgaagcgttcatcacagcgaggagagtaatggggagaggggctccttccaggctcatcnctattcctgcagggaataaatccctggggagaattactgctgagagctgagagagggagg

SEQ ID NO: 40942 - DNA, 121 bp, Artificial Sequence
  Synthesized
  misc_feature (61): n=t or c
cttttttatttggaatgattgctccttatgcaatcatttgctctgttatgcccaaattttngatggctttctcagacatctcagtcagcacttcacttgaaataaatggcaatgttaccta

SEQ ID NO: 40943 - DNA, 121 bp, Artificial Sequence
  Synthesized
  misc_feature (61): n=a or g
tctttgtgggtattctgatgaagccactgacagaatagcaaggtggagatgagttagttgnaagaggacctaattacaactatccgttggacatctgtggtgatggatatcttctgcaagg

SEQ ID NO: 40944 - DNA, 121 bp, Artificial Sequence
  Synthesized
  misc_feature (61): n=a or g
tccccctgcatgtgccaggagggccccgggtttgggatatgctgagaaatacacggacggnttgcagatgggataaggagaaacaaatgtgggcagatgagtgatatcaaagggtgaactt

SEQ ID NO: 40945 - DNA, 121 bp, Artificial Sequence
  Synthesized
  misc_feature (61): n=a or g
gcccaattaacgaggacaccgttagctccccattaatgggttcaaaaacaatgccctgttngggggaaccctattaaaaagtaaaaactgggtgttctatttgcaagtgccctactaatgg

SEQ ID NO: 40946 - DNA, 121 bp, Artificial Sequence
  Synthesized
  misc_feature (61): n=t or g
agttctttctcatgtacttaatgcccaggagaagggtttaatggtgaatggtggagaaggntttaatccccctagacgtggacaggttcttatttacaggccccagtgcctggacatctgg

SEQ ID NO: 40947 - DNA, 121 bp, Artificial Sequence
  Synthesized
  misc_feature (61): n=a or c
atctgtaagtcggtgatgtaagtcggtgaggtgatgggcttcttttgttacaagtctaaangtggatttagccacttaacttcaacctggaaacataaacagctctgaccccggtcgatac

SEQ ID NO: 40948 - DNA, 121 bp, Artificial Sequence
  Synthesized
  misc_feature (61): n=t or c
caatgtatggcctaactattaacatagatctatgagcagagggtgtgagtctcataaacangataagcagggccacattaaatacatgccttaagctataattacccagggtgactgcaaa

SEQ ID NO: 40949 - DNA, 121 bp, Artificial Sequence
  Synthesized
  misc_feature (61): n=t or c
cttctttctctttcctgcaatcgatacactttgtttttatgtctttaatgtcttctttttngtaactgccttttaaaactttctctggttaaggcagttttcgtcagataaagctcactga

SEQ ID NO: 40950 - DNA, 121 bp, Artificial Sequence
  Synthesized
  misc_feature (61): n=a or g
gatgctgggtgctttaaagcacagcaggctaattctgacccaaggacctgcctacagtgcnttttattctgactattcaatcctttctttctctattaaaacagacagcataactcaagcc

SEQ ID NO: 40951 - DNA, 121 bp, Artificial Sequence
  Synthesized
  misc_feature (61): n=a or g
attttttattttttttggacttgactgagtgcattaagcagttgagctgtgaaatttgaanaggaatctatagcttttcccttcttgaagctgcaggtttccagttctgtctgatttgatg

SEQ ID NO: 40952 - DNA, 121 bp, Artificial Sequence
  Synthesized
  misc_feature (61): n=t or g
atttcagggactatgttgtctgaagatgttctttccatttctcttcaatttcttagaatcngtgattatttttatagaagtattactgatctctggtcagacagtcctaagaatctagaat

SEQ ID NO: 40953 - DNA, 121 bp, Artificial Sequence
  Synthesized
  misc_feature (61): n=t or c
agtttaatgcatgacccgcagtactacttactctgggataaatgaattcatgacttcactncagaaaaaagagtggaaaactataggaagatatccaacacaaacacattttcaactgttc

SEQ ID NO: 40954 - DNA, 121 bp, Artificial Sequence
  Synthesized
  misc_feature (61): n=c or g
caacccaaatctatgatttttaaagactatttatgaggcttgccccatatttccattgcgnagactaatggctgaaatctgcagtgggagctttggatgtcttaagcctacacagcacttg

SEQ ID NO: 40955 - DNA, 121 bp, Artificial Sequence
  Synthesized
  misc_feature (61): n=t or g
aataaatgattattcatacagaaacttgcaattttatttttctttcccaagtttcagaaantaggccacaggatttatagatcctgtgaaaattagtaaaagaaatgatgcagtaagtaac

SEQ ID NO: 40956 - DNA, 121 bp, Artificial Sequence
  Synthesized
  misc_feature (61): n=t or c
aatacaagaatgcataaaaacctggggtacagatctgaaaggaatcctgagtccgcacacnacaagcggcagcaaataggacagcgatacagctggatggggcaactgctgctgtccaggt

SEQ ID NO: 40957 - DNA, 121 bp, Artificial Sequence
  Synthesized
  misc_feature (61): n=a or c
ccttgaatattatgtgtacaaaaaaattcaccatgcaagtgcatgtatatacctatacatncagtttgaattcttttattatttccattgttgtgcctcatggttttctgtaaataatttt

SEQ ID NO: 40958 - DNA, 121 bp, Artificial Sequence
  Synthesized
  misc_feature (61): n=t or g
gtgatcttttattagcaccttcattgtatttctgtgttttcatctatcagttaacacagantacattgttaactgcttaaatatccagtttgaatcattttgtgcaagggagtataacatt

SEQ ID NO: 40959 - DNA, 121 bp, Artificial Sequence
  Synthesized
  misc_feature (61): n=a or g
ttgcaaggcaaagcaatactgtgttttctatcagaagaatctcttctggttgggacctgangctaaaattgagccctaacccccacccaaagcatctcaaatgagtgagaaaggatgggga

SEQ ID NO: 40960 - DNA, 121 bp, Artificial Sequence
  Synthesized
  misc_feature (61): n=a or c
gagtaaatgggaatttaaaatggaagatctcattgatagtggcctgtgattttaagaatgnataaaaccttcatagtgcatctcaccacgttcctagaaatagaaatgatgtctcttcaac

SEQ ID NO: 40961 - DNA, 121 bp, Artificial Sequence
  Synthesized
  misc_feature (61): n=t or c
ggctgctgatatgcccactggtaacgcaaggacccagtgtgggcttggacctgctcaagtngagagggaaaataacctgctggtgtggtttggccttcatgtaaacagcaatagcaacttc

SEQ ID NO: 40962 - DNA, 121 bp, Artificial Sequence
  Synthesized
  misc_feature (61): n=t or c
tgcagttagaattctcagggtgttggtcttttttccccccattgataattctagattttgnacttctagaagatgtttgccatttccttttcaggcagctaagggtaaaaacagatgagtt

SEQ ID NO: 40963 - DNA, 121 bp, Artificial Sequence
  Synthesized
  misc_feature (61): n=t or c
ggaatagattatggatttatttcataatcaaactcactgatggatctgatgggaggctgcngtcctttatcatctgcacaacctgatgcccttgaaaacagacataattgtaagcttaagc

SEQ ID NO: 40964 - DNA, 121 bp, Artificial Sequence
  Synthesized
  misc_feature (61): n=t or c
cttattttttgatcatagtagtagatgtgtaggacacatcaaaagagttatgagagaaaanaatttcagtctgctgtaatttagtggtcagaaatttgactatgtgggacagcctgaagtt

SEQ ID NO: 40965 - DNA, 121 bp, Artificial Sequence
  Synthesized
  misc_feature (61): n=a or c
taacacgtccattcccaaggttttgagctgaggcacccctgcagttgagatttttatagantttggaattccttcatagaaccctatggtaatatgagaggctttcaaggtcagtggtgag

SEQ ID NO: 40966 - DNA, 121 bp, Artificial Sequence
  Synthesized
  misc_feature (61): n=c or g
ttgccatggtgaaggggctgtggcactggagtttagaagcttcacattctgttgcatggangctgtgtgctgttctgggtgctgcatgcaagacttgggtctgcctcttccttgctggtgt

SEQ ID NO: 40967 - DNA, 121 bp, Artificial Sequence
  Synthesized
  misc_feature (61): n=c or g
tcctgttcccacagtgctggaggtgagaagaaaagaggggggggtggggaaaaaactattncaaggcttctcctcctgcaggaaaatacctgagggatgaggcccagcggggcgggtcggt

SEQ ID NO: 40968 - DNA, 121 bp, Artificial Sequence
  Synthesized
  misc_feature (61): n=t or g
attcctttgagaagacaagaaacagctgatgcataggaacagcacctgcattaaataatanaaccttcttactaattggtaaagtccagaaatgtgctgtcttattggcttttggcaaatt

SEQ ID NO: 40969 - DNA, 121 bp, Artificial Sequence
  Synthesized
  misc_feature (61): n=t or c
acatccaaacccattttaactatgccccatttctaggcagaagacagcctgcaattatctncttatctatgtctggacagtaataactccattccagactgcttattttaatagaaaacac

SEQ ID NO: 40970 - DNA, 121 bp, Artificial Sequence
  Synthesized
  misc_feature (61): n=a or g
accccagagatgttaattacagcagaaattacctatgaaagcttttgctcaggagcctgantgttcgcagccagtaataactttgcttttttttcctttctgtaatgctggtgcaattagt

SEQ ID NO: 40971 - DNA, 121 bp, Artificial Sequence
  Synthesized
  misc_feature (61): n=a or g
ttagaagaaaacaacatctcctggagaaattttcaattaaggagtaacgattttactatgnaaaaaaaccttttagtgggaaacttgcgctgatttctgtctatgatgctttgttgtgttg

SEQ ID NO: 40972 - DNA, 121 bp, Artificial Sequence
  Synthesized
  misc_feature (61): n=t or c
tggaaaaaatcctgtgttcttggaccatctcctggcctggtcaccttgttgtaatggctcnactcacacttacaaacaatgataagagaaaatacacaaaaagcctaaacaccaaaacaaa

SEQ ID NO: 40973 - DNA, 121 bp, Artificial Sequence
  Synthesized
  misc_feature (61): n=t or c
tttgcacatctgactgtttttcaatcaagagcagctcattgttagatctttcagctgtaanagaacattaaattaaagacaccaagaaggagactttttcctttactgccccatgacctgt

SEQ ID NO: 40974 - DNA, 121 bp, Artificial Sequence
  Synthesized
  misc_feature (61): n=a or g
gtgttacgtgaagactttgttttcacgtttcaagttttgatcacttgatccactccatccntttgatccacttgaaccacgtcccattcgtacaggagtagtgtgtgaccagtctctgctc

SEQ ID NO: 40975 - DNA, 121 bp, Artificial Sequence
  Synthesized
  misc_feature (61): n=t or c
acctttgcaacatacatcttttactgttctgctcatgagcagtctggaaagagatttatgntccttcaagttttcatcacagtcttttggatcttctgctctttcaaaatgcttccacctg

SEQ ID NO: 40976 - DNA, 121 bp, Artificial Sequence
  Synthesized
  misc_feature (61): n=a or c
aattaaacttggttagatgcattttcttcttttaaattcataatgttagcttgttgggcanaaaaaaaggaaagcacgtgtagaaatgaagcattccactgaagacaactagggacacaaa

SEQ ID NO: 40977 - DNA, 121 bp, Artificial Sequence
  Synthesized
  misc_feature (61): n=t or c
gtgaaattatccactctgaatatgaattctggaagtgctcagatggctccatgctctaganctgaacactgaacacaagggcttgataacagtaaagatcaagtgcacctttaacacagaa

SEQ ID NO: 40978 - DNA, 121 bp, Artificial Sequence
  Synthesized
  misc_feature (61): n=a or g
aacttattacaaactgttaatttaaaaaaataaattgagtttcaaggaaagtaggttctcntcctttcctctcaccttttcagtaacaaggtataataacagtaacgggcaattcttgcca

SEQ ID NO: 40979 - DNA, 121 bp, Artificial Sequence
  Synthesized
  misc_feature (61): n=a or g
aagttttactgatcatctagttacagatagtgtgcctccagaaaggacagaaatggcagtnaaggatgggccacctctgtagtcaaccaacatctttattctaatgggtttaaaacagaag

SEQ ID NO: 40980 - DNA, 121 bp, Artificial Sequence
  Synthesized
  misc_feature (61): n=a or g
accttggcaaattctcaacagttcgtaaagaatttcttgtttaatattggcaggagtccgnttgtcgtcccaaggtctaaaccatctcagagttaaacgccacaaatagaagattctcatg

SEQ ID NO: 40981 - DNA, 121 bp, Artificial Sequence
  Synthesized
  misc_feature (61): n=a or c
actaagagggctacagcaatttgtttctctgtataaagaaagtggtcatttctactgtcanctagagaaataaagacttgccaacaaaaacataactaactgctatttaaaggaagggaaa

SEQ ID NO: 40982 - DNA, 121 bp, Artificial Sequence
  Synthesized
  misc_feature (61): n=a or g
gaagacctgtaaagtacctcctgtggagtattaacctgtgtgtagaaagctttagaagccnactagtaggctgactttgttagtaaccattcctaaactttttacaagaggagggttaggt

SEQ ID NO: 40983 - DNA, 121 bp, Artificial Sequence
  Synthesized
  misc_feature (61): n=a or g
gccccaaccacagctgactgcagtgactcgatctccaatgactgcaaaagggagcgatggnttgagaagtacactgtgacattgtagagttgacagcaccccaaatgctgaacgcagaaga

SEQ ID NO: 40984 - DNA, 121 bp, Artificial Sequence
  Synthesized
  misc_feature (61): n=a or g
ctccacgtcaagcttgcccatctttttcagtgggcgttacatgcatggagtgtatgtattngctcagcctagtaatgatacgtttgcttgcagcatcttatttagctgctagttatctttg

SEQ ID NO: 40985 - DNA, 121 bp, Artificial Sequence
  Synthesized
  misc_feature (61): n=a or c
aaaacaaaaggtccttcatgcgatgagtgcggtgtgctggaatttctgcaatgcagaaacngggggctgatttctaggaagcagattgggaaggaatgtttttgttgcgtgacagcggttg

SEQ ID NO: 40986 - DNA, 121 bp, Artificial Sequence
  Synthesized
  misc_feature (61): n=a or c
aatttaaaaaaggaaaactatcaaagggctattttcttctgccatcattccttatttcatnttaaaagacacttttgactgccactgccaactcttagcttagtaaagtaagtctggacac

SEQ ID NO: 40987 - DNA, 121 bp, Artificial Sequence
  Synthesized
  misc_feature (61): n=a or g
cacaagcacatctgacttatgtttgcatccgtttcagatttctactgtttagagaaagagntattaattttaagtggtgtctcaaggaagaacaaagacattaagagcttctgtcttttgc

SEQ ID NO: 40988 - DNA, 121 bp, Artificial Sequence
  Synthesized
  misc_feature (61): n=a or c
tagcaccttaagaggtttatgttgctaaaggtcttctgtcttcccatgattttggcttttngtaagaataaaaggaagtgaactggtggtagaatgtgtgagcagactgcatacacaacag

SEQ ID NO: 40989 - DNA, 121 bp, Artificial Sequence
  Synthesized
  misc_feature (61): n=a or g
aaaaagatcaaatctgcatctcctagctgtttttgaaacctgagtgaaatagaatcttccntgttgtagtttaaacttctgtgcacggagagaacaaattttctgggatctatttattcat

SEQ ID NO: 40990 - DNA, 121 bp, Artificial Sequence
  Synthesized
  misc_feature (61): n=a or g
ttaagtatcaacagtgacgcagaagaaccatcatgtaatgtttataagaaacaccttgagnaaaatgctgaagaatgaaatgagagctccagactgaaaatctcagaccaaaaacacgagc

SEQ ID NO: 40991 - DNA, 121 bp, Artificial Sequence
  Synthesized
  misc_feature (61): n=t or c
gaaaaagaagagttagaaggactgtgacttaggattcagtagccagggaatgaataattangtatttatgttaattttcttgtaggcagtgacttttattgaataacagcccgcttcagaa

SEQ ID NO: 40992 - DNA, 121 bp, Artificial Sequence
  Synthesized
  misc_feature (61): n=t or c
cagcacagacagttcattcacagcattcattgaacaacttcagacatcgacaaagtgatangatcgaatactccatctggccgccccgcccgcctccaccaccaatcccccccagcagcaa

SEQ ID NO: 40993 - DNA, 121 bp, Artificial Sequence
  Synthesized
  misc_feature (61): n=a or c
gccactccttcccccccacctccctttgcactgaagactcagagataattacacacttcancacactcagctcacctgatccgtgtgaaggcatacagcaaataagcagctgtatttcctc

SEQ ID NO: 40994 - DNA, 121 bp, Artificial Sequence
  Synthesized
  misc_feature (61): n=t or c
ttaaaataaggagttggagtaggagcagggaggtttaggcagcccaaggaaactgattganttgatcacctacctaatgggcggaggagaaaatcccaaaccacaatcatacatacgcttc

SEQ ID NO: 40995 - DNA, 121 bp, Artificial Sequence
  Synthesized
  misc_feature (61): n=a or g
ggaagacagccctattttcttttcacatatttgcatgtatttctctccagtatcttggaangaaaaggaaaaaagcatatacctttccaaagacacataggaaaggatatgctttaggccc

SEQ ID NO: 40996 - DNA, 121 bp, Artificial Sequence
  Synthesized
  misc_feature (61): n=a or g
acactgacaggcatggggcaccagccacttctccattaagcctgttaatgtcttaattgcntgtggagagcagcatagagctaaagaggtgtttccattgtgcaaagatgttgtaaaagaa

SEQ ID NO: 40997 - DNA, 121 bp, Artificial Sequence
  Synthesized
  misc_feature (61): n=c or g
tatgcaaaaccaacttgctttgtcaacacagtaaatcagtgagcaccaaagatttgaaaancaaactcagacagcagaaggcaatgttggaggaaaaaaaaaagggggggggttgataaat

SEQ ID NO: 40998 - DNA, 121 bp, Artificial Sequence
  Synthesized
  misc_feature (61): n=a or g
aatacccttatccggagctcctgactacatctgctgacagtcacatacacaccagcaaggntcattccctggctctgaagcaaagtgacacagcatcacctagcctgatgaccttccatcc

SEQ ID NO: 40999 - DNA, 121 bp, Artificial Sequence
  Synthesized
  misc_feature (61): n=a or g
ttttgaaatatttttgtaaaatatgactacaactgtgtcttattttagaatgtagacaaangttaagctatacatttgtcacattttcctgattctgcctgcttgatcttaattttctacc

SEQ ID NO: 41000 - DNA, 121 bp, Artificial Sequence
  Synthesized
  misc_feature (61): n=t or c
tggcttatctctggtattacccttcatgctgcgaacgtctccagttacgtgtggttcctgngtggtccctccagacctcttaagtaccctcaagggcacttttacttttagctattccccc

SEQ ID NO: 41001 - DNA, 121 bp, Artificial Sequence
  Synthesized
  misc_feature (61): n=a or g
ccccagaggataagaaacggctcattaaatgaataaaaatatgaataaaggcagtggcagngagcagctgttccctccctccctgcctttatccaaaatccataggccactcttgccacaa

SEQ ID NO: 41002 - DNA, 121 bp, Artificial Sequence
  Synthesized
  misc_feature (61): n=a or g
attcatcatttctgcagctgattttggctttaatttagaaatcttcacaaaaacggacttngagtgaaagagctcaacagttagcagtgactgtgcatagacgcacgcacagcccttcctc

SEQ ID NO: 41003 - DNA, 121 bp, Artificial Sequence
  Synthesized
  misc_feature (61): n=t or c
aattttgctcacataagctgatcacatattgcatagcacttggcatctgaaagactgccangcacttttctgatggtcatcaagattttttgttctgttcttgtatgacttgagtacctgg

SEQ ID NO: 41004 - DNA, 121 bp, Artificial Sequence
  Synthesized
  misc_feature (61): n=t or c
agcgttttacatctacttaacaatcctagagatcattacagttgcaatctatccaactctntgcttttgggttgtaaccaaaaaaactgctaaataaaaaggagttattcagataaaaatg

SEQ ID NO: 41005 - DNA, 121 bp, Artificial Sequence
  Synthesized
  misc_feature (61): n=c or g
tccaacctgacccgcacacgacagtacaggacagcattgtagttccttcctacccacttcnaaaaccatatcccagtatcatagcttaatgccaaccaggcttactggggatgaactgtgc

SEQ ID NO: 41006 - DNA, 121 bp, Artificial Sequence
  Synthesized
  misc_feature (61): n=a or g
ccacatctagcacatgtaaatacagcagagtggtttttccccatgtttagtgcattaattnatatactgtaacaccaataaaacaaatcagaaagcatggtttcagataaaggtttgattg

SEQ ID NO: 41007 - DNA, 121 bp, Artificial Sequence
  Synthesized
  misc_feature (61): n=a or g
aatttaaattacatttgagacactggggcacactttctttggttatctcctttttatgatngctgtaggcataatatgaaatcatagcaaggaagtccgaaggctggtgatacactcaata

SEQ ID NO: 41008 - DNA, 121 bp, Artificial Sequence
  Synthesized
  misc_feature (61): n=a or g
gaagagcttttctggatgcataatttatacattatgtatacgtgcgtagcgctcccacacntcggtgtgactgctctttctgggattcaaatctctatacccagatttcctactgagcaaa

SEQ ID NO: 41009 - DNA, 121 bp, Artificial Sequence
  Synthesized
  misc_feature (61): n=a or g
gaaaggtacatcaccactaggcctatcagacattttatgtcctcccaggtcatcatccatnagaagtgaaagttttgcttttctttcaagcaaaatataaattgattggaaatcttctcag

SEQ ID NO: 41010 - DNA, 121 bp, Artificial Sequence
  Synthesized
  misc_feature (61): n=a or g
ctagattgctgtttttcactcagttacaaacatgcttctgatagttacaaaatacactganatcacagagtaggcactaagattagaaacggcctgtaatcctgtcccctctgctctatat

SEQ ID NO: 41011 - DNA, 121 bp, Artificial Sequence
  Synthesized
  misc_feature (61): n=t or c
atctcttctgggccatgcccacgagtgacccatgcatgcaaagccttcaactgtacttctngtacagctttacttaacctccccttaggctggaggtgcatgctttccagcctggcattgc

SEQ ID NO: 41012 - DNA, 121 bp, Artificial Sequence
  Synthesized
  misc_feature (61): n=a or g
cccagtcccaaaccaagttactgaagaggacttctgggcacagacaggtttggtaagtctntgtgttgcctcacattttgatagctggccttgaaaaggctgctatgattatcataacctg

SEQ ID NO: 41013 - DNA, 121 bp, Artificial Sequence
  Synthesized
  misc_feature (61): n=a or g
cttcaccctcgctttgcaccaagctgatgtcagtcagaggctaacccagcctatgtggccnggctgatccttagcctccccgttgagcaaactgacatgcggctgctaagtgctggcagtg

SEQ ID NO: 41014 - DNA, 121 bp, Artificial Sequence
  Synthesized
  misc_feature (61): n=a or t
actagctaacaccagcacctggaccttcaaccagctagcctggagcatcctgaagacctangccttgtgcttaccccagtaagagcaagcagcaacagttaacccacatgccaagatcttc

SEQ ID NO: 41015 - DNA, 121 bp, Artificial Sequence
  Synthesized
  misc_feature (61): n=t or c
gctgagcagctgtgacccatatattggagaagagaagggaaaaacagaggaataaggacanggtgtttgagtcagtgcttgatttggctaagcaaacatgtttatgcaatactctgagaac

SEQ ID NO: 41016 - DNA, 121 bp, Artificial Sequence
  Synthesized
  misc_feature (61): n=t or c
agcagagtggagaggagatggcaggagtactctgagcagataatggggccctggagagggngcatgccacccactcagagtgggctgtagcctcagttttgctcccctggctcagcaaagc

SEQ ID NO: 41017 - DNA, 121 bp, Artificial Sequence
  Synthesized
  misc_feature (61): n=a or t
gtgcaaccaagttgaagaagcaaatgtttagatggttttgagcagacacctttgattcttngagactgtaagtaatctgtgaaatacttttcagcatttcatccaacatcagaatcataac

SEQ ID NO: 41018 - DNA, 121 bp, Artificial Sequence
  Synthesized
  misc_feature (61): n=t or g
gaatcttggcttctgtgcctcaggactctgcaaaatcatatatatcacttactacattctncttaccagttttccccccaagtccatacatagaatcaggagaaaaacctcagatcttatc

SEQ ID NO: 41019 - DNA, 121 bp, Artificial Sequence
  Synthesized
  misc_feature (61): n=a or g
tcagctgtctgtctgtgtccagggcagcagttctgcccctaggtgtgtcaacaagccttcngcatgcaatgctactcgcagcatcaccccagcagctcctctttgcctcctctgaggcagc

SEQ ID NO: 41020 - DNA, 121 bp, Artificial Sequence
  Synthesized
  misc_feature (61): n=a or t
ctgctattacagtccatgtgaactatgctacacaagtggaatctgaggtttaattatatgngctcaaatcataacaagtttaagccacaccgtgtttactcaatcttaagatcctttcagg

SEQ ID NO: 41021 - DNA, 121 bp, Artificial Sequence
  Synthesized
  misc_feature (61): n=c or g
tcactgattgcagaaggatgtgcaaaggctgggctcaaactccagagttattacacaatancaccacagacagaagaaacacaaaactataatgcagagggaattttccgaagtagtgtgg

SEQ ID NO: 41022 - DNA, 121 bp, Artificial Sequence
  Synthesized
  misc_feature (61): n=a or g
tttccctttttttttttttcccctcctgctattaggccacatcttatgtctcaaatattanctttcatgtgttttctcctctggtattttttctccttttttttcctttccagtctttgtt

SEQ ID NO: 41023 - DNA, 121 bp, Artificial Sequence
  Synthesized
  misc_feature (61): n=a or c
gcagtgctcaccctcactgtgtgccatgcagttgggcttggcccattgacgcagcctacanagatcctctgccacgtgtggctgtgtccaggagctgtgctgtgtaattcagaactgctca

SEQ ID NO: 41024 - DNA, 121 bp, Artificial Sequence
  Synthesized
  misc_feature (61): n=t or g
aaatgtctaaggtcaattctgaggaacttgtagtcatcactttgtggaaaagtggacacanctaaatcaggtgcacttcgagatttagtggaatagaaagaaaggtttgtacattgcccta

SEQ ID NO: 41025 - DNA, 121 bp, Artificial Sequence
  Synthesized
  misc_feature (61): n=t or c
taaagctgcgtgcgctgactgcggtggttcggctctttacggcgcggtgctgatggattanttgtgtttgagcagctcctacttggtgcactgattcgttgttctgttcttttccagcaat

SEQ ID NO: 41026 - DNA, 121 bp, Artificial Sequence
  Synthesized
  misc_feature (61): n=t or c
ttccagttctctgcaaatgcccacatattgcataacttctttcagtctttcaaagaataantgaccacagatttcacagtttttgcacacttttcttcaaatttcagtcacactcatttta

SEQ ID NO: 41027 - DNA, 121 bp, Artificial Sequence
  Synthesized
  misc_feature (61): n=a or t
aggctgcacaggatgcattttggccacctgtccttagcacagcctctgtgcaacttgtgcngtcaaactttggtgacataacaagacacaccaaggaacggtggatggcagcgcatctgct

SEQ ID NO: 41028 - DNA, 121 bp, Artificial Sequence
  Synthesized
  misc_feature (61): n=a or g
cacaattgatgcagccatgttgtcataattggcattaactttgacaggattgctatacacngattaatcgctgggttgagactctgatattttaaactatatcttactaattttgattagt

SEQ ID NO: 41029 - DNA, 121 bp, Artificial Sequence
  Synthesized
  misc_feature (61): n=a or g
gcatatacctgtaaggcacacaaaaccacagggctgtttagtgttgggctgacctgacacngagacctgtggtacagctggttgactgtccagtgcagcctgctctcttagatgggaagag

SEQ ID NO: 41030 - DNA, 121 bp, Artificial Sequence
  Synthesized
  misc_feature (61): n=t or c
aaagaatgaacccaactttgcctagtttattctctcaagaagaaagcccagatcaataaangcagactactctacttggaccaaattagaggaaattgtagctcagagcagagggattccc

SEQ ID NO: 41031 - DNA, 121 bp, Artificial Sequence
  Synthesized
  misc_feature (61): n=t or c
gggcatatggggaggaaagatatctttccttcattctttggggccttagtgactgcatttncaggccaaatttgctaaggaaaactgaatcaggtagctggcaattttcaaaagccagttt

SEQ ID NO: 41032 - DNA, 121 bp, Artificial Sequence
  Synthesized
  misc_feature (61): n=c or g
ggaagggctactcatacatagttcggccctatcctgttgctacacaccatcgaaaaggctnaacactctcagacttttatcatctgggagatgctataggcctcaatcacctctgtggccc

SEQ ID NO: 41033 - DNA, 121 bp, Artificial Sequence
  Synthesized
  misc_feature (61): n=a or g
atgctgaggcacatggagcagccctgcagctcaggcagcctttgctataaccgaggttcantgggaggactgagccaatttgaggaccatgcaggagaacggacagctcagcagcgccaca

SEQ ID NO: 41034 - DNA, 121 bp, Artificial Sequence
  Synthesized
  misc_feature (61): n=t or g
ttcaaagcagatctgaactgtgctctgctgcttcacgttgggtgatccatcgatttgctgngcagcacatgaccaaacgctccacgttatggagcatgactgtgacaatacttaatacttt

SEQ ID NO: 41035 - DNA, 121 bp, Artificial Sequence
  Synthesized
  misc_feature (61): n=a or g
cctctgatcatcttagtggtaaggtaaggtttagaaccctgaaaaaaagcaaacactgacnggaccttggtatatttgcagtgcttgctggaaattaactacaattatttaatcctaaccc

SEQ ID NO: 41036 - DNA, 121 bp, Artificial Sequence
  Synthesized
  misc_feature (61): n=a or c
aaacaaaagcagctgggtccacagaaaacacacggtgttcatatgacaaagctctcagtanatagatgaaacaaagaaagatttttattgcacattaatgatcaattgaggcacatataaa

SEQ ID NO: 41037 - DNA, 121 bp, Artificial Sequence
  Synthesized
  misc_feature (61): n=t or c
gagcctccccgcacaggacctctgcactggcagctcacacctccttcctccaagggcttcnagacagcaaagcgagctgacaaggtgtgagtgtctctgtaaaactctgctatttttacac

SEQ ID NO: 41038 - DNA, 121 bp, Artificial Sequence
  Synthesized
  misc_feature (61): n=t or g
gggagccgtttggaaattgaataattacctgcagaattctgtacaaaaattcttttgtctnaaaagttgatgtttgaaataatggccataattacggtatgaagggtttcctgtctttcag

SEQ ID NO: 41039 - DNA, 121 bp, Artificial Sequence
  Synthesized
  misc_feature (61): n=t or c
aggcatctgggcaagcaaggccacaggtctgtccagaaaactgccctgtcctatgctaaangcatacagtcgatgcgctgcagcaccacaaggctagcagcattcccacaccagaaccacc

SEQ ID NO: 41040 - DNA, 121 bp, Artificial Sequence
  Synthesized
  misc_feature (61): n=t or c
acaaagagtgcaaccttagtatattccgatgattctgcttcatggaatagcttgtctgganctaccctaacaggcaatttcagtggtgagtgtccaggtaggattgcgctaaggctgaaaa

SEQ ID NO: 41041 - DNA, 121 bp, Artificial Sequence
  Synthesized
  misc_feature (61): n=a or g
catggtacaaatagaagcaaggtgttgtcttaaatgtctagcactgcagtttaaaacacanattttatcttaggggaatcagctcaatcctacctcgctcacataaataccagtgtcatcc

SEQ ID NO: 41042 - DNA, 121 bp, Artificial Sequence
  Synthesized
  misc_feature (61): n=t or c
cctcttgtcacacgtgctaacaaagaagcatacgccccaggaaaggactgtgctgaacttngtgcagctgtgagcaaagctgatctgttcagagcaagaaattccacatgctcaaactcct

SEQ ID NO: 41043 - DNA, 121 bp, Artificial Sequence
  Synthesized
  misc_feature (61): n=a or g
caagacacattgcaacatcaactgaatctcaacagaaacatccaggttagcaagcttgcangagtatttttcatatgagagggagggagccatcactgctttactacacatcacatggcat

SEQ ID NO: 41044 - DNA, 121 bp, Artificial Sequence
  Synthesized
  misc_feature (61): n=a or g
atttgctgcattaccacctcattgggtccatcataacagggcaccgaaggccacctttgcncttgaggaaaaatgtaaacacaagtaaatttatttttacagaagtccttgaaaatgggtg

SEQ ID NO: 41045 - DNA, 121 bp, Artificial Sequence
  Synthesized
  misc_feature (61): n=t or c
tggaggagaaaatgaccttttaagggtcagcgtcgtgatgggccacgtagaaacgtggacngagggatatgggagtaagcaggacaaaggcaatggaaaccttcccctggtcattcctcct

SEQ ID NO: 41046 - DNA, 121 bp, Artificial Sequence
  Synthesized
  misc_feature (61): n=c or g
tgaaagttggatttgctcacttagaagagacatctcacacaaagcgagcagaggcacctgnaggcagggagcaaacccatggtgtgcaatgacaccgtgggacctctcctgttctgccagc

SEQ ID NO: 41047 - DNA, 121 bp, Artificial Sequence
  Synthesized
  misc_feature (61): n=t or c
caaaagcagcgaagcaggaagactggagctctcctgtaagcataagaataaacacctgaanactaaaccaaaataaatacctattaatgttgcatatacttcaaaactgtaagctgtgtct

SEQ ID NO: 41048 - DNA, 121 bp, Artificial Sequence
  Synthesized
  misc_feature (61): n=t or c
aaagaaagcaaaataaagcaaagaaatgcacagagttagcaagcagcatctatcatttacnacagtatttaattaccattatataattatctgccctcctctttttgtatcttgcatgtat

SEQ ID NO: 41049 - DNA, 121 bp, Artificial Sequence
  Synthesized
  misc_feature (61): n=a or g
ttagggtgcatttgaagattaagtgattaattatactcgttatttttactaccctagttantgacagaacagaaaatagttgtcactgtaggataatcctgtagtgcagaaatagatattg

SEQ ID NO: 41050 - DNA, 121 bp, Artificial Sequence
  Synthesized
  misc_feature (61): n=a or g
agccactctctggaactagaactttgttgtggtcttcatgtaagaggttgttgaagacacnggcaaaatgctatcctgatcttgaagaactgaatttagaaactaaatcaaattattgcct

SEQ ID NO: 41051 - DNA, 121 bp, Artificial Sequence
  Synthesized
  misc_feature (61): n=a or g
atgcaatggacagcttttaaattcttttttcaaacccttcagggaaattaagaacacaaanatcattaatctggtatgttagctattgtcatacacaaaagaaaaactgatgtaaatatgt

SEQ ID NO: 41052 - DNA, 121 bp, Artificial Sequence
  Synthesized
  misc_feature (61): n=t or c
tttgaaagtctaagtggactgagcttacttcctgggatacataaaatgtgtcactacattngtaagagggctatcagagctgcaacaggcatggggcaagaaatgattttgtgttaaaaag

SEQ ID NO: 41053 - DNA, 121 bp, Artificial Sequence
  Synthesized
  misc_feature (61): n=t or c
ggaggcagcccctgtaagaaggcctggttggccaacaaacagccaccatcccacgttctcngaagaaaataaaagggccacagccgggatgggagggaccagcctaagtcatgtacgttta

SEQ ID NO: 41054 - DNA, 121 bp, Artificial Sequence
  Synthesized
  misc_feature (61): n=a or g
aagatctattatgcttctttgagtgtatttgtacaattcttagtgaaatgctaatacttgntaagtttcactggaaaacctaaaactaagtggaagaaaatcatcttctggaggtttggga

SEQ ID NO: 41055 - DNA, 121 bp, Artificial Sequence
  Synthesized
  misc_feature (61): n=t or c
agatacggctaaaattgaaccaatgttctctcacaccaatgagatttacataaatatgtanaaagtagaaaagatggtatcacagcaaaatagcagggtaaattaaggctgttgtttgtgt

SEQ ID NO: 41056 - DNA, 121 bp, Artificial Sequence
  Synthesized
  misc_feature (61): n=t or c
atggctctggagcattaccacacagtcccaaatgtgtggttcagtgcctaaagccagaacnacaaggaaagactctccagacactgtcagtgcctgcactgggcttctccctttggggacc

SEQ ID NO: 41057 - DNA, 121 bp, Artificial Sequence
  Synthesized
  misc_feature (61): n=a or g
aggtgcttttggcttcaaaagaatgagcttgaacctgtggcatggggtttatgttacagantgggagcctgatgaagaccttacaataatgcagtttgggatgcccatagaggtagcagcg

SEQ ID NO: 41058 - DNA, 121 bp, Artificial Sequence
  Synthesized
  misc_feature (61): n=a or g
ggtaatataaacattgtgtactggaatttggagttttaaaggaaagctttttcatcccacntaatacagagacttatctaaacagcttaaatatcttaaaaatataatcagagttgaaaaa

SEQ ID NO: 41059 - DNA, 121 bp, Artificial Sequence
  Synthesized
  misc_feature (61): n=a or g
ggtatagatatagaagagtttatctggggaggaatgaggagacaaggtcacacatgcagcntgacctagatcactgcacctgatccaggaggagctggctgaagcagaaggtggggacaag

SEQ ID NO: 41060 - DNA, 121 bp, Artificial Sequence
  Synthesized
  misc_feature (61): n=a or g
aataggggataactgttttaaatgggactagcctgtagtgctcctaccacagaggcagcgnggcactggtgactttgccatgtggtacagaaaagtcaacactgctcaccagcccagggca

SEQ ID NO: 41061 - DNA, 121 bp, Artificial Sequence
  Synthesized
  misc_feature (61): n=t or c
aatttttggatccaccttaattgtcaaaacttcaaaagctacaaacagaggatatgctctntgctgtttgatgcagcatcacagcctgaaacagccttacagaagaagagagcagaggaga

SEQ ID NO: 41062 - DNA, 121 bp, Artificial Sequence
  Synthesized
  misc_feature (61): n=t or g
gtcaaattcatcaaacagtaacccatcccctaaattctacccaaaagaagaggaatccagnagtctcactgtaaatctccagaacatcaaaggattatagtatttaaacaaatcaccggag

SEQ ID NO: 41063 - DNA, 121 bp, Artificial Sequence
  Synthesized
  misc_feature (61): n=t or c
agaatcactccccagctgtgatgagagctcctggagagctgcgggccactgcagaacacanagaggatggtccccagggatttccagcgatgtgcagatgtgcgaatagcaatcaccgccc

SEQ ID NO: 41064 - DNA, 121 bp, Artificial Sequence
  Synthesized
  misc_feature (61): n=a or g
caaggcccctgaatccgtatccaccatcattaccgcagagtcgatcttctataaggtacgncccgtgcagatctgcccgccagaaggaccgtgttgtctctgcctccagtatcaaaagtta

SEQ ID NO: 41065 - DNA, 121 bp, Artificial Sequence
  Synthesized
  misc_feature (61): n=a or g
taaggaaaataaagaaataagaggcttcctcatccctcattcatgtggtcatttctatttntattgccataaattgtgagcacacaggtagtgaaatcttgcaaatacacaaaactgcagc

SEQ ID NO: 41066 - DNA, 121 bp, Artificial Sequence
  Synthesized
  misc_feature (61): n=a or g
actgcagaggagttggagccactcaaggtcaaagcgccgggtttggagaaatcacccacanaagtagttctgcagttggcactgagcgcgtcactcttgtgagtattatttggctttaatc

SEQ ID NO: 41067 - DNA, 121 bp, Artificial Sequence
  Synthesized
  misc_feature (61): n=a or g
tatccataaggtgtataaccaatggagcaatgagatgacttgttttcagttctgacaacanctgtgttttcaggcttctgtgtgaacttactcagatttaaggctgtcctttacttaaacc

SEQ ID NO: 41068 - DNA, 121 bp, Artificial Sequence
  Synthesized
  misc_feature (61): n=t or g
tggctcggatttatcagcccgtttttgacttcactgtaaatgtaagtaaacaaaaaaaagnagactgctgccacatctccagtggatgctgttgcagaggtaattcattggagacagtgaa

SEQ ID NO: 41069 - DNA, 121 bp, Artificial Sequence
  Synthesized
  misc_feature (61): n=t or c
tgccttttattcagtttcttcaactgtacaggtcactgcatttctgtgacttttgatttanccaaggaactaatacttgatataataggaccaggtttacagtttaagaatggaggacgtt

SEQ ID NO: 41070 - DNA, 121 bp, Artificial Sequence
  Synthesized
  misc_feature (61): n=a or g
atactcttgggtgtattaacgtgtgctttgacactaacaggtggtaccaacattcaatcantttcctgtagcacgactacagaaacatcaggaaacagaaaacttatcattttggtgacct

SEQ ID NO: 41071 - DNA, 121 bp, Artificial Sequence
  Synthesized
  misc_feature (61): n=a or c
caaaaaataaatgtgcggccatcactataaaagacaacttatggaactttgtaacgtcatnataatattttctgcatgctaaacaggtgaactatttttattactttcattttgttcatgt

SEQ ID NO: 41072 - DNA, 121 bp, Artificial Sequence
  Synthesized
  misc_feature (61): n=a or g
cacagtttttaaaggaagagagttcttcgcatttctcaaagccaacctatcttttggaatntagtccggaaatgtagcattggatgattttatgtattataacatctaccactaaaaaaaa

SEQ ID NO: 41073 - DNA, 121 bp, Artificial Sequence
  Synthesized
  misc_feature (61): n=t or c
gtttcttttctttttctatattttctctagtctttctctgttacagagccactgcgaacanaaacaaggcatctgttaatctactgtatctctgctactgctgtgaagcaccaggcaacat

SEQ ID NO: 41074 - DNA, 121 bp, Artificial Sequence
  Synthesized
  misc_feature (61): n=t or c
gcagcaaatgggcctgctgacacagatgatttgtcaaaaacattggtgctgttgcaatgcnctcttcatttgtgcatgcagtcagcaaatacagatttagcaaccaggcattgttaaacta

SEQ ID NO: 41075 - DNA, 121 bp, Artificial Sequence
  Synthesized
  misc_feature (61): n=t or c
tgaatgaagagtagattcttacattggaagaccacattgcggaggtataaccactgtaacntcgtaatgaaaaactccaaccctgtgtaattgttctgttctgctgagtttggatgttgct

SEQ ID NO: 41076 - DNA, 121 bp, Artificial Sequence
  Synthesized
  misc_feature (61): n=t or c
ctttcattcccaatgaactgaaaggtctgacgagatcaaatctctcacatctctccattantatggagaaacagttagaacagatttttctaaaactggcctcaaagtgtggatacacagc

SEQ ID NO: 41077 - DNA, 121 bp, Artificial Sequence
  Synthesized
  misc_feature (61): n=t or c
atcagtggcacagccagaaataaaagtcaccctaaaagcaattccagcttttacctcactntgttgactgaaaacataaacaatagatatgtttgttacaacctagttcttgtttcctcag

SEQ ID NO: 41078 - DNA, 121 bp, Artificial Sequence
  Synthesized
  misc_feature (61): n=a or g
catttgctgatcaggaggagcctcatctggctttctggattcagcccaacggaagtactanagcgaacctcctgcctccacaatccattcctctcaatgtgaaaacttccacctctgcaaa

SEQ ID NO: 41079 - DNA, 121 bp, Artificial Sequence
  Synthesized
  misc_feature (61): n=a or g
tcctggagtacagtcaagaaacacattttcagaagtatcaagttgcatgcatctactgcanctatccgttttcaagcatggatctgtctctgcacaactgaagacttttcactgccatatg

SEQ ID NO: 41080 - DNA, 121 bp, Artificial Sequence
  Synthesized
  misc_feature (61): n=c or g
agtgggaagatggatctgagcaccgggttcagatctgaaagactaattgctctaaatatancttagatttagtctaagcagttcatgcaattaactcaacatgaaaaaaaaatactgaatt

SEQ ID NO: 41081 - DNA, 121 bp, Artificial Sequence
  Synthesized
  misc_feature (61): n=a or g
taaacttgaaagatagcccttctcaacttgaattctagagagtatttgcccatttttagtnttctatgcaaatgagagcatgtgtgcccattcacttctctgtgaaattcaaggtgcttat

SEQ ID NO: 41082 - DNA, 121 bp, Artificial Sequence
  Synthesized
  misc_feature (61): n=t or c
ctcgtgggatggctgtgtttagaggtctgtgctgttgaagtggtttgaactggtaaacctncccagaatggaaggaggtgactgatagacttcagtatgtagctttgaaagactctgaagg

SEQ ID NO: 41083 - DNA, 121 bp, Artificial Sequence
  Synthesized
  misc_feature (61): n=a or g
ctttgaggaatctggccactactgtagtcaagaccatgagcacttcttcctgtgccaccangcatctgttcattcataccttcttcatacctatgtcttgcaggcttgtttttctcattct

SEQ ID NO: 41084 - DNA, 121 bp, Artificial Sequence
  Synthesized
  misc_feature (61): n=t or c
gccttcttaatagactgttgcagtggcctacatagttcaaaataggccagttttgatacangctgtcttagaattattaactttggaaagaccaataagatcacctaatccaaccatccct

SEQ ID NO: 41085 - DNA, 121 bp, Artificial Sequence
  Synthesized
  misc_feature (61): n=t or c
gtcccctcctctctcactccccttttttcacttcctatgaatggaaaaaccttcagaatanttgctcaggcatgtgcctgaccttgtgcacagccagggaagggcaggtaaagccaaggct

SEQ ID NO: 41086 - DNA, 121 bp, Artificial Sequence
  Synthesized
  misc_feature (61): n=c or g
acaacatagtctacataattgaaataatttcagaattaagacagtcaatcagcaactacgnttaacacattttcctttttctatggtttaaattttaactccttactttgaacaaaaatca

SEQ ID NO: 41087 - DNA, 121 bp, Artificial Sequence
  Synthesized
  misc_feature (61): n=t or c
gttttaatgaaaagaaaaaaaatcctgaagttttgctaccaaaatcaaactgaaatgaganctcattttcattttgcattgaacctcaattcagctttttattcatgcttctcttccccca

SEQ ID NO: 41088 - DNA, 121 bp, Artificial Sequence
  Synthesized
  misc_feature (61): n=t or c
gagtgaaatcccaacacctggcattaaagaatatttaacttaattgttaaactgtggtcanttaactccgtttttgaaaaattctatgaagaatgatggtccgatctctgagttttttatg

SEQ ID NO: 41089 - DNA, 121 bp, Artificial Sequence
  Synthesized
  misc_feature (61): n=t or c
ataaaaattttccatgaaggttaaagggcagctgttcaagtacacgcggcaggagacatcnggagtgtgagaaggaagttttctggtctagtacttgaccatctgaccagaggaggtgctc

SEQ ID NO: 41090 - DNA, 121 bp, Artificial Sequence
  Synthesized
  misc_feature (61): n=a or g
gcggccgctttcctcaggtccccaagtgccacctcccgtgtcctccacagggaccaccgcnggtctcttttgtctcgaagtcccacatatctccccattttgtcaccaaaaaatgccacac

SEQ ID NO: 41091 - DNA, 121 bp, Artificial Sequence
  Synthesized
  misc_feature (61): n=a or g
actgcaccagaagggaagatattgagctgattcctctctgtgaaagcagttttgtcttacntttgtgagctctcaaccatttgccccatacaaactttgttctttctttctatggcccctc

SEQ ID NO: 41092 - DNA, 121 bp, Artificial Sequence
  Synthesized
  misc_feature (61): n=a or g
tctcaagtgaaaaaacagctccacgcgtaaatactgaaagctagctttgaactaactggcnttaacgccagtaaccgcctatgttcagctacatggaggactgaccctatgtcactggcat

SEQ ID NO: 41093 - DNA, 121 bp, Artificial Sequence
  Synthesized
  misc_feature (61): n=t or g
aatttcttctcgctgcactgcttactgatagtctgactgctgtttctggagttaaaacatnaaagtactgtaaacagaaaatgaaatacaactttgcaaaagaaaacaaccagaaacactg

SEQ ID NO: 41094 - DNA, 121 bp, Artificial Sequence
  Synthesized
  misc_feature (61): n=t or g
gcattatctccaggataaaggcttaaatggggtaatctaaagccctcatgggtaaccattngtagattggcctgattacatctggtccaacttgttctcagtccattctgtttgctgtgca

SEQ ID NO: 41095 - DNA, 121 bp, Artificial Sequence
  Synthesized
  misc_feature (61): n=a or g
tggtgataaaggatgcaggcaagcagagaacatcctaagccaacttcactgtagaagagantgttttctttcagtgcagttccaggtgtattgcatctactataaatgttagcagagatgg

SEQ ID NO: 41096 - DNA, 121 bp, Artificial Sequence
  Synthesized
  misc_feature (61): n=t or c
ccccctcaaggtaatgctcacagtcatacgggagcagaaaacagccccttctgcccttttngcaaactttctgacttagtaggcaagggaatacctgccagaacaagtgaaccaagaaaag

SEQ ID NO: 41097 - DNA, 121 bp, Artificial Sequence
  Synthesized
  misc_feature (61): n=c or g
tatcaacctccatgaatttcgtattttaattagtggaaaattctaggcattatagctgtgnagtcgcataatgaaagtcaccaaagcgatgcactactgttcttccaagcacgtgtttacc

SEQ ID NO: 41098 - DNA, 121 bp, Artificial Sequence
  Synthesized
  misc_feature (61): n=t or c
gcctagcaagtgtgttacatgggactcatgcttgtgggatgtgtgattttggactagtacnagggatccaacaaacaccctcactgcatgctccaagccacaacctgagtgttacttactc

SEQ ID NO: 41099 - DNA, 121 bp, Artificial Sequence
  Synthesized
  misc_feature (61): n=t or c
tggcaccactctgcttgccacggctctggacgcctgagtagctctgcaggtaatgcatggngctgccctggctcccttccctttgttttcctctgctgaatggtagtggctgcagtgggtg

SEQ ID NO: 41100 - DNA, 121 bp, Artificial Sequence
  Synthesized
  misc_feature (61): n=t or c
tgaagaagcagggggctttacaaccaacttagaggtgaggggacagggaagatgatgagcngtgttctaccaatgatgttttcctagttgtgatccagaaggcacgtgaatcacttcagac

SEQ ID NO: 41101 - DNA, 121 bp, Artificial Sequence
  Synthesized
  misc_feature (61): n=a or g
ccgattaatacaaacattgctactgattcagatattcagaaaccaagaatgcaaacaatangcctgtccttacagaaacactttcctatttacccagactttagcttcagtacaactcttc

SEQ ID NO: 41102 - DNA, 121 bp, Artificial Sequence
  Synthesized
  misc_feature (61): n=t or c
tgtgagcatagtatgtgtgtttcatttcagtggttttgtgaaggtaccttactagtgatanaaaatagccagaatttactcaggtactagaattacacaaaaggatgtctgggccatatat

SEQ ID NO: 41103 - DNA, 121 bp, Artificial Sequence
  Synthesized
  misc_feature (61): n=a or g
gaagaccagtgcagtgaaggaagagctgaaatactggcagaaattacggcatgacttgganagggcccgtctgctcattgagctcatccgtaagagggagaaactcaaacgggagcaggta

SEQ ID NO: 41104 - DNA, 121 bp, Artificial Sequence
  Synthesized
  misc_feature (61): n=a or t
agggaaccagcagtcacctcccttcctggagaacacacatctaagttcctacctatggcanttcacccctggagcataccttaggtaacaatttggtatgggttctgttgttacaggtccc

SEQ ID NO: 41105 - DNA, 121 bp, Artificial Sequence
  Synthesized
  misc_feature (61): n=a or g
ggcaattgccttcatggcaggaccaaccaaaataggtagcaaagtcctgtgcctgaaggcnacctgtggtgggacacatgcaaagaaggcctcttgtacaagtgatgctctgtttgcttct

SEQ ID NO: 41106 - DNA, 121 bp, Artificial Sequence
  Synthesized
  misc_feature (61): n=t or c
atcttcatttgcagtggattgaataactcatttaaagcagtcagtatttttctctcatttngttgtttcagttatttctttcttttagtactgaagaaggatttcagagtggaagccattg

SEQ ID NO: 41107 - DNA, 121 bp, Artificial Sequence
  Synthesized
  misc_feature (61): n=t or c
gatttcacttgattacttctcagagctaggagattttgcctctgaagggatagctgacagngatgatccagcacgtatgtggaatacgctgagcacttggattgccagcgaggccacagtg

SEQ ID NO: 41108 - DNA, 121 bp, Artificial Sequence
  Synthesized
  misc_feature (61): n=t or c
ggtgtctaccgatatgactgtattagctatgcaggatgtttcttgaaattattttctcacnataaatccattgcaaaattcttactgaaataccaatataaatgatcagaattctttcaac

SEQ ID NO: 41109 - DNA, 121 bp, Artificial Sequence
  Synthesized
  misc_feature (61): n=a or g
gaagacttagcagtctgtgtgcctggatatgatgtccattatgtgacagcctagcaaagtncatcctctggctttaatctcatgtgcatccagagcaacagtcaatcagtcagtgatttgc

SEQ ID NO: 41110 - DNA, 121 bp, Artificial Sequence
  Synthesized
  misc_feature (61): n=a or g
acagcagacttttttctccttgttaaacattttacctcagtaccgtcaagcatgagttccnttaaatcaacacgtgctaattaagagtatttttcttcaattaccctttaaattaattact

SEQ ID NO: 41111 - DNA, 121 bp, Artificial Sequence
  Synthesized
  misc_feature (61): n=a or g
ttggtagaaacaattcaacatctggacagctttgccttgaagtgccctgagaagggacacnctaagaggaaaaggtgttctccaaggcctgggtgatgcaagtaaggaatggaggtagcaa

SEQ ID NO: 41112 - DNA, 121 bp, Artificial Sequence
  Synthesized
  misc_feature (61): n=t or c
tctgcccttattgctgcagcatccaccagcccacaaacatcatgagaactgcagcctggcngcttgttctaaacgctgagtttcacaggttgcctctttcccagcatgcaccgatgtcaaa

SEQ ID NO: 41113 - DNA, 121 bp, Artificial Sequence
  Synthesized
  misc_feature (61): n=a or g
tgtctgcagctccaatccacccaacttggctcagctgcagaagcaggtgctgctctctgtncaattccatgttctctgcgtgttcccttgttccctacaaatcactttgggtgtgccagca

SEQ ID NO: 41114 - DNA, 121 bp, Artificial Sequence
  Synthesized
  misc_feature (61): n=t or g
ctgtgctctgtggtgctctactgttttcttaatgtgcgttattggattgaaagaacccacntgagtcctcccaaagctctccagtgtgccttagggcactctagaagttccccagagcacc

SEQ ID NO: 41115 - DNA, 121 bp, Artificial Sequence
  Synthesized
  misc_feature (61): n=t or c
ctatttctaatagcataaattttgctattagaaagcaaacaagtagaaattctttactctntgttccctttgatgaaatcaggcacatcactgcttgtagctgaatacaaaaatacaagaa

SEQ ID NO: 41116 - DNA, 121 bp, Artificial Sequence
  Synthesized
  misc_feature (61): n=a or g
acagtagttaagacacaagaaaattaagctgatgagttggcctttttcttaggccatacantgcactgagacccactgcagtagccaaatattgtgtaagctttcaaacattcaaacagga

SEQ ID NO: 41117 - DNA, 121 bp, Artificial Sequence
  Synthesized
  misc_feature (61): n=t or c
aacaaatgagcatccgtgatccatttgcatactcaacatttcatttcttccagctaaatgncacttccgtagtcccagcagttttactgctgatcatctagcagatacaaatcccttagtg

SEQ ID NO: 41118 - DNA, 121 bp, Artificial Sequence
  Synthesized
  misc_feature (61): n=a or g
cactcccatcataagaatttctccggtttccttgtgctggttagagaactaaaaacctgcnttgttagaagtaaagagaaaatcagaggtaatgatccaactcgtgcttctatttagacct

SEQ ID NO: 41119 - DNA, 121 bp, Artificial Sequence
  Synthesized
  misc_feature (61): n=c or g
ttactcagcatgaccttgaagcaactattacagataccaacaaggcaaacttaaccacttnaataacgaaaacaagttagcggcaattcaatttctaacgtgaggaaaagccctcatctta

SEQ ID NO: 41120 - DNA, 121 bp, Artificial Sequence
  Synthesized
  misc_feature (61): n=a or g
tcctctgtgctactgtctggtccagccacactccaccacaaccactgatggggacaaaatncaactattctaaaatgcatcagtttaagttcacatgtagaaatggttataatgtagatct

SEQ ID NO: 41121 - DNA, 121 bp, Artificial Sequence
  Synthesized
  misc_feature (61): n=t or c
ccttcatcccctctgtgcccatccacagcttttccctgcgagcgccgcaaacgctgcagcnacaacagcggaggtattttggtgaccccccgactaacagaggaccccgagaacgccctga

SEQ ID NO: 41122 - DNA, 121 bp, Artificial Sequence
  Synthesized
  misc_feature (61): n=t or c
ctagctgtgctcactcccagattttctatgggcttgttcttgaaccgcctgtttgggctgnctgctctatgcctcaaaattacctgggagaggttaggctgctccttaaggaacagagggc

SEQ ID NO: 41123 - DNA, 121 bp, Artificial Sequence
  Synthesized
  misc_feature (61): n=a or g
caaaccctgctgaccccatacaaagattatcaatgatttgtgaagttgattttaaaatcanaagtgttatccttgcaagaaacatgtgatttacctaccattctagtcacagcagttagct

SEQ ID NO: 41124 - DNA, 121 bp, Artificial Sequence
  Synthesized
  misc_feature (61): n=a or g
ggtgatagcaaagcacagaagacaatcaagaagtaggtcaggacaatctagaagcaggttnggagaataagcaaaataagcaaaaaaaagtaagctgtggtgatggcatctcttttagagt

SEQ ID NO: 41125 - DNA, 121 bp, Artificial Sequence
  Synthesized
  misc_feature (61): n=t or c
tcattacactaaaactagattgttttactctttccacatagctaatactgtaactgttctnacagtaaaacagttgatttcccagcgtatgctttcagggagctgtttagcatgtttggaa

SEQ ID NO: 41126 - DNA, 121 bp, Artificial Sequence
  Synthesized
  misc_feature (61): n=a or g
ctagggattttccatgagctattttcattgcccttctttgacctacttctgcattgaggancaggcatattgtatacagtgttcaacatgaggctgaaagacatatataaacatatttcca

SEQ ID NO: 41127 - DNA, 121 bp, Artificial Sequence
  Synthesized
  misc_feature (61): n=a or g
tctgcaggatgtctgtctgctgatggggatgtggtgctgggacagctttggagaatgcacngagccatgtggagaagtaacagggcagtgaaaaatgccatcttaagctggcctggggaag

SEQ ID NO: 41128 - DNA, 121 bp, Artificial Sequence
  Synthesized
  misc_feature (61): n=c or g
gggatttttctgaagagaacagaagcaggcagcaatgcaacttttgaaggttaaagtcctnaggcagggacaaatgcagtcctggagaacaatttccatagaagttagaacaagtccctct

SEQ ID NO: 41129 - DNA, 121 bp, Artificial Sequence
  Synthesized
  misc_feature (61): n=a or g
ttgtggatttttggcagttaagctattaggcctcttagacctcacaaataaaaataggaanttctgcaatacttgcctatccaaagcctatgctcaacaaacaatggcttttatgaacatc

SEQ ID NO: 41130 - DNA, 121 bp, Artificial Sequence
  Synthesized
  misc_feature (61): n=t or c
ccttctgtacacagtatttgggatctttccagtagaatcaagcagtttggcctattgccancttcagttatgtcacaaggaattaccccttttctgtcccttctgtttgtggcttggttct

SEQ ID NO: 41131 - DNA, 121 bp, Artificial Sequence
  Synthesized
  misc_feature (61): n=a or g
aaggatattaaattacttttaaaatacatacaaaggcaaaggtttcatacaaatataagcngtcaagatttagctagggttttaatgcaagtactgccttaaaacacctttacctgcctcc

SEQ ID NO: 41132 - DNA, 121 bp, Artificial Sequence
  Synthesized
  misc_feature (61): n=a or g
attggttgctttactctgacagttttattcatgaaggagaatactggaacttacggaagcntagcttattcaatatatcattcttgaaacttagttaaaaggtgaatggaaactgagttta

SEQ ID NO: 41133 - DNA, 121 bp, Artificial Sequence
  Synthesized
  misc_feature (61): n=t or c
gaagattacccttataaatatctgaagaataactgagttattctctttagaaagctcatantttttatcgtatcaataaggcatgaagtggtataacaagtgagatatacgtcaaattctg

SEQ ID NO: 41134 - DNA, 121 bp, Artificial Sequence
  Synthesized
  misc_feature (61): n=t or c
cagagataagaccttgcttcatttctggaaaaagagaaagaagcttgaatattttagggcnaccccacccctaacagtaacacttccccttcatcagtacccattatttcacagctaagtc

SEQ ID NO: 41135 - DNA, 121 bp, Artificial Sequence
  Synthesized
  misc_feature (61): n=a or g
aaggggtgagctgcagcctctgaaaagcatgtggtgcagtggtagtggttgctgtcggagngtgtgcagggagagatgtgacctgctccaacctgtggtgtggttaggtgttggtacagcc

SEQ ID NO: 41136 - DNA, 121 bp, Artificial Sequence
  Synthesized
  misc_feature (61): n=t or c
atccattacttatttcctgttttttaaccatttatgtaaccattaaccacttaaccattangtatttaaccctattgctgcctagttttctgaattttttttggtaagggaaagccttctt

SEQ ID NO: 41137 - DNA, 121 bp, Artificial Sequence
  Synthesized
  misc_feature (61): n=a or g
tacagcaaggccaagtacaggctgttgcacttaggctgggcaatctcaggtacaagaacanactgggagtatttgttgagagcagtcctacagagaaggacttgggggtcctgatgaacaa

SEQ ID NO: 41138 - DNA, 121 bp, Artificial Sequence
  Synthesized
  misc_feature (61): n=a or g
ggcaggcttgtcttaagacatgctgtccataggcctggaagatgcttccactctgtaggantagtaggaatagtgtggttcttcagcagcacacagtgataaaaaaaagagagtgcttttg

SEQ ID NO: 41139 - DNA, 121 bp, Artificial Sequence
  Synthesized
  misc_feature (61): n=t or c
gattttaatcacatagtaaattgaataaattgacaaagtttgagaaacttacacaactcanagtggcatctgtttctagacaacattcagaattaagtgcttcaaaataactaacaagatt

SEQ ID NO: 41140 - DNA, 121 bp, Artificial Sequence
  Synthesized
  misc_feature (61): n=t or c
gtaaataagaggggtagttgtacatagacctgatcacagtaagctcaaaggaaaccgttantaaatccttgagtcttgtgcagcttactatgggtgggagagaacaggcttttgcatctta

SEQ ID NO: 41141 - DNA, 121 bp, Artificial Sequence
  Synthesized
  misc_feature (61): n=t or c
gagcaaagctgtgttagataatgccatgagtgtttgctactgcatgaaacccagacaccanattcctttccttcgattttacactgcttgtgctgcctcaactctcctcctaaccctgagg

SEQ ID NO: 41142 - DNA, 121 bp, Artificial Sequence
  Synthesized
  misc_feature (61): n=a or g
agaattgaaaatttcacctcttcctaggactaaggataaattggcactatcagaatgttgnctttgaagtgatactggagcagctattgatagacttacaattttgagaaaactgaccata

SEQ ID NO: 41143 - DNA, 121 bp, Artificial Sequence
  Synthesized
  misc_feature (61): n=a or g
agaaaacacaaaagaaggcagcagcttgtttttcagcttctgcttttgaattttctgctcnggatccaggaaaaagggaagcatttaaatcaggaagcatgtatgtcttgcaggattagca

SEQ ID NO: 41144 - DNA, 121 bp, Artificial Sequence
  Synthesized
  misc_feature (61): n=t or c
agcgatctcaatctctgctaggctaaaagtaattttaaagccacttctctataaaatagcnttacacacttattaaagtaattaaatatctctataagtgagacagaattactcttacacg

SEQ ID NO: 41145 - DNA, 121 bp, Artificial Sequence
  Synthesized
  misc_feature (61): n=t or c
tgtctaagagaagatgagaagatcatcctcatcaattgacttttacaaacaccttcctgangctacgtttgtttcatttctaccaagaacctgaggcagatgctacagcagctcaactgct

SEQ ID NO: 41146 - DNA, 121 bp, Artificial Sequence
  Synthesized
  misc_feature (61): n=t or g
gcatacaagccttagtgcaagtttggtttcccataccaagtgagccgcagcacatggagcngagcggtccagcaaacctcagggacagcaaaatccctgctgtgaacggtgatgggacgag

SEQ ID NO: 41147 - DNA, 121 bp, Artificial Sequence
  Synthesized
  misc_feature (61): n=t or g
tgacatctaccagttgcaacagctgcctattagaagcagccagttgccacttttactctgngggcaaattgctaaagaaaagcactattagagctggccagaaatcatttctccaacttgc

SEQ ID NO: 41148 - DNA, 121 bp, Artificial Sequence
  Synthesized
  misc_feature (61): n=t or c
tcagaaataacagaagagtaaggaaagaacatgaaccaaaataaaaccatctctgaggcanagtgaaaaatgccaagaacaaagccgagataccaggattgagtgagacagaggaaggagg

SEQ ID NO: 41149 - DNA, 121 bp, Artificial Sequence
  Synthesized
  misc_feature (61): n=t or c
gtggctgaatatgcttgtactcatagatacatttatatcatagtgctaggcttggcaacangttgtctggattgggcagataggttctaaaacaccccaccactaataaatacatttttaa

SEQ ID NO: 41150 - DNA, 121 bp, Artificial Sequence
  Synthesized
  misc_feature (61): n=t or c
acaaaccctaatgggaacctctctgcacgcagtggttacagctccaggcgctaaagcatanggcaatgccaagatttgggctgcaaaacgcaccgaagtaggagtcctctccagtggaaca

SEQ ID NO: 41151 - DNA, 121 bp, Artificial Sequence
  Synthesized
  misc_feature (61): n=a or g
aagtgaattacacgtgtgatgaggggtgagtttgtggccagctgagctcagctgtcatttnacagtaaggcagaatttaagtgacaaaatggctttacatggaggaacctcataaagtctg

SEQ ID NO: 41152 - DNA, 121 bp, Artificial Sequence
  Synthesized
  misc_feature (61): n=t or c
gagttgtcacctaactgttgttctactgttatgaattaatatataacaaatatatctatcnatatcatccttctaatgagctgagtgtggaaggaggcggatgcacactcttgttgttcga

SEQ ID NO: 41153 - DNA, 121 bp, Artificial Sequence
  Synthesized
  misc_feature (61): n=a or g
ggcactgagagctgatgactgatatgggcaatatttgggaggagagagaatggaagtgtgncaaatatgacatttttactacttgttaatgaggacatctctctagtcttcttactctgtc

SEQ ID NO: 41154 - DNA, 121 bp, Artificial Sequence
  Synthesized
  misc_feature (61): n=t or c
tctttcatcctaagtctccactatcactgttctatcagaatttttggttagtgcactacantgataggagtattaatctgatcaacataaatttcagcagcttttaggattttctcgctgt

SEQ ID NO: 41155 - DNA, 121 bp, Artificial Sequence
  Synthesized
  misc_feature (61): n=a or g
tggcttacggttccaccatagatctcaccctgagcctgttgtcttttattctataatgtgncatttaactactgatggcactgatctcctgctgaacgtagagtgaaatctaaggtttctg

SEQ ID NO: 41156 - DNA, 121 bp, Artificial Sequence
  Synthesized
  misc_feature (61): n=t or c
gttcaaagccacacaattggtttccaaaatacaggttcaatatgttcttgtttatctacanttcttgatacgctgggaaatcatacaataccaactttattttataaacatggaggctgga

SEQ ID NO: 41157 - DNA, 121 bp, Artificial Sequence
  Synthesized
  misc_feature (61): n=t or c
gaaaagaataaagcttccacttttgagagcgtaatagtgtgctgaaacaggcacccaagancatagaatcattttgatgtgttatacctggaagctgaaaaaaatccaacatgcagtctgt

SEQ ID NO: 41158 - DNA, 121 bp, Artificial Sequence
  Synthesized
  misc_feature (61): n=a or g
ttgtcttgtgctacatacatggttcctccacacagacctcctgtcatcctcctcactgtgngtctcacaatccttgggaacccctgacacagcttccactatggatatggaacctctaaga

SEQ ID NO: 41159 - DNA, 121 bp, Artificial Sequence
  Synthesized
  misc_feature (61): n=a or g
ggactggcagtaatttactttgtggaatggctgagatgagattggaggacaagcactgccntccaggtggctttctgacacaagcacagtcaatcagccaccagcatttcaaactcgttcc

SEQ ID NO: 41160 - DNA, 121 bp, Artificial Sequence
  Synthesized
  misc_feature (61): n=t or c
gacatcttccccctcaccgttcctcccttctcctcaggctggtggcagagcctcgtcctgngctctgcacgctgcaatactgctattggatggcagttgtgtcacgcagggctctacattg

SEQ ID NO: 41161 - DNA, 121 bp, Artificial Sequence
  Synthesized
  misc_feature (61): n=t or c
ccaaaagctactacaagatttgtttacctgaatgtgtcaagacaaaacacttgaatgctgnttcaagaacctcaaatctctaagggctgtggttagagaactgagaacccaagatagctat

SEQ ID NO: 41162 - DNA, 121 bp, Artificial Sequence
  Synthesized
  misc_feature (61): n=t or c
tccagaaaggctctgctggacagtctgcagcagaaggccatgacttagatgggaattggcnggtctgaaatattggagcatcaccggcctgaaaactcaaccgtgcttcagtggacacgta

SEQ ID NO: 41163 - DNA, 121 bp, Artificial Sequence
  Synthesized
  misc_feature (61): n=t or c
gtgtgtgtacacgcatggtggggaggggagtgcatgtgtgtgtgcatgcccacaagaatgnatacatgtgtgtgcacacgtgtgtaagcccaggacagagcgggctgtgtgcatgctggga

SEQ ID NO: 41164 - DNA, 121 bp, Artificial Sequence
  Synthesized
  misc_feature (61): n=t or c
caaaatcatgacccagtaaactgccaatgggtgacacaggtgcccagcagcataacagctncactcaccaatctcattcttcagggtccctgcaagaagaaagaaaggaaggaaaccttgc

SEQ ID NO: 41165 - DNA, 121 bp, Artificial Sequence
  Synthesized
  misc_feature (61): n=a or g
ggagaagctaaaggggtgctgcagaagaggagatacgtggattcatgcatggaaatgtgcntatgggaaatgggatgctgtgtgtgctaggagtgagttaggtgtgggaacagagaaggtg

SEQ ID NO: 41166 - DNA, 121 bp, Artificial Sequence
  Synthesized
  misc_feature (61): n=a or c
ataatacaaaaatttagtaaaatataaggctaccgtaacagaagttcttaagctactgaantagtgtgaagtctacgttccatctacacagaaaaaagctacttctaactgtatgtgtata

SEQ ID NO: 41167 - DNA, 121 bp, Artificial Sequence
  Synthesized
  misc_feature (61): n=a or g
cagtcagaggcccaaaagcaatgtaggaatgagtttttcatcaatactgaaatacagagtntggtggtacaacatctgccacgcactcacatctgagagactaaaagcatgggatttcagc

SEQ ID NO: 41168 - DNA, 121 bp, Artificial Sequence
  Synthesized
  misc_feature (61): n=t or c
gctgcagaagttcctcccgcggcgcgctttgcgcgacagcgccataagtaaaacccgctgnctccctgcaaagcgttcgcttcgtccaacacttctgagcaagaaaccaaacagacagagc

SEQ ID NO: 41169 - DNA, 121 bp, Artificial Sequence
  Synthesized
  misc_feature (61): n=a or t
tgatcagttctggaacttccagaaatgtaattcagtgcaacagtgagttgtctgatgccantacaaagcccaagtattcatcttccgaacgtcagttctgtttgttgtagagagattgtct

SEQ ID NO: 41170 - DNA, 121 bp, Artificial Sequence
  Synthesized
  misc_feature (61): n=a or c
ggggtaaaaatagagaaaagtggaagatgtggatacatgctactaggctgataaacaaaantagcaaacttatatgaaagatcagattgtgacatattttcacgaaagcaaaaacaaaaac

SEQ ID NO: 41171 - DNA, 121 bp, Artificial Sequence
  Synthesized
  misc_feature (61): n=t or c
cagcaaacggacatgggggcacctccctgtgccaaagccacagtctgaccggggtctgatnccccttggaagcgtcgtgtaatggtgccatcaaagtaaatggccctgagaacacactcca

SEQ ID NO: 41172 - DNA, 121 bp, Artificial Sequence
  Synthesized
  misc_feature (61): n=c or g
atttgtgtcctgctgttacgctgagtgatatttgtgtaaggaaagttctatgcagagatancaaatagtgtttggtgtcaaaggggagagacaactacacttcaaatttgcttcttaatgt

SEQ ID NO: 41173 - DNA, 121 bp, Artificial Sequence
  Synthesized
  misc_feature (61): n=t or c
tacctccatcaccctagcacacaagaaccccatctccatcatctctgttaccctaaggacnccacttctgtcacttccagcactccaagaaccccatttccaacatacccagcaccccaat

SEQ ID NO: 41174 - DNA, 121 bp, Artificial Sequence
  Synthesized
  misc_feature (61): n=a or g
ttcagattaatgcactattatgcctataagcgcataaatccaaagaatgaaaatttctggnaagagattagctttcagtgacatcagtttcatttcttaagcaagaactcctgaaaattct

SEQ ID NO: 41175 - DNA, 121 bp, Artificial Sequence
  Synthesized
  misc_feature (61): n=t or c
tgtcactagtaaaatataccctgtaagtgtgctctattgtgttataaaatttgtgactagnttttctacataggtattacacccttaccatgttcagaggctttttcagacatagaaaaag

SEQ ID NO: 41176 - DNA, 121 bp, Artificial Sequence
  Synthesized
  misc_feature (61): n=a or g
cattcaggaatctggcattctgcttcattctcttcttatcagactgttgaacagtgagagncacaataccttccagtggaaattattccagaaagttccatggcaaagtgactttgcctgt

SEQ ID NO: 41177 - DNA, 121 bp, Artificial Sequence
  Synthesized
  misc_feature (61): n=c or g
gtgtgttagtgacatagtttgtttgataccaaacatatcagtaaagattgtcgctactcancaaacaacatatcatgcataaccagtagaactatacagcagcagttttgccactgagata

SEQ ID NO: 41178 - DNA, 121 bp, Artificial Sequence
  Synthesized
  misc_feature (61): n=t or c
aaaacagcaagcacccattggtggagatattcccactgtgcagaagcagaatgatgttcanagggtaggatttttttcaaatgatctttcattagttgcatattgttttgaagtttactgt

SEQ ID NO: 41179 - DNA, 121 bp, Artificial Sequence
  Synthesized
  misc_feature (61): n=t or c
ttgcctcatgcatgctttcattgcattggtacacctatttggccaatacatattcttgaantaatcatttcaaaccatttctgacagagaaacacttttctcccattgcaaagctactccc

SEQ ID NO: 41180 - DNA, 121 bp, Artificial Sequence
  Synthesized
  misc_feature (61): n=a or c
aaagcaacaaataagcaaagactttacaatacatccttttctccgactttcttctttgccnttctgacatggagtcagtaagatagatagatacaggagatccagaacaattgctcccagt

SEQ ID NO: 41181 - DNA, 121 bp, Artificial Sequence
  Synthesized
  misc_feature (61): n=a or g
acctttgtacagaataagaactgagaaatgtgggcttcttggccacatctctggaggttanagcctacattctgaaatgtgaggacagtctgggtcacttaattgatagaaatatttaaat

SEQ ID NO: 41182 - DNA, 121 bp, Artificial Sequence
  Synthesized
  misc_feature (61): n=a or g
tgtaagatgatccaagtcagggtccaaaacacagatatgcacagtgttttggaatgatacnggctctcagtttcattcatcaccttgccaagttgggtcagagtaaagaccttaagcagaa

SEQ ID NO: 41183 - DNA, 121 bp, Artificial Sequence
  Synthesized
  misc_feature (61): n=a or g
aagcctggagattcagagatgcctgggaggtcagaaatccatgtgttctggttctcatagnttcccttaaaattgaggtacataaaggaggtgaaaatgtgcgtgctggagatgaaggctc

SEQ ID NO: 41184 - DNA, 121 bp, Artificial Sequence
  Synthesized
  misc_feature (61): n=a or t
caaaaaggagataagaacattacgttacagagagtcaatgaaactacgttgatagaagacntttaacctcttcatcaagcctgcactaaggaaccaccaaaaactgaagaaataagcttgt

SEQ ID NO: 41185 - DNA, 121 bp, Artificial Sequence
  Synthesized
  misc_feature (61): n=a or c
atttttaccacaaagagaaggaattctaaagaatgtacaattttaatcaagactctaaatnctaaggagtagatagcaaatgagaagggcatggcttatgcattctgaaagataaaaataa

SEQ ID NO: 41186 - DNA, 121 bp, Artificial Sequence
  Synthesized
  misc_feature (61): n=a or t
cttgattaaaacaaaaagacaccttagaactccattgctattgccacatgtttaaatattngtaccaaaagtaaagtatcttcaagactgaaagaaaggcaaatctaattgctttgagaag

SEQ ID NO: 41187 - DNA, 121 bp, Artificial Sequence
  Synthesized
  misc_feature (61): n=a or g
tacatcaggccgagaacagaatgcatagccaaagtctccattctgttcacaccaaagactnctcccaaagatgcaagttctcattcagcatggagaagttctatacagattgtagaatcac

SEQ ID NO: 41188 - DNA, 121 bp, Artificial Sequence
  Synthesized
  misc_feature (61): n=t or c
ctgctaggtgagagtttacctgtgcttcactgctgtctgcttccaccctcacccaactccngctgcagctctgtccatctccttccagctgcatttctcactcagcccaaggccacctctg

SEQ ID NO: 41189 - DNA, 121 bp, Artificial Sequence
  Synthesized
  misc_feature (61): n=t or c
tcctcattattaccataatcatttcagcttattagcatgggaacttattgttttcaaaaangagttatggacagaacactcctgaaagctcagctttatgcttcgagattcaacatctcca

SEQ ID NO: 41190 - DNA, 121 bp, Artificial Sequence
  Synthesized
  misc_feature (61): n=t or c
ctagaacagcctttctgaaaactaagaaggggaaaaaccaacagcagctttgagatggttngcgctaagttctacctgcgattacagggctacgcatctccttctgggcatacatccaaca

SEQ ID NO: 41191 - DNA, 121 bp, Artificial Sequence
  Synthesized
  misc_feature (61): n=a or g
tgtggagatttcaaaatatctttaaaggagcctggaattaacctctcccaagcaactaaanttaggatcactcccaaattggagaaaaagacgactcgacgcacacacgtgctcctgggcc

SEQ ID NO: 41192 - DNA, 121 bp, Artificial Sequence
  Synthesized
  misc_feature (61): n=a or g
atcattgataatacaaggaggggatataattacacataattacgggacacttacgcagganccactctgaaccccccagataagaaaattcaggcattttccttgcagggttctcttgcag

SEQ ID NO: 41193 - DNA, 121 bp, Artificial Sequence
  Synthesized
  misc_feature (61): n=a or t
tcaaaaaacagtaaaggaactgccatgactttaaaggatattaacatagagcaccggaacnaaaaagcagtccagtgactgtttttgcaagatagactcattcatttgcagggaacagtgt

SEQ ID NO: 41194 - DNA, 121 bp, Artificial Sequence
  Synthesized
  misc_feature (61): n=a or g
tgccccaaatctgctgcttcatgtgtgcaggtgacaaaattacatgctcaaaaatgaaccnccaaaaatgattctcaaggattaagcagatatgattccccacagatcactacagttagag

SEQ ID NO: 41195 - DNA, 121 bp, Artificial Sequence
  Synthesized
  misc_feature (61): n=t or c
taagtcagttttgccatctgcacgccttacccatccaatccaaacaactgcagagaccaangtgacgagagcaactcctcactcctcttctctgagaacctgtttctcctcttcctcctcc

SEQ ID NO: 41196 - DNA, 121 bp, Artificial Sequence
  Synthesized
  misc_feature (61): n=a or c
aaggacagtctacacctcctaccaaataaaaacagaaaagggaacatgcaattgataagancagatacaccagatcagaccagaaattcatgtgtatcatgatccatatgtggcactggcc

SEQ ID NO: 41197 - DNA, 121 bp, Artificial Sequence
  Synthesized
  misc_feature (61): n=t or c
cacaaagtctctaattaaaactattactgaggaggcagccacagatttcaagcaacttttntgcaagagaaaataaacctgagattattttacccttctgaaaaaattcacctctgtgatg

SEQ ID NO: 41198 - DNA, 121 bp, Artificial Sequence
  Synthesized
  misc_feature (61): n=t or g
catcttgctccaaaaatatgataattaggagtcctttgattttaagtaagaaataataatntgttattattattagagattggctagagattatgtcaccgtgtgatcctcatttgagaac

SEQ ID NO: 41199 - DNA, 121 bp, Artificial Sequence
  Synthesized
  misc_feature (61): n=t or c
ttatattgataactcaccctaccccaaaggcaaacagcaggatacttttcctgatttcctnacgtgtttgtactctagaaagctggtgagaaaactgcatttactctatgaatgaaaatcc

SEQ ID NO: 41200 - DNA, 121 bp, Artificial Sequence
  Synthesized
  misc_feature (61): n=c or g
ccatttcccctctagctcatcctccacacacctctgttggcaaccattgtgatgctgcctnacatcagctatccgagtgagtgtgtgtgaagaccacaagaaaggagggtgcctcccttct

SEQ ID NO: 41201 - DNA, 121 bp, Artificial Sequence
  Synthesized
  misc_feature (61): n=t or c
atacggatctttgataaggacacaatgatatactgtagctgaaacccagaaatgagttcanaattcaactaattaaccatcacaaccctgccatttaaggcagtgattattcttcgttatt

SEQ ID NO: 41202 - DNA, 121 bp, Artificial Sequence
  Synthesized
  misc_feature (61): n=t or g
ttctgagggacctgtggggccgtggctgttcacagtcttactagatgaatacaggaggtgnatgaaggcttcacaccctgcttatcagtggtgcctcttgcccatgatgggggagataggg

SEQ ID NO: 41203 - DNA, 121 bp, Artificial Sequence
  Synthesized
  misc_feature (61): n=t or c
cactcttggagcgtaataaatcttcagtgattcacttttataatcaatactgagcaattgngttaccaaaaacctaacacaacaatggccatatgcagcattatccctccactaatgaaat

SEQ ID NO: 41204 - DNA, 121 bp, Artificial Sequence
  Synthesized
  misc_feature (61): n=t or c
ccaaagcaatagcagctaaacaaacaaacacccctatgaggcctgtttctgttttaaattnacaatttatcttatgccagcacaactttccggtaaataccttttaggcggctgtgtggcc

SEQ ID NO: 41205 - DNA, 121 bp, Artificial Sequence
  Synthesized
  misc_feature (61): n=a or g
tgcctcattgctttgtggacctctgctccaggctgcagcaggatgaggcagagtggcgatntgttctccatgcagctgggcaccatgatacccatcagaaccctttgggtcaggaactgtt

SEQ ID NO: 41206 - DNA, 121 bp, Artificial Sequence
  Synthesized
  misc_feature (61): n=a or g
tacttttcagtgcgtgaattagtgtttgtgttgtcagtcatgagaacagccctcacatgangacttagtgctgaagtagtgtgctgagcttttgtgcaactgaatcagatctccttgagta

SEQ ID NO: 41207 - DNA, 121 bp, Artificial Sequence
  Synthesized
  misc_feature (61): n=t or c
taaaagggaactctgacattaagggaaatgcaaacagcagtctgccgcctcttaggtttgngagcgaggcatcaaaaaggcaacgaagttggtaacagtggaagcaacagctatatttccc

SEQ ID NO: 41208 - DNA, 121 bp, Artificial Sequence
  Synthesized
  misc_feature (61): n=t or g
atatataccttaaagtggtacagaaggagtgtacatcagcagtaatatgattgtgaatccncagagtatagctgggtctgggaactgttaacctttattatccttccttgtctaatagcca

SEQ ID NO: 41209 - DNA, 121 bp, Artificial Sequence
  Synthesized
  misc_feature (61): n=a or c
gaagtggtttagcattatctgatgttctacaacttcagacccaggaaaattcatcagattntctgtttgcagaattttaatgaaatttggctctttgaaaatcagctcactgatatttttt

SEQ ID NO: 41210 - DNA, 121 bp, Artificial Sequence
  Synthesized
  misc_feature (61): n=a or g
ctgggcagttgttcagcttttggcaatttctgtgaggttttgggtactctgaaaacacacngggaatgaaattcctttctgacagtggcatgaagaggcagccgaggctcgaggagggaac

SEQ ID NO: 41211 - DNA, 121 bp, Artificial Sequence
  Synthesized
  misc_feature (61): n=t or g
gaaaattgacatctttgtgtccatgcttgttccactgggaggactgccacttgacacaatnagtgtgtattacttttgtcagtgaaggcacagattaggacagcttccaggctattcagag

SEQ ID NO: 41212 - DNA, 121 bp, Artificial Sequence
  Synthesized
  misc_feature (61): n=t or c
tgtgcaaatatgttttgaaacagtcgctgtaaatgtcatcaaacaatgctgatatcaacantttggacagctttttacaagtactaacagtgcacaaaatctgagaagattagcatctcag

SEQ ID NO: 41213 - DNA, 121 bp, Artificial Sequence
  Synthesized
  misc_feature (61): n=a or g
tccagtcgagcactgcccgggcagcatgaaatacctcaaccacagaacaaggctggctctnggatgtgagcaacctggccagagagtttaaatcttctgcattgtggcctgagatctgctg

SEQ ID NO: 41214 - DNA, 121 bp, Artificial Sequence
  Synthesized
  misc_feature (61): n=a or g
tgtcaccagcagcctgacagtcctgttccctacaggcatcccatcttccagcacccaaagngtgaaaggcagctgccattcgccccaacagcagctggagaagccacagcaaaagagtgtg

SEQ ID NO: 41215 - DNA, 121 bp, Artificial Sequence
  Synthesized
  misc_feature (61): n=a or g
cattaaaagctcattgcctaacctggacggtttgcaaaactctttgtagtgattggcaccngaaaattttagcctgcaggtagctttggaaagatgaaaaagccatgctgtcagcccaaac

SEQ ID NO: 41216 - DNA, 121 bp, Artificial Sequence
  Synthesized
  misc_feature (61): n=a or g
tatttatagcagtttgctctctagggagcacggctacagcagtgctttgtggagagatggngagaagatggcgggcagcagcatgccatacacatcagggctgccctcctgctgagggaag

SEQ ID NO: 41217 - DNA, 121 bp, Artificial Sequence
  Synthesized
  misc_feature (61): n=t or c
actgcaaatgactgggaagaacctagaagtcagcagaggattattcttgataatgttccgnccacataacaagcagtactgattattactcaccaggcgtacatcaggatgagtgtgttcc

SEQ ID NO: 41218 - DNA, 121 bp, Artificial Sequence
  Synthesized
  misc_feature (61): n=a or t
tgcaaccacatcatcttcttcttcctcatctaagaaaaaagtacaagactgtcagtgtttntagagaggaatgatgtcattctgaaggaatctataaatatatcagagaaatatatcagaa

SEQ ID NO: 41219 - DNA, 121 bp, Artificial Sequence
  Synthesized
  misc_feature (61): n=c or g
tttcactcttgcccttctcaatgtgctgacagtgctcagatggccagcagaatgagaaaantcaacagcttatctcgcagggctcatttccagccagttcaacctactggtgtcagcaaag

SEQ ID NO: 41220 - DNA, 121 bp, Artificial Sequence
  Synthesized
  misc_feature (61): n=t or c
tcttttctgagcaaattctattcctcctatgagcataaacctaaaaggatgcaaaaaattnaccaattgcagattgtctcaattaacgtcagaatctgctgtattcttctttgtcagaagt

SEQ ID NO: 41221 - DNA, 121 bp, Artificial Sequence
  Synthesized
  misc_feature (61): n=a or g
tctcttcttgaaaagatccctcacttcattcttcagctgcagaaagcactaggaggctgcngaaaccagctcacttccttgtctacgaaccaagcaagtatgtgagtatgtggctttcctc

SEQ ID NO: 41222 - DNA, 121 bp, Artificial Sequence
  Synthesized
  misc_feature (61): n=a or g
ctgtgcccaccagagcaccagtgctgtgtctgctgtgactcaccgtgatgccatgaggccnccttgcagtgggctgagggcaaacagaagatgcgatgtttcatccatgaagctttgtgat

SEQ ID NO: 41223 - DNA, 121 bp, Artificial Sequence
  Synthesized
  misc_feature (61): n=a or c
gttcttatttgtattagagcaagggcagtgatatgatacttcttccaaagactaacttacnggtattactctgccttacagatattaatctgcctttctaatgccttaaaacagagctgga

SEQ ID NO: 41224 - DNA, 121 bp, Artificial Sequence
  Synthesized
  misc_feature (61): n=t or c
tcacaccttaatgttgtctttatttttataaatgcaagtttataatcccacacagatttgnccataatacttaggaactttgcttggtctaattcttgctttgacaaatttgccatcaatg

SEQ ID NO: 41225 - DNA, 121 bp, Artificial Sequence
  Synthesized
  misc_feature (61): n=a or g
ttgagctccctgcatttggggttaagcaccctgcatttcccattgcaggtcccaactgcancagcccaaactccctgcaaatctgtgctccatgctgggagcacagaaacagcttgaacca

SEQ ID NO: 41226 - DNA, 121 bp, Artificial Sequence
  Synthesized
  misc_feature (61): n=a or g
ccagatgcttttttttttttctttcctttttaactgatttctgtagtgcacacataacgcngatcacaatttctgagttgtagcccttaggctcatagggattatggaaacagacagactc

SEQ ID NO: 41227 - DNA, 121 bp, Artificial Sequence
  Synthesized
  misc_feature (61): n=t or c
caaaacagaaaaacacaaatgaatgtagtcatcccaaattatatacagcccaatttttctnaattgagacatattactttactgtaattaaagtgtcaataaaagtctaatatctgacaga

SEQ ID NO: 41228 - DNA, 121 bp, Artificial Sequence
  Synthesized
  misc_feature (61): n=t or c
ctctttttacgagaatgtctgggtgtttttcaagatgtagagctgccaattaagatttccncatgcaagtctcatagcaacatacaaacttgtaaatacttttctctccctttataaccat

SEQ ID NO: 41229 - DNA, 121 bp, Artificial Sequence
  Synthesized
  misc_feature (61): n=c or g
tacaggatctgaacatgcagatcctgtacccagttcggctgcacagctacaatcttagaanaatagggaataatgaatgtgtggaaataggaatggaagcatttaaataattcagaactgc

SEQ ID NO: 41230 - DNA, 121 bp, Artificial Sequence
  Synthesized
  misc_feature (61): n=t or c
gatcagggtcagcacccggcagaggtcctcagcagtgcttcccatggacgcacacactccntcaccgtgcagtggatgtactctgagcttggggaggtttcttgtcttgggcttcccactc

SEQ ID NO: 41231 - DNA, 121 bp, Artificial Sequence
  Synthesized
  misc_feature (61): n=a or c
tctaattagattgttaaacataaaagcagaatggcacagcggtaaagaatttgctctactntttgtaattccagaataaggcatagcaaagattcaggatttttccagcccatttccccca

SEQ ID NO: 41232 - DNA, 121 bp, Artificial Sequence
  Synthesized
  misc_feature (61): n=a or g
actgctggaaatgtctttcaccaaaattcagctaaagggaaggaaccatttcacatagcangataccactgtcctgttcaaaatgggtgagatgctctcaatcgatgagaacctccagtgc

SEQ ID NO: 41233 - DNA, 121 bp, Artificial Sequence
  Synthesized
  misc_feature (61): n=t or c
agatagccctagacgtgataggagttacatattgaaagctgtgtatgtaaaaatcttgtcntggagccacagaagtaggacccaaatctccctgaatgggattcgctttctcacttcagcc

SEQ ID NO: 41234 - DNA, 121 bp, Artificial Sequence
  Synthesized
  misc_feature (61): n=a or g
tcatcatgaatcttcttgtactccaaattcatctactttttcctttttaatatggaaggcncaatatcctttagactgctacttcaaaaatgacatctcaatgataacagaacgttatgca

SEQ ID NO: 41235 - DNA, 121 bp, Artificial Sequence
  Synthesized
  misc_feature (61): n=t or g
agtgcttggcactgtttttcctgttcaaataccaattcctgtgactgtcattctttgcagncttccaaatcctggcatttggaagttgcagttgcttccaacagagccttttgtccagcag

SEQ ID NO: 41236 - DNA, 121 bp, Artificial Sequence
  Synthesized
  misc_feature (61): n=a or g
tcaatataaaccataaacaaaattcttccaaatgactattatgaaaagtagcttcacaatnttgcatgaatctctcagcatcctatgccttatcgaaagtttatgcctggaagatagacta

SEQ ID NO: 41237 - DNA, 121 bp, Artificial Sequence
  Synthesized
  misc_feature (61): n=a or g
gctgtaggacagcacagctttatagagcaacaatcttagtgtgaagttttacggtcagtgnaagccatgagctcttttcccttttcaattccttattttagagagtttaagagcctcactg

SEQ ID NO: 41238 - DNA, 121 bp, Artificial Sequence
  Synthesized
  misc_feature (61): n=a or g
ttctccatgccactttccacaccttggttctgctcgttataaagatgacattgaaataganatttagttctgacattttgaagatggactttggttctacttttgtggtcaaactgtggga

SEQ ID NO: 41239 - DNA, 121 bp, Artificial Sequence
  Synthesized
  misc_feature (61): n=a or g
gtcctgtagacatcaagcagctcatacagctgccatcagcacttagaataatgtgaacaanaggtaagctgtagaggcagcagatgacagaaagtctctcatagttccctttgcatgaggg

SEQ ID NO: 41240 - DNA, 121 bp, Artificial Sequence
  Synthesized
  misc_feature (61): n=t or c
ctgtaaactggcaaagatggccagtggcctcctggactgcattaggaggactgctgccagngggtcaaaacaggtgacacttctccttgctcagaactagtgagagacttctgaagtgctg

SEQ ID NO: 41241 - DNA, 121 bp, Artificial Sequence
  Synthesized
  misc_feature (61): n=a or g
tggatagtctgcatttcagaaggcacacaaagctctggagacactcaacacagggcactgnaggcatctcaagttgggcagcccccaaccacagatgctgggtgactacctcaccttgccc

SEQ ID NO: 41242 - DNA, 121 bp, Artificial Sequence
  Synthesized
  misc_feature (61): n=t or c
ccccttctttctaatttttctcaaataagtggtttgtgggttcagcaggagcagcagatantgtatagagatgcccgatctggttctctttatctctgttaatgcaggctgcttgaagaag

SEQ ID NO: 41243 - DNA, 121 bp, Artificial Sequence
  Synthesized
  misc_feature (61): n=t or c
aagtaaagtgccataagtggggctttccagtaaactgtggaaatctctttgttagaggagnggattttcaagcttcatactacatgtacatttatttacttgcaaaacatgaaacaggaaa

SEQ ID NO: 41244 - DNA, 121 bp, Artificial Sequence
  Synthesized
  misc_feature (61): n=t or c
taatgaatacaaaagattatttctccactttgtatccagaccaattctgcagaagttgtgnatatattagttactgtttcttcagttctgcagctgaaaggttgcacatatcgcagaaaaa

SEQ ID NO: 41245 - DNA, 121 bp, Artificial Sequence
  Synthesized
  misc_feature (61): n=a or g
tacactgctaaattggaacagctctgaggactccgtcatgctcctctactctttagactcncagagtctcgctggtatctctaggggtgcctggagttaatagtaacatctaaaatgctat

SEQ ID NO: 41246 - DNA, 121 bp, Artificial Sequence
  Synthesized
  misc_feature (61): n=t or c
ttttgccactcgagtttcattgcatggggagctgcatacattgtccatgcagctgtggctngatgctaagaaaacacacaccaaaatggtacttgtgtttttcacagacttaactgatctt

SEQ ID NO: 41247 - DNA, 121 bp, Artificial Sequence
  Synthesized
  misc_feature (61): n=t or c
cggcgaaaaagggtaacctgactcgcactactgataatgaattctgttgatttctactttngattatagaggaaagctgggagggttttttaatttgtgtccttccccccccccccccccc

SEQ ID NO: 41248 - DNA, 121 bp, Artificial Sequence
  Synthesized
  misc_feature (61): n=t or c
attggtaagcacacgtaatcacaggatggttgaggttggaaggaaccactggagaccatcnagcccaacctcctggctcaagaaggaccacctacaacaatttaaccagggctatgtccag

SEQ ID NO: 41249 - DNA, 121 bp, Artificial Sequence
  Synthesized
  misc_feature (61): n=t or c
aactcacagttttatgagggcagatactagcaagtcatccaaatatcaagacaaggaagtnacacttgggtgtgcagaccaaaggaattaaaaaactctccagaaagtgtagaaatagctg

SEQ ID NO: 41250 - DNA, 121 bp, Artificial Sequence
  Synthesized
  misc_feature (61): n=t or c
ctaaggatcattttcttactgaccctgtatgaaatatcagccccattaagcaagcattaancttagggtttagtccagttcttctgaaagttatttctcccctccctgatgctgatgtgtt

SEQ ID NO: 41251 - DNA, 121 bp, Artificial Sequence
  Synthesized
  misc_feature (61): n=t or c
gatttcactgtaaaaacagaataaaaattgatcccaagtgtttccaacctaaggaagaaangttttagaataggtgcgatgactgtggaaggatgaagtggtgtccatcagcatgatggcc

SEQ ID NO: 41252 - DNA, 121 bp, Artificial Sequence
  Synthesized
  misc_feature (61): n=a or g
aggattgccaatgaagtcttaatacagtcccactgatttttatcagatgaatgaattgagnctgcacagaaccatagtgacttctgttttgtctgcagttaaggagcatggcctcactggg

SEQ ID NO: 41253 - DNA, 121 bp, Artificial Sequence
  Synthesized
  misc_feature (61): n=t or c
gcaaggcagaagggagggaggggacaggaataacttagcaaataataatgttcacaaccanatggccagactgtccctcttctcactatgacagcactgagggaagcagcaggccacagtc

SEQ ID NO: 41254 - DNA, 121 bp, Artificial Sequence
  Synthesized
  misc_feature (61): n=t or c
gctgttagtattctctgcgttacgttatctaaatgtaaatgtctgtctctgatgtagcatnctagttagactctaaaatttatgaactaagggaaggatgaaatgtgaaaaagttgagaag

SEQ ID NO: 41255 - DNA, 121 bp, Artificial Sequence
  Synthesized
  misc_feature (61): n=t or c
cataaattagagctatagtgtagaacaacttctacccaaggtaagatagttggccagcttngctgcactgacttaacttttcctattccaggaataggacctggcttatgtttctggcatg

SEQ ID NO: 41256 - DNA, 121 bp, Artificial Sequence
  Synthesized
  misc_feature (61): n=a or g
gaattaattctctgtccaactttgaaccaatctgcttccttactggcagacatggaccccnaattcactgtgtttgttcccagaagaagctatcccaccatacattttgtaacagaaacaa

SEQ ID NO: 41257 - DNA, 121 bp, Artificial Sequence
  Synthesized
  misc_feature (61): n=t or c
ttcctcttctaagaatggaaaacagctagtctttaatcaagaccaagcttgtttccagctngggtcgctttgagtacctgagatcccactgttagagagccagagtgagaatccattttgt

SEQ ID NO: 41258 - DNA, 121 bp, Artificial Sequence
  Synthesized
  misc_feature (61): n=a or g
acattcagatagcagttctgtgaaagacctgtaacatctggggagccccacctacctacancagatgctgtttcctcccacttgtgtttttatacactctaataaggacactgcaaatact

SEQ ID NO: 41259 - DNA, 121 bp, Artificial Sequence
  Synthesized
  misc_feature (61): n=t or c
actgcttctgtgagtccacgtcctttcctatggatctgcatctgggtgatgtttctgtttntctgtttatgatgagatagagtggaatggtaaagagattccttcctccttcctcgaggtt

SEQ ID NO: 41260 - DNA, 121 bp, Artificial Sequence
  Synthesized
  misc_feature (61): n=t or c
atcctctcctatgccatgcacagcaggatggagaaattcggaaccagagccaaatggctgngctgggagtgaggggttctcctgtttcagtttggtggatgggtcccttctgtccctgatg

SEQ ID NO: 41261 - DNA, 121 bp, Artificial Sequence
  Synthesized
  misc_feature (61): n=a or g
ggcagaactcattcacagcaaaacttcatctctcaaaataggaattaccacgaagggatcnagaatgactcttttgaggccaaatggcccattaagaaggtgggaaatgcttttatcatct

SEQ ID NO: 41262 - DNA, 121 bp, Artificial Sequence
  Synthesized
  misc_feature (61): n=t or c
tcagaaagaacgagtctcagtcatgagctctcttactgaaactccaatctgagcaatcagnccaataatctcatggctcaattacttataattaactcaattttcaccgtccttagacatt

SEQ ID NO: 41263 - DNA, 121 bp, Artificial Sequence
  Synthesized
  misc_feature (61): n=t or c
atacttggtgtccagtgctccattctgatggaacgtgtgtcagttctcccgacagaaatancactttcagggtaaggtgatctgaacaggtaattagttcctggtagagtcagaatcatct

SEQ ID NO: 41264 - DNA, 121 bp, Artificial Sequence
  Synthesized
  misc_feature (61): n=t or c
tttgtgctctttagaccatcaccaattaaaggcttacttctaccttctacgagattttcanccacttgtattgcagatatatcagccaaaggaaaaaaaaaaaaaaaaaaaaaaaacagag

SEQ ID NO: 41265 - DNA, 121 bp, Artificial Sequence
  Synthesized
  misc_feature (61): n=a or t
gtaggcacagttttactgtcataggaaatatttttctttccatttccaataatggtcatgngaaaccacctctacacagtatgggcattttctagtactcacgtacttagagaatttgaag

SEQ ID NO: 41266 - DNA, 121 bp, Artificial Sequence
  Synthesized
  misc_feature (61): n=a or g
gaacagacttttttttttaataatgatgatttcagcaggagtcagtgggtctaccccaatncactctagctaagacccaggttataaatatattacagctttgttggtttctattgcagat

SEQ ID NO: 41267 - DNA, 121 bp, Artificial Sequence
  Synthesized
  misc_feature (61): n=a or c
ttcagactcttcacttccagttggtttagcacctcaagccaagcactgaataatccactgnttctttaaaacccagccattttaaatcaagaaagggaacaaaagatatgtccattttctt

SEQ ID NO: 41268 - DNA, 121 bp, Artificial Sequence
  Synthesized
  misc_feature (61): n=a or g
tcctgagctgacaaataattcctgtgctttctccacattgtgtttccaggccattcctatncatttgacctatgacactttgctcctttccttgaaagagcagacctccccggcttccttt

SEQ ID NO: 41269 - DNA, 121 bp, Artificial Sequence
  Synthesized
  misc_feature (61): n=t or c
acagctgaagtacatttccacagtgactgtgcaggaaagtaaactagagctctatatagcngtcatccattatcccatatatttttagcaagccgaagattaacgatcggaaggagccaat

SEQ ID NO: 41270 - DNA, 121 bp, Artificial Sequence
  Synthesized
  misc_feature (61): n=a or g
aaccagttgagaaggacaagtagaaccctcccagtctctgtttcaggataccaaatatcanctaatatagcaggtataatttaagacaggtttctgatccattagaacccaagaatcaatt

SEQ ID NO: 41271 - DNA, 121 bp, Artificial Sequence
  Synthesized
  misc_feature (61): n=a or g
tgctagtaatcagatttctgataatgttgctgttgttgtgatttgaaaatacttgggttgnatttaatgctcctatagtggattatgtaacaaacaacagaagaaagattttgtggttttt

SEQ ID NO: 41272 - DNA, 121 bp, Artificial Sequence
  Synthesized
  misc_feature (61): n=a or g
tcacctccttccaacagaggaggtctaacactgtttctagactcatatttcatatcacagngaagttctttcccacctgtcccaaagcaatacttatagttgtgagccagcaagaaaacca

SEQ ID NO: 41273 - DNA, 121 bp, Artificial Sequence
  Synthesized
  misc_feature (61): n=a or c
ttaatgcataattaattgttatactaattttcctaattttaagtaagcattgtggcaacantgtctaatcccattgttgattcttttaataagattgaatattccttggcagaatgcttgg

SEQ ID NO: 41274 - DNA, 121 bp, Artificial Sequence
  Synthesized
  misc_feature (61): n=t or c
aaggttataatccaattcccagcacttacacatactgacagtcatactacaccctttcacngagaaaaatgttttgtgtgataccatccctgcttgcagtgatcatatgagggaatccatg

SEQ ID NO: 41275 - DNA, 121 bp, Artificial Sequence
  Synthesized
  misc_feature (61): n=a or g
caccaagtgtgattggtcagctccccagtagtaaaactcaaatggagccatttaaaaatancagccaaactcctatgaactctgtgagtacgaagaagtcaaggcattaggaaaattttag

SEQ ID NO: 41276 - DNA, 121 bp, Artificial Sequence
  Synthesized
  misc_feature (61): n=a or g
aaaccttgcagggcctttgctctccccccgttaaggtgactggggcaaaagaccaaagacnggactatgaattctaaacaggattgtacagccaaagcagctaaaagttctgtttgtacat

SEQ ID NO: 41277 - DNA, 121 bp, Artificial Sequence
  Synthesized
  misc_feature (61): n=a or g
ttctgctgttgcagaagagtaaatctaggagaagtggcagaattttgcatgtctaatccanctctgaattatgccattactactgtggagtccccagcctacaagtaaaagcatggactag

SEQ ID NO: 41278 - DNA, 121 bp, Artificial Sequence
  Synthesized
  misc_feature (61): n=t or c
tgtgtcctgcacatggccagccctcgctttggagctgccttcatctcccagagatgaaaanaggagactttgtctctgttagatctacaataacttcttaaaccaaagcattctttgtttt

SEQ ID NO: 41279 - DNA, 121 bp, Artificial Sequence
  Synthesized
  misc_feature (61): n=a or g
ctatcaagttacattttcaagttgcatgacattatcaatgagactttttcctaatatagtncagggaggaagggaacaaggcaacagcctgacaacaaggctactggaacaatggtagagg

SEQ ID NO: 41280 - DNA, 121 bp, Artificial Sequence
  Synthesized
  misc_feature (61): n=a or g
gccatcccaaactgcttggagtcccaggagcatcccagggatgggtaacagatggtacagnggatgagcagactccatttccatgaactgcctcttgcagaccaggctgcatcccaaacct

SEQ ID NO: 41281 - DNA, 121 bp, Artificial Sequence
  Synthesized
  misc_feature (61): n=t or c
caattcttactcaaatgtattgatttcttctctccctctcttctcacaacatgggatttgngctggtgtctgttctcttggttgtcagccctcctccctgccctgctgcagagccttccgt

SEQ ID NO: 41282 - DNA, 121 bp, Artificial Sequence
  Synthesized
  misc_feature (61): n=a or g
tctaaaaaaagattttttgataaatgtatccaaaggtatattaaatagcatcaatagcctncagcctattaggttggaaatgaccaacatcagtggaatattccttaaaacttacacaact

SEQ ID NO: 41283 - DNA, 121 bp, Artificial Sequence
  Synthesized
  misc_feature (61): n=a or t
ctacagtttgactttatccacactctgcttcctagcatcgataggaaatggaactagaaangacaaattgctaccaagaaaagattactttttcgtaagactttctgtacttggtggtaga

SEQ ID NO: 41284 - DNA, 121 bp, Artificial Sequence
  Synthesized
  misc_feature (61): n=a or t
aaaagttatgatgtgtgcacttcttacactgatcacttgaggccagtggtctttttaaggntaaaacttacaattcacagaaagaaatacgtagaactctacctaatgtttcagcacagta

SEQ ID NO: 41285 - DNA, 121 bp, Artificial Sequence
  Synthesized
  misc_feature (61): n=t or c
tatacccttccacagaatcacttaatttcttttcctactgaagggcctacaagtgtttgtngctcggtctgctggcttccaggggcctgctatctgcgctaatggtactgagtgtttgtgc

SEQ ID NO: 41286 - DNA, 121 bp, Artificial Sequence
  Synthesized
  misc_feature (61): n=t or c
caaatacgtaattctgtagtggaatttaagttgcattgttttagtacaataaatatatggngttttcaaaaatatttgtgtttctctacagagaaagcttttgaagctctttcacctttga

SEQ ID NO: 41287 - DNA, 121 bp, Artificial Sequence
  Synthesized
  misc_feature (61): n=a or g
cccagtatctgggagaaccacaagcaaaggtaactggctacacgaatcacacattctcttnctcgaaaaatacaactgcatatgtgtttgagcctccacatttaagtaattgaggtaaata

SEQ ID NO: 41288 - DNA, 121 bp, Artificial Sequence
  Synthesized
  misc_feature (61): n=t or c
atcaacttcccagcatcaagccatgtgcttgaggcacgtcagcagaagacctggaggaccngtgcagccagccacatccctcctgcagaaccacaacctgcagaaccattcaggacgtaac

SEQ ID NO: 41289 - DNA, 121 bp, Artificial Sequence
  Synthesized
  misc_feature (61): n=a or g
attactaagatggaggcgagattttccactgtgggaatagtagtggtaacaactgtagggngaattgaatcagggcactgacctcccaagaacatttggaaagtctttccaagaggttttg

SEQ ID NO: 41290 - DNA, 121 bp, Artificial Sequence
  Synthesized
  misc_feature (61): n=t or c
tagccacgggaaaagcacgttccttcagggtaaagccttctgtgtttgagaaaagtaaggncactggatcattggtgacccactggtgttaaaagcatggtttcagcatgtcattaggaat

SEQ ID NO: 41291 - DNA, 121 bp, Artificial Sequence
  Synthesized
  misc_feature (61): n=a or c
ttgttctgtattttccacagtgtaatcattgtcagttgagagatcaaactgaaatgatatntagtccagaagatgggtgtttcaagaaaagaatttcaatcaaagctttgcaaagcaaagt

SEQ ID NO: 41292 - DNA, 121 bp, Artificial Sequence
  Synthesized
  misc_feature (61): n=a or t
tgggtaagatgtctttcattttctttcaaagaaataagcatgttcttctcacttctgtctnttctacagcacagttctgtattactcaactttgttccttcccatttcctattctgttttt

SEQ ID NO: 41293 - DNA, 121 bp, Artificial Sequence
  Synthesized
  misc_feature (61): n=t or c
gtccctgactcccccatccacatagagaaaccatatttttcttctgttcccaaggatttgntggtaattgaagacagtggtggaatgaaataaggggcacgcacgggattcattccaacag

SEQ ID NO: 41294 - DNA, 121 bp, Artificial Sequence
  Synthesized
  misc_feature (61): n=t or c
ggtgcagagctgtggagaaaagcatgttggaggtgagtttgtggtcctgcagctcattccnaggacctctgcttcccatcccagggacagactaaccctctgcagctccatgcgggggctg

SEQ ID NO: 41295 - DNA, 121 bp, Artificial Sequence
  Synthesized
  misc_feature (61): n=a or g
cactgtgtgtgtgtcccaaatgcacctgaagtcctctgccgtcgctcccaaaaggccgtanctctgaatgttgggtgctgatggtgctgtgctcgggccggctccatatcagcgtggaccc

SEQ ID NO: 41296 - DNA, 121 bp, Artificial Sequence
  Synthesized
  misc_feature (61): n=a or g
gtcatactgggtaatgctaggcagttcattacaataccttggggctaagtttgggaaccantaatgatccacataacagtcttagcaactttaattgataattctctgtttatgtggaaac

SEQ ID NO: 41297 - DNA, 121 bp, Artificial Sequence
  Synthesized
  misc_feature (61): n=a or c
gcaggtaggggtatggggctgccagcatgccgacatggctgggcaccagcagctggacccnctgtgcttcaaagatggttctgtctggggatccatagcaggggacagagccagaggtcat

SEQ ID NO: 41298 - DNA, 121 bp, Artificial Sequence
  Synthesized
  misc_feature (61): n=t or c
gcacaaggcagcctgcaaagtctgcttccaacacaaacaaggccagcaccttcaggagcangacaggaagaagataaatcataaggatccaaattcttcatctgagctctgaggaatactc

SEQ ID NO: 41299 - DNA, 121 bp, Artificial Sequence
  Synthesized
  misc_feature (61): n=c or g
cagtatttctcctttaagaactcatattttatattacatcatttattagaatcagctggantgtctgatctggacaccggcaattgctcaacagtagccacagtaaaaacttaatttgtac

SEQ ID NO: 41300 - DNA, 121 bp, Artificial Sequence
  Synthesized
  misc_feature (61): n=a or c
tggtacaagatgtgctgttttgagggaattctggctgcagctctgcttcaggtgtgcacanacctgaaatgagtgctgtaatgaggtaaaggctgacacaacaaatcccagaactcagagt

SEQ ID NO: 41301 - DNA, 121 bp, Artificial Sequence
  Synthesized
  misc_feature (61): n=t or c
cacagggacccctatggcatcgggatccccacaacacagaaattctatgtcacaagactcnatggcatgggaaccccacggcatggccacattacagcacagggacccacatggcatgggg

SEQ ID NO: 41302 - DNA, 121 bp, Artificial Sequence
  Synthesized
  misc_feature (61): n=t or c
actggttgccacgcggggagcaggcacagtcataataactcggagtcaataattcataaantataatgcattattaatcaattatcgggacctgaattacatttaatgagattacactgat

SEQ ID NO: 41303 - DNA, 121 bp, Artificial Sequence
  Synthesized
  misc_feature (61): n=a or g
tgccaaccacaaaacttttcttcgggttcaagtacatcctgaataccacaatggtaacctnataggcaaagtatgtatcattttaaatctgttttctcttaataaatatgccatcttcttc

SEQ ID NO: 41304 - DNA, 121 bp, Artificial Sequence
  Synthesized
  misc_feature (61): n=a or g
gtcaccaggcctcctaaactgagccgagaggcagctgggcttcagggctgctgcgcaaccnaagctcatacacagcagcacccaggggatcataatctccctgtttggaggggaaaatact

SEQ ID NO: 41305 - DNA, 121 bp, Artificial Sequence
  Synthesized
  misc_feature (61): n=t or c
gtaaagaaactctctcctaatggaatcttccataggcacaaaatcagctccagaaaaagantgaccttagaaattaattttactaaaataagctagcattggctagaggctattttttttc

SEQ ID NO: 41306 - DNA, 121 bp, Artificial Sequence
  Synthesized
  misc_feature (61): n=t or c
cactcatgcagatcactgtcctgttaaggttattctgatatattccctttatgtgattctntctctgaagatcaggcccttcacccaagtctacaaggctgaagaactgcctgctgctcca

SEQ ID NO: 41307 - DNA, 121 bp, Artificial Sequence
  Synthesized
  misc_feature (61): n=t or c
taaaaataaagcaaaggaaaaggtttaataattttcaaagtctgaattgaattcataatcnttctttgaatttttggagccaagtaatccaggcaatattttaactccctgatatacatga

SEQ ID NO: 41308 - DNA, 121 bp, Artificial Sequence
  Synthesized
  misc_feature (61): n=t or c
tgtggggtgggtgccgaccccactctgagtcggggaggggcggccccagagaacaccaaangaacgtccatcattctcacaccgaactgacaggaaaataaaactctctttgcggccccag

SEQ ID NO: 41309 - DNA, 121 bp, Artificial Sequence
  Synthesized
  misc_feature (61): n=t or c
gctggcagccagagaaatactgaaaattgctcaatcaacataattcacgaagctttgtggngggtctgtggctccatgggctggtatgggagcaccaggtcagaaagagctgtgcaaacct

SEQ ID NO: 41310 - DNA, 121 bp, Artificial Sequence
  Synthesized
  misc_feature (61): n=a or g
ttgtgtttagttttccctttgtaaagaaaaaagaaaaaagtatagttgtcactttacggtngtgtttgtgggctgtggtgtggtgttattgattagtgcctgtaattctcgggcaggaggc

SEQ ID NO: 41311 - DNA, 121 bp, Artificial Sequence
  Synthesized
  misc_feature (61): n=a or g
gtgtcattggaggactgggagcatcagttgggctcttcctctgcataaatgtggctgatcnagggttttccaagggaaaaagactcttgcatgtgcctgctacctagtttaaagctgaccc

SEQ ID NO: 41312 - DNA, 121 bp, Artificial Sequence
  Synthesized
  misc_feature (61): n=a or g
actttttgccataagaaaccacaacagatttttatcagacatgaatgcagacttaaaaacngcaccaaagaaacgcaaaaaaacaaaagggtccctatggacactcctgtgtaggctctat

SEQ ID NO: 41313 - DNA, 121 bp, Artificial Sequence
  Synthesized
  misc_feature (61): n=a or g
gtttctgtcagggacaccaacgctgaataaaataggagtctttaaaaataatgttgcaacnaagagcatagaagtaccctcaaggggagcaactgacacatgcgataaccctctttgcttt

SEQ ID NO: 41314 - DNA, 121 bp, Artificial Sequence
  Synthesized
  misc_feature (61): n=t or g
aggcacagagagccctggggattcggcaccctcttctagccatacaactttgacagcaggnaaatttgagatgaatgtatttgatagaatagagcctgtacatcatctccattaaaatctg

SEQ ID NO: 41315 - DNA, 121 bp, Artificial Sequence
  Synthesized
  misc_feature (61): n=a or t
tcaagttcccctgctgccatgcagaactctgtaatctgctctcttccctaatgtcaatttntcctggtgtctgccaggaacatttgctatctgtgtgacatcatggcttttcaagtgtttc

SEQ ID NO: 41316 - DNA, 121 bp, Artificial Sequence
  Synthesized
  misc_feature (61): n=t or c
tgatacaagttttgatgcaacacgagagtctttgtaagtgcagattttgatgagaactccnctaaaatctctagtaattttgttttattgttgctgttgtgaattggctccttgctttctg

SEQ ID NO: 41317 - DNA, 121 bp, Artificial Sequence
  Synthesized
  misc_feature (61): n=t or c
caccgtggggtgtttctttctaaattacctttgtagaactgagacttgtaaggcttgtgantttgagaaggctgctgtcagtctgtctgctgtgtacgctgacctcagagctgctgcacca

SEQ ID NO: 41318 - DNA, 121 bp, Artificial Sequence
  Synthesized
  misc_feature (61): n=c or g
ctcctgcttctaagggaaggatcagaaatcgaatttatctgtttatatgctgaaagaacanccctcccaggagctgaagcttcctcctcaaagaatgttttccttcactctcttttgttgc

SEQ ID NO: 41319 - DNA, 121 bp, Artificial Sequence
  Synthesized
  misc_feature (61): n=a or g
tgctaggctgcttgcttctcatgctttcctccttctatcctctggtttatgaaattaaacntaggcttcagaaaaatacatcaacagaaaaataaccatgaagtattcatgggctgtttaa

SEQ ID NO: 41320 - DNA, 121 bp, Artificial Sequence
  Synthesized
  misc_feature (61): n=a or g
tcctacattcttacctagtttctgtcagtgtatttattgttgggaataatatatcaaagcntacaattaacaatgtcaaaaatagagtaagattaggggttgatcttcctccgtggattga

SEQ ID NO: 41321 - DNA, 121 bp, Artificial Sequence
  Synthesized
  misc_feature (61): n=a or g
agacaaggaaaggaagagaaagatggcaccttttattccttatgaatttcagctaccaganttagacatctgcgttaacctgaagcaggctttaaatgctgggcaagtcagctgatggttg

SEQ ID NO: 41322 - DNA, 121 bp, Artificial Sequence
  Synthesized
  misc_feature (61): n=t or c
ttaaatgtcaatcaccttgaatttctcatcaaatacaaattcctttttttctggccaggtngtggtatattatttcatgtgcaggcaaaaatgaaagaaaaagtaaccccataaatcaagg

SEQ ID NO: 41323 - DNA, 121 bp, Artificial Sequence
  Synthesized
  misc_feature (61): n=t or c
aatcttaaaagcgcagcacatgatcccacctgcaaaatgtgaaaggaataaaaacgctgangagactgagagtttggaaatacctgactggttttctttgttattttcttggaagaaaaaa

SEQ ID NO: 41324 - DNA, 121 bp, Artificial Sequence
  Synthesized
  misc_feature (61): n=a or g
agcaatgttcaagcagtaatatagtgtatttttcaatacatccattcaataattctaagtntatatgagctgtttcaaaagaaaacaaaccccattcccaatgaaaaaaattcaaaatcaa

SEQ ID NO: 41325 - DNA, 121 bp, Artificial Sequence
  Synthesized
  misc_feature (61): n=t or c
caactagtttaatttgctctgttttccacttcagtaccacctcaggctgtttcttggcttnccttacgagatttagcaaagtcagcctcattattagtgataagggagacctcaaagtaaa

SEQ ID NO: 41326 - DNA, 121 bp, Artificial Sequence
  Synthesized
  misc_feature (61): n=a or c
ttgcattaatcagatcaaagtagtcattatgatgctaaatgactatgtgttatcagcaaanaaggcatgggcggtatgattgcactcagtgctcccagctgctaacaagacagaggagccg

SEQ ID NO: 41327 - DNA, 121 bp, Artificial Sequence
  Synthesized
  misc_feature (61): n=t or c
aaagtaagttgttccaaacaatggcagctacaggtctgtgctagcacaagccagaaagtgnatttcttcccctccacccccgaccctctcctttactttcttgaatttttaaaccctgcaa

SEQ ID NO: 41328 - DNA, 121 bp, Artificial Sequence
  Synthesized
  misc_feature (61): n=t or c
atgacatatctacatgatttactctgaagatcttggacagttttcaggtgggggcttccantgcctgaaatgtgcagagcaatggtatttccactgtaaattgggttcattcttcaggcca

SEQ ID NO: 41329 - DNA, 121 bp, Artificial Sequence
  Synthesized
  misc_feature (61): n=a or c
atctttggcttaggtttccccatctgttaaatacggattaagaaactttctctgcctcccngcagggtgtaaaagctaatcagtttgttaaaaaagctaaatccgttggttgtttggctgc

SEQ ID NO: 41330 - DNA, 121 bp, Artificial Sequence
  Synthesized
  misc_feature (61): n=a or t
tcatagggaataaatgatacatgggaaaaagcattatgaacatatatttgatttatattanttataagttagctcaaggccatcaccacaaagagataatagaacttccattttttgtaca

SEQ ID NO: 41331 - DNA, 121 bp, Artificial Sequence
  Synthesized
  misc_feature (61): n=t or c
ggttactgagacgttttggtcagatattttggttcttccaaaatatacattaatcactacntgggaactattactgataccatacatttatgcttaaacaatgctcccaggatttcttcca

SEQ ID NO: 41332 - DNA, 121 bp, Artificial Sequence
  Synthesized
  misc_feature (61): n=a or g
ggcctcagtgccccttggtccaatttccctggctgaggggacaccatgacttctacgaacntgaaatctgagcagcttggtgactcatttgcccctttccatctatcccttattagcattc

SEQ ID NO: 41333 - DNA, 121 bp, Artificial Sequence
  Synthesized
  misc_feature (61): n=a or g
caaggaaaataaatacatttagatgattttagggcctcttatattgtcacatcagttatcnaattcaatttccaaacatttgctcactcgtaactatatctgttttctaaaatcacttcac

SEQ ID NO: 41334 - DNA, 121 bp, Artificial Sequence
  Synthesized
  misc_feature (61): n=a or g
gattgagggtatttgagcaggaaccaggtgaagctcagggcatgggtctcagctcagatgnatcctgactgatgtcttcacaggctgagaaatcaaggtgattacagccctaaaaaaaaaa

SEQ ID NO: 41335 - DNA, 121 bp, Artificial Sequence
  Synthesized
  misc_feature (61): n=a or g
tgtgcctgggaattatgtttgaaatggccactgctaatatttgttatcctgagctgtttcncactcaatgagcatgcttttctgatgtacagcaatacacagaatagctactgacttcaac

SEQ ID NO: 41336 - DNA, 121 bp, Artificial Sequence
  Synthesized
  misc_feature (61): n=t or c
ctactatctgtttctgtaacagaaacaagctccctaaaacacatttagctctgatggaganagatagttttctgcattttttctgctttttacaccagtctcaatagtaacattgtactgg

SEQ ID NO: 41337 - DNA, 121 bp, Artificial Sequence
  Synthesized
  misc_feature (61): n=t or g
ctgtcctccaactgtctcggagcacattcctttccttgcaaaatggagctcccttctttgncatcaatggcaaacttggcaagaggcaggttagatttctttttatattaagttttgactg

SEQ ID NO: 41338 - DNA, 121 bp, Artificial Sequence
  Synthesized
  misc_feature (61): n=a or c
agctcacccaagtcaagcacaaatgcatacacttctgaaaggcaatcctggcttctctganaccaaggacaaaaatttcatcagcttcaacagggtgtgaatttttctcagtcgttggtgg

SEQ ID NO: 41339 - DNA, 121 bp, Artificial Sequence
  Synthesized
  misc_feature (61): n=a or g
gagtaggaatgtttctaaaactgtagagtacttactatgaaacggctattatatatatatntatactaagtgttttggcacaagcattggtacagttctactgaattgggatgaataatct

SEQ ID NO: 41340 - DNA, 121 bp, Artificial Sequence
  Synthesized
  misc_feature (61): n=a or g
ctgactgaactcaccatggaatccatcttacagcatttttgacagaatttactgtcacacngaccttcccctaaattcactcaaaacaaggaagagagctgtaaagcagtaattgttaaga

SEQ ID NO: 41341 - DNA, 121 bp, Artificial Sequence
  Synthesized
  misc_feature (61): n=t or c
actgtgcaatctgttgactgatggctgtcatcttggtccatatttcatggatggaacagantgggatcttaaagcacagaatattatgacttcatttaaaaatcaaaagctacctaaggct

SEQ ID NO: 41342 - DNA, 121 bp, Artificial Sequence
  Synthesized
  misc_feature (61): n=t or c
tgggaaatgagaaaatctggcagacttgttttgtttgaaattaacgtcactgaaacaaagnaaaaagaagcaaatacaaggaagcaaacattattgcccatagtcctcatcttcaaaacac

SEQ ID NO: 41343 - DNA, 121 bp, Artificial Sequence
  Synthesized
  misc_feature (61): n=a or c
cccccatggccttgcttggaggcaccttcgagctcctcaccagtgcctttgcatagatgtngttgcttttcctgcagggtggcggttagagagctggatctgacagccgggtgtctgaaga

SEQ ID NO: 41344 - DNA, 121 bp, Artificial Sequence
  Synthesized
  misc_feature (61): n=a or g
tttcctaatagattttctctgtcccataagaaaattaaaccagagcaatcctcattttctntgtgttacgagtgatagattagaccagcagaaagattcccctgggcttggaatccaagaa

SEQ ID NO: 41345 - DNA, 121 bp, Artificial Sequence
  Synthesized
  misc_feature (61): n=t or c
agtatggaaagggtgtgaaggacagagaaatctttgtagcaaagctacattacctactttntacttcagtgctttgttctgttactcttgcctgtgctacaggttatttttcccctgacag

SEQ ID NO: 41346 - DNA, 121 bp, Artificial Sequence
  Synthesized
  misc_feature (61): n=a or t
caagagtcctgtggtaattctgtccttgggtgagaattgtcttcactttctttgatttccnacatgcatttgaaatttggaaacactttaaggaagagactgtgtctcttattagtagtgc

SEQ ID NO: 41347 - DNA, 121 bp, Artificial Sequence
  Synthesized
  misc_feature (61): n=a or c
ctgaaagtttcaacagcataaactatttttgctgtcactacacagaacatcccatcctgcnaactcccaaactctgctatgctgaagaaagccagggcaggcaagatagagcaaatatata

SEQ ID NO: 41348 - DNA, 121 bp, Artificial Sequence
  Synthesized
  misc_feature (61): n=a or g
gtgtcagcaaggatccacagacaacactcacgtttgtgcaattccattatacaaacaggcnctgcgctgcaattaagctttgagtaaagcccaggtaccacacaccactcagcacattcag

SEQ ID NO: 41349 - DNA, 121 bp, Artificial Sequence
  Synthesized
  misc_feature (61): n=t or c
ggcatcaagcaagcaagaaaaaaaaaggctatttaatttgcatgggagttttccacctctnctgaacaggtccacccatctctatatttttcctctttaaatgttaaagcatctgaacatt

SEQ ID NO: 41350 - DNA, 121 bp, Artificial Sequence
  Synthesized
  misc_feature (61): n=a or t
ttgatttaagacccaatagcaaggttttttcttatattaacatcttatctaggtgttacanccagctagaacgtgtaaagatttggtttagcatgaaaataaacagggcgactttataatc

SEQ ID NO: 41351 - DNA, 121 bp, Artificial Sequence
  Synthesized
  misc_feature (61): n=a or t
tttatgtcactgcaggctcaagaacatttctatagggaatactctgaactcagactgacangatgagcctcgattttgttacaaaaagttaaaaactgttctatgccaaattctaattcta

SEQ ID NO: 41352 - DNA, 121 bp, Artificial Sequence
  Synthesized
  misc_feature (61): n=a or g
taattgcgtcttacaagatagaagtgagagaaattggcagatatttctgaaatgtgtcgtnatacgtaaacaaaaatttccaatgtagatattcccaaaaagacaacatggtggtttgggt

SEQ ID NO: 41353 - DNA, 121 bp, Artificial Sequence
  Synthesized
  misc_feature (61): n=t or g
ccctgctattttttatttaatttcttagagaagtgtttgtaaagtctgagcagctgaaatnttcacgccgagctgtaccttttacagccaaatagagcacatacagatatcagaagtcttg

SEQ ID NO: 41354 - DNA, 121 bp, Artificial Sequence
  Synthesized
  misc_feature (61): n=t or c
aactgggcaaagagaaaggtaagcagggatgctcagtgcacccatttcatattaaacaaantggcagcttggatgggtttgtgcgagttccaaagcaataaattgcaagctgcctggttcc

SEQ ID NO: 41355 - DNA, 121 bp, Artificial Sequence
  Synthesized
  misc_feature (61): n=c or g
gattattttataattgtcatctgatatagatcaatcataacaaaagctaatgaccaattanttacatgaatctagccacagatacagggcaaatgaaaaaggaaataactggttggaaaaa

SEQ ID NO: 41356 - DNA, 121 bp, Artificial Sequence
  Synthesized
  misc_feature (61): n=t or c
cacctgcattacgttgatgctagttgtacatgattatagttcttaacactatgcagcaacntcaaggtacttcaaaaaacacattttttccccctccccctccaattactaatcatatgaa

SEQ ID NO: 41357 - DNA, 121 bp, Artificial Sequence
  Synthesized
  misc_feature (61): n=a or c
tgaactagcagtcatgtggctttaagttttttttcctgtaaaatactagtccttgctttgnctggtggccacatggcaattggcactgtaagaacagatgagggctgagctagtgtcagat

SEQ ID NO: 41358 - DNA, 121 bp, Artificial Sequence
  Synthesized
  misc_feature (61): n=a or g
ggtctggaggggttaggggagaggagacggggacagagagggttgagagctcctggcatcntgttggctgaagagcagctctagacctgtgtgtactgaggtgggaaaggaaggcatcagc

SEQ ID NO: 41359 - DNA, 121 bp, Artificial Sequence
  Synthesized
  misc_feature (61): n=a or g
ctcacccacagcgacctaaaaactccatgctatcaatgtctttagtacagtttatctcagncctatgaagacaccctaatgaaagcatataatacatgcagaactctatatttggctacct

SEQ ID NO: 41360 - DNA, 121 bp, Artificial Sequence
  Synthesized
  misc_feature (61): n=t or g
gctgtgagaaagtgaggcggtaggttcagaaacacctttcagctccatattaaagattagntggaaggtactggtgaaggcaaagcaatagaaactttccttatcaattagttttgtgttt

SEQ ID NO: 41361 - DNA, 121 bp, Artificial Sequence
  Synthesized
  misc_feature (61): n=a or g
tacctgtgtgcacactctgtgggttttgtttcttaaagggagcatcatatgacagccccancaccactgatctttctggcagactgatccctcttccttcctgaacttgataaacagtcca

SEQ ID NO: 41362 - DNA, 121 bp, Artificial Sequence
  Synthesized
  misc_feature (61): n=a or g
cctaataatcagcatgctacactaaacttgctgaagtctggaaaacagttatgaaaatganctcatatttttcctctcaaggtttctagggcttttcttattctaagtgtgcagatattac

SEQ ID NO: 41363 - DNA, 121 bp, Artificial Sequence
  Synthesized
  misc_feature (61): n=t or c
gtcctctgtattttgttttgaatgcttaatattattagaatacaattgcataaattaaaantatatgcaactccatatgtgtcctggagattttttttttctcctaatagtggtaacttct

SEQ ID NO: 41364 - DNA, 121 bp, Artificial Sequence
  Synthesized
  misc_feature (61): n=t or c
caacagactttttgctttgcacttctgtggcagtgacacaaccaaaacgtctgcctgaganctcagcaccatcgagaagcatttctcataaaatctttaagtttctgctgttccgacccaa

SEQ ID NO: 41365 - DNA, 121 bp, Artificial Sequence
  Synthesized
  misc_feature (61): n=a or t
acattgcagaataagcttgcattttaaacagataaagtccaacttcaagattaaaaaaaantatgaaaacatgctagcatttctgcttccatcttgtttatatggcgacaagtccaaaaac

SEQ ID NO: 41366 - DNA, 121 bp, Artificial Sequence
  Synthesized
  misc_feature (61): n=a or t
ttatgatcaaacctacagcaactccataggtaaacaacaaagaacagtgctggtggaaacnggttcttcaaaatcaaaatagcaataaacagggtcacatctttacctttaaattaacact

SEQ ID NO: 41367 - DNA, 121 bp, Artificial Sequence
  Synthesized
  misc_feature (61): n=t or g
gaagtgcaaggtctgcagcactttccttcctctttcttcctcagctgaggcagcacagtgntttctgagctgggcaatggaccaggatgggttctgatatcaacataagaaataaggtgat

SEQ ID NO: 41368 - DNA, 121 bp, Artificial Sequence
  Synthesized
  misc_feature (61): n=a or c
aaagggattatatgctctgttatgagcaaactgaattcagaaaaacattggactgtttttntctggttggactgattacgctccatcgtatctagctctttactcaatagtttatggtttt

SEQ ID NO: 41369 - DNA, 121 bp, Artificial Sequence
  Synthesized
  misc_feature (61): n=a or g
gagatactgactgtaatcagaatcagacattaaggagatgatggcaatcacaatgaaatcnccacctgccattattttgtgaaagagactagctgaatcctccgaggaacaaaggaaagcc

SEQ ID NO: 41370 - DNA, 121 bp, Artificial Sequence
  Synthesized
  misc_feature (61): n=t or c
gttcactcttctgaatggaaggaagtgtttaaaactgaaaagtggtggtcatttttataantttgtgaacttgcagtgaaagtttgagttatgagtaatacatcttaagttggatttctca

SEQ ID NO: 41371 - DNA, 121 bp, Artificial Sequence
  Synthesized
  misc_feature (61): n=a or g
tggcttttatccgcgggatatgcaaagcgcatttatttcgtcttttatctctcatattgcncgttgatcccatacatatagattgattttgttcaggtagataatgaaaagtcaagtggaa

SEQ ID NO: 41372 - DNA, 121 bp, Artificial Sequence
  Synthesized
  misc_feature (61): n=a or t
ctagaagctgaattacactttgctaattgatgaccagaagacaaaagaatgctaaaaagcntaagccttcatcagtgggtaaagatgaaagtcctacatttgcaaaaaggcactatctagc

SEQ ID NO: 41373 - DNA, 121 bp, Artificial Sequence
  Synthesized
  misc_feature (61): n=t or c
gatttcatccttctggatgaggagcagtcttcgtatgcctcttcggctctggttttcctcnctcgttttcccctttaaggagaggggggaaatcggaaaggatccaaaaggacaggaaaaa

SEQ ID NO: 41374 - DNA, 121 bp, Artificial Sequence
  Synthesized
  misc_feature (61): n=a or g
aaatcccaaacagaataacaacaaaacaaacaaagaaccccaaagctgaataatcagtggncaaaaagcctttttctgcctcacactggagatcagatacttttagtcatatgcttatttt

SEQ ID NO: 41375 - DNA, 121 bp, Artificial Sequence
  Synthesized
  misc_feature (61): n=t or c
tactgaagtttttcagactatgctatatgaaatatatgaaacatactatactaaactaccnctttgtaggctgattctcctagattatcaaaataagggaaagtgaaatcaagaagtgtta

SEQ ID NO: 41376 - DNA, 121 bp, Artificial Sequence
  Synthesized
  misc_feature (61): n=a or c
atttatttataacttttgaacacccaacttggccaggtggaaaaaccttgcatcagagcanagctgacgatggtgatgggtgtctgcttgttgtacgttaaatgggaggaaaggggaaaga

SEQ ID NO: 41377 - DNA, 121 bp, Artificial Sequence
  Synthesized
  misc_feature (61): n=a or g
tgaatctgccagaagttcatggccaaatgtctcatgtgaccgcatttcctgttgtccctgngaccggagtgctgtgctgccacgaagcagagcattcatctgttgaggacagaggagcctc

SEQ ID NO: 41378 - DNA, 121 bp, Artificial Sequence
  Synthesized
  misc_feature (61): n=a or g
cctctgcagccctcaccatcttcatcaagccctttgaacttcatgttatttatttcccacncaggtattctgtaaaagatgtctgaatactttaagcatgaatttatcctgtgtcaagaca

SEQ ID NO: 41379 - DNA, 121 bp, Artificial Sequence
  Synthesized
  misc_feature (61): n=a or t
tgtttgttctcatacaatattcagtaagaccatgcttccacctgctcttcagtaaaaaaanattctgaattttctgaaatgaaaaccaatcttctattaccatgtataacaatagtaacta

SEQ ID NO: 41380 - DNA, 121 bp, Artificial Sequence
  Synthesized
  misc_feature (61): n=a or t
gtaagtgcacagcataagccatttaccttaccagaaacaacatgcagtacattagacctgnacaacaaccttaaccttttcatgactcacaacacaaagcccacttacatttgttctccgt

SEQ ID NO: 41381 - DNA, 121 bp, Artificial Sequence
  Synthesized
  misc_feature (61): n=c or g
aagttgactttgaagatgaactcttctgtggttgcctttcctgcttgttatcaggattttntagcccattcaaagggtgccatcaaagatatatctatagagatgtaaagcagcatgagct

SEQ ID NO: 41382 - DNA, 121 bp, Artificial Sequence
  Synthesized
  misc_feature (61): n=a or g
ttttactattaatctatgtttttattcctaattgcatgctgccaaaacacagaatagatgnaagattgaaatatgtgttttggattgaagtatgaattctgaagaacacggctagttcaaa

SEQ ID NO: 41383 - DNA, 121 bp, Artificial Sequence
  Synthesized
  misc_feature (61): n=a or g
gaattggtttaagttatcaactacaaaagcaatagcttagagttgtcatgctttagtgaanaccctgtcttattataggacaggataactgggcttaaaaacttggtttatgcttgtggga

SEQ ID NO: 41384 - DNA, 121 bp, Artificial Sequence
  Synthesized
  misc_feature (61): n=t or c
gtaatctcagagaagctacctgctggaaacagtaaaatgggtgtgtgtgcaataacagggncatttagttggacatttgccagcagtttgctacacaggtgcatcttcctgaatgtgtgag

SEQ ID NO: 41385 - DNA, 121 bp, Artificial Sequence
  Synthesized
  misc_feature (61): n=t or c
ttcaaagcaaatgattaacagcgaagatatcaacagcaatacctaatacctcccacctaanaatttgacagctcacataaggcttatgcctgagaaataggtattgctagatgttttcaaa

SEQ ID NO: 41386 - DNA, 121 bp, Artificial Sequence
  Synthesized
  misc_feature (61): n=c or g
tcaatttcaagcctgctggtgggcgatgtttcacagtgtccttttcccctgtttgtacagntgggaggtggaaggcttaggaacctgtcttgaggtcatgccaagctctgcagtgaagccc

SEQ ID NO: 41387 - DNA, 121 bp, Artificial Sequence
  Synthesized
  misc_feature (61): n=a or g
gtacttccagtataactgagtgatgcttatttttaatacattttccaaggtttccatagcntcaatttgcataaacatttatatatatgttaaggctgaatggtaatccagtacgcttgtt

SEQ ID NO: 41388 - DNA, 121 bp, Artificial Sequence
  Synthesized
  misc_feature (61): n=t or g
atgctggccaaggcaggaaacacatgaccatctactagtcattgctcgagatgcctgcaangacaagttcatttgctgctgttcctgctctgatctttgtttgaaagtagtatttctccaa

SEQ ID NO: 41389 - DNA, 121 bp, Artificial Sequence
  Synthesized
  misc_feature (61): n=t or c
ttactcagacgattttagggagctgctttgcctccctccctttgctttgttccagtggtcngaagtttctccataccaccctctgtaacagagacacggtgcagtatttggctgtggtttt

SEQ ID NO: 41390 - DNA, 121 bp, Artificial Sequence
  Synthesized
  misc_feature (61): n=a or g
aagtacgataattcaaggggagaacactcctttttcatacggtcatgtggttgaatttccnttttcaggtgcaaataaggcaactttaactacagaactgcaaatacaacaatgggtttat

SEQ ID NO: 41391 - DNA, 121 bp, Artificial Sequence
  Synthesized
  misc_feature (61): n=t or c
gttctggggtgtgcctcttgtgataaggaattcagagcagctgggtattctgtaactgccnaatgcccctctgtcatcatcctaaatgagcagttcctgagatgttggtggagttctactg

SEQ ID NO: 41392 - DNA, 121 bp, Artificial Sequence
  Synthesized
  misc_feature (61): n=a or t
aatttggaacctctaggcaaggactgtaaagctgtgtagtcacaacactgaatatctgtcnaagttactacagtctttggctgagaaatgaaaaaggctgggatgtgtgatcattgttttc

SEQ ID NO: 41393 - DNA, 121 bp, Artificial Sequence
  Synthesized
  misc_feature (61): n=t or c
gtctgaccctgcatgtctcgagctgcctcccttcagccctcctgtttcctttatagggccnacattgcatatgtgccctgggaagattgtggtgcttggggcgatcaaccccttcacagag

SEQ ID NO: 41394 - DNA, 121 bp, Artificial Sequence
  Synthesized
  misc_feature (61): n=c or g
gcatttcttggttgaacgacaggctgcagcccgggcttctgccttatcagccatcaaagantccacatcggggcagaggatttagaaaaacccatttgagctgcaggaaacgatgtgattg

SEQ ID NO: 41395 - DNA, 121 bp, Artificial Sequence
  Synthesized
  misc_feature (61): n=c or g
cacatacaaaaacatcatgagagaacatccttccagcctggactaaaatatacacgatcgncgctcatgaagcaaataacattgggaaagaaaaaaaactgaggaaaacagtaggaatttt

SEQ ID NO: 41396 - DNA, 121 bp, Artificial Sequence
  Synthesized
  misc_feature (61): n=a or g
aaggacaaaatattggacagaccttccccaggttgggtgaatcagtcggccactgcgagcnctggttggaagccattcagtcagcatgcacaaccagctctcgttgctccctccccacccc

SEQ ID NO: 41397 - DNA, 121 bp, Artificial Sequence
  Synthesized
  misc_feature (61): n=a or g
aatggaacagtaaactttacattcccaactgtggtacaaaagataagatgctctctccagnccagcgtgaacattttccttctagcgttagtgtcattagccaactgagctattgaaaata

SEQ ID NO: 41398 - DNA, 121 bp, Artificial Sequence
  Synthesized
  misc_feature (61): n=a or g
aaattagtggaggaaatgaacagaattgctttactgtaaaacaacaagctgctgacagacntgagttccttataggccttgttactgtctgagtgctgaatcacacctcttacaccgttat

SEQ ID NO: 41399 - DNA, 121 bp, Artificial Sequence
  Synthesized
  misc_feature (61): n=t or g
tcactattggctttgcttgctttcactgaatacctttttaagtcactattttattttctangtattcagagtatcattgcatttgcttttagattcacttggggaactgcatggtgacatg

SEQ ID NO: 41400 - DNA, 121 bp, Artificial Sequence
  Synthesized
  misc_feature (61): n=t or c
gccagtaatgccaccagatttctttccagcgtgtttttctgcccacacacttaactgattnccacccagcctgggtggtaaagtttaagccctactaccaccatgccaaaataggcagctg

SEQ ID NO: 41401 - DNA, 121 bp, Artificial Sequence
  Synthesized
  misc_feature (61): n=t or c
cagaaatttcatctaattaaacttacagatttgccccttaagtttatgaagatcctcctanattaagatttacttgtttaagacagatcacatgtttagctgataatatccagcattactg

SEQ ID NO: 41402 - DNA, 121 bp, Artificial Sequence
  Synthesized
  misc_feature (61): n=t or c
gaagtgacgtggctgtagactgtctcatgtcacttaacctattcgagttaaaagcacacanaacaaagactgtggtttgtctttcttgagaaaacaaagactttgccccctgaacttagct

SEQ ID NO: 41403 - DNA, 121 bp, Artificial Sequence
  Synthesized
  misc_feature (61): n=t or c
caatgtgtgtgcaccaggaagagaagcacagaatcagggacagccaatccagttggtctgnagctgcaaaaatgtattcctacaaagtctgaagtacctgactaaaatctaccagagccat

SEQ ID NO: 41404 - DNA, 121 bp, Artificial Sequence
  Synthesized
  misc_feature (61): n=a or g
gcatggctgtacatgaagattatttgacttctagcaataaactgtaactcagcaatccacntgcccgaattcaggccaatgctggcagctgactggagcttaaggttggtgttttaacaag

SEQ ID NO: 41405 - DNA, 121 bp, Artificial Sequence
  Synthesized
  misc_feature (61): n=t or c
atcttgtggtctactgtaacacattatccattctctcacagcactccatgcttttttcttncttctaattaatgctgcatgaaaagaggtactttcttcacaaaggactaaaggctgctgc

SEQ ID NO: 41406 - DNA, 121 bp, Artificial Sequence
  Synthesized
  misc_feature (61): n=a or c
aaacataaccaacagcaaaagaaatacaacatgcagttactcaaagattaaaatctggcanagatgttacctgtactgataaaaaggaaaattgcagaagaattctcagaagtcaaaaggc

SEQ ID NO: 41407 - DNA, 121 bp, Artificial Sequence
  Synthesized
  misc_feature (61): n=a or t
gtttaagtattatatgaaccagacgactctccaattcttgtgaattctgttgatgaatacnttacactttaaagtttctgggccacattcaaccttttgttacaaaagaaagacctccaga

SEQ ID NO: 41408 - DNA, 121 bp, Artificial Sequence
  Synthesized
  misc_feature (61): n=t or c
cattccttccaaaacaattggaaataaatgctaaagggtaaaatacttcttgttgaagacntgttgcttttgcttagtgtatacgctatggattgatggctttcttgaacttgatatatca

SEQ ID NO: 41409 - DNA, 121 bp, Artificial Sequence
  Synthesized
  misc_feature (61): n=t or c
aaccttggtcttgatgaatgtgttcatccatctgcactgcagaagcagagataacctatcnttattatctgttatatattagcagtactgccacataagagttgaatcagaacttagccag

SEQ ID NO: 41410 - DNA, 121 bp, Artificial Sequence
  Synthesized
  misc_feature (61): n=a or g
actcttttcctacaaaaatagaaagaggcttgaaagacttccaaatttggaataggagtgngttttaagtggctatgaaaggctttctagagcagagggtagagacatggatctttcttac

SEQ ID NO: 41411 - DNA, 121 bp, Artificial Sequence
  Synthesized
  misc_feature (61): n=t or g
ctaaatatggctttaattatgacatcaatttgagatgcagtttaacctttctttggcattnatctgttacttgtgtctgcctgcaaaaacatagtcaaacccaacctggggaacatctcag

SEQ ID NO: 41412 - DNA, 121 bp, Artificial Sequence
  Synthesized
  misc_feature (61): n=t or c
cacccgctgccgtgttgttaaagctagacggacgtccacttccgtcccggctgctttctcngcgcttcgattggtcttatagaccgccgctcagcgcgcgaaaaccaataggaggcgacat

SEQ ID NO: 41413 - DNA, 121 bp, Artificial Sequence
  Synthesized
  misc_feature (61): n=a or g
acaaatgagttcatactatgctgggtgatgaattggctcgatggaagcgctcaaggggtanacgggctacatctggccatgaacagttaccagtggtgttctctggggctcagctctaggg

SEQ ID NO: 41414 - DNA, 121 bp, Artificial Sequence
  Synthesized
  misc_feature (61): n=t or c
gcactgctcctccagcagagctgactgcttgtgtcactgctcttggctgtaacaacgagcngatccaggtttaattagcaaaagtaggcagggttggtttggcagtgcaaacagttttacc

SEQ ID NO: 41415 - DNA, 121 bp, Artificial Sequence
  Synthesized
  misc_feature (61): n=a or g
agcggttggacatgataacattagggcttttccaacctagacagccctacaagggctctangaaggttgctacaacagctctacaaaggttctcaatcacccctggggaccagcagtgaca

SEQ ID NO: 41416 - DNA, 121 bp, Artificial Sequence
  Synthesized
  misc_feature (61): n=t or c
ctgattatagatggaacctgcacgagcagtttagtttttgcacctagagacagatgagaangagatacaaaataaggagatctgggaatctattgtcattctggcctaacgtggatgaaaa

SEQ ID NO: 41417 - DNA, 121 bp, Artificial Sequence
  Synthesized
  misc_feature (61): n=c or g
caaggaaaacacatcagagaatgcatactggaaatcttattgagacggtagtacacgacanagatgactttccaaccacatctggatatagagcatgaggaaactgtcccaggtcgcacct

SEQ ID NO: 41418 - DNA, 121 bp, Artificial Sequence
  Synthesized
  misc_feature (61): n=t or c
tctgaaagagcaactgcagactgtgatggtcatggaaagaatcagaacagggactgtgtgnggcacacagaaatcacatcccttctattgaactgggattcgctccagagagcctgtgcgt

SEQ ID NO: 41419 - DNA, 121 bp, Artificial Sequence
  Synthesized
  misc_feature (61): n=a or g
gtggaaagtttttgcactcttatttaatagagcaaatgtatgaaaagtgtaaaaatttganccactgtagctcttatctggtcacttaaaccagatagcagaagtgattactgtagtatgt

SEQ ID NO: 41420 - DNA, 121 bp, Artificial Sequence
  Synthesized
  misc_feature (61): n=t or c
tctcctgccagttatagtctctgatgcagatttttcattattccccactgaaggacattcngtaataaggaatttggtgttttttgcctcttttccctctttctgccagcagtagatctct

SEQ ID NO: 41421 - DNA, 121 bp, Artificial Sequence
  Synthesized
  misc_feature (61): n=a or g
cagagtccactaattcttaaaaagctctgtaaaatatggggaatgtgtcatctgtaagatnttttccacagaggtaacgctatcattttagaaatgcacttaccatttttaaagtggtgtg

SEQ ID NO: 41422 - DNA, 121 bp, Artificial Sequence
  Synthesized
  misc_feature (61): n=t or c
aaaatccaccaaggtacacttctaaaaattcaaaaatacatttttcatgtgagcatttacngattacatagtgttactatggaagtataccgttctattttgcttttcctttgagcgtaga

SEQ ID NO: 41423 - DNA, 121 bp, Artificial Sequence
  Synthesized
  misc_feature (61): n=c or g
ctgagtttatttttttcttaatcttactccctaatatcttacatgaggaatttctttccanagctgtagatcttgaaaatgggtgggaagcatttctcttggatgaagatgtatttttaag

SEQ ID NO: 41424 - DNA, 121 bp, Artificial Sequence
  Synthesized
  misc_feature (61): n=c or g
gggtgagcacgtggccagcctcattaaaagttgccccaaggccttcagtgcttatatcttncattcaaaatacagattcagcattaattcagacacagatcccccagtcattttgcacctc

SEQ ID NO: 41425 - DNA, 121 bp, Artificial Sequence
  Synthesized
  misc_feature (61): n=a or g
ggaagacagattgtgtaggatggcagcccatgctacaagaacagcctcttacatttgatcncagggcatcgggtgtggttcagcctccagctcaggactcggctcgctaacaaagatgtct

SEQ ID NO: 41426 - DNA, 121 bp, Artificial Sequence
  Synthesized
  misc_feature (61): n=t or c
tgcttactaaaatgaaatcagcaaattgctgtatgaagctgcctgtcacatggtgattgcnactaacataattaggagtgttataggatagtgtctgttgcatccaaaatatgaagagtaa

SEQ ID NO: 41427 - DNA, 121 bp, Artificial Sequence
  Synthesized
  misc_feature (61): n=t or c
ggttgtaaatactgagggagcaagtgaaaatggtcattgaaggaagtgtacttaatcttcngaacagtatatcctaaattgcagtcatggattgatttctgttcaggttctggcaaacgtg

SEQ ID NO: 41428 - DNA, 121 bp, Artificial Sequence
  Synthesized
  misc_feature (61): n=a or c
aaaattgagtcctgtttctgcaagcatgcatgttaaattttcgtatgtttttttgcatctnttaaatcctactgaaatcagtaaaaggtacctaaagctttgagaatcattgttttatatg

SEQ ID NO: 41429 - DNA, 121 bp, Artificial Sequence
  Synthesized
  misc_feature (61): n=a or g
aaagtgctgtatcaggatattgataggatcttagtggagtagcctctgctccaggcattcngtggtggatcaacagtcgtgtgttgatgctaatcaggtcatcagttatgactgtgaaaga

SEQ ID NO: 41430 - DNA, 121 bp, Artificial Sequence
  Synthesized
  misc_feature (61): n=t or c
atccaaccacctgggaaaaaagttgccatatagaaaaaacttgggtctaagtttctataanatggatatctgttcatctgcctgaaaattcagtatggatgacttaaatgcaatccaagag

SEQ ID NO: 41431 - DNA, 121 bp, Artificial Sequence
  Synthesized
  misc_feature (61): n=a or g
ctgagctgacttccatgtgaagcattcagcatttttcctgctgaagtggtgccactgtggnaaaataactcagagcagcaacagaaagtgttagaggagctggcatatgtgctaaagccat

SEQ ID NO: 41432 - DNA, 121 bp, Artificial Sequence
  Synthesized
  misc_feature (61): n=t or c
ccatacaaacatagtaaaaaaaaaaacacttcaccataatcatccatacctagctgcttgnaagtcaagcagctatctgacaagttttgcttatgtacctgtacctgttcctcaatgaata

SEQ ID NO: 41433 - DNA, 121 bp, Artificial Sequence
  Synthesized
  misc_feature (61): n=a or g
gactgagggcaagcacatcttcctttggacggagcaccattctttgcacggggctcctctncacagacaacataaccaccagaacagaaggaaccaagtcaggttcagacccactggtcgc

SEQ ID NO: 41434 - DNA, 121 bp, Artificial Sequence
  Synthesized
  misc_feature (61): n=t or g
ttttttattcttctgattaataagcagtgagaaaatgaaatgaaacgttcaaggagatttnttccagcgttcaaggagtttttccaacaggaagaatcaaaatggccaaatatcttggtag

SEQ ID NO: 41435 - DNA, 121 bp, Artificial Sequence
  Synthesized
  misc_feature (61): n=a or g
tcttcaagacttgccaacgtgacatctacctcatgttttctgtttttcttgattacagaangaaaaaggagcaaagatgactgaatacctataaaagaagagttgttgcaagaataagcat

SEQ ID NO: 41436 - DNA, 121 bp, Artificial Sequence
  Synthesized
  misc_feature (61): n=t or c
tcctgcctagctttcctgtgggcccctctttaggtactagaaggtctctataagatctccntggagccttctctagaaataatttacccaggtcttccagcaccactaagatttagctgga

SEQ ID NO: 41437 - DNA, 121 bp, Artificial Sequence
  Synthesized
  misc_feature (61): n=c or g
gaattcctgcacagatccgatgctggccgcaaccaaattgcagcttgattgatttacagcnctaacgagcatcttgcttctcgcttcctaatccttcagagggttaccacccactcgaaca

SEQ ID NO: 41438 - DNA, 121 bp, Artificial Sequence
  Synthesized
  misc_feature (61): n=t or c
tagagggaggatgcagaaataatttgaggctatcagtaagcacactgtttctaggaagcanctaggaacatcagagtggtagcgtcatgaaaagatgtcctcatgaaaagatgcgcctgga

SEQ ID NO: 41439 - DNA, 121 bp, Artificial Sequence
  Synthesized
  misc_feature (61): n=t or g
tgccaggcagagctgaacggctgtcaggagggacagcacctcagggtctttagagttctgntggttggggttcaaaaaggcaaaccccaaaccaaaagagctctcacacagtgtgaatttt

SEQ ID NO: 41440 - DNA, 121 bp, Artificial Sequence
  Synthesized
  misc_feature (61): n=a or t
gcataccagaactaggaccacatagaacgttaagtttatccccttaacacatgtatatggntttttacctaacatcgtaggcaaaaaccctgattaaggtaaagcatcatattactgcctg

SEQ ID NO: 41441 - DNA, 121 bp, Artificial Sequence
  Synthesized
  misc_feature (61): n=t or c
gtacttctggccttggtgatcattactgcagactgtgtcagaccaaagggattagggagangtgctaggaagcctggaggattcagtttagtgaaggaaaatttcagaaacagtggttctg

SEQ ID NO: 41442 - DNA, 121 bp, Artificial Sequence
  Synthesized
  misc_feature (61): n=a or g
ttgaaagcatttatgacttctttttaattggctagcaatgcattccttccattgacacacnctgtaagtcttccctgcaaaattatcatgacaatataccagtacaggcactgaaatcttt

SEQ ID NO: 41443 - DNA, 121 bp, Artificial Sequence
  Synthesized
  misc_feature (61): n=a or g
attatattaatacttttttttttttttttgagaatgagtgagcaagctacaagaatgctgntaaagaagggaggtattatctttttaataaggtctctgtctagctgcataatcagcctta

SEQ ID NO: 41444 - DNA, 121 bp, Artificial Sequence
  Synthesized
  misc_feature (61): n=t or c
aaaaaaaaatccttttcccatttcggtggcccatagctctgaactgttacgctgcaattangcttctcaaaagcagataaatggcaggtgaaaaaaattaaacccacttaagcaagtcagg

SEQ ID NO: 41445 - DNA, 121 bp, Artificial Sequence
  Synthesized
  misc_feature (61): n=t or c
ctatgccttgccagtatcttttctatataaggtaatacagttgtcttgcacttgtcaaacnggaaaacaaatgtggtaatgaataaagtaatttttgcactgtacattatgtgactgttct

SEQ ID NO: 41446 - DNA, 121 bp, Artificial Sequence
  Synthesized
  misc_feature (61): n=a or t
ggccaaagttttggcagagctaattaaatcagctttaatttcagtttaagctgttataatngttgcgtgcttggagaaaatttcaccaatggtgaggctggagatgataatctagtccctt

SEQ ID NO: 41447 - DNA, 121 bp, Artificial Sequence
  Synthesized
  misc_feature (61): n=t or c
gtaaataggtttgggaaagaaaaggctgttactagagcttttaggctctagtactgcctanagtgttgcttttatccattttgtttgcgttgtgatagtttattttgctatgttattttaa

SEQ ID NO: 41448 - DNA, 121 bp, Artificial Sequence
  Synthesized
  misc_feature (61): n=a or t
ccttttcaaaaatagcttcaacttgaaagttcctgcaaggctgccaaaacggggaccaaantacatttctgtcttgatactaatattacaactaaatacgtagggagatctgaaagtttac

SEQ ID NO: 41449 - DNA, 121 bp, Artificial Sequence
  Synthesized
  misc_feature (61): n=t or c
agtttaacactctcctgctttttccctcgcagtgactcagttacagacaactttagcagcngtccaagaaatgctaatccagcaacaacagaagatccaggagctcacccaagaactggct

SEQ ID NO: 41450 - DNA, 121 bp, Artificial Sequence
  Synthesized
  misc_feature (61): n=t or c
ttctaagtataaacaaaacccaagatacagtcagaatagttagagcgggcatgtccagccnatgacccgcgagccatacgcagcccgacccagtctgtcctgtggacaccccctgtcccat

SEQ ID NO: 41451 - DNA, 121 bp, Artificial Sequence
  Synthesized
  misc_feature (61): n=a or g
aaaacatacttgaaatgagataaaatgttatcttggattagtttcagttaagcaaggtctntaatcagaatgaaaatagcactgccattctcctgagttcagactgtaccctcagtaacta

SEQ ID NO: 41452 - DNA, 121 bp, Artificial Sequence
  Synthesized
  misc_feature (61): n=a or g
gaggggccaggacattttctgtttcctgggtgagcacagaaacctctctgaagaagacagntgttcacttagtctaccttttaatgcctaagtcaggatcgaagtgttcaagaaaccactg

SEQ ID NO: 41453 - DNA, 121 bp, Artificial Sequence
  Synthesized
  misc_feature (61): n=a or g
ccccatcagcagggatcctacacacacacctcactcatgacatctgtaaggtcccgatcancagatgaattcttatctcaccaaagcacaccatcaagcactcttacaatgtgggtgacaa

SEQ ID NO: 41454 - DNA, 121 bp, Artificial Sequence
  Synthesized
  misc_feature (61): n=t or c
acttactgcaggtgttggatcccactgaacccgagtggtcctgaggagttcctccatgcanaggtggtggcctgagtgccatcagagctgtgtcacatattgtgggcaagcagcatccgtg

SEQ ID NO: 41455 - DNA, 121 bp, Artificial Sequence
  Synthesized
  misc_feature (61): n=a or g
ccttctttatttttaacttacttatgagtttaaaaacaagacttctgctttcaaatttaantgccacgtaaaaggaagacttccaagttttggtagggatcatcatcataaataatcataa

SEQ ID NO: 41456 - DNA, 121 bp, Artificial Sequence
  Synthesized
  misc_feature (61): n=t or c
gcaaggatggagtcagggaagctaaaattaagctggagttgaagctagtaagagatgtaangagaaacaaggaaggtttctgcatctacattgacaagaagaggaaggctaagaaaagagt

SEQ ID NO: 41457 - DNA, 121 bp, Artificial Sequence
  Synthesized
  misc_feature (61): n=a or c
cccagcagcctgcggtgatgcccactgtccccgcgtgccgtcccaacccacctcccgtgtnaccgcaacactttacaccgccgccgctttcctagaccggagctattgaattttcctttta

SEQ ID NO: 41458 - DNA, 121 bp, Artificial Sequence
  Synthesized
  misc_feature (61): n=t or c
aatgtgtaatgagaatagtttggggaatccagaagtcaatagcggagatcaaaaagaaagntggcttcaactaaatagatgaaaaacaccttacatgctgaaagctgcttcaaatattcaa

SEQ ID NO: 41459 - DNA, 121 bp, Artificial Sequence
  Synthesized
  misc_feature (61): n=t or c
agaggcatacctggtaatgctgagggttcagcctccctctgcccagatcaccgcagtgcantgaacagttacacgcccacaagagctggtgggtaaggagcaagtctcctacttccgaggt

SEQ ID NO: 41460 - DNA, 121 bp, Artificial Sequence
  Synthesized
  misc_feature (61): n=t or c
atccaatccatctggggcacaaacaccttctccccccatatcagatgggaggatgcagccngtgaccacagaaaagacaaataggacttagggccactcagcagaccccgttagtcattag

SEQ ID NO: 41461 - DNA, 121 bp, Artificial Sequence
  Synthesized
  misc_feature (61): n=a or c
tcaatctatgtatgaacatcagttctcagaggtacctgtcacttccattgtacaaaaaaancggctttgtgaaggctttcaaaaagaaaataaaagacctcattaagttaaacaaagccaa

SEQ ID NO: 41462 - DNA, 121 bp, Artificial Sequence
  Synthesized
  misc_feature (61): n=a or g
ctgtacattaaaaacttttgctttaattaaaattcatatatggttatttgttcaatttctntttactgcttcttcaactattttccgatctgcagtgcataacagaatgtctgaaatgaga

SEQ ID NO: 41463 - DNA, 121 bp, Artificial Sequence
  Synthesized
  misc_feature (61): n=t or g
actctgtgattctaactcctccattacgccctcagccatgcccgagcacagctctcaatcnctccaaaccaaggagtcaggcctgccttgagtgtgctcagtgttcaggcccagcactgcg

SEQ ID NO: 41464 - DNA, 121 bp, Artificial Sequence
  Synthesized
  misc_feature (61): n=t or g
gatttgcaggtgcctgagatctttaaggaaaggtttttctttctgactaatgttcaaactncactgtgtgtagttttaaagttgtgattgtgatttgcattatgcttaactcagtggaaaa

SEQ ID NO: 41465 - DNA, 121 bp, Artificial Sequence
  Synthesized
  misc_feature (61): n=a or c
acaaatcacatcaccaggaaaaatgttgccttcctttttgctgcacaaccacagggcagtntttttcctttgtcaagtcaatgacgacacacacagcattccaaggaacaaaaagctggcc

SEQ ID NO: 41466 - DNA, 121 bp, Artificial Sequence
  Synthesized
  misc_feature (61): n=a or g
ctatttgcttctctattcaccatctcagtgtgctgtggtgtgcgtgtgggtccggtgtttnttagatgtaaaggagcttgttaaagaattacgttccaagtctatatgtgcatgtccactc

SEQ ID NO: 41467 - DNA, 121 bp, Artificial Sequence
  Synthesized
  misc_feature (61): n=a or t
gcagtagaaatacataaactttacaataacaatttatcatacgattgtgactacagttacntcagaccctacaaatgtcaataacgaacaaccatgtgacacttttgtgataagtgaaaat

SEQ ID NO: 41468 - DNA, 121 bp, Artificial Sequence
  Synthesized
  misc_feature (61): n=t or c
cccaggtaccacagaacttctcagggacggtgcaaggctccatccagagctatagctcacntgggaagacctttcctctcattttaagggtaccgttaaacttccaggctgaattctgcca

SEQ ID NO: 41469 - DNA, 121 bp, Artificial Sequence
  Synthesized
  misc_feature (61): n=a or g
ctccttagcagaaaaatcactgacccagtagagcatcgctcttcagctcgtagctaagtcngtgcacgagctgcttcgtatgcaaacctaattggaaacgagggatgaattcactctttaa

SEQ ID NO: 41470 - DNA, 121 bp, Artificial Sequence
  Synthesized
  misc_feature (61): n=a or g
aggagtggatggaaaagtttgggggatcctcacttttcccatgggacaaagctggaccccngggttgctgatcctgcggagatctgtgcactggaagtctctgcagtgacagaaaactgct

SEQ ID NO: 41471 - DNA, 121 bp, Artificial Sequence
  Synthesized
  misc_feature (61): n=a or t
taagtgaatttggatcgcgcttaagtacgagtgggcagatggaaaaaagggcttttttatngagccacttaaacccggcgctctctatctgttcagttggaaccctcaccgtaacaattac

SEQ ID NO: 41472 - DNA, 121 bp, Artificial Sequence
  Synthesized
  misc_feature (61): n=t or g
atgttttagaggtgagtgagaagaatgggtccaaaataaaattactggagtaacttttttntttgtttttttaaaacagcctcaatttgggtaattctatcactacagaaacagaagaaaa

SEQ ID NO: 41473 - DNA, 121 bp, Artificial Sequence
  Synthesized
  misc_feature (61): n=t or c
gatttccctgcaaatctctgggttgtgctgtatgagaggggttgaagtggtgagggtctgngcattcccaatggaatgcagaggaaaaatgccattcagcaacagggcggggagttcctgg

SEQ ID NO: 41474 - DNA, 121 bp, Artificial Sequence
  Synthesized
  misc_feature (61): n=a or t
tctttgaagttgatatgagttagtatgagcaattttctgaacttctgcacattcagttacnagtaactgaaggtaaatcttcagagaatttcttggatagatatacctacttgtggatctt

SEQ ID NO: 41475 - DNA, 121 bp, Artificial Sequence
  Synthesized
  misc_feature (61): n=a or g
attctggtcacttccagtagggtcagatttgggggcaggcagaacagaacaacttgacaanggtgaggttggtatagatgcttttgttgactttgtggagccctctcattgctccaagatt

SEQ ID NO: 41476 - DNA, 121 bp, Artificial Sequence
  Synthesized
  misc_feature (61): n=a or g
tctgggaaacgaaagtgttctgagcactttcactttcttgttctcctgctcagtgcaatcntgcagtatggtaaaggttgcatcaagtcagaatgaagtccgtgttttttcattcctttca

SEQ ID NO: 41477 - DNA, 121 bp, Artificial Sequence
  Synthesized
  misc_feature (61): n=t or c
tggtagtgtggtctagtgggatgattacagctaagagccaggaagccttgatctataatcntggctctagtaaaggtttgcgtggcctgaatgtctcagttctcctgttaaacaaaagcca

SEQ ID NO: 41478 - DNA, 121 bp, Artificial Sequence
  Synthesized
  misc_feature (61): n=t or c
tgctagactattctagggttgaagagcatgtctcattgtaatgacattttgaaaaggtctntatctgcagaatggagattcttctaatcctacaaatattcttggataggagaaaatgtcc

SEQ ID NO: 41479 - DNA, 121 bp, Artificial Sequence
  Synthesized
  misc_feature (61): n=t or g
agctcagatttttgtgattccagagccaaacacatcaggcctgaaagctcctcctgaaatntcagagctgcctttaccattgttgaagtaataaagcaagtttgctccccaccaggagcag

SEQ ID NO: 41480 - DNA, 121 bp, Artificial Sequence
  Synthesized
  misc_feature (61): n=a or g
tagttagcaattatcaattctgtaggcttatatttacattagtgtgtgtgttagctggacntggatctgcatatatacccatacacccataactgtgggtgtatgtgtgaatgcatgtgtg

SEQ ID NO: 41481 - DNA, 121 bp, Artificial Sequence
  Synthesized
  misc_feature (61): n=t or g
tttgtttgtgcccatcttcactgtttctgctttgctaaagcaatataatcccaagcacctnctgcaagtctgctccatgatgagaggagcaccattccagcctgaccagctcaaatgggca

SEQ ID NO: 41482 - DNA, 121 bp, Artificial Sequence
  Synthesized
  misc_feature (61): n=a or c
catatatggttcaatagccacaagcactttctggccatactcctgttgagactaatattanacctgctaaaaacaaaggtttaccctgatagtaataggatcagactaggtgtaatatttt

SEQ ID NO: 41483 - DNA, 121 bp, Artificial Sequence
  Synthesized
  misc_feature (61): n=a or t
cttaacaactgctagataattcatccaaagtggcagccaaaggaaaaagaaattgtcttanaataagtttgaaaagaagggtggtatgaaaatgcagggggggggggaaacaaagagctgg

SEQ ID NO: 41484 - DNA, 121 bp, Artificial Sequence
  Synthesized
  misc_feature (61): n=a or g
gctgcagcaccattaaattcgatactcatttgtatttacaaatgcctcctcaatccctacnctcttcatcaactcctgctgaaccgcagggaccagaaattcctccacgatgtttcccttc

SEQ ID NO: 41485 - DNA, 121 bp, Artificial Sequence
  Synthesized
  misc_feature (61): n=t or c
tcacttgcttccaaggccagcttcctcctgatctcttgcttccaaggccagcagaagctgnagagacaggacgtttggctccttcaggaaggatgttagttctttgcttggtttgaatctc

SEQ ID NO: 41486 - DNA, 121 bp, Artificial Sequence
  Synthesized
  misc_feature (61): n=a or c
gggttggctgctgcccatcctcatttcccatcaggattccgtaggctctgtttttttcccngcaattttcccatcccacggtcacaacaaatctcagtgcgatgagttttggaccatttga

SEQ ID NO: 41487 - DNA, 121 bp, Artificial Sequence
  Synthesized
  misc_feature (61): n=a or t
gaatattgggatgccaaaaggactggaaataaaataagaacacagatttctttgctctccnttattgtttgtgcatcaagctctccgagtttgtttctggaactctgttgaaagcttgcca

SEQ ID NO: 41488 - DNA, 121 bp, Artificial Sequence
  Synthesized
  misc_feature (61): n=t or c
taaaaaactcactgcatctgaggaagcaagaggctgcttgtggcacaggttagtcacatcnccagagttccaaaaggcaagctaatgttaaaggaggttatcctacactgcagtgaaatga

SEQ ID NO: 41489 - DNA, 121 bp, Artificial Sequence
  Synthesized
  misc_feature (61): n=a or g
tttccagtgttggaatgcttgtaatttagcttgttcaactggatacctttttaaatacacncttgttgtttatccagttgcagcatagtcctcaactaggtagtcctgtcacctcgccagc

SEQ ID NO: 41490 - DNA, 121 bp, Artificial Sequence
  Synthesized
  misc_feature (61): n=a or g
ctgccccctctcctcttttttaaagtgcactgcatctgtgtaaataagtgccccatgtatncgacaaggtaatatttaatgtggacacagtgtgtacagaattagccactgacagggcggg

SEQ ID NO: 41491 - DNA, 121 bp, Artificial Sequence
  Synthesized
  misc_feature (61): n=t or c
ttccaatgtcatgttttttcatatttttttcagactttttttgagcaaaatttgataccanttgttatttggggttcaaatctaccatatgctttccagcgcatgtaaaaacagacaaatg

SEQ ID NO: 41492 - DNA, 121 bp, Artificial Sequence
  Synthesized
  misc_feature (61): n=a or g
gtttcagtgcaatacaatatgcctgagggatgtgatgggacaagctgggctgcaatgtacnttaagggtttgggtatttggtgtggtgcagcgcgtaggagttttgggtgaggttcctcct

SEQ ID NO: 41493 - DNA, 121 bp, Artificial Sequence
  Synthesized
  misc_feature (61): n=t or c
aagcttactggaatgcctggaaatctcttagtagctgtcagatctcttttcagaagacaantgtacactggtgcatatctgtttgtgtttctttagcccatttttcttcttgtaaccccat

SEQ ID NO: 41494 - DNA, 121 bp, Artificial Sequence
  Synthesized
  misc_feature (61): n=t or c
ttgggggtattcaggctgatcttaaaatactgatccttgtgagtacagttccagtccttgngtcttactacgaaggctttcttctgtcactcattttccttcttgcgttgttgtatgtaat

SEQ ID NO: 41495 - DNA, 121 bp, Artificial Sequence
  Synthesized
  misc_feature (61): n=t or c
aggacagtacaacactgcttagatggagaatacccgtagttggtacttagttgagttttcngtctgaaactggtgaaaaacctaaccaaagcatgatgttcattaagaaagtgaattatct

SEQ ID NO: 41496 - DNA, 121 bp, Artificial Sequence
  Synthesized
  misc_feature (61): n=a or c
atacgaggtggtgaatgtggcttatcccaacagcatcccaaccgcaaactccgagctgatnagcctcagagcttcttaacattttctcagacttcctagcttgttatttcagttcccagac

SEQ ID NO: 41497 - DNA, 121 bp, Artificial Sequence
  Synthesized
  misc_feature (61): n=t or c
tagccagttttctaagatctcctgctgcatttttacttttctccatcagagctcgtttcantgtgatattttggtatttgacagatgtgtgtgtattcaagttaaaagtgaaacgaggggc

SEQ ID NO: 41498 - DNA, 121 bp, Artificial Sequence
  Synthesized
  misc_feature (61): n=t or c
cataaaagcgatatgagctgtcctgatgcttgcccatgtttttagccacgagtacaaagcntttatcgcgtctagcaaaagttagcaagtcaaatgcaacttagatgcttaagactgtaca

SEQ ID NO: 41499 - DNA, 121 bp, Artificial Sequence
  Synthesized
  misc_feature (61): n=a or g
attgattctatcgaggaaagcattccaaaggccaagccttaaatgcttccctgtcattttntttgagacaatcaataaagtgtttctctcaaatatttcctctcaacatcattcctaataa

SEQ ID NO: 41500 - DNA, 121 bp, Artificial Sequence
  Synthesized
  misc_feature (61): n=t or c
ggctcctactagtccttctactctcaagtgtcttcatcgtaagatgcacagcaatctttanatttcacatagtcctgaggagtaaaaattatcatttaaagcatgtctcttccatgatttt

SEQ ID NO: 41501 - DNA, 121 bp, Artificial Sequence
  Synthesized
  misc_feature (61): n=a or g
aaaatgttgacaacaggctgcaagcatcctgaggccactctattatgttgttccccactcncatttgtgtgaattttatctcttgtgtttagttataaaacctttgggtgaaggggagggc

SEQ ID NO: 41502 - DNA, 121 bp, Artificial Sequence
  Synthesized
  misc_feature (61): n=a or t
agccccatgctggggacccatgggcagggaccacaagaaagcagcaacaaacccaggctgnctccaacccaatgcaacctacaaacagcagatccattgctgggagcacagatgcagctca

SEQ ID NO: 41503 - DNA, 121 bp, Artificial Sequence
  Synthesized
  misc_feature (61): n=a or c
gctgtgactgcattatatagaggcttacatatattacccttactcgttacaattgtgttanatagaaatgttggtgcagtacaaccacccacccaatgaaggaccagcagatgcctcagga

SEQ ID NO: 41504 - DNA, 121 bp, Artificial Sequence
  Synthesized
  misc_feature (61): n=a or c
tttcacagcactgtttctattaaggctctgtttaaatgcagttacctgtccttacttcaancctctgtagatattctttttgtattcagtttatccagaagctccctatttatccatatag

SEQ ID NO: 41505 - DNA, 121 bp, Artificial Sequence
  Synthesized
  misc_feature (61): n=a or g
attctctattttattaaatctacattgagcatacgtgcttgtgttctaagctgaaagtggnaaatcgtgtaatgtgtaactgttcaaaagttatgtcttaaagtcacacatttcagatcac

SEQ ID NO: 41506 - DNA, 121 bp, Artificial Sequence
  Synthesized
  misc_feature (61): n=a or t
aaatttattaacatgttttccaggagctgatgaaaactaattcccctcagtgaattccacnggaaagcaagtggtatcctttatgaccttttaatacagctatataatacttaaaatgatt

SEQ ID NO: 41507 - DNA, 121 bp, Artificial Sequence
  Synthesized
  misc_feature (61): n=a or g
atgcctaacctggagctggtgagcagtaagcggttgtttcagttcaggatatgccttcatnttttgctggatcagaggcagtattcttaggattgagccacctttatgattttgctgcttt

SEQ ID NO: 41508 - DNA, 121 bp, Artificial Sequence
  Synthesized
  misc_feature (61): n=t or c
tcacacacacgcacgttcctgcaggaggtcagcaagtgcagcacaggtacgtgtgctcagnggtaggcatgcaggagcccaggctgcatttgcactcactgctgaacctcatgcacagagg

SEQ ID NO: 41509 - DNA, 121 bp, Artificial Sequence
  Synthesized
  misc_feature (61): n=a or c
tttttgtctgggttggttagttgtcgtggtgtctttctatccctcaaaaggctgaaaaaanctatgagaactaaagttaataggattcatcactcctaaaacctaatagcaatgaactgtg

SEQ ID NO: 41510 - DNA, 121 bp, Artificial Sequence
  Synthesized
  misc_feature (61): n=a or g
cctatcatcctcaaaataattgttgggcttttttgtgaccataagagaaccccacagcagnaagaactaaatggagatttgtgcacacagagtatctgctcaaaggaatggtagccctacg

SEQ ID NO: 41511 - DNA, 121 bp, Artificial Sequence
  Synthesized
  misc_feature (61): n=a or g
tgctagatagacactcccagtgtgacctgttggcttttcatcccacaatttagtgagcatntttgtgcatgcctttcttctatcaaaatagcccagactgaacagaagtagcagaagcatt

SEQ ID NO: 41512 - DNA, 121 bp, Artificial Sequence
  Synthesized
  misc_feature (61): n=a or g
aacaactgcagggaaggaaaatgcattgaactctatacatttaccttactcaggctcactnaagtgcagtggagaaaaaaccaacttaaaatgttcccatttagttgaaagacagaaaaag

SEQ ID NO: 41513 - DNA, 121 bp, Artificial Sequence
  Synthesized
  misc_feature (61): n=a or g
gctttctctgtgccccactgcccatgcagctgctgcactgagtgagctgggattggtgacnctgcgtgcagcactgctcctccaggacacaccaggaaacgccttatggaaacagcaacaa

SEQ ID NO: 41514 - DNA, 121 bp, Artificial Sequence
  Synthesized
  misc_feature (61): n=a or g
tgaattggaatgaaataaggtaaaatgtgtacctcccctttatcacactatggagttttgntagcaaagagatggatacataggtagcaacactaatgcatttatggatatttagagttgc

SEQ ID NO: 41515 - DNA, 121 bp, Artificial Sequence
  Synthesized
  misc_feature (61): n=t or c
ttgtttttgctttagttcaacaagctggaaataaaaattaagtttcccaggtggaaaattncccatagaaaatgttggagccccattttgttttgttttggttttttttccccaataatga

SEQ ID NO: 41516 - DNA, 121 bp, Artificial Sequence
  Synthesized
  misc_feature (61): n=a or g
tcttactgctcagtcttactgagcatataagcatttcttgtatacgaatggtgcaaatgtncagacctgaccatggcaacagtgacattgttgtctattttgcctcctgttatgattccag

SEQ ID NO: 41517 - DNA, 121 bp, Artificial Sequence
  Synthesized
  misc_feature (61): n=t or c
tcagatccgtggcctaatgacacttctgcaccctaaaacaattgaaactcctaaaacaatnatttcttcttggtattgttttgacatttttacaaatggagcttcttaatcattagtggat

SEQ ID NO: 41518 - DNA, 121 bp, Artificial Sequence
  Synthesized
  misc_feature (61): n=a or g
atgttcttcctgtcaaatgtttggctcgtgtcaaagactgcagatttgcagttcagcgatntagaatcttaatgctgttagcgttccatgtaattcctgtggccaaggcttttgtagagct

SEQ ID NO: 41519 - DNA, 121 bp, Artificial Sequence
  Synthesized
  misc_feature (61): n=a or g
tcaagacagataaatgtctagctattacaaatcagatacatgaccctggatgaaagatacntaaatacccatgcagctgctgcacaagacactggaatccaagatgacacaaacatctggc

SEQ ID NO: 41520 - DNA, 121 bp, Artificial Sequence
  Synthesized
  misc_feature (61): n=a or t
ttttgctgaaaaataaaaaaaaatcatgattggtggccatataggggcttgttagataatntaatggagaccttataaataacagtatacaatggtactgccatatactaacctcaatata

SEQ ID NO: 41521 - DNA, 121 bp, Artificial Sequence
  Synthesized
  misc_feature (61): n=t or c
cagccacctatagagtctttattccaaatactgaccaaatctctaactcttgctggacttntcagttttatctggccatggagtgttagcttagcctggaggtctacaaggcagccatgtg

SEQ ID NO: 41522 - DNA, 121 bp, Artificial Sequence
  Synthesized
  misc_feature (61): n=t or c
ttgcttcctctgcttccttctctactgtattcttccaaactttcaccatcttgataactgngtacttctatgatctatcagtaaaaagtgaacacaacctaatgaatatgaacacaaacta

SEQ ID NO: 41523 - DNA, 121 bp, Artificial Sequence
  Synthesized
  misc_feature (61): n=t or c
caaacccacaaattctgtgatgcaaataaaaagttatatctttctggtttgttcattcagnatcactaagagatacatttctgctatgagacagcatgagactttgaagagatttgttatt

SEQ ID NO: 41524 - DNA, 121 bp, Artificial Sequence
  Synthesized
  misc_feature (61): n=a or g
ctctcaagtgttaggtattgtggaacacatgttcatatgcctggaaagatctttcaaatgngtattccttgaggaaaaatgtaggagatgagaatattttgaagttaaggatgacttcaac

SEQ ID NO: 41525 - DNA, 121 bp, Artificial Sequence
  Synthesized
  misc_feature (61): n=t or c
caaactgtgcttcaaagaccattcacacacattataaaccagagaaaatctaatcacccangtggaaaattctgagaaaataaagtcatttatcccacacaagttgtttaaaagaaagatg

SEQ ID NO: 41526 - DNA, 121 bp, Artificial Sequence
  Synthesized
  misc_feature (61): n=t or c
tttagattttttttgtttttttgttttttgtgatttctttgacatgtctccaaaataaggntgtattggtgtttacagttctgtcaatccaaatataaactggacaaaaatcataaatatt

SEQ ID NO: 41527 - DNA, 121 bp, Artificial Sequence
  Synthesized
  misc_feature (61): n=t or c
aaaacaatcataaacatcaaacttaaatctgatccacagcatgttgttggcagagcttttntaccataatacttcaggaagctttgaacatgagcattactattaacaaaacaaaacaact

SEQ ID NO: 41528 - DNA, 121 bp, Artificial Sequence
  Synthesized
  misc_feature (61): n=t or c
tagggactgcttaaattgccagtaaagatttccgaggaggatatatggatgcccaggtcangaactagcatcagggctcttccctgcaggtatttctaacctgcacagtcctgctggacta

SEQ ID NO: 41529 - DNA, 121 bp, Artificial Sequence
  Synthesized
  misc_feature (61): n=a or g
atagacttcccttcttgtgagacttgaatttacagcagcatttaaatggaagtgggatagncattctacaatatacttaaactgtaattatttttggaaggtgacatgctcatgtacttct

SEQ ID NO: 41530 - DNA, 121 bp, Artificial Sequence
  Synthesized
  misc_feature (61): n=a or g
ccagcaaacaggagctctgtgcttttctcctactgcccacgttgatgtgttccctttctcncattctcaccttccccagcaagtctaacacttacacaatgggagacagagcggatgcagg

SEQ ID NO: 41531 - DNA, 121 bp, Artificial Sequence
  Synthesized
  misc_feature (61): n=t or c
agtaggtgagagcttatcgcttcagacaaaaagcagaataccaaatagaataggtaagctnttcactgagtgtgcttaggggtggaaaaggaggtgtagccacagttaatatgtgtattgt

SEQ ID NO: 41532 - DNA, 121 bp, Artificial Sequence
  Synthesized
  misc_feature (61): n=t or c
ttacttctccctctgaatcacgtgacatttagatttcttatttgcattttggttttggaantgtcaaggttcaggccttccttgtgcttctttgtaaccatgacaactacaaacttttctt

SEQ ID NO: 41533 - DNA, 121 bp, Artificial Sequence
  Synthesized
  misc_feature (61): n=a or t
caaaacacaggcatagaaatgctgttcatatgaaaagtagtaaactgggaaaagaggtaanggttttgtacagtactttaatcaggtcctcttccaaagttcattcttgattatgacagta

SEQ ID NO: 41534 - DNA, 121 bp, Artificial Sequence
  Synthesized
  misc_feature (61): n=a or c
gctcctcagtaagtcagccatcttgctaaaccaggtctcttgcagatgaagtttcgttctntaaatgaggagctggttacaaccacagatttttgaacctacataatcctgatgtccttat

SEQ ID NO: 41535 - DNA, 121 bp, Artificial Sequence
  Synthesized
  misc_feature (61): n=c or g
cattcacttctgcattagatcagcccttggctgcctcagcgaagaacgaaattacagcagngctcggtgcagacctgtggacaaagcaaacaaccccatcctgccaggcagctgctgcaca

SEQ ID NO: 41536 - DNA, 121 bp, Artificial Sequence
  Synthesized
  misc_feature (61): n=t or c
aagacattgtctcaaaacaagaaaccagatgaaacaattaaattttgaatgcttgcattancttatacaaggctgccttctaagaattagcctcagacttctaaccaaagtcacttctgtg

SEQ ID NO: 41537 - DNA, 121 bp, Artificial Sequence
  Synthesized
  misc_feature (61): n=t or c
ggttgttagtagctcattaacacaaatctcaccttatcattaccaggtggaattccactcnctgccatggcagtctgcagtgccctttacagagcacagcagtaaaatcacacaaactcct

SEQ ID NO: 41538 - DNA, 121 bp, Artificial Sequence
  Synthesized
  misc_feature (61): n=a or g
cattgcctttgagtcccttggggaagaagagaaataaaaccccagtagacaggcatcagtnttggaaaagcttgctctgcctttcctgaaaacaccatctggaatattttttagtttgaag

SEQ ID NO: 41539 - DNA, 121 bp, Artificial Sequence
  Synthesized
  misc_feature (61): n=c or g
aaatatattgttcctgcaaagtttctataaggatcacaagaacaggcagctattggagggntttataaatgagggccgaaccctgggggtctttggatattatcaggagaaataaactatc

SEQ ID NO: 41540 - DNA, 121 bp, Artificial Sequence
  Synthesized
  misc_feature (61): n=a or c
taattttcagcatgttgcagatatgtataagcataaacagatgttgttaacttttaaaatnaaaaattacaaacacaatcagcctgaaaacaatagctaggtttgcccagcaaccgcactg

SEQ ID NO: 41541 - DNA, 121 bp, Artificial Sequence
  Synthesized
  misc_feature (61): n=a or g
atgtcgggggagcttttctaaatcaagagagactttctagaatttctttttctcattttcntcctctaaaccagagatttgctgcagttgatataggcaaatggttaaaaaaacaactcta

SEQ ID NO: 41542 - DNA, 121 bp, Artificial Sequence
  Synthesized
  misc_feature (61): n=t or c
tccaatttgtctttgatttttcaggttaagggctgctgggtgatcacatacacatagcatncagcacctatttaataaaaacacttattttgggcaaatttcaactgctcactgaacatgt

SEQ ID NO: 41543 - DNA, 121 bp, Artificial Sequence
  Synthesized
  misc_feature (61): n=a or g
ttgaaaggatgccacagtagtcaagtacagaatatctccattgagaacaaagatgcctacntgtttatggcatctctgataagaatgtgccatcagatcagtggtctgaaaatgagaatgc

SEQ ID NO: 41544 - DNA, 121 bp, Artificial Sequence
  Synthesized
  misc_feature (61): n=t or g
ttttagtggccaattgtgacagttaaaattgtcatcaagacaacaaatttagcaagacagnacttgctattttagagaggcggaatgttattcccagacaaactctgacagtctgtcctct

SEQ ID NO: 41545 - DNA, 121 bp, Artificial Sequence
  Synthesized
  misc_feature (61): n=a or g
gagcttcccaatggcactcaatacatccttcagggcaatgactgctgctgtttgattctgntgtttgtaggaggagggaacccttaagatttgcatctcatttcccagaatgccccagggc

SEQ ID NO: 41546 - DNA, 121 bp, Artificial Sequence
  Synthesized
  misc_feature (61): n=a or g
tctggcctttgtaactgtcagaatatgtttgaaatatgctacattctatctatttatcagnaagaaacaggttgacaattcaagtgaagaaataagtggaggtactttaatttttagaagt

SEQ ID NO: 41547 - DNA, 121 bp, Artificial Sequence
  Synthesized
  misc_feature (61): n=a or c
caatgctaggaaacacccaataggctgaattactgcacgcagccttgcaatttcatttatnccacactcatcaccctgtaacaataggaaaagctactgagtatatgatagcagataaaca

SEQ ID NO: 41548 - DNA, 121 bp, Artificial Sequence
  Synthesized
  misc_feature (61): n=t or c
gccctctgcgctgcaggtgatgctgtgaccaaacactgcgtgtgtgggtggcacagacgcngtatctctgtcccaaactgccatcattctgttcgttttctttctttctttctttttcaga

SEQ ID NO: 41549 - DNA, 121 bp, Artificial Sequence
  Synthesized
  misc_feature (61): n=a or c
agttacaacagcaggtaggactttccatacctcactgaaagcaatctttctgggtaagagnaagagataactcagtatcttaggaggtgtgaccttttctagcccgttctaacctaatgca

SEQ ID NO: 41550 - DNA, 121 bp, Artificial Sequence
  Synthesized
  misc_feature (61): n=t or c
aatatactgaagaaaggttaaggctctaacagtggacttgatgcaaatgccttattttgcntaaagaagttgttctttgccattccctgaatcagcagtgcagcacttgtcttgtacgcct

SEQ ID NO: 41551 - DNA, 121 bp, Artificial Sequence
  Synthesized
  misc_feature (61): n=a or g
ttcatagggcatgtcagccattttcttttctctgtttcttcaaatacccatggaaaaaatntacttgagctcaagttggttctaaggattcctcttgcgatatccactatcataattgctg

SEQ ID NO: 41552 - DNA, 121 bp, Artificial Sequence
  Synthesized
  misc_feature (61): n=a or g
agtcctactgatagcacagaagtgttggagcagccctgctctgggtgcctctcacataatnatgtttaggagcaatgcagtgtctgataaaaggcacatttttcttgatcctcctgatctt

SEQ ID NO: 41553 - DNA, 121 bp, Artificial Sequence
  Synthesized
  misc_feature (61): n=a or g
tcctgggggctcagacaacggcacacaatggtaccgactgcctcaaaggtcaaagcctccntcgggacgggctgttacacacaaaatactcctgtagctgttcagatgacagacaaatggc

SEQ ID NO: 41554 - DNA, 121 bp, Artificial Sequence
  Synthesized
  misc_feature (61): n=t or g
aatgcattggtaatgcgttcataatgtacatcttagaaataacagtaataaaacatactgncttccgagatgtattttatacatcacagattcctccagtacaagaagccacctggttctt

SEQ ID NO: 41555 - DNA, 121 bp, Artificial Sequence
  Synthesized
  misc_feature (61): n=t or c
ctgttgggtccctgagctgagggtaagcagcccttagtcatcatgaaaccgcctgcgtgcngaggagacacacagggctcagtgcagcccaacgcaccacatgggaaggagcttcactgaa

SEQ ID NO: 41556 - DNA, 121 bp, Artificial Sequence
  Synthesized
  misc_feature (61): n=t or c
atacagtgaaatagatctgcctatttatttcagatttaggtgatcttcccatgtttatttnctggagaatcaggtagatcatttcagatgtcctctcatggcatctaatattgctgtacat

SEQ ID NO: 41557 - DNA, 121 bp, Artificial Sequence
  Synthesized
  misc_feature (61): n=t or c
tttgttttttaatggaaccgcagcttcatttcttgagttaaaaggagtacttctagtggcntagagcagagctccttccagagacatccatgcggagctgctccctgcagtgtgcccagcc

SEQ ID NO: 41558 - DNA, 121 bp, Artificial Sequence
  Synthesized
  misc_feature (61): n=t or c
gctttatgtaccagatgttgctgtaggcattttacttcctcttttattctttaaaggtgangctgctattcatgaaaatgttgagtgctggaataatgaaaccattctgcagaaatccctg

SEQ ID NO: 41559 - DNA, 121 bp, Artificial Sequence
  Synthesized
  misc_feature (61): n=t or c
tttcccccatcaaagcacgaagcgtgactaacaaaacagagaaggtcctcgcctttttcanggtagccttaaagaagaactttttggtttccaaagcttgtatggcttcagatccaaattc

SEQ ID NO: 41560 - DNA, 121 bp, Artificial Sequence
  Synthesized
  misc_feature (61): n=t or g
ggaccactgaagaaggcagccaagagtcagtgaaataggagcagagtccacaccacatagnatcctccttgtctgcttagtagaaaaaaggaagactgagataacacagaaggaaatgggg

SEQ ID NO: 41561 - DNA, 121 bp, Artificial Sequence
  Synthesized
  misc_feature (61): n=t or c
aaaagaatatacaatggaagtgatgcacagttgtagttacttaccaccagctgacccatgnccagctgattgctgagtagcagcagccctcctggcctatgtccctcaattttattgttca

SEQ ID NO: 41562 - DNA, 121 bp, Artificial Sequence
  Synthesized
  misc_feature (61): n=t or c
aagacttttcataatattttctcatgctgtcctgttgagtagggagtggtgtggtggacanctggcagccagccaaggtcactacatggctgacctttctaaactcaactactaaagaatc

SEQ ID NO: 41563 - DNA, 121 bp, Artificial Sequence
  Synthesized
  misc_feature (61): n=t or c
ccttagctgggcactctgcccttcccctccaccctgaatgcatcgggtatgtgctacaganggggatttaagggcatccacctgccagaaacttcctagagatttattgcacttcacccta

SEQ ID NO: 41564 - DNA, 121 bp, Artificial Sequence
  Synthesized
  misc_feature (61): n=a or g
acaataagatctcttggcttcccatcttttacccaaaacatgatacatacatgttaaactntagcctgcagataccttgctctcagcgtaaaaaagggtggcaatgcctttactgagaact

SEQ ID NO: 41565 - DNA, 121 bp, Artificial Sequence
  Synthesized
  misc_feature (61): n=t or g
ggttgcggactttcagagaaatcttcaaaggaggacaattctaactcattgcagcctgttngtatgcttttttaatggtctattcataaagttctgagcagaaaaccttgatttatttcga

SEQ ID NO: 41566 - DNA, 121 bp, Artificial Sequence
  Synthesized
  misc_feature (61): n=a or c
gtgaaagagctgtttgcaaacttctggtgtatgcaggtctgcagtactccacctgcagacncaacagagctgggcattgtttgtttcctttctgttcctgtttggaaactgtagcatgcag

SEQ ID NO: 41567 - DNA, 121 bp, Artificial Sequence
  Synthesized
  misc_feature (61): n=t or c
tgctttagtttgaaggaaacatctttgaatgctgaagttccaacagtcccacacaaaacangtgcctcttgctcacttcaaggaggtagtggttatcaatgaggctggagaagccagggcc

SEQ ID NO: 41568 - DNA, 121 bp, Artificial Sequence
  Synthesized
  misc_feature (61): n=a or g
agtgatgagagcgcccagctgtggcttcacagcttcccatgagccccataaatcctcccantgcccataaactcagggatgctgcagggtgggagcatccaggtgcttattcaagagagaa

SEQ ID NO: 41569 - DNA, 121 bp, Artificial Sequence
  Synthesized
  misc_feature (61): n=a or g
aaccaaacctttctgggaatgatctcgttgtgatccttacatgtaggaagtaaacaaaacnatctgaaactgaagactgcaactgagtttcatgcagacccactgcctgaggagaacttca

SEQ ID NO: 41570 - DNA, 121 bp, Artificial Sequence
  Synthesized
  misc_feature (61): n=a or g
gctagagtgcagaggagcacttgaggaactctggtcaatgacatcaggaagaggaagaggntggagggcctagaaaggaagagcaagacatggctgtttaaataaccacactttagataga

SEQ ID NO: 41571 - DNA, 121 bp, Artificial Sequence
  Synthesized
  misc_feature (61): n=t or c
aagcaaaaatatatcagccaagggttagcagccagcctatactttctttttcatatcttantgtgcaccacaaatagcgatctatacttatgttctgctgctcagcaacaacttacagctt

SEQ ID NO: 41572 - DNA, 121 bp, Artificial Sequence
  Synthesized
  misc_feature (61): n=a or g
gtctaaacgtggaacaaagcaggagagataactgagtgacccaggaggaattcccctctcngtttcggatctgtcccctttaccacagacagagtttttctctggtgtgtctgcattgctc

SEQ ID NO: 41573 - DNA, 121 bp, Artificial Sequence
  Synthesized
  misc_feature (61): n=a or t
tggagatcctgaattaataagtgaaaacttataaaactgagtaatatatgataaaacttcnttttttttccttaagaaccatttctgttagaaggctacgtcatgttctttctttgtacta

SEQ ID NO: 41574 - DNA, 121 bp, Artificial Sequence
  Synthesized
  misc_feature (61): n=a or t
aaatcatctcttctggccataaacagctttgattcttttgctgcttctttcttacctattntattcagccttttcttattttgtgtctttgtcgtgttgtcgcagtttctgctttgttatt

SEQ ID NO: 41575 - DNA, 121 bp, Artificial Sequence
  Synthesized
  misc_feature (61): n=t or c
aagcttaacaaatttcatttgacaggactgacctgacataaggttggcagtggatgcaacngtagccttaattaaatgagcctggacatctgtctcagctgtcaatccttctaacactgag

SEQ ID NO: 41576 - DNA, 121 bp, Artificial Sequence
  Synthesized
  misc_feature (61): n=t or c
tgaggaagtttgcagacttcaagtccaaagtggaggcaggaattggaaagcaatggatganggaacacagagtgggagacatggcaaaggctgctcagcaaaaagtcctttttttttttcc

SEQ ID NO: 41577 - DNA, 121 bp, Artificial Sequence
  Synthesized
  misc_feature (61): n=t or c
ctttgaggcttcaagaaatttactgtgcagttcctaaatactggcagagatgcctttgacntttatgtctattgtgtattacaggactgtaggaagaaacagtagtggctttagatcagag

SEQ ID NO: 41578 - DNA, 121 bp, Artificial Sequence
  Synthesized
  misc_feature (61): n=t or c
ttacagtgttgtaaggacacacagaaataacatggaaaagccctttctggctctaacaggnagccagtgacacaggtgaagcacctactgcaccacttctattttaattaaaaaacaacaa

SEQ ID NO: 41579 - DNA, 121 bp, Artificial Sequence
  Synthesized
  misc_feature (61): n=a or t
gctgacttccctgcacagtgaaatttagaggtgttttaaaatttacatttatcctttattncctcacggaccgatcctctgatttcccagagaagctttttactgctttataggttccctc

SEQ ID NO: 41580 - DNA, 121 bp, Artificial Sequence
  Synthesized
  misc_feature (61): n=a or g
ggaagtatcagaaagagaaattcagttgaagaagaagcatgattctatacactgtctttcntaacagctctcagttacaggtctgattcaaagttactagggtcagtggtagctggtccat

SEQ ID NO: 41581 - DNA, 121 bp, Artificial Sequence
  Synthesized
  misc_feature (61): n=c or g
ggtggctaggaaatggttcagtcccataaactctgcaaagctctgtttgtagagatcttgnagcccaagctagagacccggatctgttagctcatgttgtgcccatatataaccaaataag

SEQ ID NO: 41582 - DNA, 121 bp, Artificial Sequence
  Synthesized
  misc_feature (61): n=t or c
acctggctatgcaaaagacaccttgggactcacagtccagaagtgtctcttgagataagtnctcatgtggttcttctcaggaaatcaaacagaacttttctcttttttttatgtaggatct

SEQ ID NO: 41583 - DNA, 121 bp, Artificial Sequence
  Synthesized
  misc_feature (61): n=c or g
ctgaattttaccctaggaatgaagaattatttgaactcctgagcttggttctttttgtctncctcttcttgaaggttaattcctcagaacttccttttggatggtttgaagaattgtgtgc

SEQ ID NO: 41584 - DNA, 121 bp, Artificial Sequence
  Synthesized
  misc_feature (61): n=a or g
ataaaagtcaagctagtgccctaaggatttttctgaggtgatccttgcctgttaatttcanacacaaataatcttggattgccatagaaattacaagaggttcaaaaacatcttcaattaa

SEQ ID NO: 41585 - DNA, 121 bp, Artificial Sequence
  Synthesized
  misc_feature (61): n=t or c
ctgctcggctcctgcaggaggaggtagctgcctcttgcatagaaacaggccctgagaggcngcctggagcatcctcactcttacttcagtttcctgctttttgatgcacgccgctcgctgt

SEQ ID NO: 41586 - DNA, 121 bp, Artificial Sequence
  Synthesized
  misc_feature (61): n=a or g
tcatttccttgctaagtctttagtaagagtattcatcaaaaatgttgcaaaaattcaaatnctttttctctttgctaatgggctccaaattgcaatcgcaagatggctgtttctgtatcaa

SEQ ID NO: 41587 - DNA, 121 bp, Artificial Sequence
  Synthesized
  misc_feature (61): n=t or c
taattttaatgaaacagtaaactgatccctatgtacagggatagttcattatttaaggccntttcagcatccccacaaaaagaacaatgtacaaccacacagcacagaaagcttctagttc

SEQ ID NO: 41588 - DNA, 121 bp, Artificial Sequence
  Synthesized
  misc_feature (61): n=a or g
aaatataccaggttttcatcagcttcaggaaaaattactggcaatgagtggcctatcccantcaacagagtgggtgaaggtgacatgagaactttctcttctcccacccctcttcctctgc

SEQ ID NO: 41589 - DNA, 121 bp, Artificial Sequence
  Synthesized
  misc_feature (61): n=a or c
tagtgtaaacaaatccatctgctgctaagtactggcatcttaagagcttttgtttgttttnatctggcaaaacacaatcctactaacgttatttactgtaatacatgtgttctgtgggacc

SEQ ID NO: 41590 - DNA, 121 bp, Artificial Sequence
  Synthesized
  misc_feature (61): n=t or c
cagcccttgattagcatgtttttccatgattttttcctaggcactgtttgaattcattttnacttttggtgactacaacgttctttgccaatgacaacttaattactttgttttcatttaa

SEQ ID NO: 41591 - DNA, 121 bp, Artificial Sequence
  Synthesized
  misc_feature (61): n=t or c
tatatgtttattccctcaggcatctagatcaattgatttctgattcccaaatcaacagaantcaagaacagaggttcttgcccaggatgatgaatgttcatctgccaaatgacagaaagtg

SEQ ID NO: 41592 - DNA, 121 bp, Artificial Sequence
  Synthesized
  misc_feature (61): n=a or g
ctgaatttattttgctattaaactgaaattagttataaataacttactattatcaacttangaagttgctaatataacaagtatatcgaaggcactccctgttcgtctcatgccatctatt

SEQ ID NO: 41593 - DNA, 121 bp, Artificial Sequence
  Synthesized
  misc_feature (61): n=a or g
tacctttaagatgccttttttttttttttttttttttttgtaggtttgtttcagaagtacngaagctgcttctgacctaattgatcaaacatgatatttttcaagaaacagtgcaaaatgt

SEQ ID NO: 41594 - DNA, 121 bp, Artificial Sequence
  Synthesized
  misc_feature (61): n=t or c
gaagcagctgatataaaactgtcatcatactttgcactgtagccaaattagcataaaaatngagttacctatcgtttccatccacagagcttacttttaggcaagaatttcagtgcataga

SEQ ID NO: 41595 - DNA, 121 bp, Artificial Sequence
  Synthesized
  misc_feature (61): n=t or c
atcaacagaaaacaaaatggaagataataaaacattttcattccaactacttgatttatangtacacttctatattgtttcgttagactgtttccaaaatgccaaaatgaaacatatagtt

SEQ ID NO: 41596 - DNA, 121 bp, Artificial Sequence
  Synthesized
  misc_feature (61): n=a or g
acgctcctactgttgcttaggtgatgttttttaaaggatgctggttaagtctaacctctcngtttgttcccttcaaagcagttaagaacgtattttgctcacatgtgctattaggataatt

SEQ ID NO: 41597 - DNA, 121 bp, Artificial Sequence
  Synthesized
  misc_feature (61): n=t or c
atctggcactcacacaaactctggagcagcagtcatatagactagctcagtgaagcccagngtgtccaacactcaagacctcggatggctctgctccatctgctctggaggatgtgacgtt

SEQ ID NO: 41598 - DNA, 121 bp, Artificial Sequence
  Synthesized
  misc_feature (61): n=a or t
ctctgcaggctatcactgattctaatcctttcaatatttacatataatttagcaacaaagngattttcttcctccaaattcatctggctgatagctcaattaaattggtaaacacttgagt

SEQ ID NO: 41599 - DNA, 121 bp, Artificial Sequence
  Synthesized
  misc_feature (61): n=t or c
cagaactgagtgtcataggtaagtttacttttctgagtgctgcaaaccttccaaaattggnaaagctttaacccaaattggtttagcaaagtgtcaacgtctgaagtgctgctgagaatct

SEQ ID NO: 41600 - DNA, 121 bp, Artificial Sequence
  Synthesized
  misc_feature (61): n=a or t
tacaataatatatattactaataaactaataaatataatttatgtataaacagctaataanttagagcaagtataatgctatttcttgactgagactttatccgtttcagtttaatttcac

SEQ ID NO: 41601 - DNA, 121 bp, Artificial Sequence
  Synthesized
  misc_feature (61): n=t or c
gcacaggtatttttgctgaactcacactgaagtgagaaaggctaaaattacaccacctgangtgggactggccatgttgctgcactctgctccttctgggtatgcaacctagctgcttaca

SEQ ID NO: 41602 - DNA, 121 bp, Artificial Sequence
  Synthesized
  misc_feature (61): n=a or c
atggaggctaaatctctgttctagcactcctggactttatttggcaatatttggcaaaaanctctatcaagcaggacatgattttactttatgctatgattacttctctagtgtgccgttg

SEQ ID NO: 41603 - DNA, 121 bp, Artificial Sequence
  Synthesized
  misc_feature (61): n=a or g
agaaaggcatatctccaaacagtggattgtcacattctaacataaatgtacatggtagatnggaaggaataccttctgaagatgcctctttctctttactgatggtacttggaaactggat

SEQ ID NO: 41604 - DNA, 121 bp, Artificial Sequence
  Synthesized
  misc_feature (61): n=t or c
tttggactgatgggcagtaattctcctgccatctgccttttgggcaaggatcatgtgtctnccttcctaaattgtgtggtactcttaataaaattcccaaggtgcttgttttctgaaaaca

SEQ ID NO: 41605 - DNA, 121 bp, Artificial Sequence
  Synthesized
  misc_feature (61): n=a or c
taattttactaatgctctgccaatccagtgatctgattatctgtaagtacacgctatttgntcttttagccatgatagaatttggggctaagagcaaaactccctttcagaaaaaaaaaaa

SEQ ID NO: 41606 - DNA, 121 bp, Artificial Sequence
  Synthesized
  misc_feature (61): n=t or g
gacttgccatgtatgtttttaccttcagttttgtagatttgaggaaataaaatagaacttngtttttgcaccactgaaaaagacgaaagggaagaaaggagtcacagatttaggacacaga

SEQ ID NO: 41607 - DNA, 121 bp, Artificial Sequence
  Synthesized
  misc_feature (61): n=a or c
tcttactccttggggagtggagggcatgtgtgaaaaatcaggcagtaaattagaaaaaaancatgcctccatctgcttcccctctcttcttggggctggacaaacaggtaaatatgtcttt

SEQ ID NO: 41608 - DNA, 121 bp, Artificial Sequence
  Synthesized
  misc_feature (61): n=a or g
gctgtggaaacctttagaaataaacttccctttctgtcttaaaagtgcattattgcagctntgtaaatagctattttcctgtatttgaagtgttctttgaactttgcatggagaaagtgct

SEQ ID NO: 41609 - DNA, 121 bp, Artificial Sequence
  Synthesized
  misc_feature (61): n=a or g
tcagcccttccctgcacacaccagagccccagaatacaaaccacaacccgaaaggtccacntggtccataggtgcacttgggagctttgcgtgggaagaatccttcagcacaacagcacta

SEQ ID NO: 41610 - DNA, 121 bp, Artificial Sequence
  Synthesized
  misc_feature (61): n=a or t
gttacagcagttgttatcagggtcctgagtggcctctgtgcattaaaagcgaactggggtnttacttgccccttcaatccttctgttttgcccttcagattttcgggtttgatgaaggcca

SEQ ID NO: 41611 - DNA, 121 bp, Artificial Sequence
  Synthesized
  misc_feature (61): n=t or g
cacagatacaccaataggcacaatggaagtcacaagaggagcatgaaagtatcaggacaanagggaactttccctttgcagctaatgatcttcccttgcagcctgctctgcagataaacac

SEQ ID NO: 41612 - DNA, 121 bp, Artificial Sequence
  Synthesized
  misc_feature (61): n=a or g
attaactcatctgaaattaggccaaaggtacctcaaaatgggacaccagaatcaacagccngcttgaaaatgtaggttatatgatttttctgtattcacccatgagaaaactgtttgactt

SEQ ID NO: 41613 - DNA, 121 bp, Artificial Sequence
  Synthesized
  misc_feature (61): n=t or c
cttggaagtgtgtggggagaaagggatggaaggatgcaaaagacttacagtgtgcttctangtcagaaaaacaattactcagcgtaccagcagcaaaaccgtgcatcatctttccttatgt

SEQ ID NO: 41614 - DNA, 121 bp, Artificial Sequence
  Synthesized
  misc_feature (61): n=a or g
caattacaccagagtcactccaaagatggactacaagataacagtcactgcagataactcnaggggaagctcacctcctgcatccatcctgactaacgtcggcatccaaggtaaagccttc

SEQ ID NO: 41615 - DNA, 121 bp, Artificial Sequence
  Synthesized
  misc_feature (61): n=t or c
tagtagtacctcgacaggagtctttgtgtcgtcaggaggagctgtgttgttaggctgcagnttattgtacctcttaatgtccgtattctatcatttctttgcggctcttgtcttgctgtgc

SEQ ID NO: 41616 - DNA, 121 bp, Artificial Sequence
  Synthesized
  misc_feature (61): n=c or g
attcatagaaaggtcaacattggatgagtcgctgaggttaaactgctttattgtcaaactnagtttgaggcatatatgtgcaatggaatagaaaatgtggaaaatatttatgccatacctg

SEQ ID NO: 41617 - DNA, 121 bp, Artificial Sequence
  Synthesized
  misc_feature (61): n=c or g
ctttcacctgccgttattttggcagggcaatgccattaagacagccaagtacaacgtgctnaccttcctcccgctgaacctctacgagcagttccaccgcatggccaacgtctactttgtc

SEQ ID NO: 41618 - DNA, 121 bp, Artificial Sequence
  Synthesized
  misc_feature (61): n=a or g
atgttggggactaagtcagtgccagtgacataaccatgaaaattttgttgtttgatcaagnaaaaatgacttcatgcctttaagagcagctgctgagaactcagcataacagaatccttct

SEQ ID NO: 41619 - DNA, 121 bp, Artificial Sequence
  Synthesized
  misc_feature (61): n=t or c
taccacttctcaatgtgccccatggcaggggagcagagttggctacagaacaatgtgttcngcagacatgcacctccgctggtgaagccagctctttgtgggatatctagaaaaggagaga

SEQ ID NO: 41620 - DNA, 121 bp, Artificial Sequence
  Synthesized
  misc_feature (61): n=t or c
gtcatgacttcaaggagatctcaaatatgaatattttttaagaagaaagtttcaattccanataaatttgtcattgtcccacttctcttgaggtatactgagttcctacttcctctttatt

SEQ ID NO: 41621 - DNA, 121 bp, Artificial Sequence
  Synthesized
  misc_feature (61): n=t or c
ataaatcaactactgctagagtttggtcactattgtttttcagtacagcatacagttaagnctgacaggttagcaggtgacattaaagcaacatgtgggtaactgttaaatttggttcctg

SEQ ID NO: 41622 - DNA, 121 bp, Artificial Sequence
  Synthesized
  misc_feature (61): n=a or g
acagatgtgcctggaagggaaaacacaaatcttggcatttcagaagtgcccattcacagcnctagccctagaggctgctaattcccttaagctcttcacgtgcctcacacaaaggaacacc

SEQ ID NO: 41623 - DNA, 121 bp, Artificial Sequence
  Synthesized
  misc_feature (61): n=t or g
aactacacgcagtgtttccaacatatttctggacttcatatagattcttaattttctaaanctccagtcacagcagtagcttccttacctgcacagaccttcccgtcgtagatctcacaca

SEQ ID NO: 41624 - DNA, 121 bp, Artificial Sequence
  Synthesized
  misc_feature (61): n=a or g
attgatcttgggacatgagatagctgggttgctctggtgcatagaagttaggggacagganctgcagcctgtgggtacacactgtgcacagcagcgaggtgcttttggtttttaatcggag

SEQ ID NO: 41625 - DNA, 121 bp, Artificial Sequence
  Synthesized
  misc_feature (61): n=t or g
acacatccttatagcttaaaaataggcccttatagccaaatttaaaaaaagctgaacttcnttgggaaagctttataatctgcagttcagtatactttagttacacggaacatttcatcct

SEQ ID NO: 41626 - DNA, 121 bp, Artificial Sequence
  Synthesized
  misc_feature (61): n=a or c
gcatgggatgaaaaggaaaaagtgcatatgcacttaccttagaagtattactcaggtagtncatccaaatgagcagccctgatgctctcattaaaacagacatttacagccttctagtttc

SEQ ID NO: 41627 - DNA, 121 bp, Artificial Sequence
  Synthesized
  misc_feature (61): n=t or c
ttcagatcggcaattatagagctctgcgtaaaacagcacttttccatctcctaagttgagnggatggtctctaaaagagtatttcacaaccaattaaaatcagaaaaagacttaacaagac

SEQ ID NO: 41628 - DNA, 121 bp, Artificial Sequence
  Synthesized
  misc_feature (61): n=a or g
ctgcggccgtttggatctcctgtggtttaccaaagggcacggctggagtggctgctcttanaaatgccattttgcaaaagcagaagaagaaacagatgacctttcagattgcttgcagtgt

SEQ ID NO: 41629 - DNA, 121 bp, Artificial Sequence
  Synthesized
  misc_feature (61): n=t or c
aaggagttcctatactgccgaagtgagatacaagaatgagtctggtaatgctaatggtttnggtaaatggcttaaacaaatgcagagctcagaaggcatgttaggactaacctgccatcct

SEQ ID NO: 41630 - DNA, 121 bp, Artificial Sequence
  Synthesized
  misc_feature (61): n=a or g
actctgcaacatttgggaacatattttgtagactagacaaaatatgcttgacctacatttncaaaaagtatacagcatgaggaaaattcggacagtagggagataattacacagtgtggta

SEQ ID NO: 41631 - DNA, 121 bp, Artificial Sequence
  Synthesized
  misc_feature (61): n=a or g
aaataccaaattgagaagatcaaagctaactgcccattaaccacaacaccgagagagtagnctaattgggatatatgcagctcagtggcttcgctacatcgctcaggttcaacactgcaaa

SEQ ID NO: 41632 - DNA, 121 bp, Artificial Sequence
  Synthesized
  misc_feature (61): n=t or c
cttttctctgacccttggatctgagacttcgagccagtaagaacctgtccacaataactcnctcgatttctttgggtgcaaccaaataattctgcatactcaaatttgaaaatctgtcttt

SEQ ID NO: 41633 - DNA, 121 bp, Artificial Sequence
  Synthesized
  misc_feature (61): n=t or c
aaaggaactagaggcctcactgggttaaaaaacaaataaaacactgcaaggggaataaaangctgccagggatccccaaggcccaaactcaaggaaattatttggtggcacaggaacacag

SEQ ID NO: 41634 - DNA, 121 bp, Artificial Sequence
  Synthesized
  misc_feature (61): n=a or g
ttacacgaataaaccctccctgactcagtctcgagtgaagggcttttgagaggtgatggtnagcaaggaaaaagaattagactgcagcacagcttcacacctctctccagagaggctcatc

SEQ ID NO: 41635 - DNA, 121 bp, Artificial Sequence
  Synthesized
  misc_feature (61): n=t or c
ctcagaaacaaagttctttttccagcttcgcccttatcctgcagctcatcacacctttgcntgtcctgcaaaaaatctgattaaaaatgctacaacaggaacatacatcttatttttatcc

SEQ ID NO: 41636 - DNA, 121 bp, Artificial Sequence
  Synthesized
  misc_feature (61): n=a or g
ttcttttttttccctcctatttttttttttttttttttacctcttttctagattagaaagnagtgattttgaagaacttcttgttgggatgcctcgcatcagcatagctgcagccctgcag

SEQ ID NO: 41637 - DNA, 121 bp, Artificial Sequence
  Synthesized
  misc_feature (61): n=t or c
aagcttgatctctgttttactgagaagtttagatttcaggttaaataataaaaaatcacanaaaaaacctcaaccctaatcaccaagcttgtggagcccggagagcacaaacctaatggtt

SEQ ID NO: 41638 - DNA, 121 bp, Artificial Sequence
  Synthesized
  misc_feature (61): n=a or g
ttctagacaaactcagaaaatgagtaaaattagtgacacatggccaaaaagaaaaaagganaagacaaggcaaaatgtgtgagagctctggtgctaatgcagagagggacttaaagagagc

SEQ ID NO: 41639 - DNA, 121 bp, Artificial Sequence
  Synthesized
  misc_feature (61): n=t or c
ttccaacctcttgcagttatacagccccttaccctgagagaagctgggatgtggtctgttngcccatgttagttaggttttcaaaacctgcctgagtttcccagactccctttggtggcag

SEQ ID NO: 41640 - DNA, 121 bp, Artificial Sequence
  Synthesized
  misc_feature (61): n=a or c
gtgatggtacagccctcactttgtccattgtggctttttttctgcttttaccacaaaatgncttgccccattctgaccgtttttttcatgggttgtcagagctgaatttcttttgaggagg

SEQ ID NO: 41641 - DNA, 121 bp, Artificial Sequence
  Synthesized
  misc_feature (61): n=a or g
ctcatgcaggaatctgatctgtcagcacttccaagtgtttgattatacttctattataaancacacaggagaaaagtatgattttttggtcctgtgttgccttgattactatggtagcttt

SEQ ID NO: 41642 - DNA, 121 bp, Artificial Sequence
  Synthesized
  misc_feature (61): n=a or c
aacatttcaaaagctgctcacaaacaaaacagcccggtcgcacctccttaataccctgcgntgcctgttttcatgaacagcagagccagcctcctctctacccactttaatgctggctttc

SEQ ID NO: 41643 - DNA, 121 bp, Artificial Sequence
  Synthesized
  misc_feature (61): n=a or g
aatggacaatatttgaaattttccatagaagaaatagtaatatttttgaattcgaactctntgaacaaatagataagtgatggagaaagaggatgaattcctttcctggtgtctgtatatt

SEQ ID NO: 41644 - DNA, 121 bp, Artificial Sequence
  Synthesized
  misc_feature (61): n=t or c
tattcacttttccccatttgccatggtttctgtatgactacctcacacctgcagtatagangtctaatattaggtcattgatggatcccataattcaatgctcatttcacagcttggggac

SEQ ID NO: 41645 - DNA, 121 bp, Artificial Sequence
  Synthesized
  misc_feature (61): n=t or c
atatttagagcgtttctctggttatattgcttgtattcccataacttgagtcattgttccnttgcaaagcactgtgtaagtgttcacccaggggaaaaagttgacttttgaagttcacagt

SEQ ID NO: 41646 - DNA, 121 bp, Artificial Sequence
  Synthesized
  misc_feature (61): n=a or t
aaagaacgcatttctgcttccttggcagcaagttggagccattcccttaaaaagcattttnttagaagagtttggaagccacctatgtggccaatttcattcataatctttagatctagat

SEQ ID NO: 41647 - DNA, 121 bp, Artificial Sequence
  Synthesized
  misc_feature (61): n=t or g
gttctccattagtcttcattgcagtatttgtcttcaatttttctaagtggtttataatcanaagtgtctattcagatagtgctaaacatatgtattttgaggtttagagagataaaagcaa

SEQ ID NO: 41648 - DNA, 121 bp, Artificial Sequence
  Synthesized
  misc_feature (61): n=t or c
atgcatgagtgctatttaaactgatgactccccgtcatctgggagctccatgcctccattntaacagcctgctggagggccaccaatggctgagaagcactggataaataaccttctgctg

SEQ ID NO: 41649 - DNA, 121 bp, Artificial Sequence
  Synthesized
  misc_feature (61): n=t or c
aaagtgttgcaaaatgcctttgtcttcataagagattgagtcagggaaaacagatcacaancaatatttgtacgaacacctttgattcaagagtggagggttgtgctggtgtagggttgtg

SEQ ID NO: 41650 - DNA, 121 bp, Artificial Sequence
  Synthesized
  misc_feature (61): n=a or g
gctgctgagctctgaagctggtgctgatgctgaagatgcctctgctggtgccacaaacccnactcacgtctcattttgcgtttgtttgtgtgttggtttttttttccctggtattttctgc

SEQ ID NO: 41651 - DNA, 121 bp, Artificial Sequence
  Synthesized
  misc_feature (61): n=t or c
acagtcagtgggacaaatctctcctcctattcttcatgccctaacactgtacttcaaagcnctatgtattagatgaaatttccaatggcacagttagctatttcagtcaatgggactattt

SEQ ID NO: 41652 - DNA, 121 bp, Artificial Sequence
  Synthesized
  misc_feature (61): n=a or g
tttaatgtctgcagaagaatcgtttatgagaagttttgtctgcagaatatttctggattgntttcataaaggtcctcatagaatcacggatgggttggaagggaccttaacacacacccag

SEQ ID NO: 41653 - DNA, 121 bp, Artificial Sequence
  Synthesized
  misc_feature (61): n=c or g
cattaggtcagaaggctgctctgcctccttgagggggagaacttgctgcctacatatttangttttcaccttggtttgaaacagtgaacaaatatttggtgggatgaaaggagggctgcca

SEQ ID NO: 41654 - DNA, 121 bp, Artificial Sequence
  Synthesized
  misc_feature (61): n=a or g
cctgctttcaacactcccactgggataccttgggcattgcttaatattaagaggtaaaacntgatttttggtgactagagtatataaaaaaattcttctgaaactaaattcctttgccaca

SEQ ID NO: 41655 - DNA, 121 bp, Artificial Sequence
  Synthesized
  misc_feature (61): n=a or g
gaggaagaggagctgttaagagctgattatcttgggacaaggaggaaagaggttgaaaatnggacacgctgcgttactgaagcatattgtctgcaaagcaacatctggcatttagggggga

SEQ ID NO: 41656 - DNA, 121 bp, Artificial Sequence
  Synthesized
  misc_feature (61): n=t or c
atttttgttttgaggtttttgtaatcctttagggtatcagaggcaatataatcactgcctnttcttgagggcttgtggcttctctatccaaacagagacttccagatcaaggaggtaattt

SEQ ID NO: 41657 - DNA, 121 bp, Artificial Sequence
  Synthesized
  misc_feature (61): n=t or c
gggctgctcctggctcccagctggtggtgatggactgggagctacagctgtgacttggaanctctcagccctataaaaccaggcagggggatagatttcatcttaagagagagcaagggtg

SEQ ID NO: 41658 - DNA, 121 bp, Artificial Sequence
  Synthesized
  misc_feature (61): n=a or g
tggaaaataccctgaatcaacacagggcttagatcatattaaaatagacatcaatccctcngttattccttttgctccatggacagccttgtcataaggtttcagtccagtgaatgaagat

SEQ ID NO: 41659 - DNA, 121 bp, Artificial Sequence
  Synthesized
  misc_feature (61): n=t or g
ctggactatattaattatggatctgagcatgcctgcaataactgtcctgcaaatggggaantttgcaacggctgccacagaaaggagcgatgtgcatatatgtgcaaagtgagcaaggcat

SEQ ID NO: 41660 - DNA, 121 bp, Artificial Sequence
  Synthesized
  misc_feature (61): n=t or g
aatggccttctgccattgttgtccaggctcttgcatgtatttttggaggatttgagctgtncgactcattccagttcaccttcattgcaatcctgtttcatctgaacagcagaaacaaatc

SEQ ID NO: 41661 - DNA, 121 bp, Artificial Sequence
  Synthesized
  misc_feature (61): n=t or g
agagcagtactttctgaaggtacaagtcctcagatcccccagtatcctatgggctgatagnaggaaagagctcagggacagaagggctggaaagatgcagcctgcaggggctcagcagact

SEQ ID NO: 41662 - DNA, 121 bp, Artificial Sequence
  Synthesized
  misc_feature (61): n=c or g
aaaataaaattataatcaactcgggctttcaaagattaatgagagcacagaagacagtttncaagaggtgctgagacagaaacaatgaggtcctggctattttgacattgcattttacact

SEQ ID NO: 41663 - DNA, 121 bp, Artificial Sequence
  Synthesized
  misc_feature (61): n=t or c
aatcttttgattaaaacattttctaaagatgacacagaacataagagtcttgcaaaaattnccctggagaaagttattcattctctcatgtgtgtaaaccaagcattttaaatacatgact

SEQ ID NO: 41664 - DNA, 121 bp, Artificial Sequence
  Synthesized
  misc_feature (61): n=a or g
gcactttgtccttgaagtgaagctcttccagttgattttttttccatgagactccctgtcntcatgtacagcctcaatttatacccatttcctgggatagaaagacacgtgactgatcata

SEQ ID NO: 41665 - DNA, 121 bp, Artificial Sequence
  Synthesized
  misc_feature (61): n=t or c
taataaccccttagtaatctgtcctggatctatacccttccaacctcacagcttccttacnggtagggaagcatatgggatataggaacacataagcatagcctagtagctattttatctg

SEQ ID NO: 41666 - DNA, 121 bp, Artificial Sequence
  Synthesized
  misc_feature (61): n=t or c
agttcaaaagaagcccttaagggccctgcttctgttttaagagtgaacagaccccaggctncatgaagtatacaagtatttttgtctgctgcatcagggcagctttcccatttcctttatc

SEQ ID NO: 41667 - DNA, 121 bp, Artificial Sequence
  Synthesized
  misc_feature (61): n=a or g
cttcactgttagcagatctgggccttaagatgtcccattatttgcactatgaatgagcaancctattcttaacagcgaaagaagaaaacagcattgtttgcatggcagcggtagtgctctg

SEQ ID NO: 41668 - DNA, 121 bp, Artificial Sequence
  Synthesized
  misc_feature (61): n=a or g
caccatctcatccaactacctgccagcctggctggggatgccctgggcgttgtgccatgcnctgtgagcagcaccctcatcctgcttatacccttggtgtttaataagaggcgctgaactg

SEQ ID NO: 41669 - DNA, 121 bp, Artificial Sequence
  Synthesized
  misc_feature (61): n=t or g
cacatccagcctggcattgaataagactaactatgaattaagagcagtcacagaaacgagngggaaacatcagctgtctcgaacagtaacatggcactccaggctgcttttcctcataaag

SEQ ID NO: 41670 - DNA, 121 bp, Artificial Sequence
  Synthesized
  misc_feature (61): n=t or c
taacatcttacctgggagcttgtcactatgccatgaagaaccctcttctatccataaatangaacctggaagacttcttttttccttacatcaacttctctcactgttgccacttccaaat

SEQ ID NO: 41671 - DNA, 121 bp, Artificial Sequence
  Synthesized
  misc_feature (61): n=a or c
atttaagcaccagatatctctgcctttctttatagatcagtcttttactcaaaagcttccncattgtcttcactgtctcagccgctgttgtgagtacagcggtcacagaaatagtctcata

SEQ ID NO: 41672 - DNA, 121 bp, Artificial Sequence
  Synthesized
  misc_feature (61): n=a or t
cctttcttgctctgctgctcactcttcagtgaagcataatgtataggatcatggaaaatanggtgagaaattgagctgttgcgacacccttatgacgtgcctttgaagaggcctttgagaa

SEQ ID NO: 41673 - DNA, 121 bp, Artificial Sequence
  Synthesized
  misc_feature (61): n=t or c
ttccattaaaaatgcagcatggagacactaaaaactaagatctcatttgtttttggttagngtaactcaaaaacaagcctgcttacatgaaaactgatgctatttgttcagaactgtggac

SEQ ID NO: 41674 - DNA, 121 bp, Artificial Sequence
  Synthesized
  misc_feature (61): n=t or g
gaggaaaatattgtgaatttctgctttttgtttttttcccctaaaattttccacttcagtngctaattaacatttcagagaaaggaaggttttactaaaaatccagcatttctgcttaagg

SEQ ID NO: 41675 - DNA, 121 bp, Artificial Sequence
  Synthesized
  misc_feature (61): n=a or g
acccatactgcacatgcaatataaaagcagcagaaaaaagccagcttcctttcaagcaaanattagattcctctgcagtcagggaaaccttcccctgtggtaaaagggctattttatccaa

SEQ ID NO: 41676 - DNA, 121 bp, Artificial Sequence
  Synthesized
  misc_feature (61): n=c or g
acctaaatactaacagaatccattgcaatggtaagaaaagaatggcttgtaaaaggagganaaggtggcattttgctcttaacgagtatgtttaatggaatggtgcttattgcatactcca

SEQ ID NO: 41677 - DNA, 121 bp, Artificial Sequence
  Synthesized
  misc_feature (61): n=t or c
agacctctagagaattagttaaagatgtggcttgtctgtctaaaagcctccttcgtaaagntcttttttgttgcttgtagcaaaatgtcacagtggttgtggatctgcagacactgggttg

SEQ ID NO: 41678 - DNA, 121 bp, Artificial Sequence
  Synthesized
  misc_feature (61): n=a or g
gtcttctatatttctgaacaaggtggcccccttcctgcgctaggaatagctgccaacttcnttttgaaggccgctcagcaggttgtggtgttctgcaactgagcgcttttgatatggatta

SEQ ID NO: 41679 - DNA, 121 bp, Artificial Sequence
  Synthesized
  misc_feature (61): n=t or c
atgacaaaataacttttactcgagcaaagcacagcagccccaacataatctctttaaacanctaatgctagtcaaagacaatgaaaggaaagcaacatgggctagaacagtatctaaccag

SEQ ID NO: 41680 - DNA, 121 bp, Artificial Sequence
  Synthesized
  misc_feature (61): n=a or g
gcatatcattacgatctattactaagatgttgcaaaaatcttcctgcctttgctttcaccntttttaaccaacacaatcaggctaaggtttttctactcatattgaccaaaaggctgcatg

SEQ ID NO: 41681 - DNA, 121 bp, Artificial Sequence
  Synthesized
  misc_feature (61): n=c or g
taaagtataggtggtttatatttatcttgctgtactctttggggtctggctgttgagcagntgtctcctgacctgaaccagagcctctataagatatgctatagaactgtgcattcagtaa

SEQ ID NO: 41682 - DNA, 121 bp, Artificial Sequence
  Synthesized
  misc_feature (61): n=t or c
cctttatgtgagtgaagattgacttctgagacccttgtatttaaacaccagtagctgacgngtcaccactgatataggctgtcatttctgattaaaaaaaaaacaaaatgcctttccagta

SEQ ID NO: 41683 - DNA, 121 bp, Artificial Sequence
  Synthesized
  misc_feature (61): n=t or c
aggctccaagcagtgctgcctcgggcaggcaatacccccaggcagtgccaccaaaaagtgnaagagggagtggcagtgccactctaattcaaaatgcatttcaacccacattccttttaca

SEQ ID NO: 41684 - DNA, 121 bp, Artificial Sequence
  Synthesized
  misc_feature (61): n=a or g
ggaaaagagaggtcagacgtggcaaaaggcctcagtggggatacggggataaaccttcctnggggataaaccacacggaaccctcccagggcagcgcagcaggacggcaccgcaccgcagc

SEQ ID NO: 41685 - DNA, 121 bp, Artificial Sequence
  Synthesized
  misc_feature (61): n=t or c
aaaactctttaaagcagcagtgtaactggaactttagttaaacattcattctttcttcagnacctaaagattatcacaacaaattcagctttttactacctgtgactgaaaaaatagaaaa

SEQ ID NO: 41686 - DNA, 121 bp, Artificial Sequence
  Synthesized
  misc_feature (61): n=a or g
tacactgtacatgaaaacatccctggcctttgtcagccacaactgggcttcacactccagncactgtagtatttcttaaccctgacagatccaggtcaaactgtgttcctccacattccag

SEQ ID NO: 41687 - DNA, 121 bp, Artificial Sequence
  Synthesized
  misc_feature (61): n=c or g
tcaaagacatctcctgtgcaacagaggcccattagctcctattaaggctgcagtatcccangccctgtgaggttctgccgtgctgaagctgtaatgaattttgcagggctcttctcctcct

SEQ ID NO: 41688 - DNA, 121 bp, Artificial Sequence
  Synthesized
  misc_feature (61): n=a or t
ctgagtgaaaatcgtgagagggagcactgctgggggttaatgcattagatctgtctctgcnattgaatgcctgcatgactgagagatgcctgaaccatatggcttcttggttggttggttt

SEQ ID NO: 41689 - DNA, 121 bp, Artificial Sequence
  Synthesized
  misc_feature (61): n=a or g
gtgctttccctaagcaacgctttgccttgttgattgtttttcaaaatgctgagcatttttncttcctgtccaaactggcatctctgaaaattgggataggaattataaattactcagttat

SEQ ID NO: 41690 - DNA, 121 bp, Artificial Sequence
  Synthesized
  misc_feature (61): n=t or c
tttctgctactgttggcctctttgaattaatttaaggtaatactccaaagcactttcagcntggtcactgcttttcatgtgactgtcacttctatttcagtgattcacactcgggacaaat

SEQ ID NO: 41691 - DNA, 121 bp, Artificial Sequence
  Synthesized
  misc_feature (61): n=c or g
atatatattatcagcaacttttattttcacttgaagtgattctctagaaacaagctacagntgaatcttccacactgtgagtatacagtttcttcagtcacagaatcatagaattactcag

SEQ ID NO: 41692 - DNA, 121 bp, Artificial Sequence
  Synthesized
  misc_feature (61): n=a or g
acaggaaattttaggaaaccgcccaggtgttcttgctcctttgcttattataattagcacncttgcttattataattagcaatacgtaattaaagcaatgcttttaatttcttttcttaaa

SEQ ID NO: 41693 - DNA, 121 bp, Artificial Sequence
  Synthesized
  misc_feature (61): n=a or g
tttttttttttttaatatatatatataagttgcatttttaaattacaaaattggtagaacnggataaatgaaaggctgtggattttctgaatggtttcatatattttgtatattcaagaaa

SEQ ID NO: 41694 - DNA, 121 bp, Artificial Sequence
  Synthesized
  misc_feature (61): n=a or g
tggcagagttcagttcttgtcttccccctctgctcctccagtgagttgaaggaataaaggntagtgaaaatccaacttatcagagagttcattggactgtaaatcaactatttcaccccag

SEQ ID NO: 41695 - DNA, 121 bp, Artificial Sequence
  Synthesized
  misc_feature (61): n=a or c
ctggcacaggtcctaacttctgtgcaaaaagaaactattatcctttaggacagtgtccagnaagcaataatgtcatacactattcctggacaaggacacctccccagtaatcatatgcttc

SEQ ID NO: 41696 - DNA, 121 bp, Artificial Sequence
  Synthesized
  misc_feature (61): n=a or g
gaacagggcttgcttggttcaggcacccaggatgtgctaaaagaggggcaaaacagaacanttagatagagaaaataattgtttggggttttttttggtgtgtgtgtgtcaaatgaagatg

SEQ ID NO: 41697 - DNA, 121 bp, Artificial Sequence
  Synthesized
  misc_feature (61): n=a or g
attaaatggctttctttttcctttctccctgtgtgtagatatttgtgtgtatgtctgtatntctatacagacagatgaagaactggaggataaaaattggatgagttcttttgtctttcaa

SEQ ID NO: 41698 - DNA, 121 bp, Artificial Sequence
  Synthesized
  misc_feature (61): n=a or g
tttcggagcgtttccctgggagtgcggattgagaaatctggagtcagtagaaaatcaattnagacgcagcagaggtttatcaggaggttggcgcttgctttggtcattgatttgccgcttg

SEQ ID NO: 41699 - DNA, 121 bp, Artificial Sequence
  Synthesized
  misc_feature (61): n=t or c
gttttggtgaactgtgtgatcatggcaggcagtattgcaagcccatctatgatgaccgcgnttgcaaggtcatgggaaatacatgctgtgctttgagatagcagtagctcagctggcatgt

SEQ ID NO: 41700 - DNA, 121 bp, Artificial Sequence
  Synthesized
  misc_feature (61): n=a or g
atatgcatgtcatatttaacaaattagaatatttacaaccctttccacctcccacttcttncagtaacaacagtgctcaacttacgtctgcaaacagcagtcttttttttcattcagagac

SEQ ID NO: 41701 - DNA, 121 bp, Artificial Sequence
  Synthesized
  misc_feature (61): n=a or g
agtttaccacctgtaagatattaatcctcacaacgttcttgtcagcatgtggtattatacngtgtatatacgaaggatgaaggtacagcaggacaagtgagttgtgcctccaatagcccat

SEQ ID NO: 41702 - DNA, 121 bp, Artificial Sequence
  Synthesized
  misc_feature (61): n=a or g
gaccacaccatggccccagcctgggccaaagggcatagatcagagcacacaggaactgatntaactgaatagaatttggcagctaatgagctgtatttggccaagcccaggtgcaagacct

SEQ ID NO: 41703 - DNA, 121 bp, Artificial Sequence
  Synthesized
  misc_feature (61): n=a or g
atattagactgcagatacttctctgcagatgacagggagagtatcctctccaactaaaatngtggatctgcagtataagctgaaattcattggaacaggagaggataaggccccaacaagg

SEQ ID NO: 41704 - DNA, 121 bp, Artificial Sequence
  Synthesized
  misc_feature (61): n=a or g
acagggctgtcaccttgccatgctgctcactgacccatcccacacaattactgtgtggccntggtactgcaccaagctgcaatagggctactaactgctctgtgtgctgcctgccgtgcgg

SEQ ID NO: 41705 - DNA, 121 bp, Artificial Sequence
  Synthesized
  misc_feature (61): n=t or g
cagcgtctggttgtctgtagacagtcacagaacaacagccaaatggacttctgattccctntagaactttttattgaaaactggcagccttatcacattatgcattaattaaatgtagtgc

SEQ ID NO: 41706 - DNA, 121 bp, Artificial Sequence
  Synthesized
  misc_feature (61): n=t or c
agcacagagtcgataggtgtgccctggaggcacccagagcagggggacatctgatttggangctcgtttgcattcctctaaccaatcagacactctaaagacaaggaagaacatcacaacc

SEQ ID NO: 41707 - DNA, 121 bp, Artificial Sequence
  Synthesized
  misc_feature (61): n=t or c
gagcttccacaggtctattgctgtgtattacatttttctgattaagtgcagtgaaaggaanagcaagcaattgctgcctcctagtttatgcaggagttatgtaaggaggtttgttcatttt

SEQ ID NO: 41708 - DNA, 121 bp, Artificial Sequence
  Synthesized
  misc_feature (61): n=t or c
ttgggctagcagttcctcctgtgttctggtatcaacaaaatctacttctttcaagaggttncaaaaggagtctaagtgattggttggttcacatgattatttggtaagctccgaattcagc

SEQ ID NO: 41709 - DNA, 121 bp, Artificial Sequence
  Synthesized
  misc_feature (61): n=a or g
ctacagtctctagtagatcaaacatgcaatctgtcagtggagcactgtggtccagagccantttctttcaggtcttaagatgaagatgactgtagtggttctacaaagatgtgagagtcaa

SEQ ID NO: 41710 - DNA, 121 bp, Artificial Sequence
  Synthesized
  misc_feature (61): n=a or g
gctatggatagcagggctgtgttgaggtgagctattcagatttcatctaaaatcttaaaantagcactgtaaataggaatttggaatagctatctctgtctacggtgtactttgcattaaa

SEQ ID NO: 41711 - DNA, 121 bp, Artificial Sequence
  Synthesized
  misc_feature (61): n=a or g
tttgatgtgtctgatggctccagttgttggtcagaaagcccttaggatagccaagtgctgnggccttttgctgtagagagggcccagatcggtgcggtgagacattgcctttgctcagagc

SEQ ID NO: 41712 - DNA, 121 bp, Artificial Sequence
  Synthesized
  misc_feature (61): n=t or c
attactgtgatctgaatggatattactttttcattcactttaaggctatttctgattgctngattggaataaagagaccagagtgtaactgggcagttgattccaaggtttcacctcagca

SEQ ID NO: 41713 - DNA, 121 bp, Artificial Sequence
  Synthesized
  misc_feature (61): n=c or g
caaattcaccagacgaaaaactcaaatgagccacaaactcattcattatcattctgaaaantacactcaatctcaacaccgactgagcaaaatacatttaagcaggagcagaaggagagag

SEQ ID NO: 41714 - DNA, 121 bp, Artificial Sequence
  Synthesized
  misc_feature (61): n=a or g
gtttgcttgttgtgcccgtaatccctactcactgagtttaatagcccagctccaggagccnggttatgatcaggttggtggccgtggccttcaagagcagctcttggtcctttggataagt

SEQ ID NO: 41715 - DNA, 121 bp, Artificial Sequence
  Synthesized
  misc_feature (61): n=t or c
gaatgcctgcagccaacacggctttgatccagagaagcgggacatttccatctcctgctgnctgcttttgcatggaagggaaccgagaagcccaggtgccgcacgatgggtggctttgggt

SEQ ID NO: 41716 - DNA, 121 bp, Artificial Sequence
  Synthesized
  misc_feature (61): n=t or g
tttctccaccattcttccaaaattaatccacatggataatacagacttaataactcagtcntaccatgactactgctacagttggcagtaggaggagtctgctgtccaaggagaatagtgg

SEQ ID NO: 41717 - DNA, 121 bp, Artificial Sequence
  Synthesized
  misc_feature (61): n=t or g
aagatttttttcataaagccatatttttattcatatttttccaggactttatgagtgtttntcggtgtaacaatttattaagacatagtgcatgtatcttatcaaacaagatatgaaaaat

SEQ ID NO: 41718 - DNA, 121 bp, Artificial Sequence
  Synthesized
  misc_feature (61): n=a or g
ccccagctccaagcccgggaagcccccatccccactgcagagcccacagcaagcaggggtntgattttctcctccccttcccctgccaccacacaggctctgatcgtaacaaagtaattga

SEQ ID NO: 41719 - DNA, 121 bp, Artificial Sequence
  Synthesized
  misc_feature (61): n=t or c
aggggaaatgcatttagtacacatggaaagtgattttataatcacttaacatagatatatntgggtcttgtaaatatttgtttttcctggtcagtctttgctcatgtgctctcctccagga

SEQ ID NO: 41720 - DNA, 121 bp, Artificial Sequence
  Synthesized
  misc_feature (61): n=c or g
aataaattgaggaaggaatggcaaccaaaatggaatcagtgagtgaaaaatgactttcctncattacacttcctagcatagccattcagcactttcctatttcagctgcttctgaggccca

SEQ ID NO: 41721 - DNA, 121 bp, Artificial Sequence
  Synthesized
  misc_feature (61): n=a or g
ccacggggctgattagctttttcatgatgctttctacatattcggagagatgcacttctgnatcgggtaaaattgtggctcttaaaatcacgatacagctacacgggggaatatgatagta

SEQ ID NO: 41722 - DNA, 121 bp, Artificial Sequence
  Synthesized
  misc_feature (61): n=t or c
acacggaattttatacatagagacccagcggccttacctatgtgaattcagcagcatgccnagctaccagccgacacggatgctctccatcaacaccctaacaaccagccctctaagacaa

SEQ ID NO: 41723 - DNA, 121 bp, Artificial Sequence
  Synthesized
  misc_feature (61): n=a or g
ttcctcgctctgctcccacccccccatgtgctcaaggggaggaaactactgttaatttcantgaaatgaacttacattgttgttttgcagctcggcaataatttctacgtggtgccccagg

SEQ ID NO: 41724 - DNA, 121 bp, Artificial Sequence
  Synthesized
  misc_feature (61): n=t or c
tcacattgtggtatttttttgcctattatctgtgggactagtggttattctcctctaacanaagccatgaatttttagatagatgtgattggaattggtccactgggtcagatataattgc

SEQ ID NO: 41725 - DNA, 121 bp, Artificial Sequence
  Synthesized
  misc_feature (61): n=c or g
gtggttatttattaccacgtctgctggactaaaattaggtagaagaggcatcttccccttntaacctcgggggtgactgagggaacaacagtgaaacaaccagttaaaaagaactgaaact

SEQ ID NO: 41726 - DNA, 121 bp, Artificial Sequence
  Synthesized
  misc_feature (61): n=t or c
gggaagtgcagttcatggcccttcctaggttggggtttgggaggcacagatgtgtcatatntgctccagctgttcatatgtcacagaggccttggccagaaagaattaggtaggaacaata

SEQ ID NO: 41727 - DNA, 121 bp, Artificial Sequence
  Synthesized
  misc_feature (61): n=a or g
gttaactccctgctgacagaagcctgccttctgccttaaatagagacattttgtgccttcntgtattttgtagattttcactaaaccgtgattaacatgcctaggtggagaatatagagtg

SEQ ID NO: 41728 - DNA, 121 bp, Artificial Sequence
  Synthesized
  misc_feature (61): n=a or g
attcagcaagccatatcccagagtaatagatgtctgcatgtgttccaaatgaggggggganaagtcaggtgtgtgaagtccagataatgcagaaataagcattgaatctggtgtctccttt

SEQ ID NO: 41729 - DNA, 121 bp, Artificial Sequence
  Synthesized
  misc_feature (61): n=a or g
tcttgattttgaagccttttttccctttgttgtatactttttgattaaagaccacccactnttatacattctgagaaacggtggccccacagcagttataaatcaatagctagatgtagaa

SEQ ID NO: 41730 - DNA, 121 bp, Artificial Sequence
  Synthesized
  misc_feature (61): n=t or c
attagggagctaggtcttcacatcaggatctcctgttcactgtgacattacctctgtgggntacttcatcacttctaattttctcaacaagtttctcaaatacaagtttcagtgaattgac

SEQ ID NO: 41731 - DNA, 121 bp, Artificial Sequence
  Synthesized
  misc_feature (61): n=a or g
tctcctcctaatcttggtgcagaaactcctcaggggtaagatatcagttcataccttcatngacttttattctttcagaagtaattcaagtttgtagcagaataaacatagtttgtttttt

SEQ ID NO: 41732 - DNA, 121 bp, Artificial Sequence
  Synthesized
  misc_feature (61): n=a or g
aagccaccaaagcctgatgtgacaacatgcttccttcctgccttcatcttctgtcatctgngtaaagagcagctctctgaagattgccccaaagatgcttctgcttcctcttgtttctatt

SEQ ID NO: 41733 - DNA, 121 bp, Artificial Sequence
  Synthesized
  misc_feature (61): n=a or c
ctgtgacagatacatgaaacataatcagcaatagaattcccagaattcaggcttaaaaaancgcaagaataacaatttgagataatctcctgttttggttctcagtttgtctttgtgcaaa

SEQ ID NO: 41734 - DNA, 121 bp, Artificial Sequence
  Synthesized
  misc_feature (61): n=c or g
gcgctttgcagggagagctcggacagacactgaaggaagcacagaggtccttcagggtgantgcactagaaagaacagagtctcggtgtatcaaaaatgcagccaggtttccattcaagtg

SEQ ID NO: 41735 - DNA, 121 bp, Artificial Sequence
  Synthesized
  misc_feature (61): n=a or c
atcaacattcatgttgcaccttgctttttgtcacagttatccaaattagttcattcactgntccagccagtgaagagatatgaatgctggctgaactagcccatagatcagggtgtgcctg

SEQ ID NO: 41736 - DNA, 121 bp, Artificial Sequence
  Synthesized
  misc_feature (61): n=t or c
gccagtacaccaaaaatgcttttgttgcttcactggctactcaagatttctttcctctttnagcaagagaagcatgcatacttctgaaagttgaaggaatagggagggaggacaatgcaca

SEQ ID NO: 41737 - DNA, 121 bp, Artificial Sequence
  Synthesized
  misc_feature (61): n=a or t
tgacaattcaaagacaagctacatgacacatcctgtatttctggcctcccaagctgtcttncaatagcctgcagatcagctgaaagaaatacctctgtaaaaacttctccaaaacagtttc

SEQ ID NO: 41738 - DNA, 121 bp, Artificial Sequence
  Synthesized
  misc_feature (61): n=t or g
ggtgctctgttcatgactttagacatttgtccagtctcttctccctttatggagatgtagntcaaatgctgttgaaagacccatttgttttggagcagatgtgctcggtccagtggtccaa

SEQ ID NO: 41739 - DNA, 121 bp, Artificial Sequence
  Synthesized
  misc_feature (61): n=a or t
tatggtaaaactataaacatgcaagcatcaattaactgtgttggaccaaaagaccatctcnctacgtttcccactgaggactggcttccaagcctacagcaatttgtggcccagagatttc

SEQ ID NO: 41740 - DNA, 121 bp, Artificial Sequence
  Synthesized
  misc_feature (61): n=c or g
gaaggtcaaaagcattacagctcttgggctacagccgttgcttaccactttggagagcgtnctggggcctggccatgcaatctttatgtgagcaggagatgttggaccgcatccagagaag

SEQ ID NO: 41741 - DNA, 121 bp, Artificial Sequence
  Synthesized
  misc_feature (61): n=a or t
aagcaaggatgacaaaactgaagaaaactcctatgggagcagggataagagtcagagagtnctgggcttcaagtagatcctaaaggtcatgttatggttttattaattttaattaaattct

SEQ ID NO: 41742 - DNA, 121 bp, Artificial Sequence
  Synthesized
  misc_feature (61): n=t or c
aatttcagctcgtgaggactgcagttttaacagtatgaacacagacagttagcttggcatntgggggagtcctgagattctatctgttctactgcatggaataaatagtcttaagtgactg

SEQ ID NO: 41743 - DNA, 121 bp, Artificial Sequence
  Synthesized
  misc_feature (61): n=a or c
gcattacttttggagcagcatatgtatttgcatctgttttctccagacattaaactatatnacacaaaaattccaactaaatgtgatgagattgctcacaataattgcattattcccatgt

SEQ ID NO: 41744 - DNA, 121 bp, Artificial Sequence
  Synthesized
  misc_feature (61): n=a or g
gattatagaaagttacaaacaaactacactatattgactggtgtaagacatataaagtccntttcaggaaggaaaggacttttccatgcttactctacagtctctgctgatgtgctgctaa

SEQ ID NO: 41745 - DNA, 121 bp, Artificial Sequence
  Synthesized
  misc_feature (61): n=c or g
tccaggcattaataattcacatcagtgcagccaggtgttgcctgggaatgagaagccagancgtcacccgccacacatgcagagagcacagccacggccccaccagcaccctcctcttgtt

SEQ ID NO: 41746 - DNA, 121 bp, Artificial Sequence
  Synthesized
  misc_feature (61): n=a or g
gcttcatgtttattaaagtatatgtgagctgttaaacgttttggaaagaaattcaagagcngacaagatcatagatatgtatgcaactcatatttaacttttgttttaacttatttcatgt

SEQ ID NO: 41747 - DNA, 121 bp, Artificial Sequence
  Synthesized
  misc_feature (61): n=a or g
gggaccacattgccattggagatgcaagtgaagtttatatgttttcagggacttttcaaantctatatatgtagttttattaattaccattcccaatcaagactgggaatcaaacccacaa

SEQ ID NO: 41748 - DNA, 121 bp, Artificial Sequence
  Synthesized
  misc_feature (61): n=t or c
gatctcagggcttgctggctcccagcgcttctccacctgacaccaggccagcggcactggnggaaggaaaggcagcagtagctcaagggccacagtgctgcatgccagtgtaccaacctac

SEQ ID NO: 41749 - DNA, 121 bp, Artificial Sequence
  Synthesized
  misc_feature (61): n=a or g
tatgggtttcaggcgagtttatagcagttcttatacacacacacctacttttgactggtantttttggaataaaagactgaaactgccaaatatcaattctctcatccacaacataaaagc

SEQ ID NO: 41750 - DNA, 121 bp, Artificial Sequence
  Synthesized
  misc_feature (61): n=t or c
tgtacaccggctttctgcgctgcttttcagtgtaagagaaaactgcattgtctttcacctnttcagggagctttgtagcacgcaccaggctgtgtgatagagacaaggagggtgaactgga

SEQ ID NO: 41751 - DNA, 121 bp, Artificial Sequence
  Synthesized
  misc_feature (61): n=a or g
gggatggacaaaagggttcaaggcaactgattgtgaaggggaagatgttgttgatatgctnagggaggccatcaggagaagaaatgtgagctattcttatttgagcttcctgatgtattca

SEQ ID NO: 41752 - DNA, 121 bp, Artificial Sequence
  Synthesized
  misc_feature (61): n=t or g
tccagtccaaccctcaaaaaaagagaatatatgaccacaatgtttttttaaggttttcttnttcagattatctttgataacatagaagagacaaaaccctgatagaggaagacactgcaga

SEQ ID NO: 41753 - DNA, 121 bp, Artificial Sequence
  Synthesized
  misc_feature (61): n=c or g
tatttgcagttgcaggaagacgtggggagggatgctgaggttgctgcagtgtactgtactnagctgtatgttgcttctgacctttacgacccttattttttgtcaactattctactatttg

SEQ ID NO: 41754 - DNA, 121 bp, Artificial Sequence
  Synthesized
  misc_feature (61): n=a or c
cctggtttccttcacctttggttttgctgattgatattaatatagaagttgtgaacctttnctttcacaggagcagtttatagattctctaatggattcaatcatctttttcttttcaata

SEQ ID NO: 41755 - DNA, 121 bp, Artificial Sequence
  Synthesized
  misc_feature (61): n=a or c
taaccgtagttaaaactaaccagcagatttagagattaggagtgcagcctcagtgtgatangattgataaaatgctaggtttacgtagtcagagaaccctctaaagatggtttccatgaga

SEQ ID NO: 41756 - DNA, 121 bp, Artificial Sequence
  Synthesized
  misc_feature (61): n=a or g
tgactttccctcccgcactgtttaagatctggcagggaagaagttggtaccaagcccccancgctgcgacagcggcggtggcagcgcccggccccaaccccgaagcccgagggggcgagca

SEQ ID NO: 41757 - DNA, 121 bp, Artificial Sequence
  Synthesized
  misc_feature (61): n=a or c
aaatgcccgtttccgaagcgcagagccatactttcagcttcaactcaagtgtggatttgcnagtaggaaaccaaccaaaccgaacccaaccaaaacgggagcgaatgccttttgggagacg

SEQ ID NO: 41758 - DNA, 121 bp, Artificial Sequence
  Synthesized
  misc_feature (61): n=t or c
tgtctgcaaatattctttgttcttgcatcttacagcagcaaaaaccctccataaaggtggnctgtgctgttctcagtgctatggggtgtgactaggtggtgatgcagtgtccaatagctga

SEQ ID NO: 41759 - DNA, 121 bp, Artificial Sequence
  Synthesized
  misc_feature (61): n=t or g
gggcaggtggtggtcttttctcatggtgactattggagcattgtttccataagaaatctgnccccaagttttatttcaccagacaaaacccagagcactctgaaagcaaatccaggcccca

SEQ ID NO: 41760 - DNA, 121 bp, Artificial Sequence
  Synthesized
  misc_feature (61): n=t or c
agccgttttgcttgggcacttgcttcgtcccactgcaaagcagctgaaatcccacggcacngcctgcactgagtttctctcgggctctatggattccagctgaccacatccccacaacctc

SEQ ID NO: 41761 - DNA, 121 bp, Artificial Sequence
  Synthesized
  misc_feature (61): n=t or c
tgaataagcatcacagtcctttgagaaattcagtcagtgacaaacatacaaatgtatcctnctccgcattttggaaagataaagacatagcagggaatggaaagtatgatactgttttcta

SEQ ID NO: 41762 - DNA, 121 bp, Artificial Sequence
  Synthesized
  misc_feature (61): n=t or c
tgaccactcttttggagaagtgtttcccaatgtccaaggcatattgagttacatcagaagnctacatttaggcaacataattgcacccaaaatgcttgtaatgctgtacacaatacaaaat

SEQ ID NO: 41763 - DNA, 121 bp, Artificial Sequence
  Synthesized
  misc_feature (61): n=c or g
ccacggaggtgaggtttggaggtcttcttgatgactattggccattccaactaactgtcanggagcactgcttccactggggatggaggaaattgctgatgataggaagaacaggtttccc

SEQ ID NO: 41764 - DNA, 121 bp, Artificial Sequence
  Synthesized
  misc_feature (61): n=t or c
ttttataaccttggctttatctaaatctgtatctttgggaaattcttccagactgtttcantttagttcctggttagtagagaaacataaaatgctgctacttctagtgcttctgcaaact

SEQ ID NO: 41765 - DNA, 121 bp, Artificial Sequence
  Synthesized
  misc_feature (61): n=t or c
gtttctgtaagaatacattatggagtagccaaataaggccacttaatagaaaatcataatntttgaaaactgggcaatgggatgacataaaaaaatgttgatgtaagtaaaattatggacg

SEQ ID NO: 41766 - DNA, 121 bp, Artificial Sequence
  Synthesized
  misc_feature (61): n=a or g
cagcccaggttgcctactggaagagctgcagtcactcagcgtgtcagctacagatcacgtngagaatctcaagcactgacaggcatggtttttgccagcattgccttgcaccaattggacc

SEQ ID NO: 41767 - DNA, 121 bp, Artificial Sequence
  Synthesized
  misc_feature (61): n=t or c
catcactactctagccaccatccagaatagaaggataaacatcatcaccttggcctgatangctaaaaactcacaaaccaataaatatttgctgttgcagactacagtacaagaatctcaa

SEQ ID NO: 41768 - DNA, 121 bp, Artificial Sequence
  Synthesized
  misc_feature (61): n=t or c
agaagacatggcacttcttttgatgatggttaaattgatagtcttttctttactggttacngttgaagtcagcatggagttctcctagttgaagcctcctatagagtgtactttgtagaat

SEQ ID NO: 41769 - DNA, 121 bp, Artificial Sequence
  Synthesized
  misc_feature (61): n=t or c
cctgcccccagagctgacaggattgaccacatagtacagtgcagcatttactttgaaaagnaaaaggaaattcactgtctggcattttacagcacacaggatggcatacccataatgaaga

SEQ ID NO: 41770 - DNA, 121 bp, Artificial Sequence
  Synthesized
  misc_feature (61): n=t or c
ttttattcaacaccagataggtttaaagatactcagccatgtgcacgtaatagattgaagncataagagaaaactgagcagctcacaatctcttgcctgcaaaggcaagctttaaagggaa

SEQ ID NO: 41771 - DNA, 121 bp, Artificial Sequence
  Synthesized
  misc_feature (61): n=a or g
caagagaattagattcactcttaccagtgtttatcatttggaacagcagtggcagaaggancagccatacaacccttgcttatgactgcagtcattctgtcctctctgaggtgttagtaca

SEQ ID NO: 41772 - DNA, 121 bp, Artificial Sequence
  Synthesized
  misc_feature (61): n=a or g
agatctgtctcaggtcagaaaaggacgtttgtgtcactggttatcataagcacatcatgcnttacaaacttggtatatttactcaatcacatcaaaagactgtgcaccacccctgtgtcct

SEQ ID NO: 41773 - DNA, 121 bp, Artificial Sequence
  Synthesized
  misc_feature (61): n=a or t
tcaggcaggctggactcagagcgagatgtcttctgaggcttttccagcactggcctggacntctcaccccttgacttgagcagtttttgtgacttggatcctggtggatgctgtccagatt

SEQ ID NO: 41774 - DNA, 121 bp, Artificial Sequence
  Synthesized
  misc_feature (61): n=t or c
aaaaggtatttaaaaggagaaagatgacatttcagacatctagaattgaagatcacagtgnaatgctcagatctggaggtgttcatcagcttagaaagcgtagctcgccaactgtgaggta

SEQ ID NO: 41775 - DNA, 121 bp, Artificial Sequence
  Synthesized
  misc_feature (61): n=a or g
cttccttttagaagctgcattgtgatgttttataactactgtcttgatacagagtaaaaanaaatgatagtaacaaacatttcatttatgtcacagcttcctgagctcttttccatagcgc

SEQ ID NO: 41776 - DNA, 121 bp, Artificial Sequence
  Synthesized
  misc_feature (61): n=t or c
agaattgtgggtgttttttccacatctcatcctcaatcatctccacccagcagcacgcggngcgtgcgccccaagtgtctcacacatggacctccccagtcactgggaaggaaagtaatta

SEQ ID NO: 41777 - DNA, 121 bp, Artificial Sequence
  Synthesized
  misc_feature (61): n=a or g
aggaacctctcttcaaccagcatctctgctgccaggctgtgttcactccaattatgactgnattaagaaaaactgaccactgactcctgttcaatatgacaaactgcaagaacctggcaaa

SEQ ID NO: 41778 - DNA, 121 bp, Artificial Sequence
  Synthesized
  misc_feature (61): n=t or c
ttttaaggaactcccatactagtataaaaatacagaaacttagaacatgagttacagaagnaatggagtgcttaaaacataaaataatgttaagtcttttcctgtgcaaggctgtgcaaat

SEQ ID NO: 41779 - DNA, 121 bp, Artificial Sequence
  Synthesized
  misc_feature (61): n=a or g
tgtcgtcgtcgttctgtttcaagctgaaataccctttgacggctgtggaagggtttccagncggtcccaatagcttccaggggaagaggttaaagactcgggtggttcttttcattctcca

SEQ ID NO: 41780 - DNA, 121 bp, Artificial Sequence
  Synthesized
  misc_feature (61): n=t or c
tgactttgtggatgcacaacaactcgaagacatcattttgtattgacaagcatctgcaagnatttgagaataggaggaaggatatgtgtgtgtatatatatataacccatcaccacttctt

SEQ ID NO: 41781 - DNA, 121 bp, Artificial Sequence
  Synthesized
  misc_feature (61): n=a or c
ctccagccctctgatcatcttagaagaacaacaatttattacaggtaagcccaaacctttntataagagcatttatccatatattttcaacattatcatgtgcagggctgaagctagggaa

SEQ ID NO: 41782 - DNA, 121 bp, Artificial Sequence
  Synthesized
  misc_feature (61): n=t or c
aaacaaacaaacaaacaaaccaaaaaactcttcatccagctgtcaggatataacaaaaacngtgagtgaaattgagatgtgcatagtggaagctttgcttgtggaggaaggacagaaaggt

SEQ ID NO: 41783 - DNA, 121 bp, Artificial Sequence
  Synthesized
  misc_feature (61): n=a or g
aatgggagggatgggaagagacagtaactctcttggacagagcaagtctcttaaatcctcngctaaccattaaatccttcctatgcttagtggtctccaactggctgttttggccattcat

SEQ ID NO: 41784 - DNA, 121 bp, Artificial Sequence
  Synthesized
  misc_feature (61): n=a or g
aaagctgtgcagttgagcccataacgccaccctccaccaccgccttcttcagctgcataancattttgtaatctacagggctccaatgtctctgtccttgcgggtcatttatcaccgggta

SEQ ID NO: 41785 - DNA, 121 bp, Artificial Sequence
  Synthesized
  misc_feature (61): n=t or c
ttttaagtgcaaacgagtataaaaatgacttatctatccctttggctagatattagcatangtgaagatgctacagctggacaaccaggtcttactgtagctgtccctgctcactgcagag

SEQ ID NO: 41786 - DNA, 121 bp, Artificial Sequence
  Synthesized
  misc_feature (61): n=a or g
ccctttgtatctctcttagagtttcctctcctaactgctgtttcttcctactcagcagccnctgtttgttcctctgtatattcaactttactactattcaaaagatggatgactgttacaa

SEQ ID NO: 41787 - DNA, 121 bp, Artificial Sequence
  Synthesized
  misc_feature (61): n=a or g
cacaggagatcatcacagctttcaggctaaaagacccagatcttttagtccatttttcatntaactgtttggtaatatgttggaacaggctgcttagggaagtggtgaaatcactgtccct

SEQ ID NO: 41788 - DNA, 121 bp, Artificial Sequence
  Synthesized
  misc_feature (61): n=a or g
tatatatacaatcatttattgtgctgttgtttataaatcttagttttccaaagtactcatnttccattgctacacaaatatcacacggtacactgtttttttccaagtgcttgctagtcta

SEQ ID NO: 41789 - DNA, 121 bp, Artificial Sequence
  Synthesized
  misc_feature (61): n=a or g
ctagcagtgactcttctttcagctgtagattaggatgtgccctgcacccaagcagcctggnaccatgaatcagcaaggcagggagggacttgcaagtccctttaggtgtgttattgccaag

SEQ ID NO: 41790 - DNA, 121 bp, Artificial Sequence
  Synthesized
  misc_feature (61): n=t or c
cagactgcagtgttctgttactcccccgctgatatcacgtagatatttcccttgtcttttnagctgtctgatcagatccaaaatatgattaatgatgtcttctggacacaaatttaaggaa

SEQ ID NO: 41791 - DNA, 121 bp, Artificial Sequence
  Synthesized
  misc_feature (61): n=t or c
ctccacagggagcatcctctaaaataccttccccagtgtcatcctcaggaagatagaaatnctgatgctcatcagaaagatatcatacaaccttgtgcttcaccctactgttggtagacac

SEQ ID NO: 41792 - DNA, 121 bp, Artificial Sequence
  Synthesized
  misc_feature (61): n=a or c
gttgccaaagcaaaaagggctaacagctgtgctgtaagcccgctgtgcaacaccggaaggngacgcagcactacctcacgctgttgctctgggaaccggtgcccgcatttcccggactgac

SEQ ID NO: 41793 - DNA, 121 bp, Artificial Sequence
  Synthesized
  misc_feature (61): n=t or g
atcaataattcagcaaataacatatttaattaaatcatatagtataagatctcaacaaccncttggaaaagttcctgattctgcatgtatgtattttgccaaatctgcctcaataaatcca

SEQ ID NO: 41794 - DNA, 121 bp, Artificial Sequence
  Synthesized
  misc_feature (61): n=t or c
cctctttttccttttgctcctgtctagactgaaagggaaaaacaatgattttacagtaganaatactgagcaacatcactgctgttcttactcgccccgtaagtgaaactccgcctactgt

SEQ ID NO: 41795 - DNA, 121 bp, Artificial Sequence
  Synthesized
  misc_feature (61): n=a or g
aatttgtgactgctgggagtttttgtgtgatacaagccaggggctggagtggggatgtgantggacaaccaaatccaggagtacatgagaagcaattcctctgagatgtgcccgagcacct

SEQ ID NO: 41796 - DNA, 121 bp, Artificial Sequence
  Synthesized
  misc_feature (61): n=t or c
gctcctggtggagcagatttttacctggttgcttgtggcagtgaggctgctcaagctgggnagagcacctcgcatacccagccctaaattgctcctactttcaatctcctttccacactga

SEQ ID NO: 41797 - DNA, 121 bp, Artificial Sequence
  Synthesized
  misc_feature (61): n=a or t
accagtataacacagtgccatttaaccaattgcctggatttacaaaccaaaatataacttngtaaactggccacgttcaatcacacatttctctttagaagaaattactgtgcctcctgat

SEQ ID NO: 41798 - DNA, 121 bp, Artificial Sequence
  Synthesized
  misc_feature (61): n=a or g
attattaagagacaaaatagtttgtgttcaagcatttcctttttgcagtaccatagactcnctaattaggtgcagaaataactaaaatgtcagcaaagcttcagttttatctagagcagca

SEQ ID NO: 41799 - DNA, 121 bp, Artificial Sequence
  Synthesized
  misc_feature (61): n=t or c
ttggataacaatccaagaacgtacacacacaccattccttccctgccagtttgatgtctangtgccctttgaagaaaaggacaaagtaaaagcaaaatgggggaagattctgagcccaccc

SEQ ID NO: 41800 - DNA, 121 bp, Artificial Sequence
  Synthesized
  misc_feature (61): n=t or g
agtgttgttctgagggttctgttgcaccatcatcccacaaaaccccaaattacagaggtgngggggggggaaggatatatttctaaatttgtagctgagataattactagaaagttgagtc

SEQ ID NO: 41801 - DNA, 121 bp, Artificial Sequence
  Synthesized
  misc_feature (61): n=a or t
taattgagctcaataaaaggatagaacaggggcagtgaattgccttcttcttaaaaaaaanttcttgagcttgctgttttcaaatattaataaataaccagaaaattctacattctcttgt

SEQ ID NO: 41802 - DNA, 121 bp, Artificial Sequence
  Synthesized
  misc_feature (61): n=t or c
tagatcaccagaaggctgaataaaccacaagagtacttttcaaattggagcgctgcaaacngtggcaccaccatggctaatatgtcaatatagctggccttcagtagtgactagcttgtat

SEQ ID NO: 41803 - DNA, 121 bp, Artificial Sequence
  Synthesized
  misc_feature (61): n=c or g
aaaatgagagaggaagatctttgtaagcccaaggactcgcccttcagaacacagatgtggngaggtggtcccaagccccctgtctgcaccaaccaccactaatccgcctgtctccagcagt

SEQ ID NO: 41804 - DNA, 121 bp, Artificial Sequence
  Synthesized
  misc_feature (61): n=a or c
tcttatatctatgtccacttcttttactttttattcatttacagagtaaataagtgtattnatattcatccatactacactgagagggtatgaaacagagaatttccatttgaaattactt

SEQ ID NO: 41805 - DNA, 121 bp, Artificial Sequence
  Synthesized
  misc_feature (61): n=t or g
tcaggtaaataatcacatatattgcttaaattatagcaatgtccaggtttacattaaatangtactttcctctgtatatactgatgaggcaacctcagatccaaatatccaagctaaacta

SEQ ID NO: 41806 - DNA, 121 bp, Artificial Sequence
  Synthesized
  misc_feature (61): n=a or g
tgcccaagcacccttcctcaggtgccacagctttctcctaacacaacagcactgcctggcncgctgccagcgatgtgcaagtgcagcacttggctcattttctgatcatctttgatctacc

SEQ ID NO: 41807 - DNA, 121 bp, Artificial Sequence
  Synthesized
  misc_feature (61): n=a or t
aaaaaaaaaagaaaataacggatccaaatttgaccgtcactctgaacattgataataaaantagagtaagcttttctaatattacattcaatctaagttacaagttgcatcaagaatgcct

SEQ ID NO: 41808 - DNA, 121 bp, Artificial Sequence
  Synthesized
  misc_feature (61): n=t or c
atgggaggaatgtttgcttttgaaaatgtggggtagactgtccatgactgtgggggagatngaataccatgcagtgatctacactgcatgatgcgcagaaatggtctggctttgtccctgt

SEQ ID NO: 41809 - DNA, 121 bp, Artificial Sequence
  Synthesized
  misc_feature (61): n=a or g
ctcggccaataaatgcttcacaaatccagaccaacactcatttgtccccgtggatcttttntcttgaattgtacctttacaaacattttgacatcaaaaataaatcacgtgaaataatgag

SEQ ID NO: 41810 - DNA, 121 bp, Artificial Sequence
  Synthesized
  misc_feature (61): n=a or g
cttgcagaaacaagccaaggaacctttaattagcgcctttaattagagggtgggactcccnttttgtatcttacctaagggactgcacgggcaccaagtcttgcagatgtcaccttagggc

SEQ ID NO: 41811 - DNA, 121 bp, Artificial Sequence
  Synthesized
  misc_feature (61): n=a or g
caggaaaacctgctgatcacccttcaacaacaaaaagttgcttggggagattatgggtgtnctaattatcaacataacttgtctgggcttacagatataaagcaattctcttgcaggaagc

SEQ ID NO: 41812 - DNA, 121 bp, Artificial Sequence
  Synthesized
  misc_feature (61): n=a or t
tagattcaaaactaaattatttttattaattactatgatcatatgtgctgttcagtttagnacaaatgagtgaatgctgaatgtcggtattgactttagtacaaatcaagttaaaaattga

SEQ ID NO: 41813 - DNA, 121 bp, Artificial Sequence
  Synthesized
  misc_feature (61): n=a or g
gccatcatgaaggcaatagctgatgtcatcatagcttgaagcagctgcagggagtgcaagncatagctccaaagtgttgatctatatttaatataaagatattgattacattcacagagta

SEQ ID NO: 41814 - DNA, 121 bp, Artificial Sequence
  Synthesized
  misc_feature (61): n=a or g
ggaacttagaaaactaccaatgcaggcttatacttggacagataccatcatatatggtccnctatacttggacagatactaaataccatcagtatctcccaactgcatagaatcaagagac

SEQ ID NO: 41815 - DNA, 121 bp, Artificial Sequence
  Synthesized
  misc_feature (61): n=c or g
caggggatacaagaattttaggaacattaaagtaattaccactgtatggtaaatacggctnttgttaacacctcagtcttgtaaaaatatttcaaaagcttttgggattgtaagtgttcaa

SEQ ID NO: 41816 - DNA, 121 bp, Artificial Sequence
  Synthesized
  misc_feature (61): n=t or c
gatcctttaggaacaaaaaccagacagcttttagccctgccagtaaacctgccctttttcnaccagcctgagcttaaacgctcagcgtcaaacagatttaattcaaatcttcagctcagca

SEQ ID NO: 41817 - DNA, 121 bp, Artificial Sequence
  Synthesized
  misc_feature (61): n=a or g
cttgcgctgaggcctgtgcagccccagatgtttctgatggtgaatctggtaacaggaagcnaggcaagagtcaccacacactggagggctgagccttttagatcctgtacatctgagcttc

SEQ ID NO: 41818 - DNA, 121 bp, Artificial Sequence
  Synthesized
  misc_feature (61): n=a or g
tctcacttcccaatatttttagtttaactgcataatactgttctaaattacttactaagancagatggaaaatgaaacctatctgggtatcttctaccaattattctggaatcactgtgct

SEQ ID NO: 41819 - DNA, 121 bp, Artificial Sequence
  Synthesized
  misc_feature (61): n=t or c
gagagcagactttaaaccacgcgccattccgggctgtttttcagatgcctctttgcctcanatatacccttatgtctctcacagagccacagattagatagcacttactgacagaaccaaa

SEQ ID NO: 41820 - DNA, 121 bp, Artificial Sequence
  Synthesized
  misc_feature (61): n=t or c
gatcatcacaaagccctatcacatcaaataaaaattagcaattaaatggtaggaactaagnacttccagggttttagaggatttaaagcttgtttccggaaaatcaggatatgcatgttga

SEQ ID NO: 41821 - DNA, 121 bp, Artificial Sequence
  Synthesized
  misc_feature (61): n=a or g
tctgctcttcaggaatttcaattttcgctcttcttccagccaccaagtgttgatgatgacncaatttgttgaaaaacacaagtgatgtttgttatttgttattttgacctctgttgtaaac

SEQ ID NO: 41822 - DNA, 121 bp, Artificial Sequence
  Synthesized
  misc_feature (61): n=t or c
cagggctctataggattgactgctaaacaagcctgttcctcatgatagaataatttgtgtntgtgaagcagtggtccagaattatctgagctgttgtgtaatttgcactttaaatgaacat

SEQ ID NO: 41823 - DNA, 121 bp, Artificial Sequence
  Synthesized
  misc_feature (61): n=t or c
cctctctggaaggagggtaaggaaaagaaataaaaacaaaattgttctcccttccctacancctttccccttttatgatctctaaaacaggttcttttttgcaagatgaagaatgtttctc

SEQ ID NO: 41824 - DNA, 121 bp, Artificial Sequence
  Synthesized
  misc_feature (61): n=t or c
aaactgcggcacgtagttcccattaatcctcactttgctgctgaagaaccaccagtgaagntatttggacttcacatcaagtatagtcttccattttcatgtgaaatgttatgggtagcag

SEQ ID NO: 41825 - DNA, 121 bp, Artificial Sequence
  Synthesized
  misc_feature (61): n=a or t
atctttcctcacagacttcgatccagtgtatccatagaccttgataaatacagtaatattnatatgacgaaaatacaaggcaaaagaattgatagtatgcaacagcttaatagaatagcag

SEQ ID NO: 41826 - DNA, 121 bp, Artificial Sequence
  Synthesized
  misc_feature (61): n=a or g
cccatgggtgctgcgtgccgggcacacaccgcaccccagagaggtgactgcgaggacttcnggatggaaacatttcaccatatgtgttgggtttctttgtgctttttcccccccgtgacag

SEQ ID NO: 41827 - DNA, 121 bp, Artificial Sequence
  Synthesized
  misc_feature (61): n=c or g
tatttgtggagatttatgtatgtatgtcattggccatttgatggttgcatttcagtgcgcngtggccacaaacagccaggctgcactgccttggtgccacctgccacgtcctgcagtgtgg

SEQ ID NO: 41828 - DNA, 121 bp, Artificial Sequence
  Synthesized
  misc_feature (61): n=a or c
caatggggaaagggagggatggaagcaaaaactcctcctagtgaagaggagggtgagaaanagcctgcctctgtaggaagtgctgttttcctcatacaattaatgtttctccctccatgtt

SEQ ID NO: 41829 - DNA, 121 bp, Artificial Sequence
  Synthesized
  misc_feature (61): n=a or t
tgtgctgtttctcgaacattaagggattaaatatgggccttagtggatagtggatttagtntactaaatcagtgagtttttcagatgaggagaagccttgtttaccacgtttttgagactg

SEQ ID NO: 41830 - DNA, 121 bp, Artificial Sequence
  Synthesized
  misc_feature (61): n=t or g
aaagggcttctgttgctttgcaacttttctttaatacagctggggatgcagcacaggaaancttgtgtaaaaagctactgatttttctttcagccagagttaagctgactccccagtgatt

SEQ ID NO: 41831 - DNA, 121 bp, Artificial Sequence
  Synthesized
  misc_feature (61): n=t or c
catttgtttgttttaataatttatgtcctgtctagaatccactgaaggcattccagtgaanttggtgttacgaggctgttgtagaattttctttcttctccactttatggtttgaagtttt

SEQ ID NO: 41832 - DNA, 121 bp, Artificial Sequence
  Synthesized
  misc_feature (61): n=t or c
cagcccaaggcagaggtcagccctggttttgcaggaagcattgcctcttattggaggctgngcaggtgaaaacgaaagcagcatttaattctggaaaaaggtgaatttcccagtccaagca

SEQ ID NO: 41833 - DNA, 121 bp, Artificial Sequence
  Synthesized
  misc_feature (61): n=c or g
tagaaacaaatttggtaattgcctctttcaacaggacttgctcaagcaggaaatgaaattnctaaatggcagttagcaaaagtatttatagctaagttcataaatgagatgtgctttcctt

SEQ ID NO: 41834 - DNA, 121 bp, Artificial Sequence
  Synthesized
  misc_feature (61): n=a or g
ctgtagagccaggagttggacttgatgatccttgaggtcccattcaactcaggggattctntgacactatgacttatggcagtttttgaaagtctatgcaaaaacttaatccaacagacat

SEQ ID NO: 41835 - DNA, 121 bp, Artificial Sequence
  Synthesized
  misc_feature (61): n=t or c
ataaaccagctctcaggcgtgctttaagtttttcacgtgtctcagcttaaaaggtgagaantttgcatttttcttactttcccacagtgtgtgcaaatgtgaagtgtgcccacacctcttt

SEQ ID NO: 41836 - DNA, 121 bp, Artificial Sequence
  Synthesized
  misc_feature (61): n=a or g
gcttttaagactgccccacatttcagtttttgtttgaataagtttatttctttgtctaagngccttgattttttttggcctgtgctgcatggatgttaaagtagttcttcattgttgccat

SEQ ID NO: 41837 - DNA, 121 bp, Artificial Sequence
  Synthesized
  misc_feature (61): n=a or c
cagctgtgggatcttggtctccagtacaaggcaaaaacagatggaagaggattagtgaatntgtttgaattttatgcaactttaactctttcttgaagaaaaaagtaccacaaattctctg

SEQ ID NO: 41838 - DNA, 121 bp, Artificial Sequence
  Synthesized
  misc_feature (61): n=t or g
agaagtctttccatatgtattcaaccaataactcattttgccagattctggctttcccagnggaaccgggaaaagaatcatcctgcagcatttgcactggaggatacgtacagaacatgac

SEQ ID NO: 41839 - DNA, 121 bp, Artificial Sequence
  Synthesized
  misc_feature (61): n=c or g
aaatctccttgttccccatgtctcccagccatggggtggagggtcatcaggagggtcaggntgcttgcagttgcattccctgcctctttgcccaccttttcattagagagcagctgctaaa

SEQ ID NO: 41840 - DNA, 121 bp, Artificial Sequence
  Synthesized
  misc_feature (61): n=t or c
gctgcccgattcggatatttcctcttgggaaacacagtcatattctttttaatccaattgntgcccagatcattaattagaagcattatgcaaataaaaggaggttgccagccaagtttcc

SEQ ID NO: 41841 - DNA, 121 bp, Artificial Sequence
  Synthesized
  misc_feature (61): n=c or g
catatcatatatctcaagctctttaaccacgagcacagcaagcttgcatggactggaaacntggcaacatgtagggccagacatggccaaaagggtgaggtgggcacatcagcacagccac

SEQ ID NO: 41842 - DNA, 121 bp, Artificial Sequence
  Synthesized
  misc_feature (61): n=t or c
atgcatgtcaggccttagtaagagctgtaggtgtgctggctggcttgtcaataactgttcngaatggccagctggctattcataaggttgaaggagctaggtacactaacttccccacagt

SEQ ID NO: 41843 - DNA, 121 bp, Artificial Sequence
  Synthesized
  misc_feature (61): n=a or g
tattaccaaatttgtatttgaaagcagaaaaatcatgctagtgtgttttcccttcttcgtnttcctcccccctgctttcttcatggaagatatcgtgccactggtcattgcagaggtgaca

SEQ ID NO: 41844 - DNA, 121 bp, Artificial Sequence
  Synthesized
  misc_feature (61): n=a or g
taagtagaaatactgcatgtgttcagtccaggcatttccaacttcaaatattcttcagatntacattgctaaatattaatgtactatcacatttaatagcctaaaaaactgcaaagcatga

SEQ ID NO: 41845 - DNA, 121 bp, Artificial Sequence
  Synthesized
  misc_feature (61): n=a or g
acaccacaaaattcagtttgttattttccatgcactgacttctatttgtgttatctcactntaagttcttatcatagggcataatcttttgtaatatttgctcacacactaaacaatcttc

SEQ ID NO: 41846 - DNA, 121 bp, Artificial Sequence
  Synthesized
  misc_feature (61): n=t or c
ctagtacctgtatgaaaatattaagtgttatcattcccctctctccccaggagaaggaaangaggaaattagcaacatgattcataattatatcaaggaaattgaagatctcaggtattta

SEQ ID NO: 41847 - DNA, 121 bp, Artificial Sequence
  Synthesized
  misc_feature (61): n=t or c
cttcggagttgttttccagattcaaatacaggtgaacacctctgacattaggcaaagctcntcaggggataaatcatggcagaattggtcttcacgctagcatactatatggcagatataa

SEQ ID NO: 41848 - DNA, 121 bp, Artificial Sequence
  Synthesized
  misc_feature (61): n=t or c
aagcatgtgctcaggaaaatgctgcactgctaaagacatgctatttcaagtagttccactngttttgactaaagatggttacagaggatgtatcggctctgcaaagatgtcagtctcgtca

SEQ ID NO: 41849 - DNA, 121 bp, Artificial Sequence
  Synthesized
  misc_feature (61): n=t or c
tatgaataaacctatgggaagagtaggttgaagttaccaataagacagacctaggagcttncattgaccgtgcagtaatgtaacaatggaatggatttagtctgtaacacttaaactcact

SEQ ID NO: 41850 - DNA, 121 bp, Artificial Sequence
  Synthesized
  misc_feature (61): n=c or g
tctggttgcaggcctattgcaccaggctgacactccacctttacctcttggaggctccctngggccacttcaggcaggaaatctttacccaggcttaagagacatttttgactgcttgctt

SEQ ID NO: 41851 - DNA, 121 bp, Artificial Sequence
  Synthesized
  misc_feature (61): n=a or g
agcataaccaagtgacctccagaggtcatttctaaactagtttattctattattcattacnaaaaaggctttcttggatcaactgaaggcagctgtgacttagaaaaaaatcagatactac

SEQ ID NO: 41852 - DNA, 121 bp, Artificial Sequence
  Synthesized
  misc_feature (61): n=a or g
tgttgcagaagcagtgatgacagttcctttggctattgggtttgagtgtgtttcaaataantaaacatcagcatccagatacttagggcacattataaggtttttaactgactcagggaca

SEQ ID NO: 41853 - DNA, 121 bp, Artificial Sequence
  Synthesized
  misc_feature (61): n=a or t
taaaggctttagaaaccttcatttttcaattaaaatttagaaggttcagataattcacagnagatgtgaaagtaagttgtacttgacttgtactatttaatgtggaaaacaaatactaaaa

SEQ ID NO: 41854 - DNA, 121 bp, Artificial Sequence
  Synthesized
  misc_feature (61): n=a or g
ttgcaaacaactgcttacttcagttatggctgtaaaaatagatactgcacaaaaaatatcngaatatgagtaattgctgttcttggggctaactcttcttacaaggctaggccatatccca

SEQ ID NO: 41855 - DNA, 121 bp, Artificial Sequence
  Synthesized
  misc_feature (61): n=t or c
ttttttcctcccttcactggaaggaggctgcagggctgagataaatttagtcccatccttnggagtttgctgccatggctgccagtgaatatagatttagccagttggatcaaccctaagc

SEQ ID NO: 41856 - DNA, 121 bp, Artificial Sequence
  Synthesized
  misc_feature (61): n=a or t
acctgtaagtttcagctggcaaatcacctggaaaattcacaccaaactcttgaataaaganggcagctttctctacccacgaccttgcaaaggacctctggaaaaacccattttcaacaca

SEQ ID NO: 41857 - DNA, 121 bp, Artificial Sequence
  Synthesized
  misc_feature (61): n=t or g
catctatatggctttttttcttcctgcctgggcactatattatgcaaaggttgcaaccacngtataatgtctctctattaagccaagtttgctatgtcatttattctttttatttatttat

SEQ ID NO: 41858 - DNA, 121 bp, Artificial Sequence
  Synthesized
  misc_feature (61): n=c or g
ccagacctagaattttgctatggatagccattattttaaaaataatgatccgcaaatgatnggtttaaagcgctttcaatctctgagtcacaaagaagctaggtgcttccacataccacat

SEQ ID NO: 41859 - DNA, 121 bp, Artificial Sequence
  Synthesized
  misc_feature (61): n=a or g
cggacaggaggagagcaggaggacaagcagaggctgaggtgagagggtaggacagacagtntggaagggaatggttgggccctgggcagggagacaggagtgtctgtcatgaaaaagactc

SEQ ID NO: 41860 - DNA, 121 bp, Artificial Sequence
  Synthesized
  misc_feature (61): n=t or g
aacagtaggatttacagctgtctgtgggaaaacaagcaaaatgctcaccatccacaatgcntgactgatttctgtacattcctggctcttggagttcttttgtcattttcatcacacaaat

SEQ ID NO: 41861 - DNA, 121 bp, Artificial Sequence
  Synthesized
  misc_feature (61): n=t or g
aaggtcagttgttgtaactacttactagtagtatacagcccctacttccatgaagaataantgatgcatctggtagtaagtgaatacaagcctgaacccataagttcttggcagatttgta

SEQ ID NO: 41862 - DNA, 121 bp, Artificial Sequence
  Synthesized
  misc_feature (61): n=a or c
ctgatgtttgataatatttgacctcagcatgtaacatttctgctgtgtgatctctcactcnggggttcagctttctgtgattcaaggtctagcactgatacagcacagcttcataaccctg

SEQ ID NO: 41863 - DNA, 121 bp, Artificial Sequence
  Synthesized
  misc_feature (61): n=a or c
acacttttgtactctcatatgtcagtgtgtttgatcaggttttatctgacacttccttagnctcttgttgcaaagcagtacatttcatctgattgaacaagaaggaaactccagaggattt

SEQ ID NO: 41864 - DNA, 121 bp, Artificial Sequence
  Synthesized
  misc_feature (61): n=a or g
tagtctacccaggacacttccttttgtgaagaggagtagtcacctgccctggttagaggcncagactgtacaggtgcctcagtgcaggagagcaaaaagcaccaagtggtgagaacaacag

SEQ ID NO: 41865 - DNA, 121 bp, Artificial Sequence
  Synthesized
  misc_feature (61): n=a or g
tttcttgcagtcaatacaaggaaatgtccaacaccaatggcttcttggagccagctgttcnagaaactggggtgcccacaaaggtctggtaggcgatgaaccacagtgactaaaaccaagg

SEQ ID NO: 41866 - DNA, 121 bp, Artificial Sequence
  Synthesized
  misc_feature (61): n=a or g
ggagcccctttttccgtcctcgctgcccacagaggttgatggtgtttgtttttgtctcccncagacagatggtggcaatggagatttggaccctggcatcctgctcactgctcagaccatc

SEQ ID NO: 41867 - DNA, 121 bp, Artificial Sequence
  Synthesized
  misc_feature (61): n=a or g
cgttccatgcagaactgcaaagtaattctgaggcagatgatacagactgcacgataatganaaaatgggctggttttaaacaaatactaaaaacaacagcactcaaaattctttaacactg

SEQ ID NO: 41868 - DNA, 121 bp, Artificial Sequence
  Synthesized
  misc_feature (61): n=t or c
agcgataacgcactgttgaagggtgtaagtgctgagaaccattcagttgggtactcttttncactggcaacaaagcaaacagaagatgagattgagcagggtagttagagaacatccaact

SEQ ID NO: 41869 - DNA, 121 bp, Artificial Sequence
  Synthesized
  misc_feature (61): n=t or c
caagacttcagccctggagcatctgtggacctgcaccctgtgttcatcttgatgcaaatcntgaggtgcacctacatttgccaattaatcttctttaaatctgtgcataactccaagtgca

SEQ ID NO: 41870 - DNA, 121 bp, Artificial Sequence
  Synthesized
  misc_feature (61): n=a or g
caactttaagatttttttcctgcctaaataaagagccaaagccatgttagcttcaaatacntagagctgttctttgtctgaatgagcaaggtctgagaaaagtgctgtcagcttagttgtt

SEQ ID NO: 41871 - DNA, 121 bp, Artificial Sequence
  Synthesized
  misc_feature (61): n=a or c
ggaagtactcatctctcactgatggaaagggcactcaaggcaccaagaactcatctgccantgctggaggggaaaggcccataaatgctccctggtgtcaggagctttagttttcatatta

SEQ ID NO: 41872 - DNA, 121 bp, Artificial Sequence
  Synthesized
  misc_feature (61): n=t or c
caccaaatgcgtgtgagcagatatggagggtcctggtgggagccgcccatgaggcgccttnccgtccaactaagcctccttcctaatcccatctcctcctgtccgtctttccctcttccct

SEQ ID NO: 41873 - DNA, 121 bp, Artificial Sequence
  Synthesized
  misc_feature (61): n=t or c
acgtgcaccacggcagtgctaggcctgggcctgagctttgaccagaggggattttggacantgaatgaatggcacgtgatcaagtcggagtgcacaaggactgcagtttctcagctatctc

SEQ ID NO: 41874 - DNA, 121 bp, Artificial Sequence
  Synthesized
  misc_feature (61): n=t or c
cacttaggtgagacctgcagtccaggctacggggagatgtggggtggtggaggaaacgcangttccggttgcttagcaaagtcaggtcagagcatggagtgggaaaaggatacagatcttg

SEQ ID NO: 41875 - DNA, 121 bp, Artificial Sequence
  Synthesized
  misc_feature (61): n=c or g
tattcaccagacagcatggaattatcattttatgtctgaaattgaaccacgattgacaganagtccattccacatcactctgtttttctcttttggacataagcaaaaagcttattggttc

SEQ ID NO: 41876 - DNA, 121 bp, Artificial Sequence
  Synthesized
  misc_feature (61): n=a or g
tggagcctgcaggagtttccctgcctatcctgatggtgggttctactgtgtcacattgttncctgcagcgctttgctttgcttaaagtaaaaaagtagcaaagtgattaaatagcatttag

SEQ ID NO: 41877 - DNA, 121 bp, Artificial Sequence
  Synthesized
  misc_feature (61): n=t or g
gttctctctggggatgccagccactaatttctgattctctgtccaggaaatcaaacgaatngatatcagctgttaaaactacatctgaatgatttcgttgctcactttcgctgtttaacgt

SEQ ID NO: 41878 - DNA, 121 bp, Artificial Sequence
  Synthesized
  misc_feature (61): n=a or g
ctctaactcacaggctgatttatggagcgtgtcttcctcttctcaataaaaattacaaacngcaccaaaaagagggaaagaaaagtgactgagtctcctcgttttgggctctgctgtcata

SEQ ID NO: 41879 - DNA, 121 bp, Artificial Sequence
  Synthesized
  misc_feature (61): n=a or g
tttcctctacggtgctttttttactacattgctccatgtgctaatatgccacagctgagcnatttaaactttgaatgcaaatcaccatgccatgaactctcagatgtcacacaagttacaa

SEQ ID NO: 41880 - DNA, 121 bp, Artificial Sequence
  Synthesized
  misc_feature (61): n=a or g
agccagcaggttctagactgtttaagaacacattaaagtagaagcaacaaggcagttctanaattagtcaaaaacaaagctctatttttccacctcgtgggacaaaaatcattgtactttt

SEQ ID NO: 41881 - DNA, 121 bp, Artificial Sequence
  Synthesized
  misc_feature (61): n=a or g
tgtctctgtgcctttccttgcagttgtttttttttttacaaggcttctttcaaaaagaacntgcctgttcactgctaggtgcagtttaaatctgtttgaaattactttgataaaagtggat

SEQ ID NO: 41882 - DNA, 121 bp, Artificial Sequence
  Synthesized
  misc_feature (61): n=c or g
tcatttatgtgctgtaaacatttggataatgtgcctttaagagccaatcaaaaatatccantgcaattatgtcattttagggataattacattgctggttcactatgagcccaatgagtgt

SEQ ID NO: 41883 - DNA, 121 bp, Artificial Sequence
  Synthesized
  misc_feature (61): n=t or c
aatggataaaacataaatcctaaactcaacaactgcagccagcaagcaaggaactcagatncatattccagttatgacaattgctgacaccttcagtcctcacaaactacgcatttggggg

SEQ ID NO: 41884 - DNA, 121 bp, Artificial Sequence
  Synthesized
  misc_feature (61): n=t or c
cagagcctctttgtgaagcctgtctccctcctgggcttgcagcagtacccaggtgaatggntgaacttgttgcccaccagagccccctggccttcactgaagagctgctcccttgccagtt

SEQ ID NO: 41885 - DNA, 121 bp, Artificial Sequence
  Synthesized
  misc_feature (61): n=a or g
tcagccatcacataagctactgcttctgtggtagatttgcactagctgcaaagtgatgtgnaacacctgcattactagcagatgccaccagactgagaaactttctgaagcagtggctctg

SEQ ID NO: 41886 - DNA, 121 bp, Artificial Sequence
  Synthesized
  misc_feature (61): n=a or g
cctcgctatccacataccacctctctattaaagacctatcttgctatctgctatctgttcnctacctgtatcaccatcagctatctatctcactatcaactctctatcaactatcttgcta

SEQ ID NO: 41887 - DNA, 121 bp, Artificial Sequence
  Synthesized
  misc_feature (61): n=a or g
ggctctggtggagaaggattcaaaacagggtcactcaggctgacatggaagcctgctacanagaatggtgagctgctctgctgacttcatggctgtgagcagcatttccaacataggtggc

SEQ ID NO: 41888 - DNA, 121 bp, Artificial Sequence
  Synthesized
  misc_feature (61): n=t or c
gaaatgtaacagaggagatcatttaacttgttcttcatcttcatttctatttatttcctgnacagtgctcaaagcttacagctagaattacttggcagctgcacaatagcaacaacactaa

SEQ ID NO: 41889 - DNA, 121 bp, Artificial Sequence
  Synthesized
  misc_feature (61): n=a or g
tgccagaagaagcaaatgaagctccagatatgtaagctctaagagcaaaaagcaaagtgcngctgctcaggaggatttgacactctccttgaagtgcctccgtctgaaaagaaagaaaagc

SEQ ID NO: 41890 - DNA, 121 bp, Artificial Sequence
  Synthesized
  misc_feature (61): n=t or c
ggtgagagtgttattttagctgcggtggcaaagatccaagaaagaaaagccagccaggctngagataagaatattggccctctgacaaggacacgggctgagagcgagccttcgggccagc

SEQ ID NO: 41891 - DNA, 121 bp, Artificial Sequence
  Synthesized
  misc_feature (61): n=t or c
aagtacctgaaatgacacacaaggctgttaataaattaggaatctaaagactgccattganattttttccatacaaacaggaaaaaggggctctggcattgtcagtatgtcctctatcttc

SEQ ID NO: 41892 - DNA, 121 bp, Artificial Sequence
  Synthesized
  misc_feature (61): n=a or c
ttttaaaaacaaaacagaacaaaaacactgtagaagaacgttcttttacaaatagagctgntgtcttgaaagacagaacaaaggcttggtcacaatatgcagaggaatactgaccacgtga

SEQ ID NO: 41893 - DNA, 121 bp, Artificial Sequence
  Synthesized
  misc_feature (61): n=c or g
aacagtaaacaatagcaaaatcaccattgccttcaagcaaaaaaatccagatagaaagaanataatttgtatttgtaatctgtatattctgttgcaaattgtattcagagacatgtagatg

SEQ ID NO: 41894 - DNA, 121 bp, Artificial Sequence
  Synthesized
  misc_feature (61): n=a or g
atttatcctctagataaattttgattatgcattgcaaagccttaaaaatatctttatcacnggcatagtacatagtgtcttcttcacattgagattaccagtgctgaaaatatttgctgac

SEQ ID NO: 41895 - DNA, 121 bp, Artificial Sequence
  Synthesized
  misc_feature (61): n=c or g
gttttgtttgctttctgccagagggaaaggcagatgcttagaagacagggagagtttcagntcttgcctctgaagctgctggctgcagatctagcacaggagccatgccctgaacaaatgg

SEQ ID NO: 41896 - DNA, 121 bp, Artificial Sequence
  Synthesized
  misc_feature (61): n=a or g
cacccattgctgaaactgggaaccgacctcatcctttcatcccagggctcatttaacaaangaatgtgggcgaagagcaccttcatgggatcacttatttaggggtttggtatgtggggcg

SEQ ID NO: 41897 - DNA, 121 bp, Artificial Sequence
  Synthesized
  misc_feature (61): n=t or c
acatatcagatggaagcgctgggatttagcacgcgtcgggctctgcagggcagacagatcnccaggaggtgacagctctgggtgacattctgactcagcatagtttatttcaaagtggaat

SEQ ID NO: 41898 - DNA, 121 bp, Artificial Sequence
  Synthesized
  misc_feature (61): n=t or c
ccaggctcatcacagccccactgaattgctgaagaagggcaacacgagcataccaaggtgngtgccccactgcagcgctgagcacagctctacaggaagtttgttttcacccaacagctcc

SEQ ID NO: 41899 - DNA, 121 bp, Artificial Sequence
  Synthesized
  misc_feature (61): n=a or g
aaaacaaacatcaaagagacaaaggcaaataagactagtctttgcaaacattgacttatgnaaactatttccaacttttattgaattgtggaaactctattgctagtaaaagtcaaagcag

SEQ ID NO: 41900 - DNA, 121 bp, Artificial Sequence
  Synthesized
  misc_feature (61): n=t or c
tacatggacagcagtctttggaccttgaatcatctttgacacgaggctggcttgagtcagnctaattctcccttcctccttcttgctgaagttcacagcttgccttgaactgtgctgagca

SEQ ID NO: 41901 - DNA, 121 bp, Artificial Sequence
  Synthesized
  misc_feature (61): n=t or c
gtttcccgagacaaaaactcaataggaagaacaatctgcagtgggacatgccttttctctngcttcattgtggcttaattaagccatctgcactcatattgactcatcagtagaacacaaa

SEQ ID NO: 41902 - DNA, 121 bp, Artificial Sequence
  Synthesized
  misc_feature (61): n=c or g
atctgaatacactggagcattgagttgtcatgaacaacatgatcaacacaggacaatgttnggtgctacacttgccaggcacaggcaaagactggagtcaagtttgactggactggacttg

SEQ ID NO: 41903 - DNA, 121 bp, Artificial Sequence
  Synthesized
  misc_feature (61): n=a or g
ctgctcaatgcttctgtcaaacaatgcagagcaaacaatatttggcttcatctcactctgngcagatcaactctttgcacccaggactttttttttttgcccgccagtttgaattttcccc

SEQ ID NO: 41904 - DNA, 121 bp, Artificial Sequence
  Synthesized
  misc_feature (61): n=a or g
aaagtgaaaagatggtccagtcgttcttggttgtgaagtgcaggatcattgactctaaacntgttcctgggagcaatgaaaatgaaggaaagaagtatatccaccacatccagagacatca

SEQ ID NO: 41905 - DNA, 121 bp, Artificial Sequence
  Synthesized
  misc_feature (61): n=t or c
agaagtccacaagaaaagctgtgtctgagaagagaatagccctaatggaatgacctttacngggacttgacacctgctaccttgtaagcttcttatatacacaacttaatccacctggagg

SEQ ID NO: 41906 - DNA, 121 bp, Artificial Sequence
  Synthesized
  misc_feature (61): n=t or c
ggacaacctgcatagtattatgcagccatgctactagaaaatcaacttaatgtaaaggtangtactagaacacttaaatgatacttttttttccccccccaccaatggttaactgtcattg

SEQ ID NO: 41907 - DNA, 121 bp, Artificial Sequence
  Synthesized
  misc_feature (61): n=a or g
ctatctgatactggtatttaccggagcaatcgcattactttgaaagataaaccaagaggancaaatcagtatttagaaaaagggaaataaaacacacattcctccttccaactgtgcttgg

SEQ ID NO: 41908 - DNA, 121 bp, Artificial Sequence
  Synthesized
  misc_feature (61): n=t or c
gtaagctcaaataatctcagctgtaagcctaccacaaacgtgacttactggcaattatcantgtcggcatgttaactgcatgccaatttctatgctgaactacaacactggtatattaagg

SEQ ID NO: 41909 - DNA, 121 bp, Artificial Sequence
  Synthesized
  misc_feature (61): n=t or c
atcaagtattctatttttgtagccctgcctgtgaataattcaaactaataattttatgcanctaaaatgttctaccttgcagcctgtatgctgctgagatggaggctgcctttcctagcag

SEQ ID NO: 41910 - DNA, 121 bp, Artificial Sequence
  Synthesized
  misc_feature (61): n=a or g
tatgcttaaagacaaacaacgtgaactattttaggtctggctggtaaacaccgcatgactntagtactgtgcccactaaggcagcccatgcaacaacattccttggaaagtctccttcctg

SEQ ID NO: 41911 - DNA, 121 bp, Artificial Sequence
  Synthesized
  misc_feature (61): n=t or c
tttcctgtttatgctttcctgtttatccaaagaataacagaaatccagcctgtagttctgngttactgtcaatgagctctcattctctactacagtcatgaactgctctgataaatgaagg

SEQ ID NO: 41912 - DNA, 121 bp, Artificial Sequence
  Synthesized
  misc_feature (61): n=a or g
ctaatgcagaatgcaagtaatgttttgcatagaaatacacatgaaaccatgtagcactctnctagaggctctcagacactgagccccactcctcagcactaattttttattaaagtattga

SEQ ID NO: 41913 - DNA, 121 bp, Artificial Sequence
  Synthesized
  misc_feature (61): n=c or g
attaatggtcaagcaaaggagaagagcatcctgcagccagggaaagcatgattagaaactncaacagcaggatgggctgatctgagatacagaaaatccatgaagcttttcccattcagga

SEQ ID NO: 41914 - DNA, 121 bp, Artificial Sequence
  Synthesized
  misc_feature (61): n=t or c
tcaaatggtgaggcatggagcaactcctgatttcacctgagttactatttgagtgaatgtnaaatgattcacatgactcacatgattgcacacctactgaagtcaccatcaccacgagatc

SEQ ID NO: 41915 - DNA, 121 bp, Artificial Sequence
  Synthesized
  misc_feature (61): n=t or g
tgagcacctggaggttttgaccttcttcacctgcaagaaatcccccagtgttggtcacatngctttaacaccactcaataaccccactgctggctcacggctccattttcaatgcgatcta

SEQ ID NO: 41916 - DNA, 121 bp, Artificial Sequence
  Synthesized
  misc_feature (61): n=a or c
gatgtgcacagcacacaaggaagaggagatatccaaggagggcacagcacacaaaatgcangcagaatgctcaaggtgcatgcacagcacctgagatgcatgcagtgtaacacctgatgtc

SEQ ID NO: 41917 - DNA, 121 bp, Artificial Sequence
  Synthesized
  misc_feature (61): n=a or g
gtgcttgtctatttgtttcagtgccctcctgtgctgctgcactttccatcccagcatcaantatgtatagagtactcaaaaacctctgaatttaccttagaaatactattccagaactctc

SEQ ID NO: 41918 - DNA, 121 bp, Artificial Sequence
  Synthesized
  misc_feature (61): n=a or g
ttgtaagcatttatattatggttgtgagcagagcagatgtgttgtgcaactttctgaacgngatcctgaaggcatgccggtccttcctcaggtgtgtttctgggagcaaaagcatccttct

SEQ ID NO: 41919 - DNA, 121 bp, Artificial Sequence
  Synthesized
  misc_feature (61): n=a or g
cacccttcaaatgaaaatctcaaggactgttttgttaaagatttgtcattaatgacttacntaaaactggtccagctttggagaatgtggacagaaaacagctcctgaggacatagtgaag

SEQ ID NO: 41920 - DNA, 121 bp, Artificial Sequence
  Synthesized
  misc_feature (61): n=t or c
aatgacctcaaacatcccaaatcagggtcctcaaatcccagtctcacagcgggatcaggangaactacacagccctgagatatctctatctacagcttcctacggttctttatttatatac

SEQ ID NO: 41921 - DNA, 121 bp, Artificial Sequence
  Synthesized
  misc_feature (61): n=a or g
acaacatttcaaattcttttgcatcagttgcatatcaacttcattttggcatctgtccctntcttagtttccaaacagaactacttcactaataatttttctctttcttgcatcattaaat

SEQ ID NO: 41922 - DNA, 121 bp, Artificial Sequence
  Synthesized
  misc_feature (61): n=a or g
atcttgacaccttctttgtggatgtaggaaggttctgggatctggggcagtggagatcacntgcagatgatgggcagcagagaacgaggaagaaacagtgacatcaattctctccattcag

SEQ ID NO: 41923 - DNA, 121 bp, Artificial Sequence
  Synthesized
  misc_feature (61): n=a or c
aacactaagcacagcagtgataaaaaggcaaaaaacagaacaagcagacacagaatctcangatcagtctgttgttcacatcctatgtgaataatgagttagactgccttgcattgccgtc

SEQ ID NO: 41924 - DNA, 121 bp, Artificial Sequence
  Synthesized
  misc_feature (61): n=c or g
aaaacataaaaacactgaggtttggagagtcctgcgtgcagtctttcagactgattttggntataatattttaccaattcgtgtatcagtgagggctttgttcatccttaggcaaagtgca

SEQ ID NO: 41925 - DNA, 121 bp, Artificial Sequence
  Synthesized
  misc_feature (61): n=a or c
aagatagtaaaacataaaataaagcatggaaaagacaggaaaatactttggtaaaaccttntacttctatcatgacttgataaaatagtgacaatcagaggaaagccataccccaaaacat

SEQ ID NO: 41926 - DNA, 121 bp, Artificial Sequence
  Synthesized
  misc_feature (61): n=a or c
tattctggcagagaagcaaacaaaaagaactccctaggctgccttcactgaaatggaggantgatagacaataatggggtacaggctggcagaggactgattgttgctgatgctagcagga

SEQ ID NO: 41927 - DNA, 121 bp, Artificial Sequence
  Synthesized
  misc_feature (61): n=a or c
agctgcacttcactggtaagcaattctaccacagaaatcaatatttcagatgcctgatgcntgcatcgggtgttacacaagtataataggccgtgtaaagacctttttaagagctggctat

SEQ ID NO: 41928 - DNA, 121 bp, Artificial Sequence
  Synthesized
  misc_feature (61): n=c or g
tttcccaaaggccttgcagcgctctgaaagccactcagatgtgtgccagctgggaagagangatggcacaaagtggtggactattggtggtgttgtacaggagtcccagcttcccagggct

SEQ ID NO: 41929 - DNA, 121 bp, Artificial Sequence
  Synthesized
  misc_feature (61): n=a or g
ataaatagcttgcctgacattctatttggaatttttctgaggccttatgttataccgtttnccctgtaagttcctggcctctctttctatcctagtaatgaactgaagacatgtgttggac

SEQ ID NO: 41930 - DNA, 121 bp, Artificial Sequence
  Synthesized
  misc_feature (61): n=t or c
aaattgtttgtgctaaattaactacagtttctttaatgcccttgttttctctaaggtatcnatggagttgtaagtgaatttatatcagtgtagcctctagagaaatatttgctaattaatt

SEQ ID NO: 41931 - DNA, 121 bp, Artificial Sequence
  Synthesized
  misc_feature (61): n=t or c
aacttgctgtgttttgcatgctgcaccacactgtgggaacattactgtgggtatgtgagtntatttggaaataactatgtgggaataagcatttacatgtctcactgtatacctacacatt

SEQ ID NO: 41932 - DNA, 121 bp, Artificial Sequence
  Synthesized
  misc_feature (61): n=t or c
gtggatgaaacttcatgatctggatgagtttggaggaaaaagatgttttgaacttgagctnccttggcattactagctcatcatcctctgcttggtcagatagtgacaggacagaggggaa

SEQ ID NO: 41933 - DNA, 121 bp, Artificial Sequence
  Synthesized
  misc_feature (61): n=t or c
cagtacataactcaaaaattgatcataacacttgtctgtagaaacacttggaaagttacangttaaccaactactataaaagtgaatcatacattactaacagtaaaaagcagctgaagta

SEQ ID NO: 41934 - DNA, 121 bp, Artificial Sequence
  Synthesized
  misc_feature (61): n=a or t
aatcatatgctaaagaactttcacagcagcattgtcctcctcaggagagtactgtcctccncagaagagtactgtcaggtacataaggaaaattcaaggttgctattaattttacaggaca

SEQ ID NO: 41935 - DNA, 121 bp, Artificial Sequence
  Synthesized
  misc_feature (61): n=a or g
ccatactcccaagaagtgacacaccttccacatcttaatttgacaactaggcactaggcanctgaagtctatttttaaaagcactaaaaataattcttctttttgttgtgaaaactgggat

SEQ ID NO: 41936 - DNA, 121 bp, Artificial Sequence
  Synthesized
  misc_feature (61): n=t or c
tgttatttagcatgctgtaagctttctcctcttctgctttaatgtggtgttaatttgtctntatattacacaattacattagtattcctctgctggttattcacaaccacacaactcatca

SEQ ID NO: 41937 - DNA, 121 bp, Artificial Sequence
  Synthesized
  misc_feature (61): n=t or c
ggaagctgtctcttttggtgagaacttcttgctgggctcctggtttgagagaaaacattgncttgttcccaatcttgtcaaggttggctattccatgcaattgcagttctgttgtctgtca

SEQ ID NO: 41938 - DNA, 121 bp, Artificial Sequence
  Synthesized
  misc_feature (61): n=t or c
ttttcaagaacactaaagcagtgtttaggaataatgacctctgcattatttaggcactacngttgttttccactaagccacatgtcctttctgtggcagtaaataatagagaatatctaac

SEQ ID NO: 41939 - DNA, 121 bp, Artificial Sequence
  Synthesized
  misc_feature (61): n=a or g
atcaagggaaacaggctgttttggggcttgtatccagttcttcctaaggcattttgcatcngagaacattagttctgtggcatcatcctcgggttgaggatccagtgtggatctggaagtt

SEQ ID NO: 41940 - DNA, 121 bp, Artificial Sequence
  Synthesized
  misc_feature (61): n=a or g
tggagagcgggttttttgcaggcagaaataatccagattatagggacctgccatgcttgcntggagcaggaaagccgctgcagacaaggacttgttaagtgattaggggctgtgctgtatc

SEQ ID NO: 41941 - DNA, 121 bp, Artificial Sequence
  Synthesized
  misc_feature (61): n=a or c
aactccaggctaagccagggagtgcattactccctttgtgactccgtgatgggtccttggngatgtggggctcactctgtgctttgtgccagcctctcatttcctccctcctagaatactg

SEQ ID NO: 41942 - DNA, 121 bp, Artificial Sequence
  Synthesized
  misc_feature (61): n=t or c
attcttgccttgatctggcacctccataaggagggatgctccatgtaagtagcatatctanaaaacattccttctgactgaaaagaagcaaaaagacaacagaaatcacactaatactaca

SEQ ID NO: 41943 - DNA, 121 bp, Artificial Sequence
  Synthesized
  misc_feature (61): n=a or t
gatgatgtgatgctttagggaagtggagtgggatgttttaaggggataacatggggtgcantagggatattttaggggataacaattacatactgtagagttgatgtggggagtgtactgg

SEQ ID NO: 41944 - DNA, 121 bp, Artificial Sequence
  Synthesized
  misc_feature (61): n=a or t
atttctgaatgtaaaagccccatcactgaatggaaatggcattcatgttgcctgcctaggnccaaaaagagaactcatctcttgctgtcatttctaagctggacgatctgcgtacactgct

SEQ ID NO: 41945 - DNA, 121 bp, Artificial Sequence
  Synthesized
  misc_feature (61): n=a or g
tggatctagtaggaacaaagttttagggtacaacttcttttcctctcagagaggtacgttntatctccatttacttgtgtagcattctgtattaatagtttattaatagtccttagttagt

SEQ ID NO: 41946 - DNA, 121 bp, Artificial Sequence
  Synthesized
  misc_feature (61): n=a or t
tgcagtttgccaagtcctatatgcttagcttgtcatcaggaaagaaaggatggtaaactgngagtagtgatgtagtccagctgtgactcaaaggtgatggtggctgttcaggtgacaagca

SEQ ID NO: 41947 - DNA, 121 bp, Artificial Sequence
  Synthesized
  misc_feature (61): n=c or g
tgtatgtatttgaaaggcttcaatagcagactaattaatcctactgttgatgctaatatanttctttcaggattcacagttcactgctccaagcaaatttacctttgatctttatttagct

SEQ ID NO: 41948 - DNA, 121 bp, Artificial Sequence
  Synthesized
  misc_feature (61): n=t or c
taccctaattagagttctgaacctgcctggcaccatgtatttttcactcatttttaacttnttcttgcctggctccacagcctacactcagaacctttccttcaaagcaaagcaaaaaaag

SEQ ID NO: 41949 - DNA, 121 bp, Artificial Sequence
  Synthesized
  misc_feature (61): n=t or c
aaagagttatcgtgtggaatcaggagaagcttatcatttagctattattatttatagagcnctggctgtacgcagcgttttacagatgtataaagaaaataagttccttgttttcagtggc

SEQ ID NO: 41950 - DNA, 121 bp, Artificial Sequence
  Synthesized
  misc_feature (61): n=t or c
ctgctcctccacctgttattacaaattattataaactgtgaaacattacgttattttgtangaaagtagctgtaaaaaattgcattgtgtaatagagtactaaggctatggcaaaaggctg

SEQ ID NO: 41951 - DNA, 121 bp, Artificial Sequence
  Synthesized
  misc_feature (61): n=t or c
ctttggagggttttgtctctgtccaggcaaggacagtgaagctgatgcttcccgtgcctgnacttgatctacaaggagagctattggggaaaaattggtataggtttctgatggagaattt

SEQ ID NO: 41952 - DNA, 121 bp, Artificial Sequence
  Synthesized
  misc_feature (61): n=a or t
ttgcctacaccgaagtccagttctaaattattatttgggcacaatgagaatttatagtggngtcaagaaacatattaagcaggactgccagagatgttacccatgacacacttttctctca

SEQ ID NO: 41953 - DNA, 121 bp, Artificial Sequence
  Synthesized
  misc_feature (61): n=t or g
gaattagtctagtgaagtcaacgtcagatacatttgctttaacaactaaactaggtcctantctcgtttatcctactgtagctccaaaataactctaccaaagcaaatacagctcctctct

SEQ ID NO: 41954 - DNA, 121 bp, Artificial Sequence
  Synthesized
  misc_feature (61): n=t or c
gtagtgacacagtggatgtatcttaatattcagacttgggagtagcaggtcttgttacctncaggcttgctgattttctgccttaccacaggaattcatcattcagcttatatcatctgaa

SEQ ID NO: 41955 - DNA, 121 bp, Artificial Sequence
  Synthesized
  misc_feature (61): n=a or c
aatgcccttatgattaaggggggaccagccatcaaaaaaaatcaggtctttttatggaccngtaggtgtgcatatgctctcttatagccatgtgctgtgctaacatttgttttctttgcag

SEQ ID NO: 41956 - DNA, 121 bp, Artificial Sequence
  Synthesized
  misc_feature (61): n=t or g
agcaactgggaaggtcacatgcaggcttacgaagatcacagctcaaggggttcttgggctnctcactatttctagggtaagaggactgggtaatagtcatagcaccacccaaggggcagac

SEQ ID NO: 41957 - DNA, 121 bp, Artificial Sequence
  Synthesized
  misc_feature (61): n=t or c
acaccattgctcatggcaacaggagtttgtggatgctgatattagtcacttggagttttangtctttattcttagtgcacagtgaataatgtgttgatcttgaggagctaccaggactgtg

SEQ ID NO: 41958 - DNA, 121 bp, Artificial Sequence
  Synthesized
  misc_feature (61): n=a or g
gtctgggacattcttgtggcctcagcaaaatgagtctcatgtgcacacgagtctgttgtcntgtccatgcagcccatcgtgatgtcagccagcacagaccatggctgggctctcctgcagc

SEQ ID NO: 41959 - DNA, 121 bp, Artificial Sequence
  Synthesized
  misc_feature (61): n=a or g
ttggagaggaaggggatgaaaatcccaaggaaactgctgtgttcctgcagtgctgactctnagctgtttgatattctctctttttttaaggtttgcttgttttaaagcaacattaattgga

SEQ ID NO: 41960 - DNA, 121 bp, Artificial Sequence
  Synthesized
  misc_feature (61): n=c or g
tttatcaaggataaagagccaattaaacaaaaaaattttagtcttcaacagtatcttttanaatatgggtcataataccatctagagtttaggctgataaggaaagaatttcaggtgaaac

SEQ ID NO: 41961 - DNA, 121 bp, Artificial Sequence
  Synthesized
  misc_feature (61): n=t or c
gaataaagcccgttctttagccaggggatttgcaaggcatcatttgcccccggttagcatnggctgccataatgatgcaactcctgagattacctgtcaaggctctgtgaattttaaacga

SEQ ID NO: 41962 - DNA, 121 bp, Artificial Sequence
  Synthesized
  misc_feature (61): n=t or c
cccccacagctgctgagaggtatccggaagcccacagctggtaagtgcttctattacagtngggagaaaactggccatagaagccagcagtgttgatgtctctgtatttctgagtaaagaa

SEQ ID NO: 41963 - DNA, 121 bp, Artificial Sequence
  Synthesized
  misc_feature (61): n=a or g
acattaaaaataaataaataaataaatacatacataaattctaaaagcccatgatgccaanaaagaaaaacctgaaatccaccgaatttgacataacaaaaccggagaacatctaacctca

SEQ ID NO: 41964 - DNA, 121 bp, Artificial Sequence
  Synthesized
  misc_feature (61): n=t or c
aaatccagcagtccttgtgcttggaaacagcatgaagggaagggtatgtgggtgaaggcanacgtaggagacctgtgagtcacacacagttttcaggcagctaatattcctctgtagctcc

SEQ ID NO: 41965 - DNA, 121 bp, Artificial Sequence
  Synthesized
  misc_feature (61): n=a or g
gtaagaatattggttatctttccacagtttacaataggcaagagaaaaatattctttgaantggctttcacagaggcacaggtattcataaaatgtaataaattctggctatcaaaccaaa

SEQ ID NO: 41966 - DNA, 121 bp, Artificial Sequence
  Synthesized
  misc_feature (61): n=t or c
tgtaatggtagtttgaaaactaattagtaccaccttctgtaatttgtttagttttgtgagnagctgtgataccaaagattgtcaagacaaactcagcattacaggcaaataacaggaaaaa

SEQ ID NO: 41967 - DNA, 121 bp, Artificial Sequence
  Synthesized
  misc_feature (61): n=t or c
tcttgtttgttatagagctgtttggttttttaggaaaagcagcagcctgggataccctggngctctttggtggcctatgggagaaattgttgctgatttcagcaatggagtgaggtgaaag

SEQ ID NO: 41968 - DNA, 121 bp, Artificial Sequence
  Synthesized
  misc_feature (61): n=a or t
gttattccctgctgcaaattaggtccccaagattaatctccattttgaatctggaaaaaanttctttgcagttctccaggatctgagaatatttgtgggttcttcaaaacttcgtttctaa

SEQ ID NO: 41969 - DNA, 121 bp, Artificial Sequence
  Synthesized
  misc_feature (61): n=a or g
ctttccattctcacttcaccttctctgcttcattactttctgtccctacctgtctgcctgncaccagctctcacccttatctctgcacatcccatttctcaatggataacgtacacacatt

SEQ ID NO: 41970 - DNA, 121 bp, Artificial Sequence
  Synthesized
  misc_feature (61): n=a or g
atagcattcaagcattagagaatacttcaaggtcttatctcatgagatggttcaactcatncagatttcaaaacaaagtaaaagccaacacagaaactgatttccttctactgtgtgattc

SEQ ID NO: 41971 - DNA, 121 bp, Artificial Sequence
  Synthesized
  misc_feature (61): n=t or c
ggctgttagtcattactgtaaaaaaacaaacaaaaaaaacaccgcagtcacaggatagcangtccagagatgctggaaagagaatgccagggtgtcatgagagggcagggttggaattctg

SEQ ID NO: 41972 - DNA, 121 bp, Artificial Sequence
  Synthesized
  misc_feature (61): n=t or c
aagcacactgcatgtagcaaccaacttttacagctcgttcatctgcaacatgctctacatnatttccactgtacactggggttcattcaagcaagtgtaaatgtgaagtcatcttaatttg

SEQ ID NO: 41973 - DNA, 121 bp, Artificial Sequence
  Synthesized
  misc_feature (61): n=a or t
cctgtggaacttcagctttaaacttgttttaatgcttagctgaagaaacctcacctcaganaactaccacagcagaagaatgcagggtaagcagcacctttttaaaagcattccccagcaa

SEQ ID NO: 41974 - DNA, 121 bp, Artificial Sequence
  Synthesized
  misc_feature (61): n=c or g
tttgctctatgtcatttttaacttagtcaaatgtggctcatccgtaccttagttcataaantgctgtagattgaagtgtattttattttgttcaagcctagggtccctagtacaggaagga

SEQ ID NO: 41975 - DNA, 121 bp, Artificial Sequence
  Synthesized
  misc_feature (61): n=t or c
aagtgaaattcacagaaaacgtaggtttattctctttaagttgtggaaaccaagggaagantacaatgaaattataatagatcaacaatgaatagattaatcacacataaaagcaaactct

SEQ ID NO: 41976 - DNA, 121 bp, Artificial Sequence
  Synthesized
  misc_feature (61): n=a or g
acctggcaccaaccgatgagtcctgtaactaaggctgctcagtttactgtcacatctgcanatggctcctgtcattgtccatggcttgagtgtctcagggctttgtattccagacccacta

SEQ ID NO: 41977 - DNA, 121 bp, Artificial Sequence
  Synthesized
  misc_feature (61): n=c or g
gctttgggcacacccctgccatgctagaagaaaatataagaagacccaaacaagtcagatnttcatgtgcttctgtccatatccatccagtgtggtctgctctgtgctgaatagtcagtga

SEQ ID NO: 41978 - DNA, 121 bp, Artificial Sequence
  Synthesized
  misc_feature (61): n=a or g
caggcaagtccttgaatgagagacactgagctaccagggattatgcagctcctttgaaaangggcttttcctcgggatccctgcagcaaatctcctgctcttacccaccctgcagcaccag

SEQ ID NO: 41979 - DNA, 121 bp, Artificial Sequence
  Synthesized
  misc_feature (61): n=t or c
taaactgcaaagatttttgaaaacttgcacaattttgatttggttcaagtccatctcttcnactctttttaatttaatctgaaatgcaaacagatcaatttttattttatttgcaactttg

SEQ ID NO: 41980 - DNA, 121 bp, Artificial Sequence
  Synthesized
  misc_feature (61): n=t or c
atgaaggcactcagcagaacaactgctactcggctcctcgctaaggttttcagcagcaganactgttacttgtcatatcatgggagaaagaaggacacgaggccatgacaacactcttctg

SEQ ID NO: 41981 - DNA, 121 bp, Artificial Sequence
  Synthesized
  misc_feature (61): n=t or g
cttccctctccctcaccgttgaaaccgaggaaactgggataactgttgcctccgcgatttngagggttcttcccctcttccttcacaaaagctttccgccccgatgccgggggtgtgggac

SEQ ID NO: 41982 - DNA, 121 bp, Artificial Sequence
  Synthesized
  misc_feature (61): n=t or g
aagtcatttttccattaaagaagagagtcatagaagagcagcatttaaaccatttcaaatnaaatcattcagagaggaaatcaatttattctaaaagtgaacaaaaacgagccatgtttgt

SEQ ID NO: 41983 - DNA, 121 bp, Artificial Sequence
  Synthesized
  misc_feature (61): n=c or g
cagaactctttcaacaatatattattccagcaataaagggaaaagttgctacacttacacnctgagtccaaaattgtcagtcagagatggagtattacatcaaggaagaaattgctcagca

SEQ ID NO: 41984 - DNA, 121 bp, Artificial Sequence
  Synthesized
  misc_feature (61): n=t or g
gcatcctaatctgcaggttttctgtttgtttgcggcgtctctcctagtcataaattcagtnaatgcaaattccgggtttttttaataatgattccttaattagaatgtgttgcaggtagga

SEQ ID NO: 41985 - DNA, 121 bp, Artificial Sequence
  Synthesized
  misc_feature (61): n=t or c
cacaaagtagtgcttgaaatgtcttcagttttgctgggcatatctggttgacttttgagtnttactacagagggaacgtttaagtcctgctgctctctgctttgcttttaacccagggctc

SEQ ID NO: 41986 - DNA, 121 bp, Artificial Sequence
  Synthesized
  misc_feature (61): n=a or g
taaaattgcttcttttcatctgtgatcgtgggtcaaaaactgaaatatatgagaagcaatngagaagaaactgactgttatttaacatctgtggcggtactgaactacccttctagactgg

SEQ ID NO: 41987 - DNA, 121 bp, Artificial Sequence
  Synthesized
  misc_feature (61): n=t or c
tagggtgggttgtaaccacacctccatcacaaactccctctgttataaagagacactgctnccagatactgtaacaacagggagatctttgagcagctctggcagaggtacaataaaaccc

SEQ ID NO: 41988 - DNA, 121 bp, Artificial Sequence
  Synthesized
  misc_feature (61): n=a or g
tgagcacacggtgatgccatgcaataatattaatatttatatgaaaattggacacactgtntgccatccgagggagacaaactctccttctgtctcagtttgcttctccccaccagcccca

SEQ ID NO: 41989 - DNA, 121 bp, Artificial Sequence
  Synthesized
  misc_feature (61): n=c or g
ttggcctgagtcagatgccaggcatagaaaatttagtccaacagatcactatttccatttncatgagcaaataaagtgttttaaaatttttaatatttttaacaaaaagatttgatgaaag

SEQ ID NO: 41990 - DNA, 121 bp, Artificial Sequence
  Synthesized
  misc_feature (61): n=a or t
gtatcctcacggggctcagctggggctctgcaggcaccgagtgtgcactccaatgatgtgngcgtctcccacctgctcacaccaacatagacaaaccccagggccatatttgggtgggaca

SEQ ID NO: 41991 - DNA, 121 bp, Artificial Sequence
  Synthesized
  misc_feature (61): n=a or g
agactgagatgcctttggtgaagtcgcaagactcagctttgggctcatttacaagtcattngtggaccagagacttaaggactgaaaagaacaaggacaccaaggataagtttatgtgcca

SEQ ID NO: 41992 - DNA, 121 bp, Artificial Sequence
  Synthesized
  misc_feature (61): n=a or g
gaaacatccagagccatttgcagaagggctggaaactgcgaaatggcttgagcaagactcntagcccgtggtttgttcacagaccagttctttgtaccacattgttgatgggtgtttctgt

SEQ ID NO: 41993 - DNA, 121 bp, Artificial Sequence
  Synthesized
  misc_feature (61): n=t or g
ccagtaatgcttgctgacaccacatcttgtcttacttgcacagtgctctcatggcctcatntactgatgacgtgaacatccatagaaaggaacaacccattaatttcagttttagataaca

SEQ ID NO: 41994 - DNA, 121 bp, Artificial Sequence
  Synthesized
  misc_feature (61): n=t or c
caacaaacagtggacaaatatatgcttaataaagcttattaatccttaattaagttgctgnactgtatgtctgatacgtaaatgcatctcaccccaggttatgctgaaataagacaaatag

SEQ ID NO: 41995 - DNA, 121 bp, Artificial Sequence
  Synthesized
  misc_feature (61): n=a or c
cagtttgaaaactttggagtttatcataccttacacctttacaacaaaatccaattctganaccttttgtaaattcctgaaagagttcctgaagaaatatacatgcaaaaagtcaaacttg

SEQ ID NO: 41996 - DNA, 121 bp, Artificial Sequence
  Synthesized
  misc_feature (61): n=a or g
gatttaaatatgaatttgaaaatggttatggaaaaaagcgaccattttttaacagctggcnctgttgttagtggctgcggtcacaaaacttgttacttcatttttttaattggtgatggtg

SEQ ID NO: 41997 - DNA, 121 bp, Artificial Sequence
  Synthesized
  misc_feature (61): n=t or c
tcttcccatggcacgcttgtctttgcaatgttgctaacacttccctgcacattcatgttgngttgcttgtgtcagacaggtgcagattgcatctgtcgttggttgtgtttgctgcacccat

SEQ ID NO: 41998 - DNA, 121 bp, Artificial Sequence
  Synthesized
  misc_feature (61): n=a or g
gtctggattagccagtaatagctgcagttgggctgggttagtgtaagatcctgcatgcagngtgggcgtgatccaaggtcttgttttgatgcacatttgtgtctcatagcctctggccccc

SEQ ID NO: 41999 - DNA, 121 bp, Artificial Sequence
  Synthesized
  misc_feature (61): n=c or g
cagagtctaaggaaactctggggaggaggagaagctgaagattaacgtgggcagctggcanatgggtggctgctgtcccagaaatggcaccgcataggtctcccagtgttcctgggtgtgt

SEQ ID NO: 42000 - DNA, 121 bp, Artificial Sequence
  Synthesized
  misc_feature (61): n=t or c
ggacgtgaaatataggaatgctttagcatgaatagtgccatgtcacaaaagaatctcttangaaaaaataatgttggcatgtatgggcaggcttctacctgaaatttttcagcaaacccaa

SEQ ID NO: 42001 - DNA, 121 bp, Artificial Sequence
  Synthesized
  misc_feature (61): n=a or g
tctgctcagcgaggctgcagcttattaattccatgcagccgagaagtgctatttttaaaancagccctcagcttgttttgaactctgcgagcatcccgctttgttttgcggcagggcaacc

SEQ ID NO: 42002 - DNA, 121 bp, Artificial Sequence
  Synthesized
  misc_feature (61): n=a or c
cttcacctgggggctccccctgcaaagtcctgccgttcccttgagattcacagcttcccanggctgtttctctttgcagctctcccagaggtgctgcagctcaacgtagaccaagaactga

SEQ ID NO: 42003 - DNA, 121 bp, Artificial Sequence
  Synthesized
  misc_feature (61): n=t or c
agcatgcatgaataattatttttacttactgtgcctattaaagatgagctattattctttngctcagaaataaaaatcttccctgatcattaacattacatacgctttttattttttattc

SEQ ID NO: 42004 - DNA, 121 bp, Artificial Sequence
  Synthesized
  misc_feature (61): n=a or g
ccagtatgaggacactgcattcaaagccgccatccaggagtgttctctggaagcttcaganctattgcaaagacaaaagccaccacagggaacctctgaagaagagataagaagaactcat

SEQ ID NO: 42005 - DNA, 121 bp, Artificial Sequence
  Synthesized
  misc_feature (61): n=t or c
taaattaaagcaccatctcacagttggaaggccatctatcacattagaatgtgttttgtcnataagtttgatgctttcatattttattttgcaatacggtaattacacagcttgccccctt

SEQ ID NO: 42006 - DNA, 121 bp, Artificial Sequence
  Synthesized
  misc_feature (61): n=t or c
acagaaatgcactggcagcccaaatgcagtttggggaacgtaagattacactctcccacanggcacttcattctacagcaatagatccaaaggacacacatttgtgcaggagcctggagga

SEQ ID NO: 42007 - DNA, 121 bp, Artificial Sequence
  Synthesized
  misc_feature (61): n=a or t
ggaataaattccatctgggacattgcaacaatgcagagagactctaaagttcaggaggtantaaatgtcagtgagttcagtgtcagtgtctcactgacaaacagcacagagtcaattaaaa

SEQ ID NO: 42008 - DNA, 121 bp, Artificial Sequence
  Synthesized
  misc_feature (61): n=t or c
acagcagatctgagttggccacgctgtccccaaagccagcgccatagatgccaactggcantaatttaactgcctacttgtgtagcccaactaaggctctctccaggtaaatacaccccac

SEQ ID NO: 42009 - DNA, 121 bp, Artificial Sequence
  Synthesized
  misc_feature (61): n=t or c
aacacttctggtgcactcaaacactccactttccaacgctccatttgttgcattcctttcnccccccccctctgctacagagacttaaatttgtatcgttatttacttttctacaaagcac

SEQ ID NO: 42010 - DNA, 121 bp, Artificial Sequence
  Synthesized
  misc_feature (61): n=t or c
acagttgtgatgaattcttctggtacttgtatggccattttccattgctataagttgagcnatatgctgctcccagcagttacataaaatagcagtcttgcaaaaatttcttctctggctt

SEQ ID NO: 42011 - DNA, 121 bp, Artificial Sequence
  Synthesized
  misc_feature (61): n=t or g
cagaacttgataaaaaacaccatatataagaacaacctgtaacactgctaaaatattaaanaagtatttcaagatcagaaaatacactgcttggaaaagctctgtggcacaccgtgcaaga

SEQ ID NO: 42012 - DNA, 121 bp, Artificial Sequence
  Synthesized
  misc_feature (61): n=t or g
actgctccaactgatgctgttagaatcttctatacaaacttagggttaaaaaaagcactantagaagacaaaacctcttcactcagcaagctgcatttccaggttcaatggactggtcatc

SEQ ID NO: 42013 - DNA, 121 bp, Artificial Sequence
  Synthesized
  misc_feature (61): n=t or g
ccagggttggtgactccaataccggctgaggtctgctggcacttttttagagtgtgggctngataaagttccaggagggctacaaagcctaggcatgaaggtcagatgctgaggacagcca

SEQ ID NO: 42014 - DNA, 121 bp, Artificial Sequence
  Synthesized
  misc_feature (61): n=t or c
tagcagtacaagacagtggcttcaatattttttattttatttgaagttaacaattaataanttcaagaggaaagatactcaggcacaagcaaaatgggttaattgtcactgttctctataa

SEQ ID NO: 42015 - DNA, 121 bp, Artificial Sequence
  Synthesized
  misc_feature (61): n=a or g
tgcaggcaccagcctggacccatcagtcacctcagtcaagccatcatcactcgtgcttgtncttgcaagcatggcatcaatgcatggggacgtcaggcaacccaatgaaaccagtgttaca

SEQ ID NO: 42016 - DNA, 121 bp, Artificial Sequence
  Synthesized
  misc_feature (61): n=c or g
tctctggagatagtacaattccaggaaaaagcatcaatataatttgcccccccaacctcanctgccaccctgcaatgaaaaagtaagactgtaaatgaaaagttccaagccagataagtta

SEQ ID NO: 42017 - DNA, 121 bp, Artificial Sequence
  Synthesized
  misc_feature (61): n=t or g
cacataatggaaggcttaatcaatcctcacaaagcactattaagaatctggagtggaaagngtaggaaaaaatgctcttactggtgaaaaactctacagaatgtgaagactaactttgcca

SEQ ID NO: 42018 - DNA, 121 bp, Artificial Sequence
  Synthesized
  misc_feature (61): n=t or g
tatgtgaggtcaataatatccattctgaaactcaggaaataaatatttataaatgataaanaatcattgctccttggagtctatcaatcattcatattttagaaggtcttaaatacatgat

SEQ ID NO: 42019 - DNA, 121 bp, Artificial Sequence
  Synthesized
  misc_feature (61): n=t or g
gttttatgaagttgaccatgattccgcagagaaggttaaggaaaaatatttgccacaaatnttgctgagattaggtttgatattaaacctgatctttcctccaccccaaaagtgagtatcc

SEQ ID NO: 42020 - DNA, 121 bp, Artificial Sequence
  Synthesized
  misc_feature (61): n=a or g
ctaatggaaagggaggaaaaccatgttttttaataatattcatctcaaccgtaaaactcgnaaaaaacaatgagatctttcatatatgattgaaaacaagaggtcagtgtcttgaaaaaga

SEQ ID NO: 42021 - DNA, 121 bp, Artificial Sequence
  Synthesized
  misc_feature (61): n=t or c
gattgcccattgtgccacatcggttgtgccaggggtttcagtgaggaggacatttattaanaaagtaagaggtgggaactaaacagctgtaagatagtcatgactttagcactctgtcaaa

SEQ ID NO: 42022 - DNA, 121 bp, Artificial Sequence
  Synthesized
  misc_feature (61): n=t or c
tttcccaccaagctgagataacacagatgtgtctgctccgccactcagggacggagggtgngaaccaaggggatgctgacatagaataatgatgttttgaataaatctagagatgccatgg

SEQ ID NO: 42023 - DNA, 121 bp, Artificial Sequence
  Synthesized
  misc_feature (61): n=a or g
gagggaatagccccaacaaatgggaaggcatgaactcaaaggcttgctgttatgacatggntagaggaaggatggttttgcacgtacttcttgattcttcttcaacttcttttctgtgcat

SEQ ID NO: 42024 - DNA, 121 bp, Artificial Sequence
  Synthesized
  misc_feature (61): n=c or g
ccctcccttctgcagctcagcagatgggcaccgctcatccatcctcacccaaaataacggncacttccctgatctgaatgctgcagcttcgcattgcccaggagagccgctcgctccccag

SEQ ID NO: 42025 - DNA, 121 bp, Artificial Sequence
  Synthesized
  misc_feature (61): n=a or g
accagtcaaattctaggaagaagcaaacaatgattttgtacaaaagaagaaaattgcccanttttaaaatgtgagttaatcacaattcttatagtagtgaacatctgaagtaatgttctga

SEQ ID NO: 42026 - DNA, 121 bp, Artificial Sequence
  Synthesized
  misc_feature (61): n=a or g
aagggctgcaggctaaaacagccaaccaaaggttcccttcagaccttttattcatcccacngatggcattaataccaccatgaattctgtggttttatttaatatccagggactgtgctga

SEQ ID NO: 42027 - DNA, 121 bp, Artificial Sequence
  Synthesized
  misc_feature (61): n=t or c
tgagaactaggaggatgttgggttttttgtttgtttttaagactgaggattatagaaacantttatctctggagcaaaagtgaaatatgagaagaaaacatttgtttcacagaaatcagac

SEQ ID NO: 42028 - DNA, 121 bp, Artificial Sequence
  Synthesized
  misc_feature (61): n=a or g
cactgtgctgatgtacagccaccagcgacgtggccaacaagggattaatgtgctttgtatntagctgctttaatttaattcaggtccagatcctgtgaggcagtaaagacctcagctacca

SEQ ID NO: 42029 - DNA, 121 bp, Artificial Sequence
  Synthesized
  misc_feature (61): n=a or g
gccacaataccatatgttacactcttgtctcatacaatagatccaaattaagtccaagatnaggggctccatgagcaggaaatcaagtgcacaatttctgcttttattcccaccttctgat

SEQ ID NO: 42030 - DNA, 121 bp, Artificial Sequence
  Synthesized
  misc_feature (61): n=t or c
atctgagttttctcttctctaatctgtaccatgaatatcaaaacaagaagttgctgataantagaggttcccctcagcagcctaaacctgactagtgtcattgatagtataatctgagtgt

SEQ ID NO: 42031 - DNA, 121 bp, Artificial Sequence
  Synthesized
  misc_feature (61): n=t or c
taagaattagtcagcttagtgacagttcccttctacagtctacctattctgaaaacttatnatcatatttaactcacagctgtgctctttcattttaaatttgcttttcactccttttttt

SEQ ID NO: 42032 - DNA, 121 bp, Artificial Sequence
  Synthesized
  misc_feature (61): n=a or g
taataattgaacaaaaacagaacaataaccagaacacttcatttcttgttacagctaggancaagtttaagaacgagatcaggttcacatagtatccatgaatcatgagttgtttatgcta

SEQ ID NO: 42033 - DNA, 121 bp, Artificial Sequence
  Synthesized
  misc_feature (61): n=a or g
cactcacgaggcatagcagttgtcctgggccacggtgacaccgttgtaaggcagcagccangccacctcagtgctgaggaaacgcttgatgctgttgatgggttcgtagaggcgtcgcagg

SEQ ID NO: 42034 - DNA, 121 bp, Artificial Sequence
  Synthesized
  misc_feature (61): n=t or c
tgtttccttttaggggcaaaatgaagtgcaaggaacttcctctatactaaaggctggcaangtgggcttgagattctacaactggaaccctgcatgtatcggatacctagcagcaggggat

SEQ ID NO: 42035 - DNA, 121 bp, Artificial Sequence
  Synthesized
  misc_feature (61): n=a or g
attaaatgtactctcagcttcagctcagcctctttatagacaaatttattcttttccatanacctgataaaagagtatgctcttttctaatgcagcagaccacagtttgaccaactggtgc

SEQ ID NO: 42036 - DNA, 121 bp, Artificial Sequence
  Synthesized
  misc_feature (61): n=t or g
tgcagggtttaactctctgtctctcacagtgactggagcgcttcctgctctcccgctgctncaggcacacgttcgtagccccagagctatggatgtcaagtgttccagctaaggaactccg

SEQ ID NO: 42037 - DNA, 121 bp, Artificial Sequence
  Synthesized
  misc_feature (61): n=a or g
atacacatctggtaatttagagtaatgagtttatattttctgtcttgcttcatgatctgcntgatattaatgcctttttaatcattcatgcattgctaggttatattttttctcaaaatta

SEQ ID NO: 42038 - DNA, 121 bp, Artificial Sequence
  Synthesized
  misc_feature (61): n=t or c
tttctctgattggcaaattttcttctaagaacattgttaaccgattgagagtgcaaagtangaaactcatctttgcaagttcatcccaaagttgccagtagcaactaaatattattgacag

SEQ ID NO: 42039 - DNA, 121 bp, Artificial Sequence
  Synthesized
  misc_feature (61): n=t or c
taataatttagtcctatgtcagagagagctaccctgctccaaagttaaacagtaactacantgcagagtctgacctatatcacagctcaagggaaaaaatattggtcaaaatgtatttttg

SEQ ID NO: 42040 - DNA, 121 bp, Artificial Sequence
  Synthesized
  misc_feature (61): n=t or c
cctttcagtgtgcattcagtatttactgctcatcactcatttttcattaaatatcacttangctgaaactgggttaatggtaggaacatctatgcatgaatattttgtcaaattggaaatt

SEQ ID NO: 42041 - DNA, 121 bp, Artificial Sequence
  Synthesized
  misc_feature (61): n=a or g
acatccgtgcaaagtgcccgagtgcctacaagctgctggctgtacacacacacagtggctntgcaaaaacccagctgtaccacagaaatgggggacagggcagggtgctgctccagggccc

SEQ ID NO: 42042 - DNA, 121 bp, Artificial Sequence
  Synthesized
  misc_feature (61): n=t or c
acctgctctccttcctcagtgtccatcactacacagcccacgcctccctaagtgccactanccttcattggccccttctcactactgtccagttaccccattccaaaaaatatctttaaaa

SEQ ID NO: 42043 - DNA, 121 bp, Artificial Sequence
  Synthesized
  misc_feature (61): n=a or g
taaaggcgtgccctcactgctgcggcccacagtgaaacttgatgccattatatatataagnaggatgctcagacgtgtttgaatccttgagaaattgcatgcacattggacatgtgtacta

SEQ ID NO: 42044 - DNA, 121 bp, Artificial Sequence
  Synthesized
  misc_feature (61): n=a or g
accagaactagtttcaggcagtattttcacaagcaacctacatacctgaacagagaatatncttaagtctgcagatcatcaagagctgacattgcagctatgctggataacaggctgaaat

SEQ ID NO: 42045 - DNA, 121 bp, Artificial Sequence
  Synthesized
  misc_feature (61): n=t or c
ctcatgcgatggtaaagctaatggcccagtccttcaggttttcttttaaaagtttcaaaanaccttaattaaaacccagaaatgcccactttgggaagaggaagaatagggacacttaatg

SEQ ID NO: 42046 - DNA, 121 bp, Artificial Sequence
  Synthesized
  misc_feature (61): n=t or g
atgttgctgcttgtcatgttgaaggggatatgtagatacactgatgggtgatggtgtgttngtatctgtgttgttttcctgcattttgtttatggttgattaatccctgcaagagggtctg

SEQ ID NO: 42047 - DNA, 121 bp, Artificial Sequence
  Synthesized
  misc_feature (61): n=a or t
catcttacttttgagtttatcccttagtgtgacagaaataagcaatcactagtacacaaanaatttatgtctacgtatacaataatatcttaattggtggtttggctttagctgtctcttt

SEQ ID NO: 42048 - DNA, 121 bp, Artificial Sequence
  Synthesized
  misc_feature (61): n=a or g
cactgagtggggcaggctgcttgcattgcccactctcctaatggccctatatggggagcanggtgaggggtcctaccatggggcttcagagcccccccccccagcactgtggggagacccc

SEQ ID NO: 42049 - DNA, 121 bp, Artificial Sequence
  Synthesized
  misc_feature (61): n=a or c
ctgccccaggtgtggcttccacccttagtttaaaatcactcctaaatgggttattttcttnatttatcccagccaatatacaacgtattcagaaggtgaaatttcctggtaataacaggaa

SEQ ID NO: 42050 - DNA, 121 bp, Artificial Sequence
  Synthesized
  misc_feature (61): n=a or g
gcaaatgaaacatggaatgtgtttgctcgttaaagcttccatgagaacccatccaggagtntaacagttgcagatacatgcactccttattttttatgctcaattggaaaaccttttgtat

SEQ ID NO: 42051 - DNA, 121 bp, Artificial Sequence
  Synthesized
  misc_feature (61): n=c or g
atctccccctttttttgacatttttatggctgaagtactttcattcattactttcaatcantattctgtctgtggagctccaaaccattggccaagtcagattcttgctgcagatctcaaa

SEQ ID NO: 42052 - DNA, 121 bp, Artificial Sequence
  Synthesized
  misc_feature (61): n=a or g
tgcaagaacataatttgggagaaaaaaaaagaatccctcagcataattcagctaatttganaagttccagttttatatatttgttgaatgggatcctccttgaacccctttcattttgagg

SEQ ID NO: 42053 - DNA, 121 bp, Artificial Sequence
  Synthesized
  misc_feature (61): n=a or g
ctgaaatggttctgtgattctactttgtctggatagtggatttattgctgaaatatggtcntaactgcaagaaaaactggaaggatttgatacagcttcttgaacctctgcttgtgaagac

SEQ ID NO: 42054 - DNA, 121 bp, Artificial Sequence
  Synthesized
  misc_feature (61): n=t or c
gattatcagaggtagataagtggtattttcagtcctgaaatcatttagtagaagctaaggntaaaatatgcattgataaacatttcttaggttgtaggggaagagaagtactcttcccaga

SEQ ID NO: 42055 - DNA, 121 bp, Artificial Sequence
  Synthesized
  misc_feature (61): n=t or c
aagatttaaagttttgttcgctgtaacatcagtgcccttgaagacttcttgtaccagaccnggaacagcactgcctgtgttggtgggaagggcaggaaggcagcaatgagccgctgttgtt

SEQ ID NO: 42056 - DNA, 121 bp, Artificial Sequence
  Synthesized
  misc_feature (61): n=t or c
tctgtaccagagctgagatcaattgaagctgttccttgagccatcccagcccgtcctactnggggaatgcatctgtctgctgtgctctgctttttggtgccttgtattaatcatgcgctgc

SEQ ID NO: 42057 - DNA, 121 bp, Artificial Sequence
  Synthesized
  misc_feature (61): n=a or t
gaaatctcactgcaagaattaaagtaataccagcaaataatcagctatgagatcctcctgngcttacagaaccaagagtttggatcccagatccgctggcctttggggtggttgtttttgt

SEQ ID NO: 42058 - DNA, 121 bp, Artificial Sequence
  Synthesized
  misc_feature (61): n=a or g
cacatacagagataaggtcaacaccacctctccattgtttccagattttaagtcaaggctntacagtcaaaagttaataattaacaatgttatttacaaatactaagcctgtttcatcgat

SEQ ID NO: 42059 - DNA, 121 bp, Artificial Sequence
  Synthesized
  misc_feature (61): n=t or c
tacaagaatttaagctcatgttttacagcttgaacagtacagttgtccctttctccatcantttatagatcactgttcaagggtatgaaaaactgagtcacatggtgattagtcaagaggc

SEQ ID NO: 42060 - DNA, 121 bp, Artificial Sequence
  Synthesized
  misc_feature (61): n=t or c
tttgtgtgccttcctgtgccttgaaatgttacaagtctttcaaactgcctttatatcttgntttaaacatggctatgctgttggatccagtcttgtcgtcttgaagaggttgtaaggtaga

SEQ ID NO: 42061 - DNA, 121 bp, Artificial Sequence
  Synthesized
  misc_feature (61): n=a or t
tctgatgccatgcagcagcaatgtgtgagtggcctggagaagtcctgttattcagcctgancttgtcgatggcgaaaggcagcgtgagattgaaaggggagaacaagtttggagtgatgag

SEQ ID NO: 42062 - DNA, 121 bp, Artificial Sequence
  Synthesized
  misc_feature (61): n=t or c
gagcactctgcaaaggaaatactcccatgtgtctgccagtctcctaaggaatcaatagcangtagtattaaaaggagtcatcttcagccacttctataacctccatcatcatcacagttct

SEQ ID NO: 42063 - DNA, 121 bp, Artificial Sequence
  Synthesized
  misc_feature (61): n=t or c
ttttgatgtgtgctgatgtgggtagggttgaggtttgcttcttgtgctgtgccacagaagngtgaccctcagactggcagcatttatctcacagggcatttaagagtaacgcatagagttt

SEQ ID NO: 42064 - DNA, 121 bp, Artificial Sequence
  Synthesized
  misc_feature (61): n=a or g
tgtgtacagctgtttagccccaaagcttattttctacaaatgccaaattttattgtcagtntatgcttttaaaatagcatcatgcaaagagggggattgtcttttgctgaagctcatgagg

SEQ ID NO: 42065 - DNA, 121 bp, Artificial Sequence
  Synthesized
  misc_feature (61): n=a or t
ttttaaaatcctatgcctggtattgagtcaatttcaactaattagttttgcacatgattgnatctccctctttcattatatgttgctttcatataatattagtggtgctcaggatgtttac

SEQ ID NO: 42066 - DNA, 121 bp, Artificial Sequence
  Synthesized
  misc_feature (61): n=t or c
cgcttacgtgtatatatattccttatatatgcttatgttggaaaatgagcaggttttctanactgttcttgtacagaacttgattatcccatattattgttcagaagtgctgatacatgtg

SEQ ID NO: 42067 - DNA, 121 bp, Artificial Sequence
  Synthesized
  misc_feature (61): n=t or c
aatttctccctctgtccttatcaagaggtaaagtggaggtgatgcattttaggactcattntttagggacataggaagcgttttatgtagggttattaaatccaatgttaatacccagctc

SEQ ID NO: 42068 - DNA, 121 bp, Artificial Sequence
  Synthesized
  misc_feature (61): n=a or g
ctgaagcaattcgatgcatggcccatataagtaaattaatctgagggagcctgaaacaccngttcatctctgctaattctctcctccacatcccatttggtgtaagaatacaatgaaatga

SEQ ID NO: 42069 - DNA, 121 bp, Artificial Sequence
  Synthesized
  misc_feature (61): n=a or g
agatcttcttccaaacatgatgctagcaaaagaataaatgccaaatatgttatgaggaacncttaccatcaaacaatacaattctcaaaccttagtactacaatctagaaaataaaaatta

SEQ ID NO: 42070 - DNA, 121 bp, Artificial Sequence
  Synthesized
  misc_feature (61): n=a or g
ctttttttttctctccacattcacttctgattcacatttatatgtgtttgcccaggcctgnttgccacagagagaacaaatgccagagaatgagaagtttctatgtgcagtggctgttttt

SEQ ID NO: 42071 - DNA, 121 bp, Artificial Sequence
  Synthesized
  misc_feature (61): n=c or g
aagagcggctgtgctgtcctggggccatccaggtgttaaatcactcagtggcccctacagngtcccgagccaaacatcgaaacaaaaggcaaagacagggaaggagagcgccagatatcac

SEQ ID NO: 42072 - DNA, 121 bp, Artificial Sequence
  Synthesized
  misc_feature (61): n=a or c
aatatatgatttagtaaaataagattctaattttcatcattcttacccagtcatttgggantgctgcacagctaatgtggaaaatattcaaggaaaagctgtttacatgctctcactttgg

SEQ ID NO: 42073 - DNA, 121 bp, Artificial Sequence
  Synthesized
  misc_feature (61): n=c or g
tcatgttgcttcaaacgttggtttcaaagctaattttaccattcctgctaaaaagtgacantttagccacgggctgtaagacccaggcagccctcacacacctgaagctatgggctgtgca

SEQ ID NO: 42074 - DNA, 121 bp, Artificial Sequence
  Synthesized
  misc_feature (61): n=a or c
aaacaaagaaatgagtaaatgaagatcacaaatcaaaacagcagaacagattttatgaatncttatgtacgcaaaatgtgtacgaaattgatattgaaatgcatttaaggcaacaaaataa

SEQ ID NO: 42075 - DNA, 121 bp, Artificial Sequence
  Synthesized
  misc_feature (61): n=t or c
gttttagggaccgaactgatttgctcctcgctggcaaagatgtgaaagctgaaagagtganaggaacatcaagtgagctgcagcgcattagcatgaagttcacatcaaatgcaaggagaaa

SEQ ID NO: 42076 - DNA, 121 bp, Artificial Sequence
  Synthesized
  misc_feature (61): n=t or c
gacttaaagttattcacccttttcactctgtaatttgtattaggaatgatgaagaaaccanagtttttaagagatgaaagaggagggagagagctagttggatagtttgttagattcctgc

SEQ ID NO: 42077 - DNA, 121 bp, Artificial Sequence
  Synthesized
  misc_feature (61): n=a or t
ttcccactagagcaaacctcctcccggagcttgtcaaaggcatcaggaggatgcttctacngtctacaggcatttgcaaagtcaacagacatttgcaaagtcaactggcaaaaacccacac

SEQ ID NO: 42078 - DNA, 121 bp, Artificial Sequence
  Synthesized
  misc_feature (61): n=a or g
tacttatcacacacagaaatatactagttttagcagtaagaaactggtatctttccaaacnatgtcggaaacttaaactgccctctactgaactgaaaacccttttaattacttttttctt

SEQ ID NO: 42079 - DNA, 121 bp, Artificial Sequence
  Synthesized
  misc_feature (61): n=a or g
ctgagagatgtttaagttattctgtgctgcagtgatttggacacatagctacgaaaggccntgctttgggccagctctagcctagcagttccttcagcttcacacaatttatgtgctcctc

SEQ ID NO: 42080 - DNA, 121 bp, Artificial Sequence
  Synthesized
  misc_feature (61): n=a or t
agtgctatgaagaaggtggtctctggtgccttggtacctaagggcaaattatgcagcgctntgccatctcttcagcttgcttcacagtcagcagctcttccaaagacagggagaaagcccc

SEQ ID NO: 42081 - DNA, 121 bp, Artificial Sequence
  Synthesized
  misc_feature (61): n=a or g
atgagcctctccttgttagtgcatcacctggggcggcccaccaaacctctgcacctgtccnggaaggtgttccccagcacccttagagagcagtgacttctcctgggacagaagcagcgct

SEQ ID NO: 42082 - DNA, 121 bp, Artificial Sequence
  Synthesized
  misc_feature (61): n=t or c
acacatcactttttctcatgatcttgacttaccttcttattgacctaatgggggagaactngatattttctctagaagatgggattacagacagcactgaacaaatgatctctccttttct

SEQ ID NO: 42083 - DNA, 121 bp, Artificial Sequence
  Synthesized
  misc_feature (61): n=t or c
ttgttatataaagcccagttattcaagtctgaaagtagtgtattctttcacagctaaaagnagcgattaatagaagaggaattgagattgcttcagcagtatgcaaggagtaagggttgga

SEQ ID NO: 42084 - DNA, 121 bp, Artificial Sequence
  Synthesized
  misc_feature (61): n=t or c
tgtatatatacacattcaatggcacaaatttgaagggaagatgaaaagcacaagcaatttntctgttgtagatttttcagcatcttgtaaatagaagtaacttacagatcaggtgatatca

SEQ ID NO: 42085 - DNA, 121 bp, Artificial Sequence
  Synthesized
  misc_feature (61): n=t or c
tgaggcatcttatattgtaggtggcatcgaagggaaaaactagtttaaaaaacatatgcangttcaactgagaaatctttgacatctacttttcaaatatttttcgaatagatcaatttga

SEQ ID NO: 42086 - DNA, 121 bp, Artificial Sequence
  Synthesized
  misc_feature (61): n=t or c
tggagattgtttatcttctgtggaaaggtaatttgtgtttgcctccttcctcttaacatgnggactgcagttatttcacccagccagaagtatattctgcttaggatattcaaacaggtgt

SEQ ID NO: 42087 - DNA, 121 bp, Artificial Sequence
  Synthesized
  misc_feature (61): n=c or g
cgcagcagtgtggtcatgaagtaaagaaacccatcggctccatcccgtttaagccctgttnggttccaagtgaggctggatttgggcactaagacacccagcgtgactgcagctaaatgct

SEQ ID NO: 42088 - DNA, 121 bp, Artificial Sequence
  Synthesized
  misc_feature (61): n=a or t
aaacaacatgaatacccagtatccttatttttggaaaaatctgatgtgaatttaagttacnattactcacataactttttcctgccattctttttctgtagattcccaattcaaaagcaca

SEQ ID NO: 42089 - DNA, 121 bp, Artificial Sequence
  Synthesized
  misc_feature (61): n=a or g
tgactgctttggcctatgtgctacccatgcacactgcctcgacgtgatgatagtgaaacanttttaacaggaaagaagtccttggacatatttgtcctcctgtatggttatccaagagaca

SEQ ID NO: 42090 - DNA, 121 bp, Artificial Sequence
  Synthesized
  misc_feature (61): n=a or t
gtaaaggggactgctacaggaaacgctggcacagaagtctcagggagctctcagtgcctcngaaacctcctaatgcagaaaacagataagaggtgaaatgtacaagactgatacaggaaca

SEQ ID NO: 42091 - DNA, 121 bp, Artificial Sequence
  Synthesized
  misc_feature (61): n=t or c
ttttgatggtagtgatttttttcctttttttctaaggcaaattatctttcactaatcttantgatgcttcatttagaccattgctgctctactggtaaatttttgtttttgatttttaaat

SEQ ID NO: 42092 - DNA, 121 bp, Artificial Sequence
  Synthesized
  misc_feature (61): n=a or g
cagtccagttttgtaccttcaaccatacaacttgaagttcagagaagagcaggaatacaanctgtaataccaatggaaaaaagctacttgtgatgcaggcagcagagctacttggatggtg

SEQ ID NO: 42093 - DNA, 121 bp, Artificial Sequence
  Synthesized
  misc_feature (61): n=a or g
ttacccaccataactctaacaattttatcttacgtacatgaggaaactggaaatatgctgnctgatgagacccatagaaccttggaatcacaaatgcaatcatagcggttgtagccaatgg

SEQ ID NO: 42094 - DNA, 121 bp, Artificial Sequence
  Synthesized
  misc_feature (61): n=t or c
ctacctagggacacgggagggagcgtgaatacccaggcagggttctaccagctggagcatngatgtggttgcactcacacagctgtgggattgctgctgcttgaagctctgcctccctttc

SEQ ID NO: 42095 - DNA, 121 bp, Artificial Sequence
  Synthesized
  misc_feature (61): n=t or c
ctatgtattacctggagtaagtggccaaaaactgggcaggacttcagaaagcatccagtgnatctgacgtttatttctattacatgagaaaccaaatttctgtacaactttatttgaatca

SEQ ID NO: 42096 - DNA, 121 bp, Artificial Sequence
  Synthesized
  misc_feature (61): n=c or g
tcatttacctgctattgctctgctccttctttcttcattgtgtgtcctcacagcagctctntgtgcgccccagcagagcctggctgatcttttccaaagcacccaccattctgctcaccca

SEQ ID NO: 42097 - DNA, 121 bp, Artificial Sequence
  Synthesized
  misc_feature (61): n=a or g
ttatcaagtcttagatctgtcaaggcaaaaacaggatcaaagaccacagtgtggaaaacangttgaatgtaaaagcacgtgcatcaaagcagaaaaaaggcagtttctttggctttctgga

SEQ ID NO: 42098 - DNA, 121 bp, Artificial Sequence
  Synthesized
  misc_feature (61): n=t or c
tcactgagaaagaattagactgtgatgatttttttttctgatttatagaggataaattacnttttttctattttgtatgtcttagtcagctttgtagacacacccacatatcatatggtgc

SEQ ID NO: 42099 - DNA, 121 bp, Artificial Sequence
  Synthesized
  misc_feature (61): n=t or g
tctgtccacctctgggatgatttatgggatttatcagtgctctgagtgctttgtaggaccngggagccccaggattgccgttcactggctgtatcccagctgggatctctcagcagcacca

SEQ ID NO: 42100 - DNA, 121 bp, Artificial Sequence
  Synthesized
  misc_feature (61): n=a or g
agacatatacggagaggggaatgtgagatatgagcagtgatggatagcacatcacctatantttaattctaatgtggactcaaatctgctcttaaaatagttaaaattactaatgcagttt

SEQ ID NO: 42101 - DNA, 121 bp, Artificial Sequence
  Synthesized
  misc_feature (61): n=a or g
aattctgcatcagctacacaatctgaaaataattagtttctctccctaggcatcacagagnaagccctaattataagtttactagagtttgaatacatttttaatagtttcttttcattca

SEQ ID NO: 42102 - DNA, 121 bp, Artificial Sequence
  Synthesized
  misc_feature (61): n=t or c
aggacacaaacataaatactgcataaaatttaaaaccacaaaagttcattagcaaaataantgaaaatttgaatgtgaggtaaaaagaactgttgtccccttcctacaaaaacagggtgac

SEQ ID NO: 42103 - DNA, 121 bp, Artificial Sequence
  Synthesized
  misc_feature (61): n=c or g
gctgcactgtctggcattgtctccctcttggaaacactgcttctgactgttaggtgccctnatgtagtgctgggccctctgggtgttgggataccatgctttttcctaatgcaggtactca

SEQ ID NO: 42104 - DNA, 121 bp, Artificial Sequence
  Synthesized
  misc_feature (61): n=t or c
aatccacgaggagttggggctgaagtaaaacccactgcttgtacagcttgagcccttctcntcagtcatctggaaagcaaacttcatttttgcaggtcgccatgaaatccacacgtctgtg

SEQ ID NO: 42105 - DNA, 121 bp, Artificial Sequence
  Synthesized
  misc_feature (61): n=a or g
tgttttccactgccatgtggggacaacacagttttaagggcacatttgcaactcagaacanaggctaatgaacatgataaacatgccctgcctggcaaaccattatatctgctagcacaat

SEQ ID NO: 42106 - DNA, 121 bp, Artificial Sequence
  Synthesized
  misc_feature (61): n=a or g
ataggaatccatgagttggcagcttgacactggcaagttcctgaactccaaaggaataccnaaacttttttttagtggggaatggagcggggtgaagtgagaggtaatgtggccggtaatg

SEQ ID NO: 42107 - DNA, 121 bp, Artificial Sequence
  Synthesized
  misc_feature (61): n=a or t
ctttcatacaaatcagactcaaatacaactcagaggtctttgaccatggattatttttggnccatctgaatgccatacaagcaatacatagtcttcaacactagatatttgaatagttggt

SEQ ID NO: 42108 - DNA, 121 bp, Artificial Sequence
  Synthesized
  misc_feature (61): n=a or g
ttctcctgtttagagctgcctgcttacccatgtgcacaccttccctcttttgcagttgtgntgtagtttaagaacctgtggcggaggacctttggtcagaagttgagatgtattttgaaca

SEQ ID NO: 42109 - DNA, 121 bp, Artificial Sequence
  Synthesized
  misc_feature (61): n=a or g
tccatttgttgtctgcttctgggaaaggaaaaggtactacctgcaaaaaaaaaggagtganaaagagtgacttcactgtggtagattcacttattcatctttaaaaaataaataaaaaaat

SEQ ID NO: 42110 - DNA, 121 bp, Artificial Sequence
  Synthesized
  misc_feature (61): n=a or g
gcttaggggtcacagggagctatagacaagtgaaaggaatggccctggggatgtggttcantctatggtgtgtcagaacaccttcagtgggggctcacatttctcctgagcagatgggctg

SEQ ID NO: 42111 - DNA, 121 bp, Artificial Sequence
  Synthesized
  misc_feature (61): n=c or g
aaactgggtcttgtacctgtcactgcacaagaagctaaagccttcatgtggaattcataantgggagcagacgttcaggttccttcctctcagattgtctgttgaatggtcctactttcat

SEQ ID NO: 42112 - DNA, 121 bp, Artificial Sequence
  Synthesized
  misc_feature (61): n=t or c
tggattcttactgagaccagtatatggcacatggaacgtagttatttctaattagagttanggtatttatcatgacgctccacaaattctgtggcaatctataatgtgcaataagtgacaa

SEQ ID NO: 42113 - DNA, 121 bp, Artificial Sequence
  Synthesized
  misc_feature (61): n=a or t
tactgggacaaaaggatgttttgggtggttttgtgcctgtctgggaaaggacagagctccnaaagaatggagctctgtgacagaaggtggccagggagacgaaggcagccaatggaggtgg

SEQ ID NO: 42114 - DNA, 121 bp, Artificial Sequence
  Synthesized
  misc_feature (61): n=t or c
taggatggattatctgaaaaaaaatggtgtgctaggtggtcactgggaccactgatacacngaaagaggaattcttggggggaaactatgggattcctgggtttcccatggctgagtgctt

SEQ ID NO: 42115 - DNA, 121 bp, Artificial Sequence
  Synthesized
  misc_feature (61): n=a or g
tccattcctaatttctaatgtcatttaatgtcctgaatataaatggccctgtatagctagngctgatgagatattttgcctcacaaatatttttacattactccacagaaaatattttctg

SEQ ID NO: 42116 - DNA, 121 bp, Artificial Sequence
  Synthesized
  misc_feature (61): n=t or g
gaaaaaaaaaaaactaaaaccaaccaaatgcaagagacactcaccaaagttcaaggtagtngtttttcctccatgtcgcagctttgtcacatcttttgggtctcaactttcacttcatctg

SEQ ID NO: 42117 - DNA, 121 bp, Artificial Sequence
  Synthesized
  misc_feature (61): n=a or g
gcctcaccactttgagaggacacccttcctttacggtatgccagtagatcatgtcaagaanatataaagagcctggattacagctcctatttttctcaccttgaatactaatagtgatggt

SEQ ID NO: 42118 - DNA, 121 bp, Artificial Sequence
  Synthesized
  misc_feature (61): n=a or t
caaaaatgtaaatctcagagctcgcaaggtcgctacttctgatgtcatagttatatcatanacaacttttatcccaatgcatacactcttgcagtattccgttgcttgatttcttcatctg

SEQ ID NO: 42119 - DNA, 121 bp, Artificial Sequence
  Synthesized
  misc_feature (61): n=a or g
agttgagataatgaaaagctgcagtaataattgaggtagtgttatgattttttcactgatngacttcctttctttttgtacttagcatgtcctgtgcaaggataagttttggcaacaagcc

SEQ ID NO: 42120 - DNA, 121 bp, Artificial Sequence
  Synthesized
  misc_feature (61): n=a or g
aaagaggtttttaggtcaaaacgtaattatgtggcttgactgtctgaatgtagtaaatccnaaatttggacccagaaactcctgctttgacctctgcagcatctaacttctcacctggatg

SEQ ID NO: 42121 - DNA, 121 bp, Artificial Sequence
  Synthesized
  misc_feature (61): n=t or c
gcttggttggagcatcagctccaggaatgtgaaaaattcatggcctgtcttgtgcatgcangctgtaaatttacagaacatatgcaggtaggaagcctttgacctctgatataaggtattc

SEQ ID NO: 42122 - DNA, 121 bp, Artificial Sequence
  Synthesized
  misc_feature (61): n=a or g
agccagccaagtgctgtcactgctgggcagccacacaggaaatgagcacagacgcgttccnaaatgtaacaccacatctgagcctgtttttaaaatggaggccttcagaaacgagaaggca

SEQ ID NO: 42123 - DNA, 121 bp, Artificial Sequence
  Synthesized
  misc_feature (61): n=t or g
atcctattttcacaaaatttctatatttaaaaaacttgcctaaaagatttcgatttctttncagccagtactttgagatctgatagttgtccgtgagatggtacttcttcagtcattttat

SEQ ID NO: 42124 - DNA, 121 bp, Artificial Sequence
  Synthesized
  misc_feature (61): n=a or g
tttttagaccatggctgtctgtaaattccattcagtcagtatcattgagaggtagggcacnaaaggaaaccttcttaccaattacttttttcttcaaacttccatcggtggaaggaccctt

SEQ ID NO: 42125 - DNA, 121 bp, Artificial Sequence
  Synthesized
  misc_feature (61): n=a or g
aggaagtcaaaacagtcattgaactgaccttatgcataaagtaggtcattgtacttccccnataccaaacagagccatataaatacccaacacacatagaacatatttttggaaatgaaat

SEQ ID NO: 42126 - DNA, 121 bp, Artificial Sequence
  Synthesized
  misc_feature (61): n=a or g
caccaaaaagttgagtattcaaaagatcagaagtacatcccagcatgaatcagccaggagntgtgtatgtaagatcaaatggatcatcaatgcaattagcagcctgggttcctgcaggggt

SEQ ID NO: 42127 - DNA, 121 bp, Artificial Sequence
  Synthesized
  misc_feature (61): n=a or g
gttagtgtggagatgggaaattcttcttaaattgtcagtaaaaataaagcctccagttcanacacttcaaatgaactgtcaatccatgtaaatgtgcctcatatatttgtttctcctttct

SEQ ID NO: 42128 - DNA, 121 bp, Artificial Sequence
  Synthesized
  misc_feature (61): n=a or g
agcagagtggttgtattaagttgcagagagatttatatattcataacaagggatgcatgtngtaaagccacagcccagggtctatggatttttataggtctatgcacaagcagtgaggaag

SEQ ID NO: 42129 - DNA, 121 bp, Artificial Sequence
  Synthesized
  misc_feature (61): n=t or g
aagctttgtgtttggagtagggattgctgtgctagagaagggcttgaaagggaatagcagnaggctacatcagatttagctacagaagctgatagaaacagaaggaccaattgtcaaagtg

SEQ ID NO: 42130 - DNA, 121 bp, Artificial Sequence
  Synthesized
  misc_feature (61): n=t or g
tcagcattcagacttctccctctttcacttcaaaaggcttatgatccaaattgaatagcancatttaatagcctgcatggatactaaccaatctaacttcatttacagtgtttccaaagta

SEQ ID NO: 42131 - DNA, 121 bp, Artificial Sequence
  Synthesized
  misc_feature (61): n=a or g
ctatttttggctctagtatggggtagtacacctctgaaaattacctttgttgcacatgatncctatcataatgttgactctattgtatcctcagcaaatatgaaattagaacccatagttt

SEQ ID NO: 42132 - DNA, 121 bp, Artificial Sequence
  Synthesized
  misc_feature (61): n=t or c
ccatacaggaaagcagggacgcgagacagaagcttaaaggcagtgcttttggaaaaacagnaaatgcctacaaaatagcagaagaacaaagcatgtgggttaggagcataaacagtgaaga

SEQ ID NO: 42133 - DNA, 121 bp, Artificial Sequence
  Synthesized
  misc_feature (61): n=a or c
tgccagcgtcctctccaaggccctgagtttgctgtagaaaatagggcacggtgagtggggncaggaaaacgcgggcatggctcagtgaatgccccgtgatcacccagccccacactcactg

SEQ ID NO: 42134 - DNA, 121 bp, Artificial Sequence
  Synthesized
  misc_feature (61): n=a or t
agacaaatccaattccagaaaaagcaatatgtttttcaaaggcattggctaccttcactangtctgcattagctttcctgtcccttccactcaagatgttcctcacacaccaagccttgtg

SEQ ID NO: 42135 - DNA, 121 bp, Artificial Sequence
  Synthesized
  misc_feature (61): n=t or c
ttatctacaacacaccaagggaacaggcattgtgctttaattctaaccaggagagatattnattaagatgttaagatagaagatcactctactgaaaaaaaaaaaaggcacagaaagcact

SEQ ID NO: 42136 - DNA, 121 bp, Artificial Sequence
  Synthesized
  misc_feature (61): n=c or g
gattcaaagctggtgaaaagaatacaatattccttaaatattttaagaattataatgcatnttactgaataccaaaggttttcaaaatccaacccattagagcctccagaagctttatgaa

SEQ ID NO: 42137 - DNA, 121 bp, Artificial Sequence
  Synthesized
  misc_feature (61): n=a or c
gcagcatcctcgagctgtctgcagagggagctgctgaagaggctgagggggtgcaaacctncactggttaattggcttcagaacaaacagcacaagctcgcacaaagcatattgttctgtt

SEQ ID NO: 42138 - DNA, 121 bp, Artificial Sequence
  Synthesized
  misc_feature (61): n=a or g
ctgctgtgagtacagacgcccagcagctcctgaagcttagatctcctctaacgtacctacnacgaactgctccaaaacgccagttaattgggaaagttttagactgaagtgcctaaaagag

SEQ ID NO: 42139 - DNA, 121 bp, Artificial Sequence
  Synthesized
  misc_feature (61): n=t or c
agccacagagctgtagacctcaaacagctcccagtaatttcaaaatagaaataatagcaangttttctgtcttccttctcaaccagcaggagaaattgtttgattatattctgtctttgca

SEQ ID NO: 42140 - DNA, 121 bp, Artificial Sequence
  Synthesized
  misc_feature (61): n=a or t
tttctctgagaaattgggcttctatttttcttctctgccttcaaattttaaacacctattngtgtttatgaatggaagtatgttgtaaagcaataaacactgcctcaagttcacaatgaaa

SEQ ID NO: 42141 - DNA, 121 bp, Artificial Sequence
  Synthesized
  misc_feature (61): n=a or g
cttcagtcccactcactgctgtgggagttaaatgacacacgggcctcgtgctggcccttcntgctgcgatacgtgtcagcctgggtggactcacagcaaaagcttttacagagtgaggaaa

SEQ ID NO: 42142 - DNA, 121 bp, Artificial Sequence
  Synthesized
  misc_feature (61): n=t or c
aaatacactccccttgcatatttcctatgggatattcctatgagagaaatcttttggcacngagtcttatcacaagagacaaacaaaagatgaagaggttgaaatctataatagattcatt

SEQ ID NO: 42143 - DNA, 121 bp, Artificial Sequence
  Synthesized
  misc_feature (61): n=a or c
tttacctaaattctttttcatggaccataatataacagtgaattggtttaattgtagatantggtcattgcatataaggctaagtgtgatatggcaatttaaactaattttaaatcaaaaa

SEQ ID NO: 42144 - DNA, 121 bp, Artificial Sequence
  Synthesized
  misc_feature (61): n=t or c
tgaggagcagtcccagccccagagaacttgttcagtcaaagactttgctgtgagttgcaanactaaaacacactaccatgcaaaagtaaactgaagttggcttggtttccagctagctctg

SEQ ID NO: 42145 - DNA, 121 bp, Artificial Sequence
  Synthesized
  misc_feature (61): n=a or g
ttccactttggggaataaggaggaagagcataattaatatgaagtattttgcaaaaatagnaaaaaaaaatagactcttcagtatcgacaggaaagcttacaggagtcaagcacgttgaaa

SEQ ID NO: 42146 - DNA, 121 bp, Artificial Sequence
  Synthesized
  misc_feature (61): n=t or c
tacgtgtgaagttactacgtatgcgtggtctcaaattgtgggcaaatcctgttcatccagncttaaggactctgcttggggctcttggtcaggaaaggggcagggaaggtgtcaaagggag

SEQ ID NO: 42147 - DNA, 121 bp, Artificial Sequence
  Synthesized
  misc_feature (61): n=a or t
ttgactgctcgttatcgttagtccttgtgttggaagtaacactctgtgttcattgtctgcntttttagctgtttgttttagcaatatttttttttttatataaaacaaatgacaaggcacg

SEQ ID NO: 42148 - DNA, 121 bp, Artificial Sequence
  Synthesized
  misc_feature (61): n=a or g
cccgcagaaaggctgagcagttctctcatctgcccctgaaagctaccctggctttgaagantgcaggcgtaggtgtttctctctcatgcctctctctcacggaagaacaaaagcacgtttg

SEQ ID NO: 42149 - DNA, 121 bp, Artificial Sequence
  Synthesized
  misc_feature (61): n=a or c
tgccttcactctcatatctgagcttttctggtacgtgtttcactgagaccaaaaaaaattntttgctctaagagcaatgttggagtgtgatttttttaacaacagatgatctcttttttta

SEQ ID NO: 42150 - DNA, 121 bp, Artificial Sequence
  Synthesized
  misc_feature (61): n=t or c
catggtagtgttgcagcaggtttagccttttttagaaagccatccagacaccaccttcagnggagaaaggctgaagaagagcatgagaaagataatgatggtgaggggagcagcagaagcc

SEQ ID NO: 42151 - DNA, 121 bp, Artificial Sequence
  Synthesized
  misc_feature (61): n=t or c
ccccgttaggctctgccatgaagtctctttgataacatttttatggccccatcaatcttanttaaacttcagcacaaataaatggcagtgcattcacagccccatcacggcgctctgactc

SEQ ID NO: 42152 - DNA, 121 bp, Artificial Sequence
  Synthesized
  misc_feature (61): n=t or g
taattcagcaggaaacttcagtgaaactaaaaaacccaatctacctcaaatattagctgtnactgaaaaactatgatctaatgaaaccatcctgaactgacatttaataacagatttttac

SEQ ID NO: 42153 - DNA, 121 bp, Artificial Sequence
  Synthesized
  misc_feature (61): n=t or c
gggtggatggatggatctgggatgctctgctccttgggagaggggcacatctctgaaggcnccttgtttggtgagtttcagcggttatctgagggcatctcacagctgcaggagttacaaa

SEQ ID NO: 42154 - DNA, 121 bp, Artificial Sequence
  Synthesized
  misc_feature (61): n=t or g
tgttttacaaatcgtatctttccattattacagtaataaactggggactattatttttcantacaaacaaccatggcacaatgttgggcgtttcggcacacacaggtttcctcatatgtgt

SEQ ID NO: 42155 - DNA, 121 bp, Artificial Sequence
  Synthesized
  misc_feature (61): n=c or g
ttatcatccttgaaattttctcttagtaaatcaaccatccaaagataaaatgcacctgtgncatattggggaattctttcctcaagaccatattaccttttccttctgaaggaggggtact

SEQ ID NO: 42156 - DNA, 121 bp, Artificial Sequence
  Synthesized
  misc_feature (61): n=t or g
tgtagccaccagagaaacagtcaccacagcgcagaaacacttcacctccactagttcagantatctttcagaccacagcatctgtaccagcactgaagaaactttttatcgtaagaaagtt

SEQ ID NO: 42157 - DNA, 121 bp, Artificial Sequence
  Synthesized
  misc_feature (61): n=c or g
tccttactgaatgactgtgaactgtgggtatttacagctttgcagttaagatcccaagagnccaatcttaatgaatcaaaagctgataatcattctgagaagtgtaaaatgggaggattct

SEQ ID NO: 42158 - DNA, 121 bp, Artificial Sequence
  Synthesized
  misc_feature (61): n=a or g
cacaaactgaactgatctttttcctaaagtctctaagagagatggggggaacgcagtggcntattttctgtcagctctaaaacctcttcaagcttgataagaaaagagtgaatttttccct

SEQ ID NO: 42159 - DNA, 121 bp, Artificial Sequence
  Synthesized
  misc_feature (61): n=a or g
acttaagcacatttccactctatgattcagtggaaaggctatgatcccaaggacaaggctncagttaactgactgcctccctttctaattcccttcctacagctgcacgttactataacca

SEQ ID NO: 42160 - DNA, 121 bp, Artificial Sequence
  Synthesized
  misc_feature (61): n=c or g
gcattactactccatacagaaaccaggatcatgttttcctcggcgttgtgaaaaacttagnaaagatatgatcctgctctaagagcttcatccgaactgcgtgaccagagacaacaggtgt

SEQ ID NO: 42161 - DNA, 121 bp, Artificial Sequence
  Synthesized
  misc_feature (61): n=t or c
ggagttaaagcaattgagctaactgttcaagtgctttgcagtattgcctttgtagaagcantggcataaatgcattttcatgtaacaaggaatgcagaagggcttgtgcattgcataaatt

SEQ ID NO: 42162 - DNA, 121 bp, Artificial Sequence
  Synthesized
  misc_feature (61): n=t or g
ccttcaggtggaagatacaaatgttagcacatccatccacagggagacttggagcgttctncactgaacgtctccttctatcccaaccacacacattacagcggggcaaataattaaaaga

SEQ ID NO: 42163 - DNA, 121 bp, Artificial Sequence
  Synthesized
  misc_feature (61): n=a or g
gagcgaagcagtccgttgcactcagaatgaagcattagcccttgcaagaaaagtgaggganagaaaggagaacttggcagaggcagacagagatgatgctaccatgcatggctaccccata

SEQ ID NO: 42164 - DNA, 121 bp, Artificial Sequence
  Synthesized
  misc_feature (61): n=t or c
ggtctgaacataaacctacactgaagaaatatgttattttctatcataggcaacactgctnagtgtggcactgataattttaacactaatttcaaagacgtctccttctccccctaggcca

SEQ ID NO: 42165 - DNA, 121 bp, Artificial Sequence
  Synthesized
  misc_feature (61): n=t or c
ggattgaatggcatgataatgcatagagattgctgacgcaaagaagaggcacaagcctaangtcactgtgaaaatagcctttactcaacaaaactcagaggcagttgtaagtgctaattta

SEQ ID NO: 42166 - DNA, 121 bp, Artificial Sequence
  Synthesized
  misc_feature (61): n=a or g
cagatccacactgaatgaacttggtatactttgagactagtagatcagaccaaatacagantgtaaatctttctttactgtctttcattattttttggaacctggcaattcctttctcctc

SEQ ID NO: 42167 - DNA, 121 bp, Artificial Sequence
  Synthesized
  misc_feature (61): n=a or g
tcaaactaacacactcattttatttctaggaagattgatactccctccctccccaaagatnagagaaaaaagtaattgaacatatgtaacagcagtgaagctcagctaaatacttcctgtt

SEQ ID NO: 42168 - DNA, 121 bp, Artificial Sequence
  Synthesized
  misc_feature (61): n=a or g
tggaacggtacaagaatatgaagataacggaaacgttcaatgagtaatctcgtgctgctcnttttattctgcacatgcatttgcttgactactccatgctgaaagatctacaaacacttgt

SEQ ID NO: 42169 - DNA, 121 bp, Artificial Sequence
  Synthesized
  misc_feature (61): n=t or c
cggcctccttcagtaaatgcaaggttgttgccatggaggacaggaaatccctcgtctgcanggagaaggaaaacattggaaactgtcctactgtaaagcgcagctgcctctgtgctgggag

SEQ ID NO: 42170 - DNA, 121 bp, Artificial Sequence
  Synthesized
  misc_feature (61): n=t or c
ggtgggcaggagcgaggggagcagatggggaaggtgcctcccatctgatcgtctgctgcgntgctgagagctcctggtatttttgtattgctcttccaaatgcctgcgggtgcagccctaa

SEQ ID NO: 42171 - DNA, 121 bp, Artificial Sequence
  Synthesized
  misc_feature (61): n=a or g
ctatctccaaagcaacaactgaccttctattatattacagcatcccttcaactccttgacntatttactcacaatccaaactagaattttctaagcccacacttctgaaatccctaaggag

SEQ ID NO: 42172 - DNA, 121 bp, Artificial Sequence
  Synthesized
  misc_feature (61): n=t or c
tgttgtagagaagaaattctcattccttctatctgccatctgcagggaagatcttacctantaggcgaagaggggctgcaaaaaagcagcctataaagcaagtctttaagcatgcaaattg

SEQ ID NO: 42173 - DNA, 121 bp, Artificial Sequence
  Synthesized
  misc_feature (61): n=c or g
tttaaaagcctcctcccttctaccaggggattgaaaagtcagaaattcatgtcaagaacanattttatatattgaaaattaagctatcacctgaaaagaaactctacagccttttaacttt

SEQ ID NO: 42174 - DNA, 121 bp, Artificial Sequence
  Synthesized
  misc_feature (61): n=a or g
agtggaaactagctgggagtgcagtgttttcttcctgctctttctctgtggaacctgggcncaaagggctctaagccttgtcccaaagcccaaggtcatgctccactgcaagtacaggtgc

SEQ ID NO: 42175 - DNA, 121 bp, Artificial Sequence
  Synthesized
  misc_feature (61): n=c or g
ccggcagctccaggacctgtaggacatcaggcagaacacagccagtcattataaagtcatnctccttcccaccaaagctgacagtgcttaggctcagtctgtaaatgaggtgtagtgaatg

SEQ ID NO: 42176 - DNA, 121 bp, Artificial Sequence
  Synthesized
  misc_feature (61): n=a or t
tcagtgtcattggaatgacccaggatgcttttctcactctttattaagaaatactatgggntttatttgcttgaattttaatttagaaaacccgatggggaatatatgttcaaattagaag

SEQ ID NO: 42177 - DNA, 121 bp, Artificial Sequence
  Synthesized
  misc_feature (61): n=t or g
gcaagcccagatgaagtaacctgtggagttacaaaagttcaaccaccttgattttgagccngccattatttttcttatggcagtttttctttacttagttaactaccatagcatttgttca

SEQ ID NO: 42178 - DNA, 121 bp, Artificial Sequence
  Synthesized
  misc_feature (61): n=a or g
cttttccccactacatgactgaaacactcgggagagaacattagggcaagaaaagaaacanggcattccaagtttaataatccttttgctattagtcagtgttttaggagccacaaatgct

SEQ ID NO: 42179 - DNA, 121 bp, Artificial Sequence
  Synthesized
  misc_feature (61): n=t or c
gcctgatgaaggccaacatcacagctttttggaaattcacatatttcagccatcagcttcngtttgagtggctttcctgaggtctctgaggccagccctctgagcagcagtatgctctgtg

SEQ ID NO: 42180 - DNA, 121 bp, Artificial Sequence
  Synthesized
  misc_feature (61): n=a or g
caaatgccctctaaaggaaggagacgatacttatttcttatatcatttggcttctgcatangttataattagcagcatggcacagtgctgtaaattgtcttctcaaactaccaatacccat

SEQ ID NO: 42181 - DNA, 121 bp, Artificial Sequence
  Synthesized
  misc_feature (61): n=t or g
tttagtcttttgtagtattttaggaagggtgctatgcacactgagaacatttgtttaaaanatgcaaatttaagtgccatttagtacatttttgaagccaaaagagcattcttcagaatgg

SEQ ID NO: 42182 - DNA, 121 bp, Artificial Sequence
  Synthesized
  misc_feature (61): n=t or c
ctactgccttttaacagtattcagtgagattcagaaggatatagagatatcctccaaagtncaacgtattttttgatatgataggcagctttcatacaaactgcagattgtgtgccatagc

SEQ ID NO: 42183 - DNA, 121 bp, Artificial Sequence
  Synthesized
  misc_feature (61): n=a or t
catgaaatagcatgacttactaataaggaactcactttgtagcctatttatagtaaggaantttttttcaaaattagatctcacagttagttcactgttatgcagtaacagtaacaatcag

SEQ ID NO: 42184 - DNA, 121 bp, Artificial Sequence
  Synthesized
  misc_feature (61): n=t or c
agtaaaggggaggaccagtaggatgctcagtgctgtgactattgaggggataaggaatggngagtcttggaaatgctggcttactgagctcagcacagcacaggagttgaggagaaaaagg

SEQ ID NO: 42185 - DNA, 121 bp, Artificial Sequence
  Synthesized
  misc_feature (61): n=a or g
attagaaaaaaatgtattgcaaaaattatctctcctgttgagacacttactctggtctatnattttatcctattttttaagaacaacaacaacaacaacaaaatcacggacaatatacatc

SEQ ID NO: 42186 - DNA, 121 bp, Artificial Sequence
  Synthesized
  misc_feature (61): n=t or c
agaggcactgttttgtttgtttgtttgtttcactgactgaaggaatttgcatggctgtgcntgagggaataaaagtgcttcaatggaaatcttgttctcagtgatgaggatgaggtatggg

SEQ ID NO: 42187 - DNA, 121 bp, Artificial Sequence
  Synthesized
  misc_feature (61): n=t or c
agtcagcatcacggactgtacatcctcagaaaaagattagagaatagtctacaattacaanccgagtccaaattagaatccataccaacacagggtgaatctgtacgcattgcacagaccc

SEQ ID NO: 42188 - DNA, 121 bp, Artificial Sequence
  Synthesized
  misc_feature (61): n=t or c
gctccactaaagccaacaggagctgtgccaagagctttgctgggtacagggtgaagctttnaggcccggaaaaggatgggaggatttctggtcaggatgagctgtgtcatggttccagtct

SEQ ID NO: 42189 - DNA, 121 bp, Artificial Sequence
  Synthesized
  misc_feature (61): n=a or g
accatggaccgtgcttgtttgcctgatctgtagacttgcaaaagagcacaatgcaatagcnactgttacgttactcttgtcatttgcttcaggtcagggttgttagagtgactggctgtga

SEQ ID NO: 42190 - DNA, 121 bp, Artificial Sequence
  Synthesized
  misc_feature (61): n=t or c
ttttttccttggaaattatagatcttagaatcatcttatggtggaccaaactcctgttttntttttatcaagtttctagcctctaacttctgtgtttagagaatgcgattgtgcagaatga

SEQ ID NO: 42191 - DNA, 121 bp, Artificial Sequence
  Synthesized
  misc_feature (61): n=t or c
gcctgtaccctgctgatgatttgtgaactctgcagtagtttccttcttttccaatgtttcngaaaatttcaatagaaattcaggcagctgcagaaacgaggcaaggctcctctgtgcattg

SEQ ID NO: 42192 - DNA, 121 bp, Artificial Sequence
  Synthesized
  misc_feature (61): n=t or c
ggataagaagaaactgtttcaggggcttagccggagccatgaggatgcagaaacacccagncccaagaacaagtgccaaaagaaaggtttcctcacatttcttgtcatggtgatagtatta

SEQ ID NO: 42193 - DNA, 121 bp, Artificial Sequence
  Synthesized
  misc_feature (61): n=a or g
gagtttggttttggtgagtagacaaaggtgttttaggcctatgcttttatattactttatnctctattatgtgttttttgccacctctgataatatttattgctaatgtcctttgatgttg

SEQ ID NO: 42194 - DNA, 121 bp, Artificial Sequence
  Synthesized
  misc_feature (61): n=t or c
agtatatgggtcagcatttgaaacctaaattttattctattatttttgcttgaaaaggagngtggaggcaaagcttaatttaagttggtcttttaaaaaacaagttaatgctactgcatga

SEQ ID NO: 42195 - DNA, 121 bp, Artificial Sequence
  Synthesized
  misc_feature (61): n=c or g
ggtcccctggtgcaggcaggatgcagcaggacgtccaggttttgccccagtctggcttcanaccaggcttggtgtaagcctgctttcccagcctttttccagacagaaatgtgggagagct

SEQ ID NO: 42196 - DNA, 121 bp, Artificial Sequence
  Synthesized
  misc_feature (61): n=t or c
caactaaatggacctgacaaagccatcctttcagccagcactccaggtcactgcgctgcangcatgatggcaaaaggccagtgacctaagcagacctcattgcagaggcttttcctgctct

SEQ ID NO: 42197 - DNA, 121 bp, Artificial Sequence
  Synthesized
  misc_feature (61): n=t or c
tggccctgtggggaactgtagcactgagaaccacagtctgctgccataatgttgggagggntggagctggccagcttctctttgtactctttgtgctccagggctcggcttgggagctttt

SEQ ID NO: 42198 - DNA, 121 bp, Artificial Sequence
  Synthesized
  misc_feature (61): n=a or g
aaaaataagtgccaaagctgggaaggtttgggaaggtgtggctttgttctcccaggttcantaacttagatcaaaaaacctctcctcgtgaaccacatttgccagcactgataataaacag

SEQ ID NO: 42199 - DNA, 121 bp, Artificial Sequence
  Synthesized
  misc_feature (61): n=a or g
tacagccataagagaagtacttttaacaaattttgtgaaaattcacaaaccttactgcaangtcagatgtactaattccaggaatgaccagaatatatcttatctgagcattgaaaagatt

SEQ ID NO: 42200 - DNA, 121 bp, Artificial Sequence
  Synthesized
  misc_feature (61): n=a or g
gtgatgaatctcatttgcttgcatgcgtgtttactatcattattctttattatttgctgcnatgctccagctgagacagagctctcaccttgctgggtatgctgcatagtgggggttaatt

SEQ ID NO: 42201 - DNA, 121 bp, Artificial Sequence
  Synthesized
  misc_feature (61): n=t or c
gttttagcaacagaaaagggaataaaaatttttaggaactattcgtaacactatgggtatncatagcagcttctagctcataattaaatgttaaagccattcatcttctttactggagagc

SEQ ID NO: 42202 - DNA, 121 bp, Artificial Sequence
  Synthesized
  misc_feature (61): n=a or g
tttgttgtttttgagataacgaagtgaaatgagaacacacgaaacaccaaaagtacatccncgtgctctctgatatcaaagctcctgccgcacatctgtgctgctttgaagatgagacgta

SEQ ID NO: 42203 - DNA, 121 bp, Artificial Sequence
  Synthesized
  misc_feature (61): n=t or c
ctttcaggcacattagaagccaaaacacattaatatgcttatgcaaaaaaagtagcatacnttagggaaaggtgtacttgacaaacttgtacgacttggtatttgccctgacttacacaca

SEQ ID NO: 42204 - DNA, 121 bp, Artificial Sequence
  Synthesized
  misc_feature (61): n=a or g
gactctacgccttgttttgtaccaacatcgcgtgtccttcatccagcagagccatcccagnacaggcgtagatcaatcacactgtcctgacagtgaggctgatttgtgggcattgcactca

SEQ ID NO: 42205 - DNA, 121 bp, Artificial Sequence
  Synthesized
  misc_feature (61): n=t or c
cgcaccagtcacaccacagcctggtgatatcacggtcgcatcatccaaatacagtcatttngttgtggcctgaggaaaacgcaccgctatgctaattgaagactgatttagctgcagcccc

SEQ ID NO: 42206 - DNA, 121 bp, Artificial Sequence
  Synthesized
  misc_feature (61): n=t or c
tgcagtcctcgcacgaaagcagctcctctgcagagggagacatacaggtaacaagtgaacnactttctgaagaaaagcattttcacaggccaatcaagctaaactgtcagagcaagaagag

SEQ ID NO: 42207 - DNA, 121 bp, Artificial Sequence
  Synthesized
  misc_feature (61): n=t or c
gaaagccaggccgggatctggctttatttacttgaaggcacagatccaagatttggaatcnaaatttaacatgagaaactccatttagtggcatcaaaaatgaagtggatgctgttaacat

SEQ ID NO: 42208 - DNA, 121 bp, Artificial Sequence
  Synthesized
  misc_feature (61): n=a or c
ttgaccttccagattttaacttacttcaaaatcaagcaatttataaatacatttttcatgntcttacgtatatggatatagaaaaagcaacacaggcccagtgacatctttactaacagtg

SEQ ID NO: 42209 - DNA, 121 bp, Artificial Sequence
  Synthesized
  misc_feature (61): n=t or c
cactgagatcattgtgtggccccattgccaagatgacacagcctattggaaacatagacangagaggcaaattttagttgtttaacttactaatgatctgtcattaaatctattcactcaa

SEQ ID NO: 42210 - DNA, 121 bp, Artificial Sequence
  Synthesized
  misc_feature (61): n=a or g
cttccccacgctgcaacactttgcagagactcctcatccctctcactcgtggcttggcccntaggtatggctgggttcctgtggacccacgtgtatttatttttaatctgtagggtgtttt

SEQ ID NO: 42211 - DNA, 121 bp, Artificial Sequence
  Synthesized
  misc_feature (61): n=t or c
tctagccctaaatgctaccagtctggcatagtatgcaggtgctggaatagagactgatcgngtacagcgcacatacgtgtgacacagctgataggtcagcagctgtagctcatctgcagtg

SEQ ID NO: 42212 - DNA, 121 bp, Artificial Sequence
  Synthesized
  misc_feature (61): n=a or c
ctagcatgtatgatctgcagttgcatcaggtagcagttcctctctgggcttcctagccagnacagatgttcttagctaccacatgcttctggttgtgaagtcaaaagactggaaggaaatg

SEQ ID NO: 42213 - DNA, 121 bp, Artificial Sequence
  Synthesized
  misc_feature (61): n=t or c
ttgaacagtttgagctgggaatattagcaacagagctgtaggaagtgcctggccaaagaanaggcataacaagttggaattgttttgctgtagaatgaaagttggagactgcaggaaaaat

SEQ ID NO: 42214 - DNA, 121 bp, Artificial Sequence
  Synthesized
  misc_feature (61): n=t or c
ttctctagtcacgggaaaaaatgtatgtcccagctggctgaagtacagccacaagccaaangtcatattggcttcatggtgctaatgtccctgctatggtaatggacttgaggcaaattgg

SEQ ID NO: 42215 - DNA, 121 bp, Artificial Sequence
  Synthesized
  misc_feature (61): n=t or c
ttcatggactaaggctaatgatttaaaaactattcccatttaacttggccaaactcctacngggcgataacaaaaacatcatttttgatgtgaaactgagctgcacctgttctatccagat

SEQ ID NO: 42216 - DNA, 121 bp, Artificial Sequence
  Synthesized
  misc_feature (61): n=t or c
aggagcaacaaaacagactgtgtggaaagacatttgctctctgccccaaacaaactaaaangtacttttagtctttcacgcccaagtgaggggacagggaaaagaacttttactctttgcc

SEQ ID NO: 42217 - DNA, 121 bp, Artificial Sequence
  Synthesized
  misc_feature (61): n=a or t
ccagagtgtctgtcatgttcatgtagttggagcactgctaaagtgaaggtgaagcagagcnctgaaaaacgcgttcctggacttctgttgcggtggtgattatggaatattcatttaaaat

SEQ ID NO: 42218 - DNA, 121 bp, Artificial Sequence
  Synthesized
  misc_feature (61): n=a or t
tttgtaactccaatccatggtcagaaccaggcctaagaaatattgactgttgctaaaaaanttccttattgatctgacaaaatttttgtattcttattagataaccagatactggaccttg

SEQ ID NO: 42219 - DNA, 121 bp, Artificial Sequence
  Synthesized
  misc_feature (61): n=t or c
atacgcttctgctcttcagagcatggctgttgctcgacgtcacaccaaatcctcccggctnctcagtcggtgaatgacacttcataatctcaagaacaatatgtggcaactaaaaatagct

SEQ ID NO: 42220 - DNA, 121 bp, Artificial Sequence
  Synthesized
  misc_feature (61): n=a or g
actccattacttctcgtctactgcttttagaatcttctggttcagatgctttctatgtttntccccaaaacaaggaccaaaaagtcaagaagtggctatgattaggcctttttccctatgg

SEQ ID NO: 42221 - DNA, 121 bp, Artificial Sequence
  Synthesized
  misc_feature (61): n=t or c
ataaatgtattatatatgatgcagaatgcaaggaaagccatgtgaggatctgcccttcctnggacggacagggcacgaggagagccaagaggtgaggaaaacatcggagggctcaagaagg

SEQ ID NO: 42222 - DNA, 121 bp, Artificial Sequence
  Synthesized
  misc_feature (61): n=a or c
tgtcccaggacagagagaaggtaattatttctgatgagaattttttctgtttgtacaaacnactgatgacaaccattgctgcctgactgaagagtggggacatgaagcccaatgccacttt

SEQ ID NO: 42223 - DNA, 121 bp, Artificial Sequence
  Synthesized
  misc_feature (61): n=t or c
ttattataattgcatccagctataagtggtttggttaagtgtatgttagataagttgccangcaatacatccaaaattccacaattggtgcattcaaaaggctttccacgatttttccata

SEQ ID NO: 42224 - DNA, 121 bp, Artificial Sequence
  Synthesized
  misc_feature (61): n=a or g
tgaaaaacagggaactagttgaagtcaaagaacaaagtagtggagtagaaatggaagtatntttagattattttatgagctatgtaatttttgtttatttacttatgagtgaaacacaggt

SEQ ID NO: 42225 - DNA, 121 bp, Artificial Sequence
  Synthesized
  misc_feature (61): n=t or c
ggggtgcacaccacagggaacagcagggctgaacagaggcctcggaacagttaaacaacantgtaaaaatgcaaccccagaacaccacaaaaacctctgctatagtaaacttaaaaacaaa

SEQ ID NO: 42226 - DNA, 121 bp, Artificial Sequence
  Synthesized
  misc_feature (61): n=a or g
gtgtttctttccagatgttattcaaactgcatcaacagaaaaggaaaaatttttgtggtcnctaacacaagcaaaactaggagaacaaaagcatcagttcatatttcattctcaattgatg

SEQ ID NO: 42227 - DNA, 121 bp, Artificial Sequence
  Synthesized
  misc_feature (61): n=t or c
gttccgatggggtcgggatggaaaaagggagaggaggatgttgtggtgggatcccatcacngcaaatcaggagcctttgctgcaaagaagcagaaaaagcttcagcattgccaccaggggt

SEQ ID NO: 42228 - DNA, 121 bp, Artificial Sequence
  Synthesized
  misc_feature (61): n=a or g
ctactctgcagaatttcctctgttctctgcatttcctataaaatggaaatcacagcccacncaatatttttaaattgtgaaaacaagctctaaaggatgaatgcagcaggttggatagcag

SEQ ID NO: 42229 - DNA, 121 bp, Artificial Sequence
  Synthesized
  misc_feature (61): n=a or g
ttacttctttctccctgctgtgtttacattcacctcagcaatattcctactcatgaggaangtgaaaaaagggtcttcgtttcaagggttttcattctgcagagaggtgtgagcatatata

SEQ ID NO: 42230 - DNA, 121 bp, Artificial Sequence
  Synthesized
  misc_feature (61): n=t or c
cagataaaatccaatgtctccaacattgcagttgtatactactttgctttctttccaaacncattttcatttcaagagctcctcttaatttactgatgataataaattaggagtgtttgga

SEQ ID NO: 42231 - DNA, 121 bp, Artificial Sequence
  Synthesized
  misc_feature (61): n=a or g
ggtctaacattaggtgctccagatattcttaacaacagtgcctcggctgatgcatgcgtcntgtcaaagacacacaaagaaagcatttttcttaatttctgtattgaatatttgtgttgtc

SEQ ID NO: 42232 - DNA, 121 bp, Artificial Sequence
  Synthesized
  misc_feature (61): n=c or g
attaacgccatgtttcaccactcatagacagctaaaagaagcagtagttgatattgtcttngtaattcacggttttaatctttgagctttcaagtagggaaaaaactgctggatgtattat

SEQ ID NO: 42233 - DNA, 121 bp, Artificial Sequence
  Synthesized
  misc_feature (61): n=t or c
gttaaatcagccactccgttgttttccctgcagctgggcaatgcctttgctctgagctgcngtgcatacttctggagatgtatttcatggccaacagagctcatttcattcttctctaatg

SEQ ID NO: 42234 - DNA, 121 bp, Artificial Sequence
  Synthesized
  misc_feature (61): n=a or g
attaagttcttattgtatctctttttttttttcagttatccatgaaatatgatgaataatnttaagttcagacagagataaatgtgagaaactttagaaggaataatggactttcaaaatt

SEQ ID NO: 42235 - DNA, 121 bp, Artificial Sequence
  Synthesized
  misc_feature (61): n=a or g
tacagtcgaaggctgtgattcaatgagtggcaacttctgctcagcgtcagatttctcagtngtgcttagcataggtggggtgagttagtgagcagggatgcaatgggcactggatgtgacc

SEQ ID NO: 42236 - DNA, 121 bp, Artificial Sequence
  Synthesized
  misc_feature (61): n=t or c
gaggggaagaggagctgattttagtgaattgaaataaatctgatgtaaaccctgagagcanttattggagcagtgacagaggaaggagatgtaaatcatggcatcctgctgtactgcttac

SEQ ID NO: 42237 - DNA, 121 bp, Artificial Sequence
  Synthesized
  misc_feature (61): n=a or g
ttaaaacacttacgcatgcaaaatagaagtcgtcttcccccattgttttcttgggaagaanctaaggtgaatgtgaaataacaaagatccttgatattttgccattgaaaatcatatctac

SEQ ID NO: 42238 - DNA, 121 bp, Artificial Sequence
  Synthesized
  misc_feature (61): n=a or g
tgtgcaccagtgggcatcttcacatgcaaatagatgtacttgtatgctctctgcttctccncgctaatagtgcaggcatgcttctgcacacacattttggaattaactgtctagaaatcaa

SEQ ID NO: 42239 - DNA, 121 bp, Artificial Sequence
  Synthesized
  misc_feature (61): n=t or c
aacctgggtctaatcctgcactctgcaggcataacatgagctagctcagttccaagctggntctgacatcacagcagcaagatccaggcagagcccaaagcccagagacgctgcagcaccc

SEQ ID NO: 42240 - DNA, 121 bp, Artificial Sequence
  Synthesized
  misc_feature (61): n=t or c
attgcctttcttcgtctgtactggaaattggaggaagtggcttctgccaacagaggaaatngggtgaaatttcagctggacctcagcttgccgagcagttcggtggtcgccatcctcaccg

SEQ ID NO: 42241 - DNA, 121 bp, Artificial Sequence
  Synthesized
  misc_feature (61): n=c or g
cagtcagatagcaggggctggctcagagccacagctgtactgcctgcagtcttctgccagntccagagcagagtcaggtttgtcagaggagctgcatttagctttatgtggtgcagcaaag

SEQ ID NO: 42242 - DNA, 121 bp, Artificial Sequence
  Synthesized
  misc_feature (61): n=a or t
agcttgtaaaacccataaacaagaagtctttgacataacatccctagatgaggacaataanaacatatggccagaaagtaagaaaaaagaagacaacaggtaacagagaagaaagtggcaa

SEQ ID NO: 42243 - DNA, 121 bp, Artificial Sequence
  Synthesized
  misc_feature (61): n=t or c
aagttagaaaaagcttagatttaaagtaactatttgtatttcaaaatgcagctactcgacntgctttagcagccatacacaagatgattatgctggctgacttcctaacgaagtaaattca

SEQ ID NO: 42244 - DNA, 121 bp, Artificial Sequence
  Synthesized
  misc_feature (61): n=t or g
ctgaggcctccttcttccagcaaccataattagggggaaaaagccccttataatttacctncataattatttgtaaggccatgtacaaaactgatacttaaattcaaaatcacagatacta

SEQ ID NO: 42245 - DNA, 121 bp, Artificial Sequence
  Synthesized
  misc_feature (61): n=t or g
tctgaccttagcgacctatgtcacatgagccctgacagaagggaagttcagccctaaggtntcttgcagaagggcaccaaagcaaaccatctttagaaggagttgcaactcgatgatcatt

SEQ ID NO: 42246 - DNA, 121 bp, Artificial Sequence
  Synthesized
  misc_feature (61): n=t or g
tcttcaggtctggggagagaactgttgaatgaggacagtaaaccgaggtcaggcattccanatgagctaagtgaatcttccctaggactgagcacaaaggatccattccttccctcagtct

SEQ ID NO: 42247 - DNA, 121 bp, Artificial Sequence
  Synthesized
  misc_feature (61): n=t or g
acaacctgcctggccttcctgcagatcagttcagtctattgttgctcataacggttgcgcngtaaggaagcgttcctttccaggactctgagactacaagaagtctctgtgctgtgccctg

SEQ ID NO: 42248 - DNA, 121 bp, Artificial Sequence
  Synthesized
  misc_feature (61): n=t or c
cccctaagcaacaacatgtttgggtttattactcttttttgacttcagtaagtgtattcanggccaaagcaagcccttgcttaaatcccctaatatgagtaattacttcttatccaaatta

SEQ ID NO: 42249 - DNA, 121 bp, Artificial Sequence
  Synthesized
  misc_feature (61): n=a or g
atatggcttggtatgtactgtgactttcaagctgcacaaatatccatttaaaatttcagtnggtacttgtgcttttgtaaaatcctaagaagtccttagttgcatcctacatcaattacat

SEQ ID NO: 42250 - DNA, 121 bp, Artificial Sequence
  Synthesized
  misc_feature (61): n=a or g
actgttgtactggtaatgctgacaggttccactatatgtatgacacctacttttccccctncctactgcagggttctatcaggatttgaagggttggttggttgtttactgaccaaacggt

SEQ ID NO: 42251 - DNA, 121 bp, Artificial Sequence
  Synthesized
  misc_feature (61): n=a or g
gggtcctatggggttcatgagccacccacggtcatccctggtgggctgggacaaagcaccngcatcagcatcgcatgccatcttggattttcccctccatctccactttggagcattccca

SEQ ID NO: 42252 - DNA, 121 bp, Artificial Sequence
  Synthesized
  misc_feature (61): n=t or g
cacagcatttcaggtgaacccctgacactctgggacaagcttttcccatcccagctcaatnctccgttgctccttcagagattgaagcagagcaagacaccacaagtgtgcaactgttcca

SEQ ID NO: 42253 - DNA, 121 bp, Artificial Sequence
  Synthesized
  misc_feature (61): n=t or c
tataaaggaggtactcatatgctaaggaacctcagtcttggcagttaaatgggatttatgngcaccaagtcaaactggcaaacaagtgttagaacccaaaatacaacaactgggacagagt

SEQ ID NO: 42254 - DNA, 121 bp, Artificial Sequence
  Synthesized
  misc_feature (61): n=t or c
atcattattataccatgctgagatgttagttttatgctctatttttatgccatctttttangtctgcgtaggatgaaagtgccttgacctactctagagcaagtctagaaacagtaaaaat

SEQ ID NO: 42255 - DNA, 121 bp, Artificial Sequence
  Synthesized
  misc_feature (61): n=t or c
aaagcctgaagggcatcagggtcagcaaatgggtaacagtttctgtacttcaaaagttcangttctttttattaaaggactcgttgggagaatttggggttctaatgaagtacaccaaata

SEQ ID NO: 42256 - DNA, 121 bp, Artificial Sequence
  Synthesized
  misc_feature (61): n=a or c
caaaaatagttgaacaacaaagattgtttgaaggcataattaaaaatagagtgaaatgagntacgttgcattgccttatttcagttataagtaattggtttagattgggtgattggtttga

SEQ ID NO: 42257 - DNA, 121 bp, Artificial Sequence
  Synthesized
  misc_feature (61): n=a or g
cctgctggtgtcttctcccagtagttggtgtcacattggctgccgagagtcatgaaggttntaccggagaagaatgcggtccgcatcctgtggggtagggaacgaggtacccaggcactgg

SEQ ID NO: 42258 - DNA, 121 bp, Artificial Sequence
  Synthesized
  misc_feature (61): n=a or c
ggtacctgagggatctctgaattcgttgcaaaaggctctggcaggtaatttctagcacagncgaggggattctttccctcttactgtcttaaaatggcatgtgttctctaggaacagggtg

SEQ ID NO: 42259 - DNA, 121 bp, Artificial Sequence
  Synthesized
  misc_feature (61): n=t or c
tagggacacgtaacttctaccattatttccctgctgacctcatctcagcatgtgattggtngcttgtctttgtgtcaggctggagttctaactccctgctaatgagtacagttttatccat

SEQ ID NO: 42260 - DNA, 121 bp, Artificial Sequence
  Synthesized
  misc_feature (61): n=t or c
gcacaaaaatccatgggccccagctggcagaagtcattgtcaggcttctctctatcatctntgaaaggtcatggagagcaagagaggtgtctgaggacttgaggaaagcaatgtcattcca

SEQ ID NO: 42261 - DNA, 121 bp, Artificial Sequence
  Synthesized
  misc_feature (61): n=a or g
tataaaagatttttgcctgatttcctgaaaaaattaaagtagttattattacttcctttcnctgggtttgaatttagcccaatgtattccttgaactaccacagtactaggaaggaggatg

SEQ ID NO: 42262 - DNA, 121 bp, Artificial Sequence
  Synthesized
  misc_feature (61): n=a or g
aaggattcagagtttctggatcctttgaattttccatcgagtcagtggagtttctccccangtttgctggagcagactgtggtcctataagatgcatctcttgtggttcccccaagatgtt

SEQ ID NO: 42263 - DNA, 121 bp, Artificial Sequence
  Synthesized
  misc_feature (61): n=t or c
tcgctgagccgctcctcctgcatgtctgatggccccgaccgcattaactgtaattttgtangaagagtgactgtccattggtttaatagaacgttagctattgtaataatttattggctgt

SEQ ID NO: 42264 - DNA, 121 bp, Artificial Sequence
  Synthesized
  misc_feature (61): n=a or g
catgctcagctgcccataatacatcaaggacacaacaatacactctgtcccattgatgcanccatccccactactaggacgtcaatacatttttttctttcttccctcgggaagcatatct

SEQ ID NO: 42265 - DNA, 121 bp, Artificial Sequence
  Synthesized
  misc_feature (61): n=a or g
catctctgagtacgttagttgcaaggggatgtctgagagaatggagggctgttcagccccnctggaaaaagcagtttctagttgaaatgtcaggtgtgtgcccgacaaggagcagcacctt

SEQ ID NO: 42266 - DNA, 121 bp, Artificial Sequence
  Synthesized
  misc_feature (61): n=a or t
cacaatatggagatgctctctgagacataaaggaagcacttatttgttttattttcattantatctgggagaagatttaattacagattgatttgtgatgggggaggatcaaaaatgagaa

SEQ ID NO: 42267 - DNA, 121 bp, Artificial Sequence
  Synthesized
  misc_feature (61): n=a or c
taaggagaagatgctaactccaggataactgacttgccttggataggttgtaccatgtaanttttgtttacttagacctaaaaatctgtatgtcagtagataagtataaactgaaagagat

SEQ ID NO: 42268 - DNA, 121 bp, Artificial Sequence
  Synthesized
  misc_feature (61): n=t or c
gttgtaatcaataggtgctgatgcatacggaaggctggaggtctccgaatggaaagctttnctccccatttctcctgggggggttttgtttggatcgcagttaccccaacccttattcaga

SEQ ID NO: 42269 - DNA, 121 bp, Artificial Sequence
  Synthesized
  misc_feature (61): n=t or c
gcactctgaggaagaaatgcacccaccctgccacatactcagttttattagttcagagtgnggcagacaactggaaaacagcattcgagcaatgaagcaacaagctggagaaagaggcatg

SEQ ID NO: 42270 - DNA, 121 bp, Artificial Sequence
  Synthesized
  misc_feature (61): n=a or g
gttttgatgtattatttttgaaaactttcaagttatgaaatgacttaggtttcaagtcctnttaactttgaggttcttaattaagagatccaaagttcttcaatgctttccaagcatctca

SEQ ID NO: 42271 - DNA, 121 bp, Artificial Sequence
  Synthesized
  misc_feature (61): n=t or c
accaggcagctaaaacatttttgaaaactcagtaatacagatctacttgttcagtagtagntttcctaaaatactcacgacagcattgtaagtagagcataaaaatagaccattgaaaaga

SEQ ID NO: 42272 - DNA, 121 bp, Artificial Sequence
  Synthesized
  misc_feature (61): n=a or t
ttaatgaaggatgtttttcctcactgacatctgcctgtaaagtagaaatacttccttcagnggtttcatagaacaacacgaaaacaagacaccccttgagcttcaacaacatgcaactgaa

SEQ ID NO: 42273 - DNA, 121 bp, Artificial Sequence
  Synthesized
  misc_feature (61): n=a or g
ttcagggtatgggctgctggagttagctgctctgctgttatcacctgtgtaatttttcacnttaaaaatcccgtatctcagacttggcagtgttttactgaactggaggaatacatgcttg

SEQ ID NO: 42274 - DNA, 121 bp, Artificial Sequence
  Synthesized
  misc_feature (61): n=a or c
tgacatcaaggttagaatggattacagccatctcatttggcctccagctttaactgcagcncagggtgttgttcacaaacattttaggcatatcactggtgtgcaacagcagcctatggac

SEQ ID NO: 42275 - DNA, 121 bp, Artificial Sequence
  Synthesized
  misc_feature (61): n=a or c
tttgaaattacagtggcttatcttggaaatgtttttgtaggtatttcaggcaagtatatgnaattgtaatggttttttgcattcacagcaggtacaagtgaactggtaatgctgagcctgg

SEQ ID NO: 42276 - DNA, 121 bp, Artificial Sequence
  Synthesized
  misc_feature (61): n=a or c
tttgcatgcctggctgtgctgctgtgatgtctctccagcttgggtttgacccattggaacncaatggtgtactcatacccaatggcagctgctgtttcctcagtgccatcaaacgcgtttt

SEQ ID NO: 42277 - DNA, 121 bp, Artificial Sequence
  Synthesized
  misc_feature (61): n=t or c
atatgtaaggaaggggacatctgtacgatctgtgtgacaatcctttttgcctgtggtactnctcagttatagcaaataacagttttgttgttcccaagtcatggattatgacagcgtgcca

SEQ ID NO: 42278 - DNA, 121 bp, Artificial Sequence
  Synthesized
  misc_feature (61): n=t or c
caggtggcggtgggagttaggggacaaagacttcaggaattaattttctcctcttaacgtngctcttccattcgattcgagaagggtaaaggcatcgtcgccaaataaaatattaacttat

SEQ ID NO: 42279 - DNA, 121 bp, Artificial Sequence
  Synthesized
  misc_feature (61): n=t or c
cattgatgctatgttgctgttgcatgtattttcctgtgtctagtgggaatatccaagcaanttcttacatagaggtcacgcagagcatcgcccatttgaagtaaccccgcagaggttatgt

SEQ ID NO: 42280 - DNA, 121 bp, Artificial Sequence
  Synthesized
  misc_feature (61): n=t or c
gagcagccctgctgtacggggggcagtgaacttctgagactggcgtacagaggaggacagntctgatggactctttgtgacaggtgtacagtgagttcgctgcctggagttggtcttgccc

SEQ ID NO: 42281 - DNA, 121 bp, Artificial Sequence
  Synthesized
  misc_feature (61): n=t or c
ggaactcaggagatgtcccccggggctgatggcattgcaatgtgctgtgatgtctgcgagncaccaccgtgcagcccatggagatgcacccatccatccccttctgagcacaactactttg

SEQ ID NO: 42282 - DNA, 121 bp, Artificial Sequence
  Synthesized
  misc_feature (61): n=c or g
gtgtaaatacaggtggtgccagggctgctgacggtggttttcacctgcagggggcaatccnattctgcacacccaccttcattcatgccctccaagtcaatgcctgggacaaggagagagg

SEQ ID NO: 42283 - DNA, 121 bp, Artificial Sequence
  Synthesized
  misc_feature (61): n=a or t
caggacagaaagtaaatcattaaacgatgacgtatttattttgtggggaaaaaggtgcctntaacgtgaggaaaaatatcctatgctgaatgctggactctgatattttccgttctgcgta

SEQ ID NO: 42284 - DNA, 121 bp, Artificial Sequence
  Synthesized
  misc_feature (61): n=t or c
cagtgtggtaggctaacattacagatgggaactttcttccctgtccctccgtgttcgagcngcacacagttgtagtctgtacgttgtctaaacgctgtaattagcgtttcataattagttg

SEQ ID NO: 42285 - DNA, 121 bp, Artificial Sequence
  Synthesized
  misc_feature (61): n=a or g
gttttgttagcagtacttgatgaggcacttgttatgtggagatatatcggggttttctatngaccaaaaggttgctgagcaactctgccgcaccttctctttgctttactaaactttaaag

SEQ ID NO: 42286 - DNA, 121 bp, Artificial Sequence
  Synthesized
  misc_feature (61): n=a or g
ccctccaccccaagcaaagcctttgggaaaagccatgcagagcagagagccctaaacaacntatagggcatggatgtggggctcagaaccacacagagcacatatttggggtttatagtac

SEQ ID NO: 42287 - DNA, 121 bp, Artificial Sequence
  Synthesized
  misc_feature (61): n=t or c
tctacagaccctgagttctgagaagaaagccaagaaagttcgtttctatcgtaatggagancggtatttcaaagggattgtatatgccatctcccctgaccggtttagatcttttgaagct

SEQ ID NO: 42288 - DNA, 121 bp, Artificial Sequence
  Synthesized
  misc_feature (61): n=a or g
gatttattgtaaacaactgaactgtaggatttaaagtacttcagaacagtgaaaactcaanaataaagaagttgaataagcgtcctacatataggctttttctaaatgcttaaatcttcta

SEQ ID NO: 42289 - DNA, 121 bp, Artificial Sequence
  Synthesized
  misc_feature (61): n=t or c
taagcaacaacaagcagtggtaaagcgttcactgtgtacatggctccatcccaagagtatnttgggccaatcccaactgaacggagagcattggtccacagctttatcttgtgccccagca

SEQ ID NO: 42290 - DNA, 121 bp, Artificial Sequence
  Synthesized
  misc_feature (61): n=t or c
gttggccaaatttagatctgttctctctttagagagaagacaaagctttgcttcaaaagtngttgcccatccctcagttgataacgttagtggcactggttagaatgtcattgctttctct

SEQ ID NO: 42291 - DNA, 121 bp, Artificial Sequence
  Synthesized
  misc_feature (61): n=a or g
tggtttggatttctatttgtcatgcatgatcagtcacaagaatacatacatccctgaagcnacagtaaactgagatgtgtttgttctgctgcatttcatttgtacaaatgctctgtgtgtt

SEQ ID NO: 42292 - DNA, 121 bp, Artificial Sequence
  Synthesized
  misc_feature (61): n=t or c
attaaatgaagggacttgaattatattttctaatttaattggagtaactggtatttttacnactgtaaaaagttggatgacaaagtccctggctttatgaagcagactgataacatgaaca

SEQ ID NO: 42293 - DNA, 121 bp, Artificial Sequence
  Synthesized
  misc_feature (61): n=t or c
gtgctgctggggtgagtggggtggaaataggggtacacaggatttggattagcacaagtcnctctttctgggacagccatggatgtgtctgtggggctgactgctccatgaggacccgcag

SEQ ID NO: 42294 - DNA, 121 bp, Artificial Sequence
  Synthesized
  misc_feature (61): n=a or g
cttggagtgctcggagctgggtgctgtgttttgctgttcagatgttcctggtgctgtaggnactgaattaaactcacaaacctccatggtctgccttcaccagggatgtccctccatccca

SEQ ID NO: 42295 - DNA, 121 bp, Artificial Sequence
  Synthesized
  misc_feature (61): n=a or g
attcttaatagatctagattcttggattgaaatgggtagcttcccaagttaatacaagagnctagtgaaaacctccatgaggtgaaaatccgtaaatttgttaaaaggatattagtaaaat

SEQ ID NO: 42296 - DNA, 121 bp, Artificial Sequence
  Synthesized
  misc_feature (61): n=a or g
tgtatctctctggcaccatttgccttgtacacagagtgccctgccaatagcctagcttctngcacagaatgttgctgtattgtctcaaagaccaactgctagccagctcctccttctgcag

SEQ ID NO: 42297 - DNA, 121 bp, Artificial Sequence
  Synthesized
  misc_feature (61): n=t or g
accattcccaaagctgcagctcgtgctgagcagctcagcaaccagcacctctcacgggtcnggcctttcgggtttattcaccgagcaggcaggcaaacagaagatcgataggaataaatta

SEQ ID NO: 42298 - DNA, 121 bp, Artificial Sequence
  Synthesized
  misc_feature (61): n=t or c
aggttacagtccatgctgggcatttccaacaagtacaccagtccttccttctgccgttcanattcattcttcctgtggcaggaaccataatctccttggctctcccagatgatgaccccct

SEQ ID NO: 42299 - DNA, 121 bp, Artificial Sequence
  Synthesized
  misc_feature (61): n=a or t
tgcatgaagtctggagcagaaccagtttcttgccgtaaagttgaactaaacttcttttttntatgtagtacaaaactcaaaatcatggtcaaaatgaaaatactgaatccttccatgcaca

SEQ ID NO: 42300 - DNA, 121 bp, Artificial Sequence
  Synthesized
  misc_feature (61): n=t or c
cagatgagattcaaacaatttctgcaagttggtggtgataaataataccagcgctggtccngtaaacatagcactattaaagtgatcactaagaaattccctggtgcatgggtctatattc

SEQ ID NO: 42301 - DNA, 121 bp, Artificial Sequence
  Synthesized
  misc_feature (61): n=a or g
ccatgggcgcacgttggcctccggaatgcatcatcttctgtgcatgcgatgaatactggcnaagcaccgctgagctgtgctttctggagctgtttgggagcggggctgtctgcagcagcct

SEQ ID NO: 42302 - DNA, 121 bp, Artificial Sequence
  Synthesized
  misc_feature (61): n=a or g
tgctctctgccaaatattgccatggaccaagcatgctcaggtaagagatgaccttggaatncaacatcgagacctgctccaattttccctatcaagacaactgaacaaaactaaaaccaat

SEQ ID NO: 42303 - DNA, 121 bp, Artificial Sequence
  Synthesized
  misc_feature (61): n=a or g
tgtagaaaaagaattgttataggttttcctcagttctgattagctgcatatcattcacatncacacattgccaaagcatactttaaggaatcaattgttcaaattttgcaacctagtctaa

SEQ ID NO: 42304 - DNA, 121 bp, Artificial Sequence
  Synthesized
  misc_feature (61): n=a or t
gggcaataattttcccattgaaatgttttgattttataatctttttaaaaaatactaactntagttatcaataaatactagtgtgattgcaaagcaacctgaatagagaaaaaaaatgaag

SEQ ID NO: 42305 - DNA, 121 bp, Artificial Sequence
  Synthesized
  misc_feature (61): n=a or g
caaaaaatatcatttatcacctccagctatgcaaaatctacttcttttctatgatcggtcntggatcttgtaattttattgcacagattaaaaacatttattatattttctttcattatta

SEQ ID NO: 42306 - DNA, 121 bp, Artificial Sequence
  Synthesized
  misc_feature (61): n=a or g
tctactcaaaacagagagcctgttggaaaatgccatggaatttctctgatttctcacccantgacaaacaggaggtgggcttgtttagcaagtagaggatgaggctttctgatggttgaga

SEQ ID NO: 42307 - DNA, 121 bp, Artificial Sequence
  Synthesized
  misc_feature (61): n=a or g
tttatagcccaagggtttgtgtctgctcctctaaggagccaaggtagaacgtctccattcntcagcctgggtgtaaggtcaccaataggcatgcattgtgactgatttaaactccatgcaa

SEQ ID NO: 42308 - DNA, 121 bp, Artificial Sequence
  Synthesized
  misc_feature (61): n=c or g
atttcttttttgctaccaacttattaattatatttcctctaagttatattttagtttcctntaggttgtgttttaggcaagaaatgtacagtaacttttgcttgaactgattctgttagtc

SEQ ID NO: 42309 - DNA, 121 bp, Artificial Sequence
  Synthesized
  misc_feature (61): n=c or g
caaatactggatggagttacaaagattgcatatcattgtgtagaaaatagatattctagantggcaaaataagactttgttttttaactgaggaagtatgatttaagccttgtttcggtgc

SEQ ID NO: 42310 - DNA, 121 bp, Artificial Sequence
  Synthesized
  misc_feature (61): n=a or c
aggcacaagtaaaacatctttacaagtcttcctacagccatttttttcaaatctgacctcntaatttaaaaccggactatcacactaagttttgagtccactagaagccaagagtcaaagt

SEQ ID NO: 42311 - DNA, 121 bp, Artificial Sequence
  Synthesized
  misc_feature (61): n=a or c
agttcttactttagctagttatatttttcactgcagcacttaatgaagtacaacttaattnaattatattgtacttcctatgtgtcttttgaaaatgtagtcagcctaggtagaatcagtc

SEQ ID NO: 42312 - DNA, 121 bp, Artificial Sequence
  Synthesized
  misc_feature (61): n=a or g
tacttgctgatgtgttctcaaagcctcctactttgaagtgttttcaaagcggtgctcgacnggatccccatgtccttttgcacaaagctgctttgcatgtgattggcccagcctgtgtggg

SEQ ID NO: 42313 - DNA, 121 bp, Artificial Sequence
  Synthesized
  misc_feature (61): n=a or g
gcttcctgcctatgttgcccatctacagtgagtgcccctttgcacagtgcagtgcaggagnatgtttaagcttttgggaaatattctgtggcaccctattctctcttggttcatcttttga

SEQ ID NO: 42314 - DNA, 121 bp, Artificial Sequence
  Synthesized
  misc_feature (61): n=a or g
tgactattttgctctgagagccacttgccaactgatttcagagcaaagacccaggtcttgnaagcacattttatccataaagttccctctttcccacaccagcacagagtagccaccctga

SEQ ID NO: 42315 - DNA, 121 bp, Artificial Sequence
  Synthesized
  misc_feature (61): n=t or c
aatgaagggtatcctctttacttgtcttttgctgtggtggattagaagtgagaggcattcnccttttcttctatttaagtgaaatacctgaccttgaaacattcccaaggcaaagtgtttg

SEQ ID NO: 42316 - DNA, 121 bp, Artificial Sequence
  Synthesized
  misc_feature (61): n=t or g
aaaaggcagagagagacagaaaacagatagaagtaaaaggaagccatttttagaaaaccantttttttctaggctgagagagaaatcgttgttttaagcagtattttacagtaagccctct

SEQ ID NO: 42317 - DNA, 121 bp, Artificial Sequence
  Synthesized
  misc_feature (61): n=t or c
gagctgcctgaagacagcggactcagacccatcgttctctgtctccacgctggtgctggcngggtagttcttggctttgatgaagccctgaggggagccagatccagtaccgggacatgga

SEQ ID NO: 42318 - DNA, 121 bp, Artificial Sequence
  Synthesized
  misc_feature (61): n=a or g
ttgatgtaatagaaatacagttacagaaaggatatgtgatatactgaagctgaacatatanaatacctaaactacataattacagcataaatatattctaacaaaagaatggtttcttgtc

SEQ ID NO: 42319 - DNA, 121 bp, Artificial Sequence
  Synthesized
  misc_feature (61): n=a or g
cctataaagagaactgaaaagtgcaggttcccgcgttgggcagttgagttattggtattcnatacttccactcttcccacgtgggctcctcttgctcagaaccccaaatccctcccacgag

SEQ ID NO: 42320 - DNA, 121 bp, Artificial Sequence
  Synthesized
  misc_feature (61): n=a or c
ttctccaggagatcagtatcttttctgtaccagggagtcccgaactgaatacagtactccnggtgaggcctgtcattttattcctgtctataccaagatgcaaatgcacgtgcagggagga

SEQ ID NO: 42321 - DNA, 121 bp, Artificial Sequence
  Synthesized
  misc_feature (61): n=a or g
tgctctgagcatcctctgctgggacgtggcggactttctgctgcagggctgcatctctgtnttggaggcagcattaaagttggggttcccaaccatctgcatcccagacgtcttccaaacg

SEQ ID NO: 42322 - DNA, 121 bp, Artificial Sequence
  Synthesized
  misc_feature (61): n=a or g
tctgccaagtgccatatgtttacagctgacttataaaatgctctaaagtagggggtttatnaggcaaacacactgatgcatccttgaatatgttgatgccaatagacaccaccataataaa

SEQ ID NO: 42323 - DNA, 121 bp, Artificial Sequence
  Synthesized
  misc_feature (61): n=a or c
ttcattctgtactttgctatcagtaagtcatgatctcactcaggttgcttcaatcctgccntgtttttgaactaggagcatatcaagaccaagaaaatgtggctatctgtgcatatataaa

SEQ ID NO: 42324 - DNA, 121 bp, Artificial Sequence
  Synthesized
  misc_feature (61): n=t or c
aatggagcaactcctgagggaggccaaacgtgaaggagtggctcagccaacatgattgctngtattttaatatagcaaaactcttggcaaagcaagaggatgaagactggggatgcggagg

SEQ ID NO: 42325 - DNA, 121 bp, Artificial Sequence
  Synthesized
  misc_feature (61): n=t or c
gaaaaaagtgagcctgtttgtgtgtgtgatgtgcagggaaaaggggcagaaagtgtggggntgtggtgcagtggatgatgtccctcatgttcagggtatcttaatcttagattgggttatt

SEQ ID NO: 42326 - DNA, 121 bp, Artificial Sequence
  Synthesized
  misc_feature (61): n=t or g
atacctggacctgaatttaacaacaggattgtatctgtgagaagagtaaagcttcactttntaatgtaccaatattaattaactaattaattcattacttattcttaacaaaattttcagt

SEQ ID NO: 42327 - DNA, 121 bp, Artificial Sequence
  Synthesized
  misc_feature (61): n=t or c
tatggtaccacgacaaccttcaagttaactcatacagtagggtgaagttaagtaagttttntaacccctgcaacaaaatgacagcatcagtatgattaggtctgcctatggtgcgctcaga

SEQ ID NO: 42328 - DNA, 121 bp, Artificial Sequence
  Synthesized
  misc_feature (61): n=a or g
taggctcgtgtaatttttggttgccttgatagataaaatgtgttcgatgtaatcaccatcnataagcttaccgaagggaagatccttctctctaaaatattttccattttttaccacaaaa

SEQ ID NO: 42329 - DNA, 121 bp, Artificial Sequence
  Synthesized
  misc_feature (61): n=a or g
ctccttccagctgcaacaaaatttagcataatatgtgaggtagaattgccacctcaaaccnaaataagtgttcactgagctgtatttcatctctggatagaaataaaaaataacattcctt

SEQ ID NO: 42330 - DNA, 121 bp, Artificial Sequence
  Synthesized
  misc_feature (61): n=a or g
cagtatcacgagggaatagttgatacacgtttactgatagactattgtgttagtctggacnacagatcttaagaaatggaattgcatggagaattgcatggagcttatgtaactgatcact

SEQ ID NO: 42331 - DNA, 121 bp, Artificial Sequence
  Synthesized
  misc_feature (61): n=a or g
ccttaatgtgcacttaaagctgttttttttcacctctctcccaaattatgagatcttatgnttacaagaaatcatgaaggaataagtataaatatagctataattatgtataatcgtaatt

SEQ ID NO: 42332 - DNA, 121 bp, Artificial Sequence
  Synthesized
  misc_feature (61): n=c or g
gaaaacagctgccaagaaaacccgggagctggggaccatcaagatggccatcctcggcctnttccagcatgtgagcgagcagatgaaaagaggcctgaatgtgccagtggatgacagctac

SEQ ID NO: 42333 - DNA, 121 bp, Artificial Sequence
  Synthesized
  misc_feature (61): n=a or g
cgtggccacagacaggagcctgcaaggcagagttcacagctgacgggctggatgccatacngaaaacaagaacaggactcaatttaatgagagctctgcagggtccctggcggtgggatgc

SEQ ID NO: 42334 - DNA, 121 bp, Artificial Sequence
  Synthesized
  misc_feature (61): n=t or g
tactgttgtgagtgagcataacgttgaggcatactttgggtttgaaagaagcaaacttttnttgttgttttattttcagaattattttgagagagcaacagttataatgttaaccttctta

SEQ ID NO: 42335 - DNA, 121 bp, Artificial Sequence
  Synthesized
  misc_feature (61): n=a or c
ctgctgcaaatatttcctgaacacattttactatttcagaatacttttcctttcatgtgantgaaaggatgcagaaagaatggctgcattcttcaatgtggcatggagcgttgtgagagtc

SEQ ID NO: 42336 - DNA, 121 bp, Artificial Sequence
  Synthesized
  misc_feature (61): n=a or t
attcaagcagcaaaaatgcaatagtggtattttgagcatttatttattatcctcgctcccngctccaaaacacttcccaaatcaggccgtgcactgtccttctgttacatgtgtggagtcc

SEQ ID NO: 42337 - DNA, 121 bp, Artificial Sequence
  Synthesized
  misc_feature (61): n=t or c
aattccatctgtggttctatggtgagaagaaagtggaaatcgattgttgtttgagagtgcnctggtgcagtgatttctgtaacaagctccacagccacattcacaggactttcacagacca

SEQ ID NO: 42338 - DNA, 121 bp, Artificial Sequence
  Synthesized
  misc_feature (61): n=a or g
cacccctgtgcagatcctcctgcatccctcctgctctcctcctagagctgtttgaagtccnagccttatgctggccactggtctgtgatgactggggagtagggcaaggagcctgcagtgg

SEQ ID NO: 42339 - DNA, 121 bp, Artificial Sequence
  Synthesized
  misc_feature (61): n=t or c
tgactgcctcctgcctcctcctgctgctccactgctggcactgtccttcccagatggctcnattgagccgctaagcctcaaaaatgcagtcttaataagccaacaccacttaacgaagaca

SEQ ID NO: 42340 - DNA, 121 bp, Artificial Sequence
  Synthesized
  misc_feature (61): n=t or c
tgacttttctgactggcataagacattgtacacagttgtatagaaacatcagacatatganactcagatctatctcctcagcagcaatggcaaaatgaagatttctcttttcatacagata

SEQ ID NO: 42341 - DNA, 121 bp, Artificial Sequence
  Synthesized
  misc_feature (61): n=t or c
tttcagtcttttcactaatgcaacagatcaggctcacaacatgacaaaatgtacttttttnccccccctttttaatgctccaagtgcttgtgatctgaggcagggcctccctgttcactcg

SEQ ID NO: 42342 - DNA, 121 bp, Artificial Sequence
  Synthesized
  misc_feature (61): n=a or g
tactttcattgtactgtcaactgctttaagtaggtgtaaatccagaggaaaccaaataatncatccatgaatgaatcacaatattttaactgtattagatgtaggtaactgataaagtttg

SEQ ID NO: 42343 - DNA, 121 bp, Artificial Sequence
  Synthesized
  misc_feature (61): n=a or g
aaccagcttcgggacaaagctgttgccatgagagtaagccatgttcaaacagccactcacnaatgagatttgaggactgctacctatgacatcctagccctgtatcccacccaaaacagat

SEQ ID NO: 42344 - DNA, 121 bp, Artificial Sequence
  Synthesized
  misc_feature (61): n=t or c
ttaacatgaactggtataaccttcgtggaaggatgggaaaacaatctttctcatttatgtnaacaagtacagattgctgatctatcttgtttgtgcatttgttttgggttgttttgtttct

SEQ ID NO: 42345 - DNA, 121 bp, Artificial Sequence
  Synthesized
  misc_feature (61): n=t or c
ttttccattataagaggttactgagcttgttattaggttgtgttgggtgaagggaacacangtgttctagaaagaagggtattttaaatgatagtatctccatttttgagggacatgatta

SEQ ID NO: 42346 - DNA, 121 bp, Artificial Sequence
  Synthesized
  misc_feature (61): n=a or g
tgatgcaaagatgcttatgtttagctgctgaagcctcccaggctgtttctatgagcaagcngtgcctactgattctcagaatccactacccactctacatatttaaagtagctttacttca

SEQ ID NO: 42347 - DNA, 121 bp, Artificial Sequence
  Synthesized
  misc_feature (61): n=a or t
ctactctatacttcttgatttccactttttataaaaatcattttccacaagtttaaatcantgctattttcaaagtgtcactcactgtagttacggagctaggcattgaacggaattgcta

SEQ ID NO: 42348 - DNA, 121 bp, Artificial Sequence
  Synthesized
  misc_feature (61): n=t or c
ctcatcaactatttcttcttttatgtctggttcttcttgggccaggtcctaaatagatgtntctcacatgcctatggccatttgcagttcagaaaaaatagcttttcaaccacgaaggctg

SEQ ID NO: 42349 - DNA, 121 bp, Artificial Sequence
  Synthesized
  misc_feature (61): n=t or c
ggttttcattacagaaacagaaaaaggagtgttttgtgagttgcagcagctgctgtcatangcaaagatttcatacaagccagcctagtggatttgttttcctaaacaaacttgcagtcat

SEQ ID NO: 42350 - DNA, 121 bp, Artificial Sequence
  Synthesized
  misc_feature (61): n=t or c
tttttcttctgcagagcaatttcccctgtcctcttctgcctctttcatgttatttattttngagtaacagtgaccttacccactgaaaaatagaaggagtttcctcctcaaagaaggacca

SEQ ID NO: 42351 - DNA, 121 bp, Artificial Sequence
  Synthesized
  misc_feature (61): n=a or g
gcagcacagattcgtgtttcccaaataatataaccattcacaaagctggttgaaatttatngactggtgtgttgcgagcaacgttatttctaccagaagaaagcttttatgtagcacccag

SEQ ID NO: 42352 - DNA, 121 bp, Artificial Sequence
  Synthesized
  misc_feature (61): n=t or g
tataggtacttcaaagtagtgcagcattatatacttcaaccacctttaaccagcaccaaanaattattttttctaaaattcatgaaaggtgcttcaagatgattgttcctttatcttcctt

SEQ ID NO: 42353 - DNA, 121 bp, Artificial Sequence
  Synthesized
  misc_feature (61): n=t or g
ttgctgcaagacttacaacacctaaatccacaattacaaaactagaacactcatgtgatantatcaacattagctagtgatacaaccatacatgtcacttacttgttcataggtaacttca

SEQ ID NO: 42354 - DNA, 121 bp, Artificial Sequence
  Synthesized
  misc_feature (61): n=a or g
aaagctgtgtgactgcctccaggaggtgatgcagatcttttggagccatcaccgccctttnaggtacaagactggtgatgcctcagttaatacctaagggtgtttgtcaagaagtggctca

SEQ ID NO: 42355 - DNA, 121 bp, Artificial Sequence
  Synthesized
  misc_feature (61): n=t or c
acacaaagcgttaaaaaggtttagacacagttcttgaagtttttgggcccatccaccattngtttcaaacagaaatattcaactgaggaggcacaacagaaacagcaaaaatttgtatttt

SEQ ID NO: 42356 - DNA, 121 bp, Artificial Sequence
  Synthesized
  misc_feature (61): n=t or c
ccctaccctcttaattcccctcaggggcacataacacacagacacactacccgacctcccnaccgacacagcaagacacgtttcctgcgcatgaaacctcagcaatagggacatgcccctt

SEQ ID NO: 42357 - DNA, 121 bp, Artificial Sequence
  Synthesized
  misc_feature (61): n=t or c
acacacacccctggttaaaggcaggctgggtcagagccattccaaaccacctttttgcagntatttctcagttaatgaggaattattgaggctcttcttgctcgcagactggaccagccac

SEQ ID NO: 42358 - DNA, 121 bp, Artificial Sequence
  Synthesized
  misc_feature (61): n=a or g
ggccaagtgcttcaggctgcaggaattgcctcagaaatgcactgttagcttctgtacctcnaaattccagctcctggagtcgtgtggcaaggctgccatgcagggcacgggtgggagggca

SEQ ID NO: 42359 - DNA, 121 bp, Artificial Sequence
  Synthesized
  misc_feature (61): n=c or g
tgagaagaatggccacggtctctgccaacttctctgtaagtagccatctacagaggcaganaccacaatggcaagcatgtaagggtgcaatgaatggaaacttcttgagtggtccacagca

SEQ ID NO: 42360 - DNA, 121 bp, Artificial Sequence
  Synthesized
  misc_feature (61): n=t or c
aggcacaaatgataataactcctgtatgagatgaactacactgtctctctaaatatgcttnggatataacaatttatcaaccagcccttctggcattacactatatacatacggaaaacta

SEQ ID NO: 42361 - DNA, 121 bp, Artificial Sequence
  Synthesized
  misc_feature (61): n=t or c
agctcatttattccagctaataaatgtcctctaatcaccagccaaccttctgctgcctttnctctgctgaagctggaggtaggcaggctcgggtcatctcgctcaaagatttggccacctc

SEQ ID NO: 42362 - DNA, 121 bp, Artificial Sequence
  Synthesized
  misc_feature (61): n=t or c
ctcaatgttttctccttctctgccattgcaatggctttctccacctcttcttgggcagccntaagattctgtagttaaaataattaattaaaaaaaaaaagaccattttgatgtctaggag

SEQ ID NO: 42363 - DNA, 121 bp, Artificial Sequence
  Synthesized
  misc_feature (61): n=t or c
tcctctctgcagcagggggaagcgatcttgtgcagagacctcgagcacacaccaggactgngcaggctgctgaaatgccccacgcctgttacaaatgtcccctcctttgttgggcagggaa

SEQ ID NO: 42364 - DNA, 121 bp, Artificial Sequence
  Synthesized
  misc_feature (61): n=t or c
aggagagaatattcaggacagcatcattgggctacagggtaatagcttctgatagatgaangtttgtttctccaatgcttttttcttagaaaccactgtttgtgagaaaataaaatttaat

SEQ ID NO: 42365 - DNA, 121 bp, Artificial Sequence
  Synthesized
  misc_feature (61): n=t or g
aggcttggaggttccttccaaccagagtccttttgactctatgaaaacccagctaagacgntttgaagcgtcctggagctcaggagggaccaaggtgagcggtgtcaacacatagaagcag

SEQ ID NO: 42366 - DNA, 121 bp, Artificial Sequence
  Synthesized
  misc_feature (61): n=a or g
acctctccctccttcctgcctgtattactgcctgttcagctgtgcaacaattgcccactantatttacttccagggttacttcccagctacattctatccttgtttcagatcatcagcagg

SEQ ID NO: 42367 - DNA, 121 bp, Artificial Sequence
  Synthesized
  misc_feature (61): n=t or c
gaaagcaaagaagagaagaagagcttcaagtttttgttgatggtgggtttttcacccattntctcaaaatggaagcagttccactgggatttcttttgttctttgagctgtgagcaaccta

SEQ ID NO: 42368 - DNA, 121 bp, Artificial Sequence
  Synthesized
  misc_feature (61): n=a or t
tcaatttagatttaaagttccaagttggtgtgatggactaagacacaaaaccatcttagcnctgcagtctgctctgtagagagaagagacagtgcctgagggcagaaattgctgaatattc

SEQ ID NO: 42369 - DNA, 121 bp, Artificial Sequence
  Synthesized
  misc_feature (61): n=t or g
tatcaacaacttccatgtagcacctatgtcaaactgcccaactgtcaaactgtcctctcanatagttctgacatatgacatcagtttgtggtgagatgactttgttttcattgcagtagag

SEQ ID NO: 42370 - DNA, 121 bp, Artificial Sequence
  Synthesized
  misc_feature (61): n=t or c
tcattggcttagtttcttgacagataagcttgagttgtgcaagagcactcatgttcatacngtatcaagtagctgctctaatgcagacttcctgcattttacagaaggtctagcagtgaag

SEQ ID NO: 42371 - DNA, 121 bp, Artificial Sequence
  Synthesized
  misc_feature (61): n=a or t
acaaaaaaccccaccgctctcgtcattccaaacctgcacagagagggacagactaaaatancctcatcttttttttaatcagaggaacatcgctgtcccaaaccactgtgcatcacagtcc

SEQ ID NO: 42372 - DNA, 121 bp, Artificial Sequence
  Synthesized
  misc_feature (61): n=t or c
ctcccaagaaagtatgcacaaattatattgtgtttgaaaaaggcaagttacaggctcttgnatttccccaaacaaaaagtatttcttccactccattagaacatttgtgtaatgcactgaa

SEQ ID NO: 42373 - DNA, 121 bp, Artificial Sequence
  Synthesized
  misc_feature (61): n=a or t
caaaaagctcttgcccagacataaaccctatttaatctagggccagagcagtagcactagngttttttctcccctcaagcagaggttgcaaatcattttgcttaatagatgcctatcagaa

SEQ ID NO: 42374 - DNA, 121 bp, Artificial Sequence
  Synthesized
  misc_feature (61): n=t or c
gttttgtgatgcacaagaggttttttggcagtatgttgtgcaggtctatatttgagcaatnacaaaaatctactcctgggcatggactttaattgcagctgtgaattgccaggcatcagaa

SEQ ID NO: 42375 - DNA, 121 bp, Artificial Sequence
  Synthesized
  misc_feature (61): n=t or c
attcttatgatcgctttacaccttgttgcgtcatgacagctgtattgacattcactgctcnattagttatgccagtgtcatgatggtgatgagcagcacatgaatttgtcttttctactgc

SEQ ID NO: 42376 - DNA, 121 bp, Artificial Sequence
  Synthesized
  misc_feature (61): n=t or g
tcagcctatccagggctctgcgccattaatagatgtttatctgctgtgttttagaagatantttaaaatgaacagaaagatttctattgcatgtccaactgcctgggagagtaatgcagag

SEQ ID NO: 42377 - DNA, 121 bp, Artificial Sequence
  Synthesized
  misc_feature (61): n=t or c
agcacatcataagtgtgagactcctcaacagatagaaatgagattaagatggcacacttanattctttcagacagctgttaaatatactttttatcatgaaccatggtctagttagcatgc

SEQ ID NO: 42378 - DNA, 121 bp, Artificial Sequence
  Synthesized
  misc_feature (61): n=a or g
acagccgataaagcagagcaacagttaaacgggacaatacagacctctagtggccgcactncagagaaacacctccagtagcaaaaggttcatttctgagaacgcaggaccgttcctacat

SEQ ID NO: 42379 - DNA, 121 bp, Artificial Sequence
  Synthesized
  misc_feature (61): n=t or c
ccggagtaacaattttgttaatttcctcacaatcatattaggaggtttggtgagctagtcnaatacctgttttgtaaataatgaacagtgatttgaaagtatttggcattacaaagaagct

SEQ ID NO: 42380 - DNA, 121 bp, Artificial Sequence
  Synthesized
  misc_feature (61): n=t or c
tgtcagagagcacagaaatcctcttatgagcaccatttacatcagacatcatggagaaatnttggggaattctctctcagaaggctttgtggatgaatctagggctggtactctgcaagcc

SEQ ID NO: 42381 - DNA, 121 bp, Artificial Sequence
  Synthesized
  misc_feature (61): n=t or c
gcctcgagaggctgcagccttcagaatggccggttctgtcattaaaaagttggggttcacntccctcaccctgaggtccgaaggcagatgagcccacaaggctgaagtttaaagcaagctt

SEQ ID NO: 42382 - DNA, 121 bp, Artificial Sequence
  Synthesized
  misc_feature (61): n=t or c
ttgttgtcactgttgttgtacgggcttagcagagctgtctcggattaggtgatttaagcanggcctcccataaaaaaagctggaaacctgtagagcctttcagcctcactttttgaggctg

SEQ ID NO: 42383 - DNA, 121 bp, Artificial Sequence
  Synthesized
  misc_feature (61): n=a or g
acgttagggataatagcagctgtataggtgaaaaatgtcttttgatcaactactagcatanggaaaaggtgcccaaaaaatgtaactgtgttgccactcttgggaaaaggtaatgttaaca

SEQ ID NO: 42384 - DNA, 121 bp, Artificial Sequence
  Synthesized
  misc_feature (61): n=t or c
caggatgggaaggaaggaattgtgatcagcgcaagaatggatgttacaaaatggccaagtntaagtatgacacaaagccacgtggcatggaaggtgaggaggaaaagggagagcatgcagg

SEQ ID NO: 42385 - DNA, 121 bp, Artificial Sequence
  Synthesized
  misc_feature (61): n=a or t
atagttcggaatctgaactatggtggtacgacctaactgatgacaagccatcctaactggnacctaactggtactggaggaagcccccagcacaggcacagggttattgacaagagcttta

SEQ ID NO: 42386 - DNA, 121 bp, Artificial Sequence
  Synthesized
  misc_feature (61): n=t or c
tttattttcaacttctaaaagactaactccagaaaatgtcgtgcctggcagagcctgcctngctttgcaatggctggactatgcctctgaagccagttctttatatgtggggactcagaga

SEQ ID NO: 42387 - DNA, 121 bp, Artificial Sequence
  Synthesized
  misc_feature (61): n=t or g
gccctcctctggatccactccagcagctccacatcattcttgtggtggggccccagaaatngacatagtacgcaaggttgggtcgcccgaaagcagagtggagcaatcgccacccttgacc

SEQ ID NO: 42388 - DNA, 121 bp, Artificial Sequence
  Synthesized
  misc_feature (61): n=t or c
tccaaagaattatgaagacccactgtgcgaagccaatcaactgtgccttgacctgcacagnggtgttcccatgagagcagttctccagtctggagaactccagcttcctggatctggatcc

SEQ ID NO: 42389 - DNA, 121 bp, Artificial Sequence
  Synthesized
  misc_feature (61): n=t or c
gattagcaacgtgttcctatacaattctccagtcactcacttgattgcaaggataggcttngttcactttctttagaaatgtttcttggggtgaatctacattaagtaagaacaagtgtga

SEQ ID NO: 42390 - DNA, 121 bp, Artificial Sequence
  Synthesized
  misc_feature (61): n=t or c
caccgggtggcactgtccctccgtgccaccgtgcccatggagctggggtgggtccgttccnatgggtagggagcagtaaatccctgaaatgctgtgggtaggacaaacagcacaccaggag

SEQ ID NO: 42391 - DNA, 121 bp, Artificial Sequence
  Synthesized
  misc_feature (61): n=a or t
ttttagcatatgtgtgtcatgacagcacagcaaatttctaaattatgaaataagagtcaanttatttgtagattttttgaacaacagctggaaaaaggtatgagtttttccatattcatgt

SEQ ID NO: 42392 - DNA, 121 bp, Artificial Sequence
  Synthesized
  misc_feature (61): n=a or g
acagaaaggagagagctgtgatctgtcacctgaacaatatggactacttataaatgtatcnaaagtcacgtttttatccaatctccaactttgacaattaaattttgtttttaatttccct

SEQ ID NO: 42393 - DNA, 121 bp, Artificial Sequence
  Synthesized
  misc_feature (61): n=t or c
acctgttcgtatctgtgctgggagcgaggtaatattgagctcagccttgaattcccctccnagaaatctgcttagaaccagcactgctgcccagaaaaaaggcctgaaatatcgctctgac

SEQ ID NO: 42394 - DNA, 121 bp, Artificial Sequence
  Synthesized
  misc_feature (61): n=a or g
aaacacctctgtgatgtgaatgaaaaaagaatgagccatgctaagtaggaaaggtgaatcnaggattctgaaaaatgattccttcttgggagcataattgaatattgtatgtagcagggtg

SEQ ID NO: 42395 - DNA, 121 bp, Artificial Sequence
  Synthesized
  misc_feature (61): n=a or g
ttaaaagaatcccgatgtcagctggtttccctttgcttttttggggtcggaggggctgcancaggcagtgtgggtgagccttcctgcccggtgatgggagcacagcagcaggaatgtctgc

SEQ ID NO: 42396 - DNA, 121 bp, Artificial Sequence
  Synthesized
  misc_feature (61): n=a or g
gcaagtagaagtccaagcccctgctcccttcatcctctcacaaaaagagcatgttttcccncctaacataacctcacaattatttttggataccagattaaatcagacacaataaaatcat

SEQ ID NO: 42397 - DNA, 121 bp, Artificial Sequence
  Synthesized
  misc_feature (61): n=a or g
aagaattcaatacaggatagctatattcagaaaagcatgtgcctaaatacttccaagcctnctccaacaccaaagctatttgctcttccaaaattataagcccaagctgagtgctgggatg

SEQ ID NO: 42398 - DNA, 121 bp, Artificial Sequence
  Synthesized
  misc_feature (61): n=a or g
ttgcattgcacgaatattatagcatttttttttaactctacagtttcgccattttcagggngaaataaaacagtaatagggcctcccatcagttttgagcagggagtctcacagtggttac

SEQ ID NO: 42399 - DNA, 121 bp, Artificial Sequence
  Synthesized
  misc_feature (61): n=t or c
tgaaatctacagaagtaggtttttgggagagtgtctttgaattctgacaaaaaatagcagnaactagaccagaatttttattgctatccatctatgatgaatcaatgtggtggagacaaac

SEQ ID NO: 42400 - DNA, 121 bp, Artificial Sequence
  Synthesized
  misc_feature (61): n=a or g
gatatccgtgggggtctaaagtagaactgcagagtgtttatgtacatcactactctagacntgagtgaatttgctgtaccattcacctgtattcaacattcatttgtgcttcagtccaaga

SEQ ID NO: 42401 - DNA, 121 bp, Artificial Sequence
  Synthesized
  misc_feature (61): n=a or g
tacattagacctgagcaatgtggattttctgagttccagtctgcatcccatgtgctttccntgccctcatgctctttaccttttaatttctcctttgttcttcttcccaggccctggagct

SEQ ID NO: 42402 - DNA, 121 bp, Artificial Sequence
  Synthesized
  misc_feature (61): n=t or c
tgtttagatcactctataacacactcagagtacctgttattcttcattttttatacttcancagtctttttctgtcatttgtgaattttaccataaagaagttgtgttcttgtttaaatca

SEQ ID NO: 42403 - DNA, 121 bp, Artificial Sequence
  Synthesized
  misc_feature (61): n=t or c
ctacttgtacagtttctcatgttaacgtaaagagtaagtttaaataggataccataaatcngttctctcaaaaaaggagatgcagtcttgagcaccctgttacctggattctgtttttgta

SEQ ID NO: 42404 - DNA, 121 bp, Artificial Sequence
  Synthesized
  misc_feature (61): n=a or g
gtgtagcaactttgaactaccatttctctttccatttctttgttgtatcactccatgggcntccgacctgttggcttgcctgggatgcattaagtaaagagaaattttaggggcttaatac

SEQ ID NO: 42405 - DNA, 121 bp, Artificial Sequence
  Synthesized
  misc_feature (61): n=a or g
agccacaaaaaaggagctgagcagaagggcagcatctccaatgcattgatgtacagtaganttattccagagtagagtcattggcatgttttcctagtagttacatttttacatggtcata

SEQ ID NO: 42406 - DNA, 121 bp, Artificial Sequence
  Synthesized
  misc_feature (61): n=t or c
cagcttgttcagattttaaacatgtgatctgctgatttgaaatcgtggtcctagtcctgcntgccgttgtttgtgtagtgagcattgagctgcatggtctccagctctgtgtgctgcgtgc

SEQ ID NO: 42407 - DNA, 121 bp, Artificial Sequence
  Synthesized
  misc_feature (61): n=t or c
gcttctggggcaaagaattgatacagaaaatttgtaaatgagtacaccattgcgtttctgngccagtgcagagtttattttccgacagagtcacagtgtggacaactgctctgcaaccttt

SEQ ID NO: 42408 - DNA, 121 bp, Artificial Sequence
  Synthesized
  misc_feature (61): n=a or c
ccccaagacctgttactcagtggcactgctgctgcgctggcggccgtgcagctctccctgnctgtgggtggttctgctgccgtgccaatagactgcagctaaagctgttctccgggctgtc

SEQ ID NO: 42409 - DNA, 121 bp, Artificial Sequence
  Synthesized
  misc_feature (61): n=c or g
cagcttttggtaaaaaattaaaaggctttccttccctcttcttttaaaagcaagaggcatnaggggagcatttttagtgaaatcagttatgttgtgtagttagtgcaaattgattgacaaa

SEQ ID NO: 42410 - DNA, 121 bp, Artificial Sequence
  Synthesized
  misc_feature (61): n=a or g
ggttttcctttcaaagagggaaagacaaacaaggatttcagtgaaaggacggttatgtganacataaacctactgtgagagtacgcagttccttttccttttggtttcagctgtggtgata

SEQ ID NO: 42411 - DNA, 121 bp, Artificial Sequence
  Synthesized
  misc_feature (61): n=a or g
gctcagtttacagtggctcaacagcaaagcaggaacctgaacctggcccattcccagctcntaaccatgtggactgtttaaaagcacaactgcacgtgttgtctgcagaggtataatcaaa

SEQ ID NO: 42412 - DNA, 121 bp, Artificial Sequence
  Synthesized
  misc_feature (61): n=c or g
tgtagtttttgctattaaggcttatttgtggtagagcatcacgcaagacaacatggtgttngcaacatctcttcactgacttagagggtgggaatttggctgtaatacttaacagttatct

SEQ ID NO: 42413 - DNA, 121 bp, Artificial Sequence
  Synthesized
  misc_feature (61): n=a or g
tgacaaatatagttacagtctacacatgcagtatccagatttaatctcactggagataaanttttgaaaaatattctcccacatttactatatttccccaacaattgtctcctgcagacct

SEQ ID NO: 42414 - DNA, 121 bp, Artificial Sequence
  Synthesized
  misc_feature (61): n=t or c
ggtatgctctgttttaatgattatatgcaggaacagaaaggatgtgactagtgagagggtnaagagaaggacagaatcttacttttggtttttaaatctgaaacaacccaaatgtcataaa

SEQ ID NO: 42415 - DNA, 121 bp, Artificial Sequence
  Synthesized
  misc_feature (61): n=c or g
ggatgcttcagccttgcactgctcagctcatcctcatgtggccataggggcacctggcatnatagccctcatctttgagaagaacactaacccatcatcctcatcctgaagaacactgaat

SEQ ID NO: 42416 - DNA, 121 bp, Artificial Sequence
  Synthesized
  misc_feature (61): n=t or g
ccaggttatattattttagaattattacaataaggcattctgtattgacatttacaaattntcaaatgtgattgtaaaagtgaaagacaaaattaggggtaaatgtggttctttgtcaggc

SEQ ID NO: 42417 - DNA, 121 bp, Artificial Sequence
  Synthesized
  misc_feature (61): n=a or g
agagaaaagctgggaattcatcatttttctgcattcaaaagataacaaaacaaagccagcnattcaaccactagggtcagaaaggtttgaggaaaatacctcttctctcactcccactcgc

SEQ ID NO: 42418 - DNA, 121 bp, Artificial Sequence
  Synthesized
  misc_feature (61): n=a or g
tatatgccctgaaatatagatcaaatactgtggcataatgctatttcacttactaaatccnaatttaaattttaaagaccattttgcaatgtagaaggaagatgcaaatagcctgttgtct

SEQ ID NO: 42419 - DNA, 121 bp, Artificial Sequence
  Synthesized
  misc_feature (61): n=a or g
tgttagtacagcaagacagcagtgggaagccttcattttaggggctggtcccaagtagtcngtgctaatgagcaacttcctattgatctgggtgcaattttgtttaggttaataagaaaaa

SEQ ID NO: 42420 - DNA, 121 bp, Artificial Sequence
  Synthesized
  misc_feature (61): n=a or c
aatgcatatattggatttttttcctctattttttcttcatgttttgatttatatacttcanacactgcataggaggtaggaactccagtcattggtgtttgacagcgccattgagcactga

SEQ ID NO: 42421 - DNA, 121 bp, Artificial Sequence
  Synthesized
  misc_feature (61): n=a or g
aaaggaaatcactgtgccaaattttaaagcaggtagaacaagagctcccttactacaatangtaaataaaatcaagttcaggatgggagagaaaaacagttgaaaagagcacatttccttt

SEQ ID NO: 42422 - DNA, 121 bp, Artificial Sequence
  Synthesized
  misc_feature (61): n=a or g
aatctgccttgtaaagggatatacaaatatcttttccaccatattactatcaaacacatgntttattatgtatataacgaatctttatgagctttcttacttgaaagtgtttttattatat

SEQ ID NO: 42423 - DNA, 121 bp, Artificial Sequence
  Synthesized
  misc_feature (61): n=t or c
agaaattagatgcctgcaataactgggaccagtttaaatcacagattattagagaaaattngggtagcaggtgtatttaatattgatcttgcaggaaaatctgtcaatcatattattttag

SEQ ID NO: 42424 - DNA, 121 bp, Artificial Sequence
  Synthesized
  misc_feature (61): n=a or c
tgctttctgcgctgctgtgacaagaattagaaggaaggagggcttccaggctggagtttgnagccccaaaaacccagacatagccacccaaggggctgcagtaagggagatccctttcagc

SEQ ID NO: 42425 - DNA, 121 bp, Artificial Sequence
  Synthesized
  misc_feature (61): n=t or g
gatcggaggagggcggtgtggcccagggtagggccctgctcctgggacctctgtgagctgnaacgtggggcaaggccccactcttcttcttgggaaggatctgggagtgaatgggcggtgt

SEQ ID NO: 42426 - DNA, 121 bp, Artificial Sequence
  Synthesized
  misc_feature (61): n=a or g
gagattacagaaatactttgcttgtccagaacaaatgcagtgttttagtttggctaaagantatgttccctccaaaccccagacaaataaataaatagatacataaaagtccactctgctc

SEQ ID NO: 42427 - DNA, 121 bp, Artificial Sequence
  Synthesized
  misc_feature (61): n=t or g
tatgcctatgattttcttactacgatgagttccagtctgcagaggatgtgtgtacacacanctagtgtggtcatgcacaaatggtgctgtcatttcttcctccgggaaacggagagggtgg

SEQ ID NO: 42428 - DNA, 121 bp, Artificial Sequence
  Synthesized
  misc_feature (61): n=t or g
attctctgttgaataccccatgcaacttaattttcaagggtaatgaaaaacacgtcaacangctgctttttgaaaacataatgaatgcatgtgccctgttttccagagtctagataccagt

SEQ ID NO: 42429 - DNA, 121 bp, Artificial Sequence
  Synthesized
  misc_feature (61): n=t or c
ttcagattactagatgccatccacagctgctctgcagagttatggaagatagttatcgtangcacctgtacaaaagtagaaaatgaaataatgaaaaagtcatactgcatccctaggacaa

SEQ ID NO: 42430 - DNA, 121 bp, Artificial Sequence
  Synthesized
  misc_feature (61): n=a or g
attgtattataaccatgcagaatatgttttatattctaaaaacaatgtcagcaacccaaangaataaaatagactttcactaacaaaacattacgatagactctgcagaacacagtcacag

SEQ ID NO: 42431 - DNA, 121 bp, Artificial Sequence
  Synthesized
  misc_feature (61): n=a or g
tcaccgccgataaatagtgataagcattgtgccgctggaatttagtcaacagctctgttgntgagtgagccagaacataatcatatgctcccacggctgtgttggctttgcgcatctaaga

SEQ ID NO: 42432 - DNA, 121 bp, Artificial Sequence
  Synthesized
  misc_feature (61): n=t or c
tggactcggcctgtgtagtactgagggtggcagtattttctcatttgtaagccacacagcnttcatcaccttaaaaattctaaaaaaaggttgacagaggcagtatgaagagggaagggca

SEQ ID NO: 42433 - DNA, 121 bp, Artificial Sequence
  Synthesized
  misc_feature (61): n=a or g
ctcgctggtctctattcctccatcccaaacaatggctttttgcagccgcctcatctcgccnagctgctgatattcctcaaggttcagttgcttcctccattgttatttgcaatttatctga

SEQ ID NO: 42434 - DNA, 121 bp, Artificial Sequence
  Synthesized
  misc_feature (61): n=a or t
tggctggggattgaaataggtgttagtcaatagggattgaggccatcaccttcatgttgcnggagataaactgaaataccacccttttagaaggagacgcattggacaaacattcagagca

SEQ ID NO: 42435 - DNA, 121 bp, Artificial Sequence
  Synthesized
  misc_feature (61): n=a or t
aaggaaatgttcctggtgaaggaatcccatgaaaatctgaaaggtcctccacacacactcngcttgtccccatgagagctggtattatcagattttaaagagagcaaaccagggaaaaacc

SEQ ID NO: 42436 - DNA, 121 bp, Artificial Sequence
  Synthesized
  misc_feature (61): n=t or c
actgagatttgtacaacagcagctggacttgctattataagtttattttacatatgtatangtatatttaaagaagcccaacaaaaatagacatgaagagaaacattagatgctagctgta

SEQ ID NO: 42437 - DNA, 121 bp, Artificial Sequence
  Synthesized
  misc_feature (61): n=a or g
agcagtcttcagtgtttgctattcctgaaactatgactaaaatctgtcttctgatgctacnactgactgctttaaacatgacagcaatcacaagcatgcctttctgttttacaggttttta

SEQ ID NO: 42438 - DNA, 121 bp, Artificial Sequence
  Synthesized
  misc_feature (61): n=a or g
catgaacatggtagctaatttcagggtaagtaaaactagcttattgcctgtgaagtcagtntagcagctttttttcctgtagttttagttttagattctacgtatttagattctgcatatc

SEQ ID NO: 42439 - DNA, 121 bp, Artificial Sequence
  Synthesized
  misc_feature (61): n=a or g
agtcagtattcacaaaatgcttcagaaataacttacacaatctgtgcagaatccaacggantctctaatattgcatttttatgttttagtattatcatttttaagttatctgcattcttta

SEQ ID NO: 42440 - DNA, 121 bp, Artificial Sequence
  Synthesized
  misc_feature (61): n=a or c
tttcagcagtgatttttcacatcagtttgaagcacaacatcacccaaagggctttggcacngtgttgacaccaatgggcacttacagatacggtgaggttttcccaggcgatggctgcagg

SEQ ID NO: 42441 - DNA, 121 bp, Artificial Sequence
  Synthesized
  misc_feature (61): n=a or c
ccaagattatgttctcctttcttgagccaaaagaaaatggaaaacatactgagaggagtgnattatttttactaagggaatcataattgagttgtatttaggctaactgatgaacaacaag

SEQ ID NO: 42442 - DNA, 121 bp, Artificial Sequence
  Synthesized
  misc_feature (61): n=a or t
gctgtgagttattgcttaataaaacagcataatgcgcatcaatcataccgcacagtgcacnaccagtcaaattaattattcgtgtaaggcagataatttggtcccaaatggactgtttaga

SEQ ID NO: 42443 - DNA, 121 bp, Artificial Sequence
  Synthesized
  misc_feature (61): n=a or g
cgtaggctctgagcagaaatgagatattgaaataatattgtaagtctcctttacatttaanttatcctgatgctattagcttccattagaaaagaataagcatagctaaatctggagctaa

SEQ ID NO: 42444 - DNA, 121 bp, Artificial Sequence
  Synthesized
  misc_feature (61): n=a or g
gctggtaagctaaatgataatgtgctttcagcttgcaagcaatcttattgtcattctttcnataatatcacaaataaacattgatgatttagcaacagaagactgtatagtcctggcttca

SEQ ID NO: 42445 - DNA, 121 bp, Artificial Sequence
  Synthesized
  misc_feature (61): n=a or g
ctgaggcaaagaggttgagctggaggaagatctgttttgctggttaaaaatctgccttccntgctgcaaaggcagcactgagattcctctgcctgctgtgccttgtcttcctcccgtgctg

SEQ ID NO: 42446 - DNA, 121 bp, Artificial Sequence
  Synthesized
  misc_feature (61): n=t or c
catgtgaggaagatttattgtaaggccatgggcagattaaggaaggtcttcaccatgccantttcccactaagagcacctgctgggggagaaatggcgttgcactctcaggcaagtctagg

SEQ ID NO: 42447 - DNA, 121 bp, Artificial Sequence
  Synthesized
  misc_feature (61): n=a or g
gggcagccctcagagctggacatacccctgtcccagtcctgcttgtgctgtacagagatcngccacagcaaaaaactgttttctgatagtgatgtacaagtttgttatgcacctgcaaata

SEQ ID NO: 42448 - DNA, 121 bp, Artificial Sequence
  Synthesized
  misc_feature (61): n=a or g
aggcctaactcatcccagcaccctcagaacacgaaacaatctccgtgtgcagctgagctcncagaggactcaggtgatgggacagtgtcttcaaaggagacggccagcagggagccaacaa

SEQ ID NO: 42449 - DNA, 121 bp, Artificial Sequence
  Synthesized
  misc_feature (61): n=t or c
gatgttcttccaagcatggacaaggtggtgttcattaaaacaccttcttcatcattagcangatccctaggtgcactatcaacaactaagcctacttgctaagttacttgaaatacatata

SEQ ID NO: 42450 - DNA, 121 bp, Artificial Sequence
  Synthesized
  misc_feature (61): n=a or g
ttgatcaacttgtttctctaaagaaacctactgcctcttcattaaagaaaccccctgctancagcagacatggttgactttacaaacttttctaaccctttaatacttcagggtagttggt

SEQ ID NO: 42451 - DNA, 121 bp, Artificial Sequence
  Synthesized
  misc_feature (61): n=a or g
ctccctctccctgcctgttaggtcttctaattgttaggccaattaagcaagcgctgctgcnggtgggttctgtaccatgagcaacaggtgatgggaggctcccacccagctcaacgctgtg

SEQ ID NO: 42452 - DNA, 121 bp, Artificial Sequence
  Synthesized
  misc_feature (61): n=a or t
caaaaccaagtgcacttttatcagtgatgatgaaccatattgtagagaacaccaaattacnatatattgtatcaaatattctatatattgtaaccggaaaataaataaagaatgaaacatt

SEQ ID NO: 42453 - DNA, 121 bp, Artificial Sequence
  Synthesized
  misc_feature (61): n=a or g
gttcagatacgtgtgcttcctcagaccttgggtgggattgaattgagtctcgcaattagcncgtcatcaggcaaacagtttctgactttggattaaagacaaaggtcaaattaaaattctc

SEQ ID NO: 42454 - DNA, 121 bp, Artificial Sequence
  Synthesized
  misc_feature (61): n=a or g
acagtatctgaccaaaccagtacacaagtaaagattcttacagagatgataatgaggacancttcccaagacatgctttatagtcactgacgttctaaaagaagaagaggtgaaccaaaca

SEQ ID NO: 42455 - DNA, 121 bp, Artificial Sequence
  Synthesized
  misc_feature (61): n=a or t
gctgtactgtataagacactggaccacttctaagaaatagtttaattccctcagtgcacancagtgcatgcatgaaaacttgcatgaagaatttcaacagtaatttggatcagtttttgga

SEQ ID NO: 42456 - DNA, 121 bp, Artificial Sequence
  Synthesized
  misc_feature (61): n=c or g
acagccttacctgtatcattttttctgacacaaatgagtgtggccttctcagcaagcttgnaaaaaaaacactgctttgtaaatgaagagcattatgaagagcaaatgaaatatgagacat

SEQ ID NO: 42457 - DNA, 121 bp, Artificial Sequence
  Synthesized
  misc_feature (61): n=a or g
aggatggagcagaaattgaaggcagctcgttgtttctgaaactaattgtaaaaatccaccntgttacacactttgagctccgctgaaacatctgagtttcagagagctgacaagagcaaga

SEQ ID NO: 42458 - DNA, 121 bp, Artificial Sequence
  Synthesized
  misc_feature (61): n=c or g
ccctcgccgagagacacagaagtgggacacgtcctcacagcacatcaaacagcaatcagtntatatgggagctaattaccgggaaaaccttcgtttaatgtggatttcacaggcgagagcc

SEQ ID NO: 42459 - DNA, 121 bp, Artificial Sequence
  Synthesized
  misc_feature (61): n=a or g
attatccttatattttgtcacagaagacatttatatataagctggtagtgctaaatggaanatttgggactgaattcttatttaaaaatgataaaattgatttgaaattgattttgtgtaa

SEQ ID NO: 42460 - DNA, 121 bp, Artificial Sequence
  Synthesized
  misc_feature (61): n=a or c
ttctcctacttttacaagtcagctattttcaattcatgggctgatttctgtcttgcagaanaagagacatctgatggtactcggggtacactaacagttttcaccaggattaatttggaaa

SEQ ID NO: 42461 - DNA, 121 bp, Artificial Sequence
  Synthesized
  misc_feature (61): n=a or g
atcagaaccttgtatgtgctggcacagatattgctaaactttactgtaatcagagatttgnctaactaaggagaattcagcactgagtagtttttcattcagtttcacctctttcgtagta

SEQ ID NO: 42462 - DNA, 121 bp, Artificial Sequence
  Synthesized
  misc_feature (61): n=t or g
atagtgttgcttactacatagacatgcaaagctaggaatctacttaagagtaagtatctgngcctatgattggtgccattacagtctggttcattactgcccttaataaattccactgctg

SEQ ID NO: 42463 - DNA, 121 bp, Artificial Sequence
  Synthesized
  misc_feature (61): n=t or c
gtttagtggctgtcaacaaatttgcattcttaaactttgaagctgatgaagaattctcagntgggataaaagttcctggtctttttgatgcagcactgtccctgtggttgtgtcagatgca

SEQ ID NO: 42464 - DNA, 121 bp, Artificial Sequence
  Synthesized
  misc_feature (61): n=t or c
cctagcacagtggttctaaatactccagtattttactttggtttaatcaatgtatggtcangaagtttttagttctccaagctgttataaattgtactagaaactgcattaatccatgaat

SEQ ID NO: 42465 - DNA, 121 bp, Artificial Sequence
  Synthesized
  misc_feature (61): n=a or g
tctgtaatacctcatgcaatgatgcactgcactccacccatatgcacagtcattatttgcngtattttttcacatagaaaatatcagcaagatgcaaataattcagttagcttccaagagg

SEQ ID NO: 42466 - DNA, 121 bp, Artificial Sequence
  Synthesized
  misc_feature (61): n=a or c
gctttccttagctgactagaggactttgaaattcaacagcctcaaataaccatggagaggnaattttatttagtttggattggtaacaggagttctatttgtaccatttttggaattccaa

SEQ ID NO: 42467 - DNA, 121 bp, Artificial Sequence
  Synthesized
  misc_feature (61): n=t or c
tgttttgttttatttttaattttgttgtggtttttttattctcttctgggtttgttttttntaggtttcaccacatcaattaatagatattgccaaaggcagaatttttgcttagcagctg

SEQ ID NO: 42468 - DNA, 121 bp, Artificial Sequence
  Synthesized
  misc_feature (61): n=a or g
aatgacaggaatcagtgctataccaagaaacagggaaaaaagggaaatgtcagcactgagntagactaagttaaaaaccctaagatctctggaactatccacaaagattgatttgcagaag

SEQ ID NO: 42469 - DNA, 121 bp, Artificial Sequence
  Synthesized
  misc_feature (61): n=t or c
gtgtgtcgggtccccaggccctgctgaccgaagagctcagccaaagcagctgggctctggnctggcacatggcactaagatgacttggcagtgtggtacccagccctggtacctcgcaggg

SEQ ID NO: 42470 - DNA, 121 bp, Artificial Sequence
  Synthesized
  misc_feature (61): n=a or t
tcagcacatcttcctgtcagaaaaagtcttctgcttctccagaggaacagctgcctctgtngcttctttgacatctcctcaaagccccatggaacttgagtccctccacaggctcctcctg

SEQ ID NO: 42471 - DNA, 121 bp, Artificial Sequence
  Synthesized
  misc_feature (61): n=a or g
aaaaacattttagaaatctcactgctgggaaaacacaactacctgacatgatggacttccnagcttttccctcctgccacttggaataacaaatcacgtgcttgagctggaaacattattt

SEQ ID NO: 42472 - DNA, 121 bp, Artificial Sequence
  Synthesized
  misc_feature (61): n=t or c
ccgtgtcaacggcgtaacaaagatcactacttgccgttacgggcaacacagcacagactgngttagtaatgcacttcagaaccgcacagttactgcgtgcagccgagctcctgaggcgggg

SEQ ID NO: 42473 - DNA, 121 bp, Artificial Sequence
  Synthesized
  misc_feature (61): n=t or c
cctttggaggactacatgttgcagtcatgttagaaatgcagcaataaaaattaggaccagnccttgaagttcacccccataatgagatagactgatagaagatatgtatttaactcccaca

SEQ ID NO: 42474 - DNA, 121 bp, Artificial Sequence
  Synthesized
  misc_feature (61): n=t or c
actgctacacctaatagtggagtcaagtgcaaggatttggcccttccccctattctgctgnagttgctaagtcctttcagtgccgctctcattactatttctcttactgctgacacagcca

SEQ ID NO: 42475 - DNA, 121 bp, Artificial Sequence
  Synthesized
  misc_feature (61): n=a or g
agcaatgcattaaaaaaagcacattcagaatgtacagaaatttgccatctgcttctctctnagcatctatagagtttgcttggcatctgaagctcattacttttggcattggctaatccac

SEQ ID NO: 42476 - DNA, 121 bp, Artificial Sequence
  Synthesized
  misc_feature (61): n=a or g
gttcttatttgcctgttttttaacgctggagccatcatcatattcatcctcatcatcgtcntcctcttttttctccagtcctgggtgcggctgcagctttggaacatctgttgaacaagaa

SEQ ID NO: 42477 - DNA, 121 bp, Artificial Sequence
  Synthesized
  misc_feature (61): n=t or c
gaaaacctttaaggacagagatttttacagcctctgtcattctttagggtatttcttcatngcacattgtggaagcaatacccaagaacacatacagaaagcattaccatcaatcacaggg

SEQ ID NO: 42478 - DNA, 121 bp, Artificial Sequence
  Synthesized
  misc_feature (61): n=t or c
gctctccatagcaggaaatgaggatgtaagagagcaaatgtttttagaaatagccactttntttcagccattgacttttcttttgttttgattttgttgttgttgttgttgttgaagcagt

SEQ ID NO: 42479 - DNA, 121 bp, Artificial Sequence
  Synthesized
  misc_feature (61): n=a or g
aaggatccccacaaccaaaacaattttgtaggtgctgctttgaggatcacttaaagatgcngctgcataacatttctgaaaggttatgttgctttggatgaattttcaggagtgggattca

SEQ ID NO: 42480 - DNA, 121 bp, Artificial Sequence
  Synthesized
  misc_feature (61): n=t or c
tatatctttccccatatctacactgacagaaaactgtgttgaaaactgctgatgacaacangtcctccaggctgggtttgaacacattaatttgcctgagttggtgaggaatagtgaaacg

SEQ ID NO: 42481 - DNA, 121 bp, Artificial Sequence
  Synthesized
  misc_feature (61): n=a or g
tgcacaatgactgcgtaaggcatggatgtacgggaccgacattaaaaacctgtcagacccncagctcggcagaagcctgccgacagtgataaacatttgtgagtggggagaagggcgggca

SEQ ID NO: 42482 - DNA, 121 bp, Artificial Sequence
  Synthesized
  misc_feature (61): n=a or g
aggtgatgaaagtgagagatgctaagcttcatttagcttcttggatccacaccctgtaacnttatttgcatgagctggcagaggttagtagtagtagaacataattggacacctttacctt

SEQ ID NO: 42483 - DNA, 121 bp, Artificial Sequence
  Synthesized
  misc_feature (61): n=a or g
caatgaattcgcattataaaatatttaacatgaagagaagaggtcgaattgtttaattacntttatggcagacttaaatgaaagcaataacagcgccgtatgactttttacaggctcccaa

SEQ ID NO: 42484 - DNA, 121 bp, Artificial Sequence
  Synthesized
  misc_feature (61): n=t or g
accagtcacttctgatgagcagaaatgcatgtggctctattaatgaagcctcaccctgctnttttgaagttgctggtaaaactctcagtaagagattataccaaaatgacattacacaaac

SEQ ID NO: 42485 - DNA, 121 bp, Artificial Sequence
  Synthesized
  misc_feature (61): n=t or c
tctttgccaagtgtgtgtgcgcttgtgacgtgcgatgggaggacccaggacccacatggancttggaaggccatctgaaagcgatgtgcttctggcacaggctgcatttgaatctgtgttg

SEQ ID NO: 42486 - DNA, 121 bp, Artificial Sequence
  Synthesized
  misc_feature (61): n=t or c
tcttcacattatatttttcctacagatatttcatttgatcaaaggtaagtctgggttttgntctaatcctaatttgatttgaatgatgctataattttcagagctgctggattgactgaga

SEQ ID NO: 42487 - DNA, 121 bp, Artificial Sequence
  Synthesized
  misc_feature (61): n=t or c
acctcattaaacactgtgcactgctaaaaaagttctgcacacacaacagcttttgtccttngagatgggaacaattcatatcctatgcataaaggagcttcagaagcagatagaatagaag

SEQ ID NO: 42488 - DNA, 121 bp, Artificial Sequence
  Synthesized
  misc_feature (61): n=t or c
cataaaagctcactattgtacactgaggaaattgagagtcctattaggtccctagtggtcnccaagagctttgctgcacctgcatactcaacatcaagctaatatattcaaacaccacaat

SEQ ID NO: 42489 - DNA, 121 bp, Artificial Sequence
  Synthesized
  misc_feature (61): n=a or t
acattagtgacttccacacacctcatggagaaggttacattaacctgtgatgtcttccttntgaatttaggagttaataacagactatcgtaagcagtccagtactaccgtgattgtaatt

SEQ ID NO: 42490 - DNA, 121 bp, Artificial Sequence
  Synthesized
  misc_feature (61): n=t or c
tccatttcttctaggcaaattctcattttgtgttttcagccacagattttaaaactaaaangaaatagtccaagtcagctgtattagatgggaaataaagaattagtctgccagaaaatgt

SEQ ID NO: 42491 - DNA, 121 bp, Artificial Sequence
  Synthesized
  misc_feature (61): n=a or g
ggaccattccaggaaaactggacagtattccaattatcatctcatagagttgtgcacttanagatgacaactgtaattgataaaaaagcaacaacggaggaaaaaaaagtaaaaaggcctt

SEQ ID NO: 42492 - DNA, 121 bp, Artificial Sequence
  Synthesized
  misc_feature (61): n=a or t
gtctaacattacaactctatgacaactaacacatagttcctacccatcaggatactcttangcttattgaaccagtctatagggtagcttttatccagtaacaataagaggtaacagacta

SEQ ID NO: 42493 - DNA, 121 bp, Artificial Sequence
  Synthesized
  misc_feature (61): n=a or g
attctcccttaacctattgttttcagaacatgtaagagtcagaccccctccagctcataanctcctttgaagtacagtgatctgaagaagtaattaaagccaggatccacacataccatgt

SEQ ID NO: 42494 - DNA, 121 bp, Artificial Sequence
  Synthesized
  misc_feature (61): n=a or g
atgatccaccttgtgcagctacttgccttatcattaggaggaggttcgaggcagtgggtgnaatggactgcctgaaccaaaatctcctctttttaccagttctgtctgtgtgtatacagac

SEQ ID NO: 42495 - DNA, 121 bp, Artificial Sequence
  Synthesized
  misc_feature (61): n=t or c
cagcttggttatgcgttttcttcctctgaagcactcatcttttaagtgtatatactacttntaagtgtatatattctaaaacttaaaatgcagtatttatcaaaactgcaatatttgcctg

SEQ ID NO: 42496 - DNA, 121 bp, Artificial Sequence
  Synthesized
  misc_feature (61): n=a or g
cagagttctattaggcccttgctttggtccttggcgtggcttctgaggtgcctcattgcanattctgccttacttgcgaaggctgttaggagctcctggagattgtgtctgcagctgtgtg

SEQ ID NO: 42497 - DNA, 121 bp, Artificial Sequence
  Synthesized
  misc_feature (61): n=a or g
cagtgtataccatttgtaagatattttaaaataacataaaaagtttatattatccttattnatagttgcatggcagcatgttactgtgataatgatactttcatttctccttccttctatt

SEQ ID NO: 42498 - DNA, 121 bp, Artificial Sequence
  Synthesized
  misc_feature (61): n=a or g
ttcatagttcccttctaggtgaactattctaatctctaagcagaagactgatgaaaaaganctctatttcacgcgtagtagctgttttctgaaatagtcacacttataaagaaaaattaat

SEQ ID NO: 42499 - DNA, 121 bp, Artificial Sequence
  Synthesized
  misc_feature (61): n=t or c
attactctccaatattcctaaaaatagattgttttattttctagaaacgcatttctcaccngaaaatttcatctactgagagaaacagagaaatttcatgccagattaagttgacaggtca

SEQ ID NO: 42500 - DNA, 121 bp, Artificial Sequence
  Synthesized
  misc_feature (61): n=a or g
accagagcagaaaccagggggaaaaaaataacaaccgtgaaggccaacagaacagccccantgcacgggttgagatgtcagtgggacgtggggctcacctgcgggcgaaggggaagttgac

SEQ ID NO: 42501 - DNA, 121 bp, Artificial Sequence
  Synthesized
  misc_feature (61): n=t or c
gcccgcgtgatctgttacctctaacccaaatatagctatttgtgtagtttacagtttgctntaggataattatttcgtgtgtttgaaatgtaattcaatctggactgtcctttaactgaaa

SEQ ID NO: 42502 - DNA, 121 bp, Artificial Sequence
  Synthesized
  misc_feature (61): n=t or c
attacattattcatttctgtgcaaacactcagttctgcaaactattcatatcagtagctgnttgcgcttatgtaagggagtacaaccacaggaagtacagcctgtgaactactgacaacct

SEQ ID NO: 42503 - DNA, 121 bp, Artificial Sequence
  Synthesized
  misc_feature (61): n=t or c
agtgatatagctgttactaattcttctaaaatgaagcgacctacttgggaaagcattttcnctttaacttcaggcaagaacacaagtggatataattatatacgcataactctctattctt

SEQ ID NO: 42504 - DNA, 121 bp, Artificial Sequence
  Synthesized
  misc_feature (61): n=t or c
gcctggatgctgctctgcgcggtcagcgtgtgcacatatcagtaatgagttcaaactgcangctctattttaagctcagcctgatgccgtgcgtggtctgtctggggctcttagttcctca

SEQ ID NO: 42505 - DNA, 121 bp, Artificial Sequence
  Synthesized
  misc_feature (61): n=a or g
gataagctttgaattaataattcaaaaatttttaacggcaaaggtgcttagattaacatangaaaattaaacaccaaggaaatttgctaggatttctgagtgaaaaactgctcaagatagc

SEQ ID NO: 42506 - DNA, 121 bp, Artificial Sequence
  Synthesized
  misc_feature (61): n=a or g
atcatgtgccaatccggcgcaggaggtacaggagcagccctgggtcagcattttctgagcncatttgtaacctgctgttcagcgaatagtcatacaggtagataaaaatcctcctcctctc

SEQ ID NO: 42507 - DNA, 121 bp, Artificial Sequence
  Synthesized
  misc_feature (61): n=a or g
ttggaaagtggcaatcccatttgtaattgtactgtcattttgttaattaacagtaactccntttcaattagtgtgagaagaaaattgagatcttacagtctctgacctttgcttttaccta

SEQ ID NO: 42508 - DNA, 121 bp, Artificial Sequence
  Synthesized
  misc_feature (61): n=t or g
tttcacaggaattaatccaacaaatggtttgggattgagcaggtgacctttaaaacacatnctagcaccacagattactcctgtaagacaaacattttatacagcagcagcagttcagctg

SEQ ID NO: 42509 - DNA, 121 bp, Artificial Sequence
  Synthesized
  misc_feature (61): n=t or c
gcatctgcagccggcctgctgtgcgaggagctccgatggcacctgagagaagatgcagccntgctgtaagggatagcaacggacaccaattgcgatttggttaattaaaagggtctggaca

SEQ ID NO: 42510 - DNA, 121 bp, Artificial Sequence
  Synthesized
  misc_feature (61): n=t or c
aagctgcaaaaaacattattggtcaagggctgctctatgcctttgaatttgctcagtcttnagtctacgtacagaacttcagtaatctttgagataaataataattccctacatccagatc

SEQ ID NO: 42511 - DNA, 121 bp, Artificial Sequence
  Synthesized
  misc_feature (61): n=t or c
gcaggattagtcagagcagcaagaaatttgttaattgggccaacaacgctgattaaagtancttaaagtatcttaaatactggaagaacttcactgttcatgtcttttctagtaaacgtgc

SEQ ID NO: 42512 - DNA, 121 bp, Artificial Sequence
  Synthesized
  misc_feature (61): n=a or c
gggatctgtgttgggttatttagggctgatgaggtccctggatgcagcagcatattggctnagaaaaaggctggtttctctgatccaagcagtgaagaaagggatggtgctgaagtgggaa

SEQ ID NO: 42513 - DNA, 121 bp, Artificial Sequence
  Synthesized
  misc_feature (61): n=a or t
acttgggcagccctggcttgagtagatcccagatacttacctctgtgattctataaaatancctaagccaatttatcaggtaagttctggacaggatatagatgcatcaagcaccatataa

SEQ ID NO: 42514 - DNA, 121 bp, Artificial Sequence
  Synthesized
  misc_feature (61): n=t or c
agaaattaaattctatgacaatagtgttacgtagaggtcaaaagttgctcagaagaaaaanacatatacttgcaaatcttccttatatactcttttaagaaataaatatatttgtgcaaaa

SEQ ID NO: 42515 - DNA, 121 bp, Artificial Sequence
  Synthesized
  misc_feature (61): n=a or g
aaaactatttagaggggtttcaaatgtgaaataactccacatatattggaataaaaagatncaagaagtctatcagcaaaacaggagaagtaggtgcagttaatcctttgggaaaagcgtt

SEQ ID NO: 42516 - DNA, 121 bp, Artificial Sequence
  Synthesized
  misc_feature (61): n=a or c
cttgtgttgtttgctttcagggtagagtcagaaatttaaaacatcctgtgtgctttttttntttaacagaaactgctttattttgaaagaaagaagcatcaaccgattttctaatttgcct

SEQ ID NO: 42517 - DNA, 121 bp, Artificial Sequence
  Synthesized
  misc_feature (61): n=a or g
taatcagtagttggctgtaaaaatcatactcttacctaagagttttttttaactagttgcngtgatgtcgtgttacttcttaaagcctttgtggtgtaaaaccaacgcaatttgaataatc

SEQ ID NO: 42518 - DNA, 121 bp, Artificial Sequence
  Synthesized
  misc_feature (61): n=a or g
agactgaaatagcagacctactgcttgatttttagcagctgaagagcagcagtaaaccacntaagtattatgtaaaatgatctttttctaagtatatgtttattgtgcacagaagaagtgg

SEQ ID NO: 42519 - DNA, 121 bp, Artificial Sequence
  Synthesized
  misc_feature (61): n=a or c
aatgatcctagaaaagcaggatggtagctttccatggtaagtgtctgtaatgtcatacttnatgcatttgcttctcaagcattaattctattttctgctataagcttgtacttgcaaccaa

SEQ ID NO: 42520 - DNA, 121 bp, Artificial Sequence
  Synthesized
  misc_feature (61): n=a or g
tgtagcagtggtgttcattaggcctggtgtcctgtctaaggttcaccttggggaaattatnttctggatagtcagaatacactccctcttctttaacaaatggatgcagtattgttatgtt

SEQ ID NO: 42521 - DNA, 121 bp, Artificial Sequence
  Synthesized
  misc_feature (61): n=a or t
gacagcaggcatggtgactcagcccttgtttctgtatatgagtgttctgtatataagcatnggtatcagatacaagcatttcctgaatactcctcataactatgatagcaagatgcccttc

SEQ ID NO: 42522 - DNA, 121 bp, Artificial Sequence
  Synthesized
  misc_feature (61): n=t or c
tatttcaatttcagtcaacttttttttttctcttgaatgtattgcaataggagtattttanttttatttccaatttccagtacggtaactggatattgctcagaaacacttaaacactggt

SEQ ID NO: 42523 - DNA, 121 bp, Artificial Sequence
  Synthesized
  misc_feature (61): n=a or g
gatgtgtgttttagggagcaggtccttggtgagaaagctctgtgatgtgggctctgcagcngtcccagagctttgcagtgaggttcagcagctgtgtgttcccttcagaacagcactttgg

SEQ ID NO: 42524 - DNA, 121 bp, Artificial Sequence
  Synthesized
  misc_feature (61): n=a or t
taattcagcggcctcttagcagatgaaactggagcgaagtagtaggatctgagttctgcanctaatgttcccatgtactgcagctgcttctgtccagtctgacgctggtagataaaagaca

SEQ ID NO: 42525 - DNA, 121 bp, Artificial Sequence
  Synthesized
  misc_feature (61): n=t or c
gtgttgacattccctcttcggggataatgaatggcacgaactgcattgtgctcctcggagngctccgggatctgcaggaacgtaaacacagcagcctggattcagcggcgctccgccgtta

SEQ ID NO: 42526 - DNA, 121 bp, Artificial Sequence
  Synthesized
  misc_feature (61): n=t or c
ggaggctgaaggccactatattcttcatataatctaatccattatgtaggtctgaaatctntgaagtctgaactatatttgtttctagttgtttccatcagttgttgttccagtacataga

SEQ ID NO: 42527 - DNA, 121 bp, Artificial Sequence
  Synthesized
  misc_feature (61): n=t or c
tgaatccctttttcatgctacttttattcctgtggcaccgttcaggtttgtgccatcttgngaagccctgaagttgccacgagacatctggtgccagcagcaggtctgcgaggggtttctt

SEQ ID NO: 42528 - DNA, 121 bp, Artificial Sequence
  Synthesized
  misc_feature (61): n=t or c
aggcaagcgctcatttgtactgtgggtagtgaactctctacagatgggtagaacaaagaanatggatttgtacactcccattcaaattctcaggggttatctagtacaaggaccatatcgg

SEQ ID NO: 42529 - DNA, 121 bp, Artificial Sequence
  Synthesized
  misc_feature (61): n=t or g
tctgacaaaataaatataatttgttaagattaggcatttgtatctgtgtaaataaagtacntagaggcatggatcgtagttacactaggagagcagtgtaatctcccccagtcctatttat

SEQ ID NO: 42530 - DNA, 121 bp, Artificial Sequence
  Synthesized
  misc_feature (61): n=t or c
tgaacacagccactctcttctgccagggaaatcagcggtggatgatcattttctcactccnagcccagtcagccacagaatggacttatgggcacatgtgagggtcggcagatgcctttac

SEQ ID NO: 42531 - DNA, 121 bp, Artificial Sequence
  Synthesized
  misc_feature (61): n=t or c
ctcatggcagctgggccaccatttgtaatagaggcttcatttttccattaaagtgttcacnttagagattgtcatatgcagcagcacgtgtataaaatgactgattgacttgacgttgggt

SEQ ID NO: 42532 - DNA, 121 bp, Artificial Sequence
  Synthesized
  misc_feature (61): n=t or c
ccacagggtaggtttgataatcagttccagggagtgtgcctccaaagaagctgttgaaatncaggagattgcttcacatcttctttaacattcaaaccgccatgcaaacagttggacacaa

SEQ ID NO: 42533 - DNA, 121 bp, Artificial Sequence
  Synthesized
  misc_feature (61): n=t or c
tttcttctttagaggggtgaattggaacgctggtcagcatgctgcagtgacttgcagacangttcatcaaagtccttgtacctaaataggctatggatgtgagtaatgcttatttcttctc

SEQ ID NO: 42534 - DNA, 121 bp, Artificial Sequence
  Synthesized
  misc_feature (61): n=a or g
tgcacaccaaagcttgtatctgatggagtcggacctgtagcaagccaggagtcctgtctgnttcccacatctcagccatgcaggtgtccatccccagcatctgcagtagagctgtggcaac

SEQ ID NO: 42535 - DNA, 121 bp, Artificial Sequence
  Synthesized
  misc_feature (61): n=a or g
agtgcttatgcgctgcatgtgggtatgctggttgggaataggccatgttttgttcaattcnaagaggcaagtggcatccctatggaaagagcctttggttgtgatgctgctgcctgatcag

SEQ ID NO: 42536 - DNA, 121 bp, Artificial Sequence
  Synthesized
  misc_feature (61): n=a or c
gtgcaaaggtgtaaggaatcacagttggcagcagtggggcaaaccccatgtgaaaaaaaancaggtgcacaggcagtgagagtgctgaagaacagaaagctgccaaaacaatgtgtactgg

SEQ ID NO: 42537 - DNA, 121 bp, Artificial Sequence
  Synthesized
  misc_feature (61): n=t or c
tggctccctggagacgttgtgctgagcccttctgcagtttgccccctcattctaaataggngtaaattgctcgttgctgtgttataatgaaaagctggaaggtccactggagcttcattca

SEQ ID NO: 42538 - DNA, 121 bp, Artificial Sequence
  Synthesized
  misc_feature (61): n=t or c
gtggtttgttgtttcttttcctgcaagacatgatcttctatacaatgaagaaggataatangctaaacaagtaacctagtacattttagatactgaatttctaattagtaagtataatagg

SEQ ID NO: 42539 - DNA, 121 bp, Artificial Sequence
  Synthesized
  misc_feature (61): n=t or c
ggaagataagaagggggttatggacaaacatagctttctgaaaagtagactatatgggcanatcacaaagtgttagacaaaatgtctgcagtaaattgtgttgctaaaattggcatccctg

SEQ ID NO: 42540 - DNA, 121 bp, Artificial Sequence
  Synthesized
  misc_feature (61): n=a or g
ccttgaacttgctgattgtaatgtctttgtgaatgtaccagaaatgtttgaaattgaaatntacgttcagtttataaataattcacaattgcaaatacaaacaaaacacctcttaattgta

SEQ ID NO: 42541 - DNA, 121 bp, Artificial Sequence
  Synthesized
  misc_feature (61): n=a or g
cgggctaaatcacaactctgccatttaaaatcataaatagtatgttatcttttaatggcgncatttgtccttttgaaatcccttgctgataggctgctctaagaaaagcctaagtagactt

SEQ ID NO: 42542 - DNA, 121 bp, Artificial Sequence
  Synthesized
  misc_feature (61): n=t or c
gcacgttaacaacgttatttcagtgagttgctgaattattcagcatcaccgcaaggctgtnggctctgttacagaagtggttccttggaggcactgccctctgacagcccctgtgcccatc

SEQ ID NO: 42543 - DNA, 121 bp, Artificial Sequence
  Synthesized
  misc_feature (61): n=a or t
attaagttcccgtaatttgaacggaatgtagtcctgggaaagttagcagtatggaaaagtnatggcaaagcaggtacattgaatttttggtgccattcctgtcacatcagaagtccacaaa

SEQ ID NO: 42544 - DNA, 121 bp, Artificial Sequence
  Synthesized
  misc_feature (61): n=t or c
tcttaaatacaaataatataaagcttggatgtgaatgcagagtttgttttcatatcagagngtccttttaggcatgagaggcactggggaaaaaaaaaaaaaaaaaaaaggattttctcac

SEQ ID NO: 42545 - DNA, 121 bp, Artificial Sequence
  Synthesized
  misc_feature (61): n=a or g
ctgcaacccagctggaacatctggccatgggcttctttgaaattccagctcctgcctcccngggtctcccctaaaagttgcagcattgaatatgatagcagtagattcatcaagagctggg

SEQ ID NO: 42546 - DNA, 121 bp, Artificial Sequence
  Synthesized
  misc_feature (61): n=t or c
gggctgatttttcctggagagaatgaaatcattaaggcactctttcttacctgcagactgncattagcaaatgacatgtggcatttccaatatgttgcaggagtgtcacagagacaagaat

SEQ ID NO: 42547 - DNA, 121 bp, Artificial Sequence
  Synthesized
  misc_feature (61): n=a or g
gaatttctaatggaggaattgccctgtgttgcaaccatagaacaatccactgtaaaacaantattctagaaagacagtctcttgttttctgaagctttatatactatcacatacacatcta

SEQ ID NO: 42548 - DNA, 121 bp, Artificial Sequence
  Synthesized
  misc_feature (61): n=a or c
agagcaaatgcacaggtccaagagatatgtgttggtttgtatcatttctttttatagaganaatctacgttattatctgcttgggaggagctctccataaacatctgccaagttacctcat

SEQ ID NO: 42549 - DNA, 121 bp, Artificial Sequence
  Synthesized
  misc_feature (61): n=a or t
gattctatgattctctaataaaccgtggtgatattctgccttgatttccagtgacttcttnggttttgggtacatttttgcaaagtcaagactatctacaagtaaagggctgatttcaagt

SEQ ID NO: 42550 - DNA, 121 bp, Artificial Sequence
  Synthesized
  misc_feature (61): n=t or c
cccagctcctaaaagcttttccattggctcactcaaataccaactcccccacccatacaanttctttgaagactaagctgggtttaccagctgcaggaactgctctgaaaagagcacagcc

SEQ ID NO: 42551 - DNA, 121 bp, Artificial Sequence
  Synthesized
  misc_feature (61): n=c or g
tatccagggattactttgtataaattattagataaatatgtaatatcacataaatccaagncagcaattgtgctaaagcatctttcccactgttacagccttctgggctgaatgcagcatc

SEQ ID NO: 42552 - DNA, 121 bp, Artificial Sequence
  Synthesized
  misc_feature (61): n=t or g
ctcctgctcctgtttcttcatgccaggtagtacgccgtctttgtttaccagactgaaaagnagaaatgtgaggctttgctggatcttgaagccctcagttatgggtttgtccttttccctc

SEQ ID NO: 42553 - DNA, 121 bp, Artificial Sequence
  Synthesized
  misc_feature (61): n=t or c
tggtacccactacccccaagccccttagcagtactgcaccaacgctgctttgtggcacagncagtgcgtggcaagatgaagagctgaagccttaacaactgggagggatcaagtaggatat

SEQ ID NO: 42554 - DNA, 121 bp, Artificial Sequence
  Synthesized
  misc_feature (61): n=t or c
aaaactaagtttggcaatagtccacttacactaacaaaagagaaaatgacctaaaaggctntacagacattcctttcctgaagtgcatcctctctcatccctagcacatctcaactaactt

SEQ ID NO: 42555 - DNA, 121 bp, Artificial Sequence
  Synthesized
  misc_feature (61): n=t or c
gcctgaatctgttagctttcgtttttctctgatctggtagaagcaaaacaattctccaganagtttttctttcttgccattttactattaatagcacataaataggattatattcagtatc

SEQ ID NO: 42556 - DNA, 121 bp, Artificial Sequence
  Synthesized
  misc_feature (61): n=t or g
tcctgctgttaatactgtgtctgggtgacacaaggcaatgagcatccagcatctcatcagnttctgtgaaggaaaggcttgctacccaccccaaaaatctaatttatgtaatactcggtga

SEQ ID NO: 42557 - DNA, 121 bp, Artificial Sequence
  Synthesized
  misc_feature (61): n=t or g
atgcagcccaggtcttgaaactcccagacatggaagttccctgatctcaggattagcctgnggccgttgcaaggagatgaaatatagatgcaggcagccctcagagcccatcagcagtgct

SEQ ID NO: 42558 - DNA, 121 bp, Artificial Sequence
  Synthesized
  misc_feature (61): n=a or g
caagcccttataaaaagcatttaacttgcaacatttatttacatacacagaacacatttcngaaattcactgaaattccgaagtttagaaactttgaaaagcgaaatagctgcccggctaa

SEQ ID NO: 42559 - DNA, 121 bp, Artificial Sequence
  Synthesized
  misc_feature (61): n=a or t
agcgtcattctacctcagaccacaaacaaaaggtgaattaaagttaaggtactgcatttangaagtcctaccttgtttcttggtggggttaccccgacagctttttacacaacaggcaaag

SEQ ID NO: 42560 - DNA, 121 bp, Artificial Sequence
  Synthesized
  misc_feature (61): n=a or g
catcctcgtgtgccctgggctcgagggattggggctgagcggtggcaccagttgggtctcntctccaaaacgaaaagcacagctggtaaagtgagcgtgtggcaggcagagccaagaggat

SEQ ID NO: 42561 - DNA, 121 bp, Artificial Sequence
  Synthesized
  misc_feature (61): n=a or g
ggagaactgagaactgcagctagcaaagtgttgtaggctgtatggagagctggaaacctcntgcaccacaacttcttccagacgtcggcaatgtgctgctgcctgcccagcagccgccagc

SEQ ID NO: 42562 - DNA, 121 bp, Artificial Sequence
  Synthesized
  misc_feature (61): n=a or g
gtggattttttttttcctggaagaggaaactcagtccgctcttgcattaacatctttcaanactataccgatagcatgaaattactattatctgagagaatggattgcagtgtttatgaca

SEQ ID NO: 42563 - DNA, 121 bp, Artificial Sequence
  Synthesized
  misc_feature (61): n=t or c
tgctttgctttggctttagatgagatgcagcagtacctctacagggctcagaaactctttntcagcacgctctttacagctcgagggaaagtcctgcgtgttgtaaaggatgccttaaata

SEQ ID NO: 42564 - DNA, 121 bp, Artificial Sequence
  Synthesized
  misc_feature (61): n=a or g
cccatccttccatagtgctcagagaggagcacacacagccacagctccgggcacggtgacnccaccatggcaaaaacaaacccgtgaatgcacgaccctccatcaggatgtgaatccaagc

SEQ ID NO: 42565 - DNA, 121 bp, Artificial Sequence
  Synthesized
  misc_feature (61): n=a or g
gtcatcctccttgcatagtccccctcccactgtgtcagacatgctaggatttgttactggntttatccacgtgtgtggtttgtgccacttttaattaggatagtttgattttgcttcttcc

SEQ ID NO: 42566 - DNA, 121 bp, Artificial Sequence
  Synthesized
  misc_feature (61): n=t or c
aagtcttgcagtggcaattattttatatatatggggacaaaaatccacattctgagttttnttttcattttgtggatttggctgcttaagcaagaaaacaaattgtttgcacaacttattt

SEQ ID NO: 42567 - DNA, 121 bp, Artificial Sequence
  Synthesized
  misc_feature (61): n=a or t
tcaggattaggggagctgatgatcaggctgagctaaaaggagcaaatacttctatgagatngatcttcatgatggaatttaattcattctgaggtgtagcagctgcagaatccttggatcc

SEQ ID NO: 42568 - DNA, 121 bp, Artificial Sequence
  Synthesized
  misc_feature (61): n=a or g
gaggatgagcatttgaatgtacaaggtaaaaatattgcgtcatggagtatgtcagtgaatnactattaagtcaaaagcagattccagtgcaacaagtgaaatgctatagggctctaaatag

SEQ ID NO: 42569 - DNA, 121 bp, Artificial Sequence
  Synthesized
  misc_feature (61): n=a or g
catatatagggtccacagtcctcagtaacgtgtagccttgggaaggtatcataaaaatgtnggaactaaaattttagcagtaagatccagccttgcaatttttaagtcttttttctttttg

SEQ ID NO: 42570 - DNA, 121 bp, Artificial Sequence
  Synthesized
  misc_feature (61): n=t or c
ttaatctgcgtatttaactttaacattaatgtgtaaaatttcaaaagatgcttatcatggnttaattttttagtaggacaattacagctcttcaaagttgctgtagctaaaaattatttaa

SEQ ID NO: 42571 - DNA, 121 bp, Artificial Sequence
  Synthesized
  misc_feature (61): n=a or t
tatgcctacaagagtagcaatgtggcttaggcactccttatatcaaactacctatgtaccnacagacttttcagaaggatccagtgagaaacactgaaaggcaaacctcaaatatttgaga

SEQ ID NO: 42572 - DNA, 121 bp, Artificial Sequence
  Synthesized
  misc_feature (61): n=a or g
taccaccaatacctcgagctgcttgctttccaaacacgtaagcttgataagacaacaaccnctagctttccttcgctttgcagcaagggaactgtgacactggaatttgtatttctaaaca

SEQ ID NO: 42573 - DNA, 121 bp, Artificial Sequence
  Synthesized
  misc_feature (61): n=t or c
aggaggaatggcagttcccatcccagctcttctcaggcctgtggtttgcacaaccacagcngatctgattacagaacagccatgcagctccttctagaatgaggagatatatatttgaatt

SEQ ID NO: 42574 - DNA, 121 bp, Artificial Sequence
  Synthesized
  misc_feature (61): n=t or c
tgcaatgagcactagagggctgcagagaactgcttttgcagttgcagacgctgacattaangcaggacgcagttttcccctgccagttgctccagtccttgaaggaaagcaggcagcggga

SEQ ID NO: 42575 - DNA, 121 bp, Artificial Sequence
  Synthesized
  misc_feature (61): n=a or g
tttctctgggctataatagcacttggctttttagtttggccagcactaacacagtgtcagnaggtctgacaggaggtttctgcaaaaaaacagaccatctcgaccaccatcccagactttg

SEQ ID NO: 42576 - DNA, 121 bp, Artificial Sequence
  Synthesized
  misc_feature (61): n=a or g
gcttagaggagagagtcctctcctaactgaatgaacacatcaggacaagatcttttttgcngggctaatcacatccagccttgagcagctctttccccaccaagttactatgcaactaatt

SEQ ID NO: 42577 - DNA, 121 bp, Artificial Sequence
  Synthesized
  misc_feature (61): n=t or g
gagaaaaagtacatcactgtgaaatgcattggtagcagctgaatcctctgcagtctcttcncctgtcccgtgcctattaacaaaatgaattgatggacttaccttaccctgctgtttgagc

SEQ ID NO: 42578 - DNA, 121 bp, Artificial Sequence
  Synthesized
  misc_feature (61): n=a or g
tgctactttctggttattgttttgcttggattctctgaccagagtaaaatgctcagcaggngaagtggtagacatacaaggcttgctccgaaggtaatgcctcctattttattgtattagc

SEQ ID NO: 42579 - DNA, 121 bp, Artificial Sequence
  Synthesized
  misc_feature (61): n=c or g
aagaaggggtaacatttgtgtttattgtttctgtgcaagatttatttttgttgatagcctntcatggtccgaaaaaggtatacttcttgcatagctgcagatcacaacactgctactaacc

SEQ ID NO: 42580 - DNA, 121 bp, Artificial Sequence
  Synthesized
  misc_feature (61): n=a or g
atgatatcgagaacaaagatatccaaataaggttcctggaggggttatttcagctcttcanatagtacttgaaactggaagcttcttattgtctcataactggcagatatgaaaagaaatg

SEQ ID NO: 42581 - DNA, 121 bp, Artificial Sequence
  Synthesized
  misc_feature (61): n=a or c
tagcagtctgattcaacttgacaaaagctttagttatgtatgtgattgtaaatttgggggntggagatccctacccacccaagaagtatataaggtagaagcaaacatttttgacttaaaa

SEQ ID NO: 42582 - DNA, 121 bp, Artificial Sequence
  Synthesized
  misc_feature (61): n=a or g
gataacaacacttttgtactgttctctcttcctttactaataatcctttacactggatttnttttcttgagctttgatgaatgatgatacagtgacggaaaataaagaagactgagacgaa

SEQ ID NO: 42583 - DNA, 121 bp, Artificial Sequence
  Synthesized
  misc_feature (61): n=a or g
tccatcctctgcgaatgcacaatgctaattttgggatggatgaggtctagatgataggctnagccttggatcttcaccagctcagtctgcacagaggtagcacggttcagttccagctcct

SEQ ID NO: 42584 - DNA, 121 bp, Artificial Sequence
  Synthesized
  misc_feature (61): n=t or c
tacagcttctctccaacttgcatgctttgtcaagcccatgactccttctctttatttctgngccatctttcttgccacctacccttgctctgatccagctgctggacttgccgtgtggtga

SEQ ID NO: 42585 - DNA, 121 bp, Artificial Sequence
  Synthesized
  misc_feature (61): n=t or c
aaggaagatacatcagaaacaatgagcactgttgcttcttgtgcttattcccccattcctnccaactgtaggttcataaagtcaagcaccagcttccttgaacaatttgcacacaggcaga

SEQ ID NO: 42586 - DNA, 121 bp, Artificial Sequence
  Synthesized
  misc_feature (61): n=t or c
attatttgtaggaaggagagccaaacgcattcccagtttcagagaggtttcgaggcttcgntgctacaaaaagctccgtatggtcacacagtgctgcaatggcacagtacacaaaacctgc

SEQ ID NO: 42587 - DNA, 121 bp, Artificial Sequence
  Synthesized
  misc_feature (61): n=a or g
tactgaacacaagcaagaattaagatgtttagaaaggatatacaaggactaatgcattgantgtgtcttaccaagtctacagagacacattaaagatagcagacctttaactagccaatta

SEQ ID NO: 42588 - DNA, 121 bp, Artificial Sequence
  Synthesized
  misc_feature (61): n=t or c
aacagagaaaaggaagatgggggatgcggggatttgatttgacgtagcaaaacaggctatnggtgatttcaggtttgatttttcttctgataaatgtgctgcagtttcttttagaaatgct

SEQ ID NO: 42589 - DNA, 121 bp, Artificial Sequence
  Synthesized
  misc_feature (61): n=t or c
gaaaaggttgtcacctgttcacaaacagttctttcacatgcaagctgtaaacttacctgcnccttctgcagcttctactgtcatggtagaagatggattttggaagggcatcatgaaatgt

SEQ ID NO: 42590 - DNA, 121 bp, Artificial Sequence
  Synthesized
  misc_feature (61): n=a or g
tcctatagagaaatgcacatcttgctttccgttaggaaaattttttggtggtagtggatgnacagactggagactgattctggaaccaaaactcctacagcaatggttttcactgtgaaag

SEQ ID NO: 42591 - DNA, 121 bp, Artificial Sequence
  Synthesized
  misc_feature (61): n=t or c
tctgcctcacatacatacacatataaatatcagcgtgatacattggacattattaacgctntgcttatgtacgatgctagtctcactcactatggcactttcaagtttggctcaatatatt

SEQ ID NO: 42592 - DNA, 121 bp, Artificial Sequence
  Synthesized
  misc_feature (61): n=a or g
aggataatcctagaaaacaaactattaatgagtaccattagcaataaaaacggctttcacngaaaaataatgttttacttaaatattgagaaaactgaggaaactcagctggagagaactt

SEQ ID NO: 42593 - DNA, 121 bp, Artificial Sequence
  Synthesized
  misc_feature (61): n=a or t
atgccaggtaattcgtcatttctccctgaatgctatagacagagccatgctcttagtgtgncagataaaggcccgagaattgcttttcagcccacctaatgagggtttgtgtttttctatg

SEQ ID NO: 42594 - DNA, 121 bp, Artificial Sequence
  Synthesized
  misc_feature (61): n=a or g
aaccagcatgggagcatgcacacagccagcgatcctggatgtgacagtaagcactgccttncaggcagggcttgacatcagcaatgcttggatccctcggttccctttgctctggttgtta

SEQ ID NO: 42595 - DNA, 121 bp, Artificial Sequence
  Synthesized
  misc_feature (61): n=a or c
aaactgtttatattgaaattgctttgagataacacaggacaagtgccttggattaagcctnctttctgctcactttccacccacaagaacagcaacccaataatctacaattatacattta

SEQ ID NO: 42596 - DNA, 121 bp, Artificial Sequence
  Synthesized
  misc_feature (61): n=a or g
gaagtcggtggtacattctcatctggcactttatagttccctcacactgggaacaatttangtatctgcactattgatggctgccatcatgactgattcaccgcttcatttttaggctatg

SEQ ID NO: 42597 - DNA, 121 bp, Artificial Sequence
  Synthesized
  misc_feature (61): n=t or c
aggggaaaagctggagggagcagaaaccgtgctagtcaggagtgccaggtaatcacagacnctgcagcagcacctcttagctgacaagtttttctttgagactacctgctgcaaattccct

SEQ ID NO: 42598 - DNA, 121 bp, Artificial Sequence
  Synthesized
  misc_feature (61): n=t or c
gtgcttagtcctgtgctttccctaagcatcttctgtcagaaggcagcaagcaggagggcanagcagctgtaggaggcagtagaggtatatggaggcaaggcagcaggccgagaaaaagcta

SEQ ID NO: 42599 - DNA, 121 bp, Artificial Sequence
  Synthesized
  misc_feature (61): n=a or g
tttctcgtggaactacattctacaagaaaaaaacaagcgagcaaccacgagggcagcagantatttcagagatgccattttcccaaggagggcagctgcagaacagaaaatctaaggaagc

SEQ ID NO: 42600 - DNA, 121 bp, Artificial Sequence
  Synthesized
  misc_feature (61): n=a or t
atttttgatgttgaaacattatctcaatttttattactccaaagaaaagctgctactgttntagcagccacaaataaaaacatcctcagagtaaaatattttcactcataaatgtttgtat

SEQ ID NO: 42601 - DNA, 121 bp, Artificial Sequence
  Synthesized
  misc_feature (61): n=a or c
aacaagcgagaccagataataatctgagcgccataccagctaccccagaagttcttcctcnccaaagccactgcagtctgctgtatgcttggcctctcctttccatccaaaggaaaggact

SEQ ID NO: 42602 - DNA, 121 bp, Artificial Sequence
  Synthesized
  misc_feature (61): n=t or c
acattagtgcagttgtttccttttactcattaaaagtacattcaacaaactaaaaaatatntttgggtgaattaaactgcttacctttgagcctcgctcattaaaaataatttcaacatct

SEQ ID NO: 42603 - DNA, 121 bp, Artificial Sequence
  Synthesized
  misc_feature (61): n=a or g
cacaacagagatataaaaaataacttgagccagtcaaacccatggtggtgttgatgctgtnttactgatttaaagatgtaaaagaaatgaagaggtgaagtgctcttccacatgcagtttg

SEQ ID NO: 42604 - DNA, 121 bp, Artificial Sequence
  Synthesized
  misc_feature (61): n=a or t
cttttcagtatcttcatttgcaatagattttcttgatacataatgtaaactttcatgccgncgttttttaagccctttacttaatatccactaccgataaaaacagtttaatccctgcctc

SEQ ID NO: 42605 - DNA, 121 bp, Artificial Sequence
  Synthesized
  misc_feature (61): n=a or g
cggacccacgcctctctgacacatatggcatctacagatggacacgaggtcgctatcaccnccacctatcagagcccactgagctatgtcattcttacacgcgggccgggcgggtcggctg

SEQ ID NO: 42606 - DNA, 121 bp, Artificial Sequence
  Synthesized
  misc_feature (61): n=a or g
tttgcacggagagggcatttatctcagtattgcccagcgagtgcagcaggagccctgaccnagctttgctgccctgctatctctgtaacgttgtggaaaagtaacacagcaaaaattatga

SEQ ID NO: 42607 - DNA, 121 bp, Artificial Sequence
  Synthesized
  misc_feature (61): n=t or c
cccaaagacccaaaaggcaatggtgtcaactgatgcaacagggagtcaactgatgcatttncactagggcaaatttcaacccaaatcttcagccagggatagtattgtatttgcctctcat

SEQ ID NO: 42608 - DNA, 121 bp, Artificial Sequence
  Synthesized
  misc_feature (61): n=t or c
gccaactgtaagctttattttgtgctatttgctaagcaataaggatacgttacacatgagnaactaattacctattactgtccacttagtaacgctgtagtacacagttctcaaataatac

SEQ ID NO: 42609 - DNA, 121 bp, Artificial Sequence
  Synthesized
  misc_feature (61): n=a or g
tcaagaatcatctgctctgttctggcactatgttctgtttttgggagtctataatgcaaangataattagcagaagtttatgaagacttttcatatgaagacttttcatatgaagactctt

SEQ ID NO: 42610 - DNA, 121 bp, Artificial Sequence
  Synthesized
  misc_feature (61): n=t or c
cagcatcaccgtggcatcctcacaccccctgcaacagagcagctcagagaggacactcatncccaaactggaggatgtggagctaagggaaaagtgacatatggggatcaaagcaaagcag

SEQ ID NO: 42611 - DNA, 121 bp, Artificial Sequence
  Synthesized
  misc_feature (61): n=t or c
caggtatacataggactagcaagtatacagctccttctgcattattgctatagggagatanattttatatcactttccaacatgcaaaactttcctaaatattttgacttcttgagttgag

SEQ ID NO: 42612 - DNA, 121 bp, Artificial Sequence
  Synthesized
  misc_feature (61): n=a or g
gaaaacaacaacaacaacaaaacaacctgagtgtttcccatggttcccctcctggattcantgctgtcccaaaggcggcaaataaaccctcggctcgttaaaaatctgccctaacacagcg

SEQ ID NO: 42613 - DNA, 121 bp, Artificial Sequence
  Synthesized
  misc_feature (61): n=t or c
tggggccatcacttagtttggaggggacactctcagctgggatgggatggaacctatggtncctgtggtccacatggccatggttttgtctgcacagtaccaagaggctgagctgctgaag

SEQ ID NO: 42614 - DNA, 121 bp, Artificial Sequence
  Synthesized
  misc_feature (61): n=a or c
tatgaggtgagtacattcattcatcttgagctgccctgaatactgcccaccatgttcagcngtgaggcgctggacttctttcctgtctgaactacttaagccagttacgcaaatggtacag

SEQ ID NO: 42615 - DNA, 121 bp, Artificial Sequence
  Synthesized
  misc_feature (61): n=t or c
ctcctcttcagacttcttgaagtctggctatttaatttcttctccttctgttagcagttangtttaaaatatttttgaacttgctgaactaagtctgctaatagctattcagtattcaaga

SEQ ID NO: 42616 - DNA, 121 bp, Artificial Sequence
  Synthesized
  misc_feature (61): n=a or g
tgtttctagaggtggcctctttatgcattttgcaacacatataaaaacataactgccctcntatcaggcaacctgcaattaattctgatagctggtccatgattaaaacctatgtcctata

SEQ ID NO: 42617 - DNA, 121 bp, Artificial Sequence
  Synthesized
  misc_feature (61): n=a or t
taacaaagagcatagcagtttattttccattctctctctgttctaagtcgatttcagacanaattctcttcctgagaataagaattagagagaaaacagagttaataagaagaaataaaga

SEQ ID NO: 42618 - DNA, 121 bp, Artificial Sequence
  Synthesized
  misc_feature (61): n=a or g
gtattctggcaccggcgattaaggcaaatctgcaaaataagaaaagaggaattttattagnagcagaacaggtggtggtcgtcaaagaaaccaccaaagaaaccttaaggctggaaaagac

SEQ ID NO: 42619 - DNA, 121 bp, Artificial Sequence
  Synthesized
  misc_feature (61): n=a or g
tttcatcggccctgcttcacatcactgaaacataaaatattagcgttattatttaatgttnggaaatatttgtagttggaaatgaagaaaaggaagatctgtaggaagatcagtacataaa

SEQ ID NO: 42620 - DNA, 121 bp, Artificial Sequence
  Synthesized
  misc_feature (61): n=a or t
gccagctgaagaggtgagatggaattcccctccaacatggacaactgtcctaacaaatatntgtttacagaattcaggcagcagaaatacttagagtcctttataagtgcaatagctgcag

SEQ ID NO: 42621 - DNA, 121 bp, Artificial Sequence
  Synthesized
  misc_feature (61): n=a or g
atctattagttggagatgagcagacaacctatgtttcacacaaaggctgagttggcatttnagatgaatgcaataacagttaataatacagtataatatagacaaatacatgtaaaaagtg

SEQ ID NO: 42622 - DNA, 121 bp, Artificial Sequence
  Synthesized
  misc_feature (61): n=a or g
ctgtctgcatgtttctccttccgattctacgtagcagtctgtcagcaccatccttttgttnttcgtctgtacattatttcgaacctagcgtgagtttctttccatgtgaggtgctggaata

SEQ ID NO: 42623 - DNA, 121 bp, Artificial Sequence
  Synthesized
  misc_feature (61): n=a or g
ctaaaaaataagatttacctaagtatcatcactctgcaggatattggagtgatcagctccncgtacccaattccaaaaatggcaccatggcaactaggtgtttttggtaaaacttatttat

SEQ ID NO: 42624 - DNA, 121 bp, Artificial Sequence
  Synthesized
  misc_feature (61): n=a or g
gttgagtcatgcctacaatactcacatagcttgaacttttgcagcatttgagcccctaaanctacttattccttttgtatcaaaccgtggtatgagagcaatattaaatcctttaatagaa

SEQ ID NO: 42625 - DNA, 121 bp, Artificial Sequence
  Synthesized
  misc_feature (61): n=a or g
ataaataagcaatccagcaacttttggatatcagcctgaagaaaggcaggtgattatacanctgcctaaggtggtccaggttctcagcagtacttaacgtgtaacagagacggtgtgatgc

SEQ ID NO: 42626 - DNA, 121 bp, Artificial Sequence
  Synthesized
  misc_feature (61): n=t or c
tggagggacagcaggttgctctgctctgtcactactgtgaaaaagactatcagtgtagacngttcttctctgtaaatgtaaaacaagcaaacagttgcatattgaagagtcacagtcaggc

SEQ ID NO: 42627 - DNA, 121 bp, Artificial Sequence
  Synthesized
  misc_feature (61): n=a or g
gcatgtcttggggctttgtggtcaagtgctctgtgttactgctggcactatgcattgcacnagaggatgcttgtggcctcgctgcggcattggcactctgcctggcacagggcattggcac

SEQ ID NO: 42628 - DNA, 121 bp, Artificial Sequence
  Synthesized
  misc_feature (61): n=t or c
agtttttattcctgtctctcactgtcttgacaactagaacattagggttgatagtctgtgngttctgttactgacacaacgcttctgatttaggaaacagcaatatagagatggtggatag

SEQ ID NO: 42629 - DNA, 121 bp, Artificial Sequence
  Synthesized
  misc_feature (61): n=a or g
ccagggcagagtcagtggtcatttggaagcttttcttgtcattttctgtccacttatcttnagccaaaattatatgagattagttttttcttaagatttctccatagtattttatttttca

SEQ ID NO: 42630 - DNA, 121 bp, Artificial Sequence
  Synthesized
  misc_feature (61): n=a or g
tcaggatccattattaattacattgttataaacttgcttattgattcatgcattatttgcnaagtatttttcatttcctacagcgataggcagaaaaagcccaaggcactaattaggagca

SEQ ID NO: 42631 - DNA, 121 bp, Artificial Sequence
  Synthesized
  misc_feature (61): n=t or c
ttttcttgggtatctgctacgaccagagagtgatatgggttgaacaagaaggaatgtcatnagatctagtaggactctggtataactccaactttggagcttcaactgtatatgcagataa

SEQ ID NO: 42632 - DNA, 121 bp, Artificial Sequence
  Synthesized
  misc_feature (61): n=c or g
tcattaaagttctatttcacacagaaatagaataaggaaaaataattagtatgttctttanacagaattttcaaaaggacttggaaatgtcttaacttccaaatgaaagagtgactttagg

SEQ ID NO: 42633 - DNA, 121 bp, Artificial Sequence
  Synthesized
  misc_feature (61): n=a or g
aggtaggtatattggtctgtgagtagaaatctgacatttggtaggtatataacgatgaagnaaaccactcggggtcagctttgggatctgttagatttgctaagtctctgtataaatttca

SEQ ID NO: 42634 - DNA, 121 bp, Artificial Sequence
  Synthesized
  misc_feature (61): n=t or c
gccatgagggtatatgtaaattatgcaactttgttcctgacgcatcagaattacttcatanaagcacaacatcaaacagaagatgtatagcaatagtcagctttctgtctcattaatacaa

SEQ ID NO: 42635 - DNA, 121 bp, Artificial Sequence
  Synthesized
  misc_feature (61): n=a or g
aaaggtgccactgggcagctgggtgctggtctgaggttgaagtgcatttcaggatgactgnaggtgtatccccagctgataaagaacagaggtggaaagcatgttgctctgcttactgcta

SEQ ID NO: 42636 - DNA, 121 bp, Artificial Sequence
  Synthesized
  misc_feature (61): n=t or c
atctctagatattaacatttattttaaaaaatcattaattttttttgaattgtaaattaangtaataaccttcaaataattgctaatttctaccgcttagcaattttgcattacttgaata

SEQ ID NO: 42637 - DNA, 121 bp, Artificial Sequence
  Synthesized
  misc_feature (61): n=a or t
cttcctgactattaacgactagagctaacaagagatgtagaatattatatattgtagtgangtgccttcatctctttctttatagtactaatgaggcatttctttgctgttgaagggaaga

SEQ ID NO: 42638 - DNA, 121 bp, Artificial Sequence
  Synthesized
  misc_feature (61): n=a or g
ggctgcagcaataaaaagaaagcacacagagcacatttgaaaatgcagtgggatcggaggnatgaatgcctttgtgtctctttggagagctgaaatgtgcatgtgggagaaagcgatcatt

SEQ ID NO: 42639 - DNA, 121 bp, Artificial Sequence
  Synthesized
  misc_feature (61): n=t or c
ttcttcagtccatctcccctgctcctttccatctatccccctatgcctgaatccacttctnccatacccacaaacacacttctaagtactcacaacagactcagtgacaaaaccaccatta

SEQ ID NO: 42640 - DNA, 121 bp, Artificial Sequence
  Synthesized
  misc_feature (61): n=t or c
cccttaagagccctcttatttacatcttagtccacgctactaaaattaatagttcccatanatgaagaacatgataatcaggcaaacctaacttaaaaaaaatagagtggagagggaacta

SEQ ID NO: 42641 - DNA, 121 bp, Artificial Sequence
  Synthesized
  misc_feature (61): n=t or c
caacctcagctggcgtgatgtccctgtgtgcacccgtgggctgtggggtgagcattggcancagccagagcccttctctattgtgtgtaaaaggagaggtgaagagtggtggtgggaaggg

SEQ ID NO: 42642 - DNA, 121 bp, Artificial Sequence
  Synthesized
  misc_feature (61): n=t or c
attttatccttgattatgggaataatttgatttgccttagcgtagctattaaatggccacngagagattgactgcagtggaatgaaggatttcgccattaatagttttatgggagagattc

SEQ ID NO: 42643 - DNA, 121 bp, Artificial Sequence
  Synthesized
  misc_feature (61): n=a or c
tgttcgagagacaaatgtaagtctgagagtgaaaatgttgtaggcactttcagttagattntttttgcataagctcaaatgcctggaggtcatatttgtagaatatatatttttttgtttt

SEQ ID NO: 42644 - DNA, 121 bp, Artificial Sequence
  Synthesized
  misc_feature (61): n=t or c
catgcacttcccagctattttgagtcatttacacatcccagcaaccatctctattttgccntcctttccatacacagacctcagggctcagcctccaccacctgctccaggtgatgcatcc

SEQ ID NO: 42645 - DNA, 121 bp, Artificial Sequence
  Synthesized
  misc_feature (61): n=a or c
ctgggcattcagctattgtttggagccattaaacatgctgctccaaatctcatctctggcnagcatcccaattaagcaggcataccgttgatcagctttctgatcacatggaatttgttcc

SEQ ID NO: 42646 - DNA, 121 bp, Artificial Sequence
  Synthesized
  misc_feature (61): n=t or g
agacgtctgtgtttttttcttctcagacatcagaagaacacgctgtttaacactactcctntcaaagcagaaagcttggaggatctctgggaaaacttgagtttgaagcctgcaaatactc

SEQ ID NO: 42647 - DNA, 121 bp, Artificial Sequence
  Synthesized
  misc_feature (61): n=a or g
cctttggtttcagcagtgctgtgtggcaagaaaaggaacatcctgatagaaatgtgagggnaaaaggaattgggatatacagcctcctcagtgtctgcacaggtgaagaagttcagagtca

SEQ ID NO: 42648 - DNA, 121 bp, Artificial Sequence
  Synthesized
  misc_feature (61): n=a or t
gctggcgttgccactctctagctgtaccagcactggtacactaagctgtacagcttaggtncttaggggtagttgctctgcctcagcttccttctttccagaaaggcaagataaaaagcag

SEQ ID NO: 42649 - DNA, 121 bp, Artificial Sequence
  Synthesized
  misc_feature (61): n=t or c
cctgaacccacatctctctccttggctttagagatttctaggcctggaagggagtttcttncttcaaatgtaaaatatcactatctctagggctaaattgaaaatctacacttctgattta

SEQ ID NO: 42650 - DNA, 121 bp, Artificial Sequence
  Synthesized
  misc_feature (61): n=t or c
acctggactctaggttgtgtccatcttggttggatgctgagggtataggtcccaccttggnttcaccttcttgtgagagcagccctgatctcactgctcctcgatggctgggagcacatgg

SEQ ID NO: 42651 - DNA, 121 bp, Artificial Sequence
  Synthesized
  misc_feature (61): n=c or g
aaacactagacagactttcagcagctaaacttccatgaagtattcactgttctcattcttnggtgagcacaccaaaactgcaaaaaaccacttaaaatccaaaccctctatattctctttt

SEQ ID NO: 42652 - DNA, 121 bp, Artificial Sequence
  Synthesized
  misc_feature (61): n=a or g
gaattcttacatgatgtacaattcaagtaaatctgtaagatggggaacagtattgcatttntttattttttgtatgcgtgtagctataaaacgtgtccagatgtggtagtagtgttaaatt

SEQ ID NO: 42653 - DNA, 121 bp, Artificial Sequence
  Synthesized
  misc_feature (61): n=t or c
gggaggtggccctgcaattcctgctgggagtttgggggatgcagtttcaggattggggcgngctcccacgtcccaggaaggtgactctgtttgcaaaaggagccagcagctgcacagtcaa

SEQ ID NO: 42654 - DNA, 121 bp, Artificial Sequence
  Synthesized
  misc_feature (61): n=a or g
tgggccttccataggaagagttataaagcttttagggcttctcaagaattgctgttttctngacctcctggggaccaaacttcacttggctaaaaactctgggactttttctgagtcctgg

SEQ ID NO: 42655 - DNA, 121 bp, Artificial Sequence
  Synthesized
  misc_feature (61): n=a or g
taatgctgagggaatagatagcactttccacctcaataatgcctcctgtacaagagcatcntttttaagtctgtctctttctgtttttcatctttgttttctctgattagactgtaagcta

SEQ ID NO: 42656 - DNA, 121 bp, Artificial Sequence
  Synthesized
  misc_feature (61): n=a or g
agtgtcgcatgtccacagctgcatgcaaattgtagcacagcctcaacgcgttacaacagcnatttttcaatacgaaataatgatttccaagggacgactgactgttcctgtgggactgtat

SEQ ID NO: 42657 - DNA, 121 bp, Artificial Sequence
  Synthesized
  misc_feature (61): n=t or c
cagctcttcaccttgtggcttttgtggcaggtgttcaaatatgcactcagttctgctcccnaccacaaaaagaaaacataattgagaaggaagtggtttaaattaaaaaaaaaaaaatttg

SEQ ID NO: 42658 - DNA, 121 bp, Artificial Sequence
  Synthesized
  misc_feature (61): n=t or c
acctgatgttcacaagatgtggaactccatccaacaaaatcaaagacagccatttttaggnatagataaattcatcccctacatttctcagaaattgcatgctcctgattgctctaacaca

SEQ ID NO: 42659 - DNA, 121 bp, Artificial Sequence
  Synthesized
  misc_feature (61): n=a or g
caaaacctttttttttttagtaaaacctctcaaattttaaatcttggaacatgttgtcgtngacttaagcaacttaacatcattgtttttctggccttggcttctcaaagaaatcctggga

SEQ ID NO: 42660 - DNA, 121 bp, Artificial Sequence
  Synthesized
  misc_feature (61): n=t or c
cagtattactgatgaagatatgaagaagtatcagtcccatcagtgacctctgtgggtcacnacccaggtgatcaggtcagctgtactggactgtgttaaggacaggctaccattttgagaa

SEQ ID NO: 42661 - DNA, 121 bp, Artificial Sequence
  Synthesized
  misc_feature (61): n=t or c
gggatttggacccatccttgcacctgctgttgctctgttgcacagctttgaagagctgatnaatccttctcactcctcacttctcaagagagttgaggcttcagggagcacagcctttgca

SEQ ID NO: 42662 - DNA, 121 bp, Artificial Sequence
  Synthesized
  misc_feature (61): n=a or g
acatctaggcataaggatgggaaataaggttttttcactttctgtgttttgcattcctccngcaacttgctgaattcagatgtacagcaaagctttaaaatatcacttttattactaataa

SEQ ID NO: 42663 - DNA, 121 bp, Artificial Sequence
  Synthesized
  misc_feature (61): n=a or g
acaaatcttgcacaaatctcccagacacatgcctgttggacactgttacactggcacccanctaaggaaccccagtgatgttttttcaggatagcacagtggttttcagatgagaagacta

SEQ ID NO: 42664 - DNA, 121 bp, Artificial Sequence
  Synthesized
  misc_feature (61): n=a or g
taagataactccaccagcacagcatgtgtcctgcaaatgtccttctgcagagtacaagcangcattcattaaagagaggcaccacactcaaacaagaattacatttggaacaacacttgcc

SEQ ID NO: 42665 - DNA, 121 bp, Artificial Sequence
  Synthesized
  misc_feature (61): n=t or c
tcctatctaatggattcaaacgctactagaaggcccgcagctcaggtcaagctgaacctgngcagcaggaccacaacatttcttttacgggtaagaaagaacaggtaagacagctgcagta

SEQ ID NO: 42666 - DNA, 121 bp, Artificial Sequence
  Synthesized
  misc_feature (61): n=a or g
agacagaaaggagagaacggcatctgctgtcacgccggtatttgctgcagtcattccaggncttcagctccgctggtagaacagaatggcagctcacatcaagccaaagttttaggagaat

SEQ ID NO: 42667 - DNA, 121 bp, Artificial Sequence
  Synthesized
  misc_feature (61): n=t or c
gcaagaaaaactgagaaacagatttttggcgaccatttaccaattgaagatgaagaagaanttcaaaactgctcagcaagtggcaactcttcagcattcccatgggtcccacggctgcccc

SEQ ID NO: 42668 - DNA, 121 bp, Artificial Sequence
  Synthesized
  misc_feature (61): n=t or c
acccactaagggaattttctgagacaatcattttggaaaaaataggcctccgagcacttcnaaatgcacagtcagactgaaataaaggtccccagttgcccattccccgtgaagtccttgc

SEQ ID NO: 42669 - DNA, 121 bp, Artificial Sequence
  Synthesized
  misc_feature (61): n=a or t
cttttcttgtcttataataaattaaaattattttgagttcacatttcaccaaaatgcatantctgcaacctaaatgtgctagaaatgttctttgggctggaagaagaaagccccttgaaga

SEQ ID NO: 42670 - DNA, 121 bp, Artificial Sequence
  Synthesized
  misc_feature (61): n=t or c
gtgacatgtcaccagaagccaccgcgaaaggagagctgccctcctccacccaggtaagatngtggggagaaaggcaaaggtgtcgattgaatccaattacccccagtcaggagtgctttga

SEQ ID NO: 42671 - DNA, 121 bp, Artificial Sequence
  Synthesized
  misc_feature (61): n=t or c
ccgagccggggatgctggagagatgcagtgtggggtgaataccgcaacccaccccaacatncctacccctgtggggcaccccccagcctggttctgtggggccaacctgttggtgggcgtg

SEQ ID NO: 42672 - DNA, 121 bp, Artificial Sequence
  Synthesized
  misc_feature (61): n=t or g
acacctggaattcaaattgctctttataacagttgatataataaacttttgcttatttgtntagtggtctgtaaccatatcagtacgtgtgcagatttcccttctatactgaatctctatt

SEQ ID NO: 42673 - DNA, 121 bp, Artificial Sequence
  Synthesized
  misc_feature (61): n=t or c
ttattgaaagagtaaagagactattagagattttgtgaataattatttttaaagcaactcngtgagtagtgtgttgtcagagctaagtgaatattggcagggtgaaattcatgtctgtgcc

SEQ ID NO: 42674 - DNA, 121 bp, Artificial Sequence
  Synthesized
  misc_feature (61): n=a or g
tgtcccgaatccctggtccttcattatctttgctgtgctgcaccttagcaccttaattaancccatataaagatccatggaaccatgttataaactgggtcacttaaagatcaaaagatct

SEQ ID NO: 42675 - DNA, 121 bp, Artificial Sequence
  Synthesized
  misc_feature (61): n=a or g
aatctaaatatcctgaattcatatttatcactcttacaatttacccatgacctttctgcantggtatatttttcacaagcatcaccttttctgctgtccaggtatttattgattaattttg

SEQ ID NO: 42676 - DNA, 121 bp, Artificial Sequence
  Synthesized
  misc_feature (61): n=a or g
ccacagtagcatcactgctaatttagaagtcacatcagagattagagatataactgtatcncttcttatggcaatttaaaccctgtaggttgggtggaattgtcattgagtgaggaagtaa

SEQ ID NO: 42677 - DNA, 121 bp, Artificial Sequence
  Synthesized
  misc_feature (61): n=a or c
tagacttaccttgcgaagaatttggcctgaggacaaataataaagcaattatcaaacaaantttcattccactgggttgcaaactctaatagttgtgatgtggaaaaagaaaggttcatgg

SEQ ID NO: 42678 - DNA, 121 bp, Artificial Sequence
  Synthesized
  misc_feature (61): n=t or c
gtttttaatatttagactaattgttcccagtagaaaaatgggagtgtttcagtctacaggncaaagatttattttccctccatacaattacaatactaaaatcgtgtgaacggtttctaag

SEQ ID NO: 42679 - DNA, 121 bp, Artificial Sequence
  Synthesized
  misc_feature (61): n=a or t
gagcatcaagaaagaggtgatgtttccaaaggaaactctgcacagccttttaatgctattntttttcaatctgtgaatgtgtggacataacactgatgtaaatctttgactgtcaatttct

SEQ ID NO: 42680 - DNA, 121 bp, Artificial Sequence
  Synthesized
  misc_feature (61): n=a or t
gacagttcagtcaaaggtagaagggaaaaattacaaacaagcatcagcacaatgtaaaacnaaatgcagaagaaagatgtagatgacaaaggtacaaaattctagagagaaaatagaacca

SEQ ID NO: 42681 - DNA, 121 bp, Artificial Sequence
  Synthesized
  misc_feature (61): n=t or c
gagtatgtggaaataaatccctctcattctgcttttgatcttctgagttccttaaatatangtcatcagcgagcttatatcctgaatttataacagccttacaaagattttctaaaacagc

SEQ ID NO: 42682 - DNA, 121 bp, Artificial Sequence
  Synthesized
  misc_feature (61): n=a or g
aataaataaattatgttgtataaatttttctcgtataaattctaaaacatttgcatcatanaagtgagaccgacactgactgagaaaaagggcaaggcgaaagtcaatgtgcttctcagaa

SEQ ID NO: 42683 - DNA, 121 bp, Artificial Sequence
  Synthesized
  misc_feature (61): n=t or c
gggctgtcccgctgaacgccttgctgtttccacccatttgtaactcacgtgttctgtaganagaagctaggatttgaaaaggtggaaaacaaaaccttaacagaagcaacctttctccagt

SEQ ID NO: 42684 - DNA, 121 bp, Artificial Sequence
  Synthesized
  misc_feature (61): n=a or c
tgaagcttctgtaacgctcacgagttctcaggataggaaataagactgtgggacttgtttnaaacagatggcacctgtgctgatagccaacaaggtgatcatgagccagcagcgcgccctt

SEQ ID NO: 42685 - DNA, 121 bp, Artificial Sequence
  Synthesized
  misc_feature (61): n=t or c
ctgctttgtggctgcttgttctagtgcatttgggcaaggcacagcacctttctgtagaaangattccttgcagaagtggttacttgctttgctgtaaggtgatttacgtcacttgtggagt

SEQ ID NO: 42686 - DNA, 121 bp, Artificial Sequence
  Synthesized
  misc_feature (61): n=a or c
ttaggtatttattcccttccactataatcagcttcaagtcatgttttctagaattcagganttcagctagttttgtctcactgaaaaccatacaggctttgttgctttttgctcttgttgt

SEQ ID NO: 42687 - DNA, 121 bp, Artificial Sequence
  Synthesized
  misc_feature (61): n=t or c
gcagggaaagggtctgcagctcccagatctcagcacagctctgtgtttatatgtgtgcctncctgggtttttgatgtgttcatcccacctagcttttgtcatgcagatagatgctccacct

SEQ ID NO: 42688 - DNA, 121 bp, Artificial Sequence
  Synthesized
  misc_feature (61): n=t or g
tctcttaaggtctgtgtgtgtctgaaggaacaagacacttttccttctcccaggtggtacngtcttaaaaacctattctaaactgtattcttagcaatatatctgtgtaagttcatgagtc

SEQ ID NO: 42689 - DNA, 121 bp, Artificial Sequence
  Synthesized
  misc_feature (61): n=c or g
atgcactttatgaaaattgaccccaaaaatcattagtagggagaaagtctctcacaaatcnctggtaaaacaaaaccaggcaccaggatttgagttacaccagtttggaattggccagatc

SEQ ID NO: 42690 - DNA, 121 bp, Artificial Sequence
  Synthesized
  misc_feature (61): n=t or c
gcaaaaagtcagggtttggggttataattactgccacttccaagtgtgtgaacaacagatncctcagagtcatgaagctggcttgtaaatcgtaggattaaaaaactatattaaggaataa

SEQ ID NO: 42691 - DNA, 121 bp, Artificial Sequence
  Synthesized
  misc_feature (61): n=t or c
ctgtactgggctccagaagaggtggtagcactaaggtcttactgtttgctgtttagctganaatcacagacttaaagaagtacttttttagcacatattcacaaagggttgcactgaggaa

SEQ ID NO: 42692 - DNA, 121 bp, Artificial Sequence
  Synthesized
  misc_feature (61): n=a or g
cctgttgttgctttcggtcggagcccagggcacggtgatggtggtcatgggggtgacaganatgtgatgtgatccaactgccaaatggcatcccatgggcagcaaacccagcactggcgca

SEQ ID NO: 42693 - DNA, 121 bp, Artificial Sequence
  Synthesized
  misc_feature (61): n=t or c
cagctccattttaaattgcttgctttgtatttgctagaaatgatttcagaagcgtagaaangtggtgtacatcgccaacatcacagctttactcctttcctctcacttctgaatgcactga

SEQ ID NO: 42694 - DNA, 121 bp, Artificial Sequence
  Synthesized
  misc_feature (61): n=a or g
gtgaagttccgcacctggaatggaataatcccaaagaacagcacaggctgggttctgtctngcagtagtcatgctgagaagaacctgggagtctctgtagctggacatgagccagcagcgc

SEQ ID NO: 42695 - DNA, 121 bp, Artificial Sequence
  Synthesized
  misc_feature (61): n=t or c
taataaaacacagctgcaggttatagaaattgagagggaaaatcctttgtaatgaaacttnattactcccatgcagcagccaagccactctatcttctgcacatgtaagaaaaggcctcgg

SEQ ID NO: 42696 - DNA, 121 bp, Artificial Sequence
  Synthesized
  misc_feature (61): n=a or g
acatcgtgcacataactgcctgtggtttaaaaaccctcaagcttatgcagccttaaaaaanaaatccacccattagttcttcttatgctattattaatacttaagatcacgacaacatttc

SEQ ID NO: 42697 - DNA, 121 bp, Artificial Sequence
  Synthesized
  misc_feature (61): n=a or g
caagtgtatgtgtgtgtgcttacatctgataagaaaaatttttcactgatgacttggcaantggaatttagaccataatgatatattgggaattatgagaaaagaatggcttattcaatgg

SEQ ID NO: 42698 - DNA, 121 bp, Artificial Sequence
  Synthesized
  misc_feature (61): n=t or c
agcacaacactgagactggactccaactcagccattaagaaggcacttcccagcagtaatncctgctttgtcctctttcctgccctgtgacccaaaagaaggcatttgattgcttagtgtg

SEQ ID NO: 42699 - DNA, 121 bp, Artificial Sequence
  Synthesized
  misc_feature (61): n=t or c
gacttgtaaattgcaggcgtgatcatacagatggacagctgctgctcagcctgccctcttncatccattccttctttcctgggttcaggagcaaagttctgcagttcctctgtgaaccatc

SEQ ID NO: 42700 - DNA, 121 bp, Artificial Sequence
  Synthesized
  misc_feature (61): n=a or g
ccaagagaaccaagttaaccagcccagtacatggctctttaaggaccagtattctgctcantcattggtagtaaagtaaattccaggcccataatatccctgagcctcatcttctgataac

SEQ ID NO: 42701 - DNA, 121 bp, Artificial Sequence
  Synthesized
  misc_feature (61): n=a or g
tctcaaaacataagaaacaagtcacctccaactcagaaacggaacaagtattacagaatgnaaaattaagctaattttacaattgctaatttaattttttatcaatataaatccttgtata

SEQ ID NO: 42702 - DNA, 121 bp, Artificial Sequence
  Synthesized
  misc_feature (61): n=t or c
aagttttttgctatgatgaagtgcaatacaggtgttgagcagttttatctaccttatccgngctccatgaaaaatgtgaaccagataacctccagaggtccctccaacctaaattatttgg

SEQ ID NO: 42703 - DNA, 121 bp, Artificial Sequence
  Synthesized
  misc_feature (61): n=a or t
cctcatcaaggtcatcaataaagatattaaagaggacaggcattcttctcatcacctaagnactcacccagaagtgcaagactacctgggctttccccagctatcagactcagaagacatt

SEQ ID NO: 42704 - DNA, 121 bp, Artificial Sequence
  Synthesized
  misc_feature (61): n=t or g
tcataatgataaaaatttaacccctttcccattattgatctctgacagctaagtaaagtantctttttctgtgtgattcttcttcttggtgattttacactaactgcatgcagttctgccg

SEQ ID NO: 42705 - DNA, 121 bp, Artificial Sequence
  Synthesized
  misc_feature (61): n=t or c
aggtgtagttagcagggactcactaagactgagggggaatcttattaatacttataaatanctaatggatgggagttggggttagtttaatggagagcggccaggctcttttaagtggtgc

SEQ ID NO: 42706 - DNA, 121 bp, Artificial Sequence
  Synthesized
  misc_feature (61): n=c or g
ttgctctgtgtgctctgagtgcttttggcctgtaaagaggagcgcaggaaggaggtttgtnatcttctaatctaaaagaagtgaggaacgtgggaaagcaaagcagtgccagatttcttcc

SEQ ID NO: 42707 - DNA, 121 bp, Artificial Sequence
  Synthesized
  misc_feature (61): n=a or g
gcaggaggagacgtgcaggtgtgagagcgtgcaccgactgcacaactctgcatctctccanatgtggagggagaagccccatttgttggagagcaaagaacagcaaagggacacagccctg

SEQ ID NO: 42708 - DNA, 121 bp, Artificial Sequence
  Synthesized
  misc_feature (61): n=a or g
aggttcagattggacatcaggaaaaattttgttagcatgagggtggtcaaaacacttgganaagcttccagcataggtggtaattgccctgtgccagccactgttcaaaggacatttagat

SEQ ID NO: 42709 - DNA, 121 bp, Artificial Sequence
  Synthesized
  misc_feature (61): n=t or c
acttgttaaatttgttttttcccccaatacaatattataaatataaatatccagaatgttnacgtgttctgattttgtctgagacaatattaataatgcactgaagctttggttgttgctc

SEQ ID NO: 42710 - DNA, 121 bp, Artificial Sequence
  Synthesized
  misc_feature (61): n=a or g
gacagttcaagagcttgatttctggggtagggctgcttcttcatatgtttttttctcttangtttgtacaaatgtatagaaatctatttggggaaggtggataaatggcagtgctgagacg

SEQ ID NO: 42711 - DNA, 121 bp, Artificial Sequence
  Synthesized
  misc_feature (61): n=t or c
aggccactaaatatccttatgttatgctctaacacccctatatatccttatgctctaacantcctatgtatccttatcatgctctaacacccctatatattcctatcatgctctaacaccc

SEQ ID NO: 42712 - DNA, 121 bp, Artificial Sequence
  Synthesized
  misc_feature (61): n=t or c
ctcattcacctgagtaatccaaacgaaatacagccttctggtggtctgtaaggagggctcngactctcacagcagaggataagctctgacctcagagtgacaccagaaaaatgaaggcaga

SEQ ID NO: 42713 - DNA, 121 bp, Artificial Sequence
  Synthesized
  misc_feature (61): n=a or g
aacaagtcccaaagaggatcaattccatctcccaaacatcagaagcgctctgtgttacacnataacacattcagatactctccagtccttccttatggggatccagatgaaggactactgg

SEQ ID NO: 42714 - DNA, 121 bp, Artificial Sequence
  Synthesized
  misc_feature (61): n=a or g
acctacagctccatcaggctgctcagagcctggtccagcctggctggaggaaacaggacanattcctgcttaaactccagggctcccacgcagaagtggcagcgacacaagcaacagtttt

SEQ ID NO: 42715 - DNA, 121 bp, Artificial Sequence
  Synthesized
  misc_feature (61): n=a or g
ctaattaagagaccttccattgtccttgcctcctcctggatggatttacctgctattaagntctgccactgcagaatttggaaggatgactttgtctgttcacaaatggagaaaagctacc

SEQ ID NO: 42716 - DNA, 121 bp, Artificial Sequence
  Synthesized
  misc_feature (61): n=t or c
tataagtgaagagcactagttagaaaaaatagtcccaaatgtaaaatccgttggatatttnggtggcttattgtaccataatttctggaaaccaaaactttagcgtgtgtgtgtatctgag

SEQ ID NO: 42717 - DNA, 121 bp, Artificial Sequence
  Synthesized
  misc_feature (61): n=t or g
cagaatataagaaaatggatcttcctaaaaaagaagcacttcctttagcaaggcattgagnttttcattgctctttagcatgtagagtgggaaatattccatacaccttctgctgatattc

SEQ ID NO: 42718 - DNA, 121 bp, Artificial Sequence
  Synthesized
  misc_feature (61): n=c or g
gatgaggaaatccctgtgctggtactagccataaactgggagaatatttcagaggaagggntactcttgtatttcctttttcttgcatttcccttggtgtctgttactagtcatgtcagag

SEQ ID NO: 42719 - DNA, 121 bp, Artificial Sequence
  Synthesized
  misc_feature (61): n=a or t
gtaatcaacataggcagaacacgggaacagttctcctgatgtttaatgggactggtcctgngggtgaggttcacaggattgtctcttttgtctgaaactcagtctctgtgagcagtttgct

SEQ ID NO: 42720 - DNA, 121 bp, Artificial Sequence
  Synthesized
  misc_feature (61): n=t or c
ctccctaaagtcttcttttttcaagacttttttttcatccccagcttcttcagcctttttncataaaaaaaatttcacaactctttgaagtcacctatatttttcagtaactcaacaacaa

SEQ ID NO: 42721 - DNA, 121 bp, Artificial Sequence
  Synthesized
  misc_feature (61): n=a or t
acctgagcaatgcagctcaatttgtcttttgtttgaaagaaaatctaaattcttctcttgnaaaacaacttttccaattccaaaggaacacctatcatactttcaaagtctttgaaatcat

SEQ ID NO: 42722 - DNA, 121 bp, Artificial Sequence
  Synthesized
  misc_feature (61): n=c or g
gaggaccatggaactctgtaaatggcagtcccagcaggatgtctttttctttactgacttngggtatttcaaaaaatgagcgtgagagctgggtagcgtgaagtggaaataacatgtgtac

SEQ ID NO: 42723 - DNA, 121 bp, Artificial Sequence
  Synthesized
  misc_feature (61): n=c or g
ctcaaacgaagagaataccttacagatgccatgaagtgtcgcaagaacacaactgcttctnagctttgatctgtttttcagctgctaccaagggtggaaaaggagtcatacttgttaatgt

SEQ ID NO: 42724 - DNA, 121 bp, Artificial Sequence
  Synthesized
  misc_feature (61): n=t or c
actatcaagaccaccaagttcaaccatcaacctgacctattaagtcccattatcaaaccangtcctttagtgtcacatccatatctctttaatatgtccagagaaagggacaccatcattg

SEQ ID NO: 42725 - DNA, 121 bp, Artificial Sequence
  Synthesized
  misc_feature (61): n=t or c
ggtgaaggcgttttaggtgccttttacaaaataagcatttatttaagaaataagagaaatngtgcgaacgtatttttttccatttagataaacgcttcctaaaaacgccgccccagctgtg

SEQ ID NO: 42726 - DNA, 121 bp, Artificial Sequence
  Synthesized
  misc_feature (61): n=t or g
gaacaccccacgtgatcccactgaacccctttagaagtgtggacagtgatcctctgtcttntggataccagaaggtcctcccctgggacagagtgactgcacagccctctgcattggttca

SEQ ID NO: 42727 - DNA, 121 bp, Artificial Sequence
  Synthesized
  misc_feature (61): n=t or c
ctccttgtcccaatatccccatgtctcgtcctgttcccacagggccatctgtgctgtcatngtgttcacgttgcttaatctctcaggttttgccctttttgggggtctgcaggatgtcagg

SEQ ID NO: 42728 - DNA, 121 bp, Artificial Sequence
  Synthesized
  misc_feature (61): n=t or g
aggaaaaggtacagctggaaaggtttcttggtacaactggaaaggaccctttcctggtccnttattagtttggtctttctgcactagtcctcatttttcaagttgcaatgggaaccaaaga

SEQ ID NO: 42729 - DNA, 121 bp, Artificial Sequence
  Synthesized
  misc_feature (61): n=t or c
tcattcctggtagacaatgtttgcaataaaaacctcaaatcagtgtttccatgggacccantattacattcccacccaggggaagatacctcaacaccactgtgatggccataaggatttt

SEQ ID NO: 42730 - DNA, 121 bp, Artificial Sequence
  Synthesized
  misc_feature (61): n=a or c
tcaaaatcactccattctttttgttaattttatgatcaaaatatgagggccttattaaaanctccaataacaattactgaaattctgggaaagcttaatagacatttaaggattagccatt

SEQ ID NO: 42731 - DNA, 121 bp, Artificial Sequence
  Synthesized
  misc_feature (61): n=a or c
acaaaagtatggcagagaaaaaaaaagcatcaacaaccattttctgaagcacaagcacaangaagattgtaacagagacaagtgcagcttcatggtgaggaaaagatgcatttgatttcca

SEQ ID NO: 42732 - DNA, 121 bp, Artificial Sequence
  Synthesized
  misc_feature (61): n=t or g
gaaatgaaagtacagctgaggccatcacttgcttgccttaacaagccagaagcaatgtttnttttttttttcacgtttctcaaaactgtatgttcaaaattagagatcactacaaatacag

SEQ ID NO: 42733 - DNA, 121 bp, Artificial Sequence
  Synthesized
  misc_feature (61): n=t or g
tgggggtacccacgtataacccaggccattggttgcaatgagcttatgcacatcccctctngagggaaagcaggtgttgccaccttcactttggaacaccaacttctgtatcactctttcc

SEQ ID NO: 42734 - DNA, 121 bp, Artificial Sequence
  Synthesized
  misc_feature (61): n=a or c
cttctcttctccaagccgaacaagtccaactacttcagcctgttatacatagcagagatgntatctacatagatatgagatgtcaggttagggttagggttagggttagggttaggttagg

SEQ ID NO: 42735 - DNA, 121 bp, Artificial Sequence
  Synthesized
  misc_feature (61): n=t or c
ttgattttatttttttccttgagattctgtaacatgacagaactctatttgcatgtttctntgcttccttgcaggtttagaagcttgccttttatcttaacctaaataaaaatgaaacgta

SEQ ID NO: 42736 - DNA, 121 bp, Artificial Sequence
  Synthesized
  misc_feature (61): n=a or g
agatcttattttaagctactagtccctaaacgagggtcaagaccttacttttattcacaancttggcagtatagtttgaagtggggtcatgaactcagaagtgggtcttgacagacagatg

SEQ ID NO: 42737 - DNA, 121 bp, Artificial Sequence
  Synthesized
  misc_feature (61): n=a or g
aaagaaaaaagcttaagaaatcagctctttacaagaagtcactcatgacttcttttttganactggtcatacaaataaaatatgaatttaatgagttttccttttcttcattaacaatgca

SEQ ID NO: 42738 - DNA, 121 bp, Artificial Sequence
  Synthesized
  misc_feature (61): n=a or g
acgaggagttttttttgagagccatcactatttatatagtatccactaattattgttctanaagataaaaccatgattgtgcagtcagggcttaaacattgcattgcaaattgtgtttatt

SEQ ID NO: 42739 - DNA, 121 bp, Artificial Sequence
  Synthesized
  misc_feature (61): n=a or g
gtgaccttaatttgtaactagacattacaaataaggtaaagcttttactcaatgctgaatnagactttttagtccaattggcaacagaccaagtttttacttggtgctatatttcctgtaa

SEQ ID NO: 42740 - DNA, 121 bp, Artificial Sequence
  Synthesized
  misc_feature (61): n=a or t
ccctcatcaccaagccttctccatggagccaagaaaatgggacagcgtacaaactgaaganggatttgaagcattatcccaaagcttccaattttcctccaagtactgacaggttcaatat

SEQ ID NO: 42741 - DNA, 121 bp, Artificial Sequence
  Synthesized
  misc_feature (61): n=a or g
aggaagagagttttcactggggcaatctgaagtcatcatggaaccatagaaaccttctaantctttgataaggctttccattccctcgccctcagggagctacacctatatccatataact

SEQ ID NO: 42742 - DNA, 121 bp, Artificial Sequence
  Synthesized
  misc_feature (61): n=a or g
ttgacagagttcatggtttcatccgtatatccgagataatactcgggattttgaattgctngtgattgctttgctttgatttttattatgacaatatgtttaccaatttacattagagcct

SEQ ID NO: 42743 - DNA, 121 bp, Artificial Sequence
  Synthesized
  misc_feature (61): n=t or c
catacttgtctttatgaagggcaaggaaaagggtctggggaactacaagctatacctcaanctccaaaaagatcaaggaataagtcctcttggatttgccatgttcaggtatgctaaggac

SEQ ID NO: 42744 - DNA, 121 bp, Artificial Sequence
  Synthesized
  misc_feature (61): n=a or c
ttgaaacatctgagagttttgagtttcccttaattgtctctttcccaccctcactcagcantgagaaagaggaggaaaatggggaaaaatgattaaacttaaaaaataatgtcggagggcg

SEQ ID NO: 42745 - DNA, 121 bp, Artificial Sequence
  Synthesized
  misc_feature (61): n=a or t
agtagaaagaagggtgtttaaaaaaaaaaaatcttgtagaatgccttatgtattttcccantcagacgtgaaataatgatgggacagcatgctcctactactttagtgtgctggtctgtaa

SEQ ID NO: 42746 - DNA, 121 bp, Artificial Sequence
  Synthesized
  misc_feature (61): n=a or t
atgttaaattgacgtaaatcaggacagtgagcccagaatgatcagctttatgctgtgatanagatttccagtgtaaaaaatcttgagtcataaagtccttttggatcagcagaaaaaggct

SEQ ID NO: 42747 - DNA, 121 bp, Artificial Sequence
  Synthesized
  misc_feature (61): n=t or c
atatgaaacatggaaatagattgcagtgccatttgcatggatttgcacaaaatactgcttntccactacattttcattcaaattgaattttcagaatttacgtatttctcacttgatcttc

SEQ ID NO: 42748 - DNA, 121 bp, Artificial Sequence
  Synthesized
  misc_feature (61): n=t or c
cagtacctagtctattcattcttactgataatatttattcctgagttatatgcaaaaaatnctcattctgcaagcattgatgtacatacttgactttctacagtccagctctaagtcagga

SEQ ID NO: 42749 - DNA, 121 bp, Artificial Sequence
  Synthesized
  misc_feature (61): n=a or g
aatggcaaagagcttcttctagggaatgtgtgcaatggtggtcccacatatggagtcaatncttggcactagctggctggttcttcctcaagtcctttaggagggcttaggtgaggttcag

SEQ ID NO: 42750 - DNA, 121 bp, Artificial Sequence
  Synthesized
  misc_feature (61): n=t or c
gaagttcttaccaaagtgaccagtctgtcggcaaagataccttttccctgcctagtcaggnagatcctgcctcttccaagtggtcatcagccctgaaagacaactccacggttgtcagcag

SEQ ID NO: 42751 - DNA, 121 bp, Artificial Sequence
  Synthesized
  misc_feature (61): n=t or c
tttattatcctaagcaatcagatctggcatatgaaaccgtttttctgtccttaatggaganggaattgatgctgggagcaccttctgccgcctatcaaagccaaatcccatgccagaactc

SEQ ID NO: 42752 - DNA, 121 bp, Artificial Sequence
  Synthesized
  misc_feature (61): n=t or c
actctgtattaaaagctccatgatcaaaacattcaagtatacctgcagaaagtaaagcacngcactgcagtgaaggatgttctcctccctctttgtgccaagtttttcagtgagctcaaca

SEQ ID NO: 42753 - DNA, 121 bp, Artificial Sequence
  Synthesized
  misc_feature (61): n=a or t
tgcataacaatattctgaatgggtagtcatagctacatctgtgactagtactggtcaaaanttttttttttcacctacggattaactgataaaagtggataaaagtactgtccagtttttc

SEQ ID NO: 42754 - DNA, 121 bp, Artificial Sequence
  Synthesized
  misc_feature (61): n=t or c
tctcctggattcgaagggccttctggctggcatagacacccagctcacagagctctcccangtgggggcacataaaccttgaccatattcttttccattgatggaggaccatcttttccct

SEQ ID NO: 42755 - DNA, 121 bp, Artificial Sequence
  Synthesized
  misc_feature (61): n=a or g
ggattacaattcatatgcaagagtgagcaattcctccagcggagaggctgagataaagttngtgtggcaatgtagtgttgtgctgtacaacaacagccccgtgctgctcagcaaaggaagc

SEQ ID NO: 42756 - DNA, 121 bp, Artificial Sequence
  Synthesized
  misc_feature (61): n=a or g
cagctggccagggtggaaaataagatagaaaacttatggatcaagaaaagacaagaaaagnccaactactgccatgggcaaaacaggttaatttataggctgttaaattagatcagtgcag

SEQ ID NO: 42757 - DNA, 121 bp, Artificial Sequence
  Synthesized
  misc_feature (61): n=a or g
tggaagggagtgggaccaactgtttggatggaaagtgtaattgtaatggtatatggaagcntaattgagggtatgtgaaagtgtaattgagggtccgaatggcgaaatagtgtaaaaaggc

SEQ ID NO: 42758 - DNA, 121 bp, Artificial Sequence
  Synthesized
  misc_feature (61): n=a or g
acagctttcaaagttattttttcctagtgctttcactcaaactctgcattttttatgggcnttcagaaacatttcagagccacgattatcagggctttaatgttcataaaaaaatacttta

SEQ ID NO: 42759 - DNA, 121 bp, Artificial Sequence
  Synthesized
  misc_feature (61): n=a or g
tcatgcaactgtatttgaacaagccttaatggtgtactgtatttgcccagagctccaccanctctgtcatctttagctgtcatactgctgtcagtgatatatagtgggttgttcagtgctt

SEQ ID NO: 42760 - DNA, 121 bp, Artificial Sequence
  Synthesized
  misc_feature (61): n=t or c
tcccttggcagcctgttcctagaccttaccactctttcagagtttttgtaacatctaatcngaactttcccagcacaacttcaggccatctctcatcttattgctgattacctaggagaag

SEQ ID NO: 42761 - DNA, 121 bp, Artificial Sequence
  Synthesized
  misc_feature (61): n=a or g
ataatcggttttggcatctcagaaggttttggtgcatgtacaatggctgccccaaaagtantgcctcttgttttattattttagcccatgacaatcagagacagatgttgctggtatgaca

SEQ ID NO: 42762 - DNA, 121 bp, Artificial Sequence
  Synthesized
  misc_feature (61): n=t or c
tgtgacctcttgatgtcttatctgagtgcttaatgtcttcaggcaatcatgcccaacctgngggccacacgcagcctggcccaacctgtccagtggcccaacccctgaaccatgccatcat

SEQ ID NO: 42763 - DNA, 121 bp, Artificial Sequence
  Synthesized
  misc_feature (61): n=a or g
cacggttgaaaagtgaatgttttatgaggattgaacaaaatattaagctaagtaaaggaangtcgatagaaaaagaactgatgcatttcattgcatagtggtatatgatttactcttattt

SEQ ID NO: 42764 - DNA, 121 bp, Artificial Sequence
  Synthesized
  misc_feature (61): n=a or g
atgcatttgcttctaagctgttcttttctgctagacagattctttgtttaattaacatagncagcttatctttttttattaatgttttctgcagtggcttgctacttggattttgtatatg

SEQ ID NO: 42765 - DNA, 121 bp, Artificial Sequence
  Synthesized
  misc_feature (61): n=a or g
agaattgaaaaacaaagaactagtacaaggagagctctccaaattaatcatacattgcaantgcttgaagtgagggctttctactctcctttccccatccttgatttttgccacagcaata

SEQ ID NO: 42766 - DNA, 121 bp, Artificial Sequence
  Synthesized
  misc_feature (61): n=a or g
ttacgtcaagctgcatgtgctgccaggacctataaaccgattttccatatgttgaacaacngagtcctttagtttcacatcaaggattactctgataatacagattataaagcgccacatt

SEQ ID NO: 42767 - DNA, 121 bp, Artificial Sequence
  Synthesized
  misc_feature (61): n=t or g
tgcatgcattcaaaaaaacaaggaaggttactgctacaaatgtatgaataattattccaantatttaattgtccaaaatgggatgctaaggagaaattctatttactctaggaaaataaac

SEQ ID NO: 42768 - DNA, 121 bp, Artificial Sequence
  Synthesized
  misc_feature (61): n=a or g
tacttagagaacaaacttttgccttttctgttaatacagttctccatgcatcttgaggttnagctaaagaaaaccattgttttctgcaactgtcctgtaaaaggaacaaatggaaagaagc

SEQ ID NO: 42769 - DNA, 121 bp, Artificial Sequence
  Synthesized
  misc_feature (61): n=t or c
taacaactatgtctctaaatattgtctaaatatttgacacaaaataaagtcagaaacaccntggagcatcttgatggcagccaggatatactaaataataatcatgaattctaaaatgttt

SEQ ID NO: 42770 - DNA, 121 bp, Artificial Sequence
  Synthesized
  misc_feature (61): n=t or g
tgtgtgtgtgtatggacgtgttctatctgtgtgcatagatgtgtgtataggggtgtgtgtntgtataggtgtgcgagatatgtgtagaggtgtgttatatatgtgtgtggatagagatatg

SEQ ID NO: 42771 - DNA, 121 bp, Artificial Sequence
  Synthesized
  misc_feature (61): n=a or g
ggctcagaatggcatgacacaggtcagcatgactcagactggcatgacacagcttaccatngctcagaatggcatggcatggcttaccatggcccagaatggcacggcacagcttacggtg

SEQ ID NO: 42772 - DNA, 121 bp, Artificial Sequence
  Synthesized
  misc_feature (61): n=a or c
agccttctcttctctagcctgatcagtcaaaaactccctcagcttgtcttctcagggaagntgttctagcgctctgatcaccttcattgccctcctctggacctgttccaacagctctatg

SEQ ID NO: 42773 - DNA, 121 bp, Artificial Sequence
  Synthesized
  misc_feature (61): n=t or c
aattacatttcttctatgttttatttttttttaatttattctaatgttgatacacataccnacaacataaatgcaatgacgggacaaaataacagtatgtaatacggctttaaaatgctct

SEQ ID NO: 42774 - DNA, 121 bp, Artificial Sequence
  Synthesized
  misc_feature (61): n=t or c
gttgttgttgaaagccattgtgaaatttaattcctataaaaactaaggaatatgacttaangttagaaaaagtcatgttcataagagctcaggcaatttttaatccctttgaggataaaaa

SEQ ID NO: 42775 - DNA, 121 bp, Artificial Sequence
  Synthesized
  misc_feature (61): n=t or c
gaatgcccaagaacagtgagaggagggaggaagactatcttgtaccctgagatggcaatangtctgcttgcttaggaaggatagaatgcttacaagcaagaaaaatgagcatgtacagagg

SEQ ID NO: 42776 - DNA, 121 bp, Artificial Sequence
  Synthesized
  misc_feature (61): n=t or g
agaggtctttcccagccttaatgactccatggctccatggttctattcctcgctctcctgnagagtgggagcaacatttccggatgctgctgtctcccttcttttctttttggccactcca

SEQ ID NO: 42777 - DNA, 121 bp, Artificial Sequence
  Synthesized
  misc_feature (61): n=t or g
aatgaagtcacacctgcagcatggaaaagagaacaaacattatcagctttaagaacttatntcaagttttgcaactgttgtgggggttttgtttttaattattagaaaaaaatcaaacagt

SEQ ID NO: 42778 - DNA, 121 bp, Artificial Sequence
  Synthesized
  misc_feature (61): n=a or g
aacacaattggtggctctttcctgaattatatgctctttcatatgatttctttttcatacngttgtcttccttcagctgcctgtgacttctgaagctgctcactttggttctcacagccct

SEQ ID NO: 42779 - DNA, 121 bp, Artificial Sequence
  Synthesized
  misc_feature (61): n=a or g
agataggttgggcaggtgagacacagggtggctgagtgtgtgaggacggagttaggcagtntgcagctggcaactggtgatgacatggttgagaacctttgtgataaaggatgtagggaca

SEQ ID NO: 42780 - DNA, 121 bp, Artificial Sequence
  Synthesized
  misc_feature (61): n=c or g
acagcaccgtggtccaggtgatgggagggagggaatcgggtccctcgcttttggtttccgntaccaaagccccaattttgatgggtttcactgcttcaagactgagtcacttattttagtg

SEQ ID NO: 42781 - DNA, 121 bp, Artificial Sequence
  Synthesized
  misc_feature (61): n=a or c
gtgtaagccaaagatttctttttccagaaaagaagcagaaccacaatccagcacatggctntctctaaaaatataattcctatttttctaatgacaaaaaaagtattttgtactgttaatg

SEQ ID NO: 42782 - DNA, 121 bp, Artificial Sequence
  Synthesized
  misc_feature (61): n=t or c
gcttgctgttctgtgccaggcccccggtgacgtggagcaagatgtactgtccccacctctnttcctcttctatttgtggtatgtccttgggatgttgccattctcaataaattgcagagaa

SEQ ID NO: 42783 - DNA, 121 bp, Artificial Sequence
  Synthesized
  misc_feature (61): n=a or t
aggctgtatttcccctgacagcaaaagggcttttgctgccttaagcttccagctgtatgcntgatgtaaacgctgctgagctactataattagagtttgtattatttttgagaattttact

SEQ ID NO: 42784 - DNA, 121 bp, Artificial Sequence
  Synthesized
  misc_feature (61): n=t or c
acactcatctcaccataaagatgcatacatagcatagcaagagttctaaaatattattcanttcttgatccggaaaaggagtaacaaagcgacatgaattcccacaacattcaacaaatat

SEQ ID NO: 42785 - DNA, 121 bp, Artificial Sequence
  Synthesized
  misc_feature (61): n=a or c
ctggcgggatagttctcctgatttagagcactgcaacgggtgaatataagccctgtgtaanagacagagtaggaagctgaggaggagtggttgtattctgtgcaaagttggaacttgagca

SEQ ID NO: 42786 - DNA, 121 bp, Artificial Sequence
  Synthesized
  misc_feature (61): n=a or g
tagaaattgatccttgtaacgttttagctgtaagatgattttaaaatgaatctgtacaacntatttatttctgtttctaaagctctttccgcggattgcataaaaggtgctaggaaatgca

SEQ ID NO: 42787 - DNA, 121 bp, Artificial Sequence
  Synthesized
  misc_feature (61): n=t or c
agaaacgaattctcaagtaacaaccaggttcctattgcattggaagaagcaacaagaaaanatggactacattaaagcatgactgccaagcagccacgcacgtctctgaatatctcatcaa

SEQ ID NO: 42788 - DNA, 121 bp, Artificial Sequence
  Synthesized
  misc_feature (61): n=a or t
agagctgcacatggggcactcatttcctcagtttcaatgtttgtttgtttaacagtcacanaaacattatgtgttcatccacaaacataatttaaaagatatatatatttttaatgaattc

SEQ ID NO: 42789 - DNA, 121 bp, Artificial Sequence
  Synthesized
  misc_feature (61): n=t or g
gctttgtttagtcctgggaaaaagagattctttcatgacataggcagatagtaggttagtntttttttccctcacctcggtgtgctcactgtagctcgataaagctctttagcttaggaat

SEQ ID NO: 42790 - DNA, 121 bp, Artificial Sequence
  Synthesized
  misc_feature (61): n=t or c
gaggactcgctcacagcagacaaggagaaatgacactcctgtttcctgcaataagtttttntggcactctagatgcagccagaaactcactggaaggaaaataacagaaagccctgaagag

SEQ ID NO: 42791 - DNA, 121 bp, Artificial Sequence
  Synthesized
  misc_feature (61): n=t or c
cctacaaagaccatatcaccatctctgtcttcaaaaccatcactcattgctgattcttttntggggggaaagctacaacatcttaaaaaaagccttacattttttatcagagacaatcaaa

SEQ ID NO: 42792 - DNA, 121 bp, Artificial Sequence
  Synthesized
  misc_feature (61): n=a or g
gatttgatgggtggatcacccatcaaatcacccgacggataaataattggatcaaaggccncagacagagggtggagatcaatggttctatgtccaagtgtaggctagtaacgagtggagt

SEQ ID NO: 42793 - DNA, 121 bp, Artificial Sequence
  Synthesized
  misc_feature (61): n=t or c
cggatgtgggggactggggcagagagcacatggctgcaagaacagaccctcttcgccaacnctgactataaagcacaaaggctttttgctcccactgcctctccctgtctgacagcgagct

SEQ ID NO: 42794 - DNA, 121 bp, Artificial Sequence
  Synthesized
  misc_feature (61): n=t or g
caaaattattttctctctgatctctgtctgctgtggctatcctacagccttacacaaggtntatgctgcctcgagataacagaggaagacaagatcacagaatcacagaattataggggct

SEQ ID NO: 42795 - DNA, 121 bp, Artificial Sequence
  Synthesized
  misc_feature (61): n=t or c
tatgatcaatgtaagtaaagcagaaggatttccatctgtgaataagatggcgtgggcaaanggaggttaagagttaatactgtgatatttgagtaagaattctgagtgatgagcaactctc

SEQ ID NO: 42796 - DNA, 121 bp, Artificial Sequence
  Synthesized
  misc_feature (61): n=t or g
acagccatgttacttggcctgcatctttgctgattcattagaaaaacccacaagacagggntctaatgagtgtaaaatgaatctcctgcttttgtgcagccagatgatatgtgtatttttt

SEQ ID NO: 42797 - DNA, 121 bp, Artificial Sequence
  Synthesized
  misc_feature (61): n=c or g
aatgcaaaggattggctaacaatttgaaactaatagctgtttctattggcagcccaatttncattctcaatgcaagtacagtgccaattctcacattcttaataggaaaatatctccataa

SEQ ID NO: 42798 - DNA, 121 bp, Artificial Sequence
  Synthesized
  misc_feature (61): n=t or c
atcacaccagacacaaggctgtgcctgtgcttccaaaccagccttcaggagagaagtggangaggaatgagctggtaagcaaaggcagcaaattcagggccttttggggcaggatggtgtc

SEQ ID NO: 42799 - DNA, 121 bp, Artificial Sequence
  Synthesized
  misc_feature (61): n=a or t
tatgaacgtgttaaagagcacagaacaatctcctgacagacagaaaaactagacaaggacnctacagcaataagagagcagagggcatgatataaatgctttgttctccaatcagcaacta

SEQ ID NO: 42800 - DNA, 121 bp, Artificial Sequence
  Synthesized
  misc_feature (61): n=t or c
ttgtttgagcctcttccttaaatgctgtaaatgtttctatgtgctgcggtccccttcatcnaaagatgatcagctggatggtgttctttgtgctcacagccactcacacactctgtggctt

SEQ ID NO: 42801 - DNA, 121 bp, Artificial Sequence
  Synthesized
  misc_feature (61): n=t or g
cagagtatcggtgtaattcccctgaagatttgccctgttgtttctgaatgacagacagtantctgtatgtaagtatgaatattgctgttcaaacacattgtgttgatttgttttttcttgc

SEQ ID NO: 42802 - DNA, 121 bp, Artificial Sequence
  Synthesized
  misc_feature (61): n=c or g
acagctgttttgcatcactgttcattagtgactgcttttcacacagctcttgagtggatgntttggaagatgggaactggaagattgaactgtaagtggagatgaggtttgtaagcacatg

SEQ ID NO: 42803 - DNA, 121 bp, Artificial Sequence
  Synthesized
  misc_feature (61): n=a or g
cccacgaggctgtgcatggacaccctccaggagcagagcagtgcctcaggggaatggtggngtttggctgggcacaatcagcaggttgattcctgcagctctgctcagagcctgtgctgtt

SEQ ID NO: 42804 - DNA, 121 bp, Artificial Sequence
  Synthesized
  misc_feature (61): n=a or c
ataaagctgacattttctaacaggaccctatctacacatacatcactgcttgaacaaagtntgctgtagtggtaaaaggactttcagccatcaccttttattcgcagttaacccaacataa

SEQ ID NO: 42805 - DNA, 121 bp, Artificial Sequence
  Synthesized
  misc_feature (61): n=a or g
tctcttatagggatggagtatacattcatttcagaatggaagggaaaagaggaggggtggngggaagatactttttttccccacataaaagaagctactgtgtttctgttgctgtccacgg

SEQ ID NO: 42806 - DNA, 121 bp, Artificial Sequence
  Synthesized
  misc_feature (61): n=a or g
tcctgtcccttattattcactcataagggtctgacagttggctgttattagtgtcaccctntttatttcctgctgctctttagcttcctacatctacctttcttaatgaatgcagaaagca

SEQ ID NO: 42807 - DNA, 121 bp, Artificial Sequence
  Synthesized
  misc_feature (61): n=c or g
tcttgaggaggctgtagggtgctgggggttgggtaaggaagacactaacaaaataaaactntgctgtgaatggttagacaagcttcttgtgtagcaaagactaaatcaatgttttgctcca

SEQ ID NO: 42808 - DNA, 121 bp, Artificial Sequence
  Synthesized
  misc_feature (61): n=c or g
ctacgaaatggcttcattgatttgaatcccctgacttcccacccacctctctcattaatgncttgtgattgggtccccgacttcacagtggtttatttatgacgctgcagtcttagtggca

SEQ ID NO: 42809 - DNA, 121 bp, Artificial Sequence
  Synthesized
  misc_feature (61): n=t or c
gaattcaaatcaccagcctcttttactgaaggacaaacgcaacatttgcagctggaattgncgacacaacagcagcacgaggggaaacataatggcccatctgagaggaagacactggctg

SEQ ID NO: 42810 - DNA, 121 bp, Artificial Sequence
  Synthesized
  misc_feature (61): n=t or c
cggagagtttctattcctcagataagatcaatccctattcttatattttacaaattgttcncagatatcagacaccatcagacttgttattttcatactgcagtaaacactgaagtagaag

SEQ ID NO: 42811 - DNA, 121 bp, Artificial Sequence
  Synthesized
  misc_feature (61): n=a or g
agcttgttctaatcagctgttttatataatgttaactctattagtctaacaaacaaagatncccaagagtaaacaacttcacctggtattctatgttaaaaaacaacaccaacactacttg

SEQ ID NO: 42812 - DNA, 121 bp, Artificial Sequence
  Synthesized
  misc_feature (61): n=a or g
aaagcgaggtgaagaaatcatcacagaggataactgagcctgaagccatttgtcctgccancttcgcctggtgacctctaatccttgagttgtatcaaacagaagctaaccagtccttgtc

SEQ ID NO: 42813 - DNA, 121 bp, Artificial Sequence
  Synthesized
  misc_feature (61): n=t or c
ttctggaaccatacatgaaatactaatcttttcagcttcgtcatgaacctttgctaagtgntaggacattatataatagtctgttgttcagctattcctcagttttcagaggaaaaaataa

SEQ ID NO: 42814 - DNA, 121 bp, Artificial Sequence
  Synthesized
  misc_feature (61): n=a or g
cagtttgtttttgcttaatacagtttctcctaagatattgacagcagcctgaacactctantagtttttagccaaattattgcaaggtatatagccatattactctaataaataaccagtg

SEQ ID NO: 42815 - DNA, 121 bp, Artificial Sequence
  Synthesized
  misc_feature (61): n=a or g
gtgtttttagaaagcacacgttcattttgcagttagaaacagacagcagctctgacaaagngaaaaatttttcgaacatcactaaaaagagcccaattccaccttccaccctaaccctcta

SEQ ID NO: 42816 - DNA, 121 bp, Artificial Sequence
  Synthesized
  misc_feature (61): n=a or g
aaagaacatgttctgacttaattctaaagccaatggaaaccacatgacagtgacacaactnaagccccaagatcatttatgtcagcaaataataaatcaagtagttctggagctatcaatt

SEQ ID NO: 42817 - DNA, 121 bp, Artificial Sequence
  Synthesized
  misc_feature (61): n=t or c
attaaaaacaatcagaagacatctgctgctacaaagggtttgataatcaatatgataattnaaggcagataaagaacttaggtttctggtgctgagcatttagacttttgtccatagtcca

SEQ ID NO: 42818 - DNA, 121 bp, Artificial Sequence
  Synthesized
  misc_feature (61): n=t or c
tctcattacgggactgtcaaaatttgctctgtcttgaaattcatcacctggcaattagccntaggacaagaccggggctttggttatctgcagcagtttgcagcctgcccaagggcattgc

SEQ ID NO: 42819 - DNA, 121 bp, Artificial Sequence
  Synthesized
  misc_feature (61): n=a or c
acagctgtgggaagtgcagagatcatagatggtgtgttctaagctagtaaaatgagcatcntaaaatgacccttcagtaagagcagcatttcaaataggaaattattagatatggtaagca

SEQ ID NO: 42820 - DNA, 121 bp, Artificial Sequence
  Synthesized
  misc_feature (61): n=t or c
tgactcaataaataaacaaaataaaaatcctttgctttttaaacagaatttttcaggaaangtaggtagactttcagggtaacactgttgacatcactgttacaataatatatccaatttt

SEQ ID NO: 42821 - DNA, 121 bp, Artificial Sequence
  Synthesized
  misc_feature (61): n=t or c
catttaaaaccagttatttacagtcttaagttaaaataccacaggaccaagagtacctccnctcctgtaacaccaaaaagcagtagcaggtatttgtatgtttctacatttccttccctca

SEQ ID NO: 42822 - DNA, 121 bp, Artificial Sequence
  Synthesized
  misc_feature (61): n=a or g
ttctacagagtatctatgccactaatgctgggctaggtaaaaggcaagctagcacgagacnttccattcactaccatatctacattccagcaaaccagatctgattcagtccttataccaa

SEQ ID NO: 42823 - DNA, 121 bp, Artificial Sequence
  Synthesized
  misc_feature (61): n=t or c
atcactgtgcaagaaatgacctcgtaaatgcaatgaaatatccctcctttccctcttctcntctctgaacatttgcttcctgtattgcgggagagcggaagactcaaagggtttgcatgct

SEQ ID NO: 42824 - DNA, 121 bp, Artificial Sequence
  Synthesized
  misc_feature (61): n=a or g
tctagtgaaaatgggggaaagtacagttatctacagttatcaaggccccaaaggcagacantgaaagctgagaaattggcttctcctgttgctgactctctctttgggaaacagcttctgc

SEQ ID NO: 42825 - DNA, 121 bp, Artificial Sequence
  Synthesized
  misc_feature (61): n=a or g
gattggtgctgtcccctagatcctggaagcgtgaagcagccatgaaaccactgattgtagntatttaaagaaagctaattataacaactagctctgaaatagtaatgcttctggactaaat

SEQ ID NO: 42826 - DNA, 121 bp, Artificial Sequence
  Synthesized
  misc_feature (61): n=a or t
aaattccttcttgatatctcactgaagcgcattctctattgtgcttccctggcaacagcangtagcagtatgagaaataatctattatagtcatgcttcatagggagatttaagatacctt

SEQ ID NO: 42827 - DNA, 121 bp, Artificial Sequence
  Synthesized
  misc_feature (61): n=t or c
aacagcctggagactcacactatatggatgggtggctgaaagatcataagtcatttcatgntaccattgctttgttgacagctctaagaatgatacactgagagcacagctctacctcaca

SEQ ID NO: 42828 - DNA, 121 bp, Artificial Sequence
  Synthesized
  misc_feature (61): n=a or t
cataagaatttttttaaagctaccgtaacaaattttaaagctaccctaacaaaaaatgatnttgaaacaaatccattaccattccactttatagaacttcaagaactgaacagtgacatta

SEQ ID NO: 42829 - DNA, 121 bp, Artificial Sequence
  Synthesized
  misc_feature (61): n=a or g
catttaaaatgctcaaggagatggagtgctcatgaactaaatggcttatttagagaaaatntcttcctgggctagaaagcaccagtgttagtaaggcaggtaaaacaaggctctttcagtc

SEQ ID NO: 42830 - DNA, 121 bp, Artificial Sequence
  Synthesized
  misc_feature (61): n=t or c
aggagtctgtaaagcctgtaagtcatgggaaaccctattactacagataaaaatgcttttnggggagtacttcattttcagacgaaaaaggggagcaaagggatatttatgtgggtttgat

SEQ ID NO: 42831 - DNA, 121 bp, Artificial Sequence
  Synthesized
  misc_feature (61): n=c or g
cagtgtcaaaacatgtaaaaacaaaggatttcctttccctttcaaaagacatttccgtgantgtaaagcttcagaaagagttcccttacatggtgtattcacaggtgacaaggtgctagca

SEQ ID NO: 42832 - DNA, 121 bp, Artificial Sequence
  Synthesized
  misc_feature (61): n=t or c
gccctttgcatgattttcaaaagcctttgggacatgacctgcaaaagtacttagacacctngcaataactttagaacatagccccagatttttatcctaagggccactgctcaaacgctgt

SEQ ID NO: 42833 - DNA, 121 bp, Artificial Sequence
  Synthesized
  misc_feature (61): n=a or g
tcaccttttgtcatagcagttttgaagaaaatgtctgtatccttcgaaagcatgcctttcntcattgcattggccagtgctgtcagtgactgaggcagtaagctgctgctaggtccctttc

SEQ ID NO: 42834 - DNA, 121 bp, Artificial Sequence
  Synthesized
  misc_feature (61): n=a or g
cagggaagtgagctagtgcttttccatgctccaccatctgcgcttgctggagaccagcacngttactggcatcccgcaaatctgtcaataggagacaaaaccattaagaaaccagcagaga

SEQ ID NO: 42835 - DNA, 121 bp, Artificial Sequence
  Synthesized
  misc_feature (61): n=t or c
ttgtaatccaacatgtcaaacttgtttaaatgtgagattgtaactgaaaaccaagggaagnaataagtgcttcattatcttgcttaccttatagaagtgtcttgcagttcttggggaaaaa

SEQ ID NO: 42836 - DNA, 121 bp, Artificial Sequence
  Synthesized
  misc_feature (61): n=t or g
tggaagcactttcctcccagataacaaacactggtctggacagcctgctgcagagatcttnattacagagagttttgattaaaaaagtaaaaaaaatcattacttttcaattatttgtcca

SEQ ID NO: 42837 - DNA, 121 bp, Artificial Sequence
  Synthesized
  misc_feature (61): n=t or c
gtatatttaagatggtaaaatgctatctacctctgttgtataacatttggaagtacagctntgatgaatacaacgtttagctgcttgggattattactgattataatccttccatttagtg

SEQ ID NO: 42838 - DNA, 121 bp, Artificial Sequence
  Synthesized
  misc_feature (61): n=t or c
ttctacgatgactctacgatgagctgctttcggccctggtcagtgaatccagattgaacgnggtaagcatggggagcagaagaccgcaagcaggaaccgaccgcacgcgacacacgcagcc

SEQ ID NO: 42839 - DNA, 121 bp, Artificial Sequence
  Synthesized
  misc_feature (61): n=a or g
acatcagtccttatgatcatatggaggggtgcgtggctgagacccacaccattaggctccncaaaagcatctgcatagatggggctggaaggccactggagggacaggcggtgggtgaccg

SEQ ID NO: 42840 - DNA, 121 bp, Artificial Sequence
  Synthesized
  misc_feature (61): n=t or c
aaagccttgatgctgtgcaagcaagcagtgttcagcagtgaaatattggtgtgttattagnactgttttatcaagaaatctgaagtgcagcatcatagaggctgctatgaaaaaagttagc

SEQ ID NO: 42841 - DNA, 121 bp, Artificial Sequence
  Synthesized
  misc_feature (61): n=a or g
aataggtcagatgatattaattatctaatattttgcagtatgagggcatgggtaagaagcnaaattgcccaccacctataaagagattttaaataaaagtaatagtccgtgagctctcact

SEQ ID NO: 42842 - DNA, 121 bp, Artificial Sequence
  Synthesized
  misc_feature (61): n=t or g
ttccttcaaggaaatttcaaggcccagactacagtgaaatgcttatcagcatagatttctntgctgagacggaacgtaacaagcaaacaaacaaataaaaggtttcacccaacaggagtaa

SEQ ID NO: 42843 - DNA, 121 bp, Artificial Sequence
  Synthesized
  misc_feature (61): n=t or c
aagaatgtaaaaagattctggatctcagccattacaatgaaaaacatctgttgaagtcttngcaagcataaatttatcttaccagaggcatgattattgattaaaaataagattatttttt

SEQ ID NO: 42844 - DNA, 121 bp, Artificial Sequence
  Synthesized
  misc_feature (61): n=a or c
ttccacaatttttccattaggcttatagtccataaaatccagttggtgtaaagagaacatnggcgtgcgtctgaacttagaggtactcccctgatgtggagcctaaatgattactgtgatt

SEQ ID NO: 42845 - DNA, 121 bp, Artificial Sequence
  Synthesized
  misc_feature (61): n=t or c
gtgagcaggcagcacagctggtgccagtctccagaagcacttcatgtttccagctcttagntctgaacaagcaatccaagctgatgcttggttggtgtggagcttcctccccacgtcccct

SEQ ID NO: 42846 - DNA, 121 bp, Artificial Sequence
  Synthesized
  misc_feature (61): n=a or g
cagggttagcatttcagggggcacggttaagaaaataagacgaatgtccaaataaaaaggnttgggccaaattttgcagtgactaaataactccactcagtaaatggaattatactgagca

SEQ ID NO: 42847 - DNA, 121 bp, Artificial Sequence
  Synthesized
  misc_feature (61): n=a or g
tctcgttcacagcatctcaagctggccttagtggagcaaaatgtggtgggctcagcccacntgtttaatgcagtgagcaagttctatggtcagtggagggctggtgacaccaaagggagca

SEQ ID NO: 42848 - DNA, 121 bp, Artificial Sequence
  Synthesized
  misc_feature (61): n=a or g
catacttcaggggtgaattttgcatctgtatttatatttagagacagcttcagtgctggcnaagaaagggtgtaaaagccataaagcactgctcccaattaaaacaactttcaaagcctca

SEQ ID NO: 42849 - DNA, 121 bp, Artificial Sequence
  Synthesized
  misc_feature (61): n=a or g
ctaacattagtctcacccagtcagagtatgtctgtcaaactaatgaaaacaggaaagacanccactgtctaggtacatttatcttcctcctatgtgccccccttcatagccagcccctgtt

SEQ ID NO: 42850 - DNA, 121 bp, Artificial Sequence
  Synthesized
  misc_feature (61): n=t or c
ggctgtcagctgacttctgaccagcattcctttaatgatacagcaccttctgatggggcantgcagatacagctgagaattgttgcagccagttggttcatgtcctccttgggagtattca

SEQ ID NO: 42851 - DNA, 121 bp, Artificial Sequence
  Synthesized
  misc_feature (61): n=c or g
tatgatattgctgagcagatttaacttcgttaaagtgatcaaagccaagcaagacaacacntaaacacaaagcacaaggcattaacatgaacagcaaacattccagattctttgccagaat

SEQ ID NO: 42852 - DNA, 121 bp, Artificial Sequence
  Synthesized
  misc_feature (61): n=a or g
cagtgacgatggaattggtttgtcttccgtcccgtctcctgaatttgcttaacccagaatnttttcccaaataccaactgtaatataaaccttaaatggttgcaatatctagaatatatat

SEQ ID NO: 42853 - DNA, 121 bp, Artificial Sequence
  Synthesized
  misc_feature (61): n=t or c
gtaaaacagcagaacacagctacaagttctgcatatcttttatacagaaatctatttaaangaactgaatattcacattacataagagaaacctacacaacaatttgaatgcattttcggg

SEQ ID NO: 42854 - DNA, 121 bp, Artificial Sequence
  Synthesized
  misc_feature (61): n=t or c
atcatcacctcggtacgtgcagccctgggctggcaatgctctgcagggcgctttgcctctnggtgatacgtgtgttttcttggtcccaggccatccccagagtcttctcatccggcctgga

SEQ ID NO: 42855 - DNA, 121 bp, Artificial Sequence
  Synthesized
  misc_feature (61): n=t or c
tatcttgtgttgctatttttagcctggtgttgtgtacttccccctgcagccggagcagttngtgtgctgctggagccatcgtggctcagcccggtgctgctggtggcacagttccttcaga

SEQ ID NO: 42856 - DNA, 121 bp, Artificial Sequence
  Synthesized
  misc_feature (61): n=t or g
agaaatgtctaaaagagtcatcaagctatccatacacaacacacagagactcccaacaagnacgcaattcttaacctacacaaaactggttttagagctccagaaacattaagctgatgtg

SEQ ID NO: 42857 - DNA, 121 bp, Artificial Sequence
  Synthesized
  misc_feature (61): n=a or g
gcaaaggaagctaaatgccttcccaggcaaccttgatctcattatagcacgattttttgcncagagatttacaaagtttatccaggtcataattcattgcatacaaagatgatgtgttagc

SEQ ID NO: 42858 - DNA, 121 bp, Artificial Sequence
  Synthesized
  misc_feature (61): n=t or c
aaatatgcatcagctctttaaatctaaaatgaaatgttatatagcacataataactgacantctaccttgttctgctttttgtttcatcatcacagaaaataaattttgctttctatatgt

SEQ ID NO: 42859 - DNA, 121 bp, Artificial Sequence
  Synthesized
  misc_feature (61): n=c or g
agtgctattaagtaacagctgtggcaatcaaggaagtggaagcacctggtctgaaaagaanccttgaactgccaaaaatttggaagtagctcattttaaaaaaatctgagtttctaatttt

SEQ ID NO: 42860 - DNA, 121 bp, Artificial Sequence
  Synthesized
  misc_feature (61): n=a or c
cgagctgaaggcagtagcacttttcaggaacacagcacctttcatctctctgcagttctcnagttgtgaaaaaggcttggagcaccttcacacgtggtactcttaactgcacagagagggc

SEQ ID NO: 42861 - DNA, 121 bp, Artificial Sequence
  Synthesized
  misc_feature (61): n=a or g
ctgttctatgcttatttaagctactccatttgtggtcggtcacatgacacaggaagtcacntgttaaattgtacttatcatttatacatatgcacccatgcacatatataacaaacatatc

SEQ ID NO: 42862 - DNA, 121 bp, Artificial Sequence
  Synthesized
  misc_feature (61): n=t or g
atttgcttcttgtgccagaagattaatggggacaccacagaagtttgtagtatctcttttnctaccaaaatctagtcatttacttaactgttggacccctaagaagtaaattggaggatat

SEQ ID NO: 42863 - DNA, 121 bp, Artificial Sequence
  Synthesized
  misc_feature (61): n=a or c
gagcatcagaggagtttgcccactgcatctcctccagcatgtcttcggcccgacagactcncagcagggccctgcactgcaaacatgacgggaacagagacttctgctagtgtaaaatgct

SEQ ID NO: 42864 - DNA, 121 bp, Artificial Sequence
  Synthesized
  misc_feature (61): n=a or g
tttcttgccaggattttttcttgtttggttggttttccttttagagcatggcttagccagnagaactgatacatacacacacctactatgcttcttcacagagtcaattttctctcatgag

SEQ ID NO: 42865 - DNA, 121 bp, Artificial Sequence
  Synthesized
  misc_feature (61): n=t or c
aaaatgaggtatgaatttatgaagtggctcttgtgtgaatgctggaatttgatgggagatngactgtgaatttagtagaaacagaactgagagatcttcaatatgcaagtagcagtcttaa

SEQ ID NO: 42866 - DNA, 121 bp, Artificial Sequence
  Synthesized
  misc_feature (61): n=t or c
tgaacctttagagcatcagaacctgtaatgtttttgacagttttaatctcagtttgactangccctttacaaatatttaattgtgacaacttaccgggtttggattatgagttcaatcatc

SEQ ID NO: 42867 - DNA, 121 bp, Artificial Sequence
  Synthesized
  misc_feature (61): n=t or c
ttttcctcagggaaagtagttcccaaggcttgggtagtaataatctcatagacaaaaacangtttgacattgaattgcactattaagaacaggtaaaacacttcacgtaaagtatcaaatg

SEQ ID NO: 42868 - DNA, 121 bp, Artificial Sequence
  Synthesized
  misc_feature (61): n=t or c
catggactgattttactaattggtacaaatggcaagttgtcctttacaagagactgtctanagtaggtttagattatgtttatgcctgtatttgcagtttatcaagaattcattatttctg

SEQ ID NO: 42869 - DNA, 121 bp, Artificial Sequence
  Synthesized
  misc_feature (61): n=c or g
gcagctcgccgcacaaacatgtgaaccactgtcccagcaagggaggaagaagcactaatantttcgtacaagggctcatttctacacagccacttgtcatttaaagggggaaaaaaagacg

SEQ ID NO: 42870 - DNA, 121 bp, Artificial Sequence
  Synthesized
  misc_feature (61): n=t or c
aaacaagctccagtgatgcggaaatttgccatcaggaatgcttctataaggaaaactgganaaagtttgagataagtgagaaaagtttcaatctgataagttactcacatgttcattgtgt

SEQ ID NO: 42871 - DNA, 121 bp, Artificial Sequence
  Synthesized
  misc_feature (61): n=t or c
gcagcagtcttagcttagcttaagcatcttcccttgcaggacagtaatgcccaaatcaccntcagccaggagaagaatctcagccagaagtttgcttccccctcccctcttccttccctcc

SEQ ID NO: 42872 - DNA, 121 bp, Artificial Sequence
  Synthesized
  misc_feature (61): n=a or t
gtagttttattactttctttttcatttccttcacatattttagagctgactctctcatgtnactcatagctctttggtcactgcacttttgattttgccctacagaagatgtgtagcaaca

SEQ ID NO: 42873 - DNA, 121 bp, Artificial Sequence
  Synthesized
  misc_feature (61): n=t or c
tgagaacatgccaacgccagatgcttcaaaagcatcttcaaaataagaaaacccccttagngcatatgagaccgagcgattatttggcttatagcctaaattctaagagccaatatataca

SEQ ID NO: 42874 - DNA, 121 bp, Artificial Sequence
  Synthesized
  misc_feature (61): n=t or c
ttaaatacacatctctcttaattttttattctcataggaaagtcacatcactttgtgctgngaagtgaaacctcacatgtaaatattgactgttttgaggaattttggattgggaagaatt

SEQ ID NO: 42875 - DNA, 121 bp, Artificial Sequence
  Synthesized
  misc_feature (61): n=t or c
ctccaggcttcaggatggcatatcacaccatgaccaaaactgaggcagcatgtgcctgctngagagctcagatgtgcaagcaaggagatgtgactggagccaaatgcctttttgttcccag

SEQ ID NO: 42876 - DNA, 121 bp, Artificial Sequence
  Synthesized
  misc_feature (61): n=t or c
tatttctctgtcacaccaggatatatgtaaagttctctcatgccatgtacaaccaggaganaaatccagctgtactcggcttcttgttcccctcttagatggtactgagtgtggcgtcaat

SEQ ID NO: 42877 - DNA, 121 bp, Artificial Sequence
  Synthesized
  misc_feature (61): n=t or c
aattgtaaaatgaaagtaaagcaaatgaagtcattaaaacaaatgtattttacagaaaaanacaaactgccaaggctcacggaaattatatctgcttagtgctcagcctgcagtgtactat

SEQ ID NO: 42878 - DNA, 121 bp, Artificial Sequence
  Synthesized
  misc_feature (61): n=a or c
ctaaaaagcacgttgtttttattttcacttgcagttaaagtccattttaatagatgctacngtcctatcacatcctggcgagccttgtgaggcagtacaacaaataaaatgaaaataatgc

SEQ ID NO: 42879 - DNA, 121 bp, Artificial Sequence
  Synthesized
  misc_feature (61): n=t or c
tttgtgacactgtttgatacagaacagcaggtcctcattaggagagacatttaccacaaanctagacttgatctctgcacaagagaggtgaacaatttgagctcaaagcatataagaatct

SEQ ID NO: 42880 - DNA, 121 bp, Artificial Sequence
  Synthesized
  misc_feature (61): n=t or c
caccggttaaatatgtctactaaaaacaacattaataacagaataccattcaaaatacttngatattgtttgtggaacactgatgtgcaagtggatatgacaactgagtggaatgctgtgg

SEQ ID NO: 42881 - DNA, 121 bp, Artificial Sequence
  Synthesized
  misc_feature (61): n=a or g
cctgagtcaagcttgagctacaagaaatgacataggtgcgttaatccctaaggaagatgtntcattagattgtttataactgactccaaaactacgttgcgtaagaagaaatgtcatgatt

SEQ ID NO: 42882 - DNA, 121 bp, Artificial Sequence
  Synthesized
  misc_feature (61): n=t or c
agtaatttcatagaaaaaaagtgctgcgtaacgtgtaattatattccatgcatctgtaacngatactcaaaaccgtgatagtttgttatactgcatttttactttgtatgtagtacaattc

SEQ ID NO: 42883 - DNA, 121 bp, Artificial Sequence
  Synthesized
  misc_feature (61): n=t or c
gatgcatcacaatttattaacataacctgctaagtcaacctgaatgtttcatggcctctgngcttgtgaatgctgttaaaggcaactttacattatacatgggagggatgtacagatcaat

SEQ ID NO: 42884 - DNA, 121 bp, Artificial Sequence
  Synthesized
  misc_feature (61): n=a or c
tctaatggatcaagctgctctaaggagttagggcagatttagcggcctcatgacttttatnagcttgcactggagtgctgatgtttatcactcgccaacacatctctgtgccagtgacatg

SEQ ID NO: 42885 - DNA, 121 bp, Artificial Sequence
  Synthesized
  misc_feature (61): n=t or c
aacgtgagcacttttataagttatcaagcaccatctacgagggagaaagtgatgaagaaangagaatggaatcttcagtgtaagattatgattcttagaaataaataagtcctcatcataa

SEQ ID NO: 42886 - DNA, 121 bp, Artificial Sequence
  Synthesized
  misc_feature (61): n=a or g
agacacaaaaaatgatatctagaacccaccctgaaaccaagtggaacaacattctgtgctngaaagacatttagaaaaagtctggggaaaagctaggcttgtaggattatactttcattgc

SEQ ID NO: 42887 - DNA, 121 bp, Artificial Sequence
  Synthesized
  misc_feature (61): n=a or g
tgtgcagagaacagaagtgcaggaaagactgtgtaacaccttcagatgtctcactgtaacntggaagcagttcatctgtttgagaagtgctgtacctgaactaaaaagccctgccttccaa

SEQ ID NO: 42888 - DNA, 121 bp, Artificial Sequence
  Synthesized
  misc_feature (61): n=t or c
atctgtcacaggtgtcaatatatgtacattttattagtaattaccagcatcccagtgatanaatttggatcacaactaatagctaagatggatgagtacacctacacatgccaaacaaatt

SEQ ID NO: 42889 - DNA, 121 bp, Artificial Sequence
  Synthesized
  misc_feature (61): n=a or g
tgctgcagcttcaagcagatgggaaactagctatatagtgttccttggacttttaaacccncaagcttctagacctcctcactcctcagaagcctaccaagtgtccaacagataaaccctg

SEQ ID NO: 42890 - DNA, 121 bp, Artificial Sequence
  Synthesized
  misc_feature (61): n=t or c
ttaatctacttccaatctcctctgaaacaacttaagaccattgagacactggtctcaatanatactttgcctgatactacacgctgtacaagttttccttctgaaggctgtaaaaacacag

SEQ ID NO: 42891 - DNA, 121 bp, Artificial Sequence
  Synthesized
  misc_feature (61): n=t or c
atcacagttgtacaggagaaagagacccaagaacatgccaaaattgctatttgtgagaaantgagttatagccaactgtaactgaacaatggggccagaacctcatcttgctttccataaa

SEQ ID NO: 42892 - DNA, 121 bp, Artificial Sequence
  Synthesized
  misc_feature (61): n=t or c
ctatgtgcatacacataaacacctagttacacagacatagccagatataacatcagcgtgngtcattcagacaaataatggaacagttgtaaatcctacctacaaattttcatgacagaag

SEQ ID NO: 42893 - DNA, 121 bp, Artificial Sequence
  Synthesized
  misc_feature (61): n=a or c
attaggtgacctctctggtctagaaacctgcagaatgctttaagcagtggggatttttttnatatgatatttgaatgagtgttaacaaccaaagaaaactcactgcaaaacgatgcctgaa

SEQ ID NO: 42894 - DNA, 121 bp, Artificial Sequence
  Synthesized
  misc_feature (61): n=a or g
gcactgaagtgcttcacttcagctaagccagtcctccatgccggcaagtaaagacttcaancctcccatctttaaaaagaaataagcagagacagctactgaacacatgctctatgcaagc

SEQ ID NO: 42895 - DNA, 121 bp, Artificial Sequence
  Synthesized
  misc_feature (61): n=t or c
ttctgtgtgaaaggggggtgaaaaaccttaagggctggtgacagacatatcatcagtgganaggatgaaatactgtagttagagggcaaggtgcaatttctacctttttatttataaggat

SEQ ID NO: 42896 - DNA, 121 bp, Artificial Sequence
  Synthesized
  misc_feature (61): n=t or g
ctttatgaaaaccgatgcattctgattgtttatctaccttgagagctgctcgtgatcaatnatcagtttcaccgatggtctgatgagccacttctttctgatataacttaaaaggtgttga

SEQ ID NO: 42897 - DNA, 121 bp, Artificial Sequence
  Synthesized
  misc_feature (61): n=a or c
aaacgtgtattgtatctcctgtttcctcttcaggaacaggtactgagaaaagtaatcctcngtgtaattcttcaaggttttctacatattcctctgaaggaggagtgagcaccccaagcag

SEQ ID NO: 42898 - DNA, 121 bp, Artificial Sequence
  Synthesized
  misc_feature (61): n=t or c
actaccaaattagggtaaatggagaccatcatttaagccagaatcacgttcaaaaattcantgtcacaaaatatgaacagaagctagacaaagtcctcatggaaaatttaggtgtcactgg

SEQ ID NO: 42899 - DNA, 121 bp, Artificial Sequence
  Synthesized
  misc_feature (61): n=a or g
catttcattttggataggtttccgccttgttcctttctgatttcaataatgccattcaggnaagttataaatcagacagcctgaggagcacatatcattttgatataagaaatacaacatg

SEQ ID NO: 42900 - DNA, 121 bp, Artificial Sequence
  Synthesized
  misc_feature (61): n=a or g
agtaccactgtgctgcagaagggaagtggagtcccatgtttcgtgtgttcagggcagccangcctttcttccatttgctgatttgagctgcagctacaagctatgggtaatcttaaatgaa

SEQ ID NO: 42901 - DNA, 121 bp, Artificial Sequence
  Synthesized
  misc_feature (61): n=t or c
tattccattattaccaagtttactgtactgggtccccacagtgtgtctttttgtatacgcngaaactggtcaaaaagatcactgatcaggaaacaagataacaaacaagaaaagaagatga

SEQ ID NO: 42902 - DNA, 121 bp, Artificial Sequence
  Synthesized
  misc_feature (61): n=a or g
cataatgcaaaatcttaccactttatgtctgctcagcgtcctctcatccatcctctgcagnatgatggcaaagatttcacatcctccttcactctgcggtcacctgcaattttgaaaagct

SEQ ID NO: 42903 - DNA, 121 bp, Artificial Sequence
  Synthesized
  misc_feature (61): n=t or c
gaccccagacgtggctgctgggatgtgagtctacacctcatctacctggggcactcattantgaaacctttcctttaataagaacgaatagatggaactgctcagagtcagtactttcctt

SEQ ID NO: 42904 - DNA, 121 bp, Artificial Sequence
  Synthesized
  misc_feature (61): n=a or g
ccttttaagtaagtctcaaaaatcataagggtatatctatgatccttttgtgcatctcaanctgaatgcatgcagatttatccccaaattagggttctggacatatggccttgatttttga

SEQ ID NO: 42905 - DNA, 121 bp, Artificial Sequence
  Synthesized
  misc_feature (61): n=t or c
agaacgtaactcggattaagaagtaagggaaggacagggctgcctggagaccctgtggtgnccacaagcaggcactgtgtggatccaggcagaagcaccaatagggcaccagtcttcccag

SEQ ID NO: 42906 - DNA, 121 bp, Artificial Sequence
  Synthesized
  misc_feature (61): n=t or c
ctttgtgcattgtttagtacttctgttaaaaacattgcctaatgcttggctacgggacaangttttgggagcttaaaatgctgaagttttgatttgccccttgctttgtagttcagtatgt

SEQ ID NO: 42907 - DNA, 121 bp, Artificial Sequence
  Synthesized
  misc_feature (61): n=t or c
cagagaaaatgatacagaattcatggaaggaagataatgctaattgtataaaaatagaggncaaatagtctctaggcaataataattcccaaatagtactactatttaagatatcaatgaa

SEQ ID NO: 42908 - DNA, 121 bp, Artificial Sequence
  Synthesized
  misc_feature (61): n=t or c
ggctcctgcacactgttaccaatctgcccctggtgcgaggtgtcagatccaatgctgtttntaaatcattccccatctgttgctctgagatagcaaaagggttgccattatttaattgcta

SEQ ID NO: 42909 - DNA, 121 bp, Artificial Sequence
  Synthesized
  misc_feature (61): n=a or c
tctgaagtctagtctgctggtcaaactcaacatttttagatcctgaacctgctcaaaatcnctctgacaatacccacagcttgaaaaatgcagaaaaaatgaaaaagctttctgtttccct

SEQ ID NO: 42910 - DNA, 121 bp, Artificial Sequence
  Synthesized
  misc_feature (61): n=a or c
ccagcatccaagcttctctttacacctccagcatctcccacattcacatgctgggaaaagngcccagagctgtgctgtagtctggaccgtgtattttgttaaggccacacaagataaggag

SEQ ID NO: 42911 - DNA, 121 bp, Artificial Sequence
  Synthesized
  misc_feature (61): n=a or g
tatctgaaaactcatttcaaaatgtttctgtatttctgcaacagtcaggaaatagctctangaggcagaaccactattaatagtggaagatattaagaatttagaattacactgcacctgt

SEQ ID NO: 42912 - DNA, 121 bp, Artificial Sequence
  Synthesized
  misc_feature (61): n=t or g
aaaaaatttactgcaattaatacagatgtgttttctttcaaattgtgataataccatgagncactctgatctttccagtactgacagatttgactatacactcaatctgcaacagggaata

SEQ ID NO: 42913 - DNA, 121 bp, Artificial Sequence
  Synthesized
  misc_feature (61): n=a or c
tactccgctgtaagtactagcttgatacagtaaactcaaaagagcacgttgggggttagcngttagagctgaaagtgaaaatcaagaaacagcagtagtactgcttttgtcttcagcatgc

SEQ ID NO: 42914 - DNA, 121 bp, Artificial Sequence
  Synthesized
  misc_feature (61): n=t or c
aaacatgcagtctaatcctgccatctttaaccactggaagccaaggatttgttcagcacangtctacgctgctaaataatgggtgctatataggaaatttgtgttatgaccacctgtgctg

SEQ ID NO: 42915 - DNA, 121 bp, Artificial Sequence
  Synthesized
  misc_feature (61): n=a or g
agcattctgtgagtgtaggaaaatctcagctttgaagaatgagaggaaaatatttgtagtntgttaaatagaatagggatagatgtatcttgtggtctgtatcagagggccttttagttgt

SEQ ID NO: 42916 - DNA, 121 bp, Artificial Sequence
  Synthesized
  misc_feature (61): n=t or g
catcctatggtgtttgtctgaaaacttcccacaaatggaaaatgccacttcatcaaaaccnaaactcactatggtaaagtgttctgtcttcaacgaggatagacttgaaggtcatactgga

SEQ ID NO: 42917 - DNA, 121 bp, Artificial Sequence
  Synthesized
  misc_feature (61): n=t or c
caggggggcacagtttaaaggctttatgagggaaaatgagtgttataaaggaaggtttaanctgactgagctggatgtgattggagaagtgctcagaaggcatcaagtgatcaaaggctgg

SEQ ID NO: 42918 - DNA, 121 bp, Artificial Sequence
  Synthesized
  misc_feature (61): n=a or g
agcaccagcaggctgtgtcttgtcacagctcacaagcacttgttcaagtcttatttttcanagatgctgacacttgcagttcctgtttatgtcaggaacactttttgatgcacaaacattt

SEQ ID NO: 42919 - DNA, 121 bp, Artificial Sequence
  Synthesized
  misc_feature (61): n=t or c
ggggaaaaagactgatgatgaagtgaggaattactcaagctcccatcaattccttcactgncaataagttcccttcaaccagtaatgttattcattacatgcttccttgcttccctcctct

SEQ ID NO: 42920 - DNA, 121 bp, Artificial Sequence
  Synthesized
  misc_feature (61): n=a or g
cagttaacctgtggtaaggtagaagcaggaacactggactcgaatgaactattatatcctngtgttgagttagggctgaaatgggacctagatctaaactaactgcaaaactctgtggtcc

SEQ ID NO: 42921 - DNA, 121 bp, Artificial Sequence
  Synthesized
  misc_feature (61): n=t or c
aatgaagctctatgtttttagaaccttcaaaaacctctcggtcctatctaccaggaatcangaatgacaaacacattctgcttaacaaatccttctggcccttaaactttaatggtcagaa

SEQ ID NO: 42922 - DNA, 121 bp, Artificial Sequence
  Synthesized
  misc_feature (61): n=a or c
aagtgtttcttgtgctcaatttccttaaaggtgagttacacatattagaaactattatagngagatatggtcagttgtaacttcccttcactgtgaacttctgtgatcttaaagatagctc

SEQ ID NO: 42923 - DNA, 121 bp, Artificial Sequence
  Synthesized
  misc_feature (61): n=t or c
tttgtgtccaattctatatactatgaatttagcagataagatcaacagagcagaacaaagnttgataataagtgcttatacctaacatgaacgaaagttttcaaggagcacaagcaaaatt

SEQ ID NO: 42924 - DNA, 121 bp, Artificial Sequence
  Synthesized
  misc_feature (61): n=t or c
aactgacagaacacaggactgacgcagagtgggcaagaaaaaaaagtaccgtgtgatttanactggctaaaggtgcttacaatttcagagctccttgttacagattttgtgttctttctag

SEQ ID NO: 42925 - DNA, 121 bp, Artificial Sequence
  Synthesized
  misc_feature (61): n=a or t
tataaattagagcgagacagtgttctaagcagaatttaacagaatttcagatagagagagnctgagatttcatcagctggtacaaggtacaactgctgctccagggttgagtctcttgagg

SEQ ID NO: 42926 - DNA, 121 bp, Artificial Sequence
  Synthesized
  misc_feature (61): n=a or g
aatgtggggcttttccttctggagtcaacataagattgatgaagtggtggataatgtttancaaaacaaatgcacctgacggcagccacgtatccatccaaaggaagcaagggcaagagtg

SEQ ID NO: 42927 - DNA, 121 bp, Artificial Sequence
  Synthesized
  misc_feature (61): n=a or g
tcagacttgaagcacagaccttggccattcacgttagcagagttctccactggagtgtgangactggaaactttctgcttgggtttcccaagttcagacctaggctctgaagtttgccttg

SEQ ID NO: 42928 - DNA, 121 bp, Artificial Sequence
  Synthesized
  misc_feature (61): n=t or c
aaacatctgagtagaaacggggggggtggaagtacctatgaataacgttattgaatttagngtcagtcaaacagccataaaacaactacagcaacagtacactgagtgcagaattgcttcc

SEQ ID NO: 42929 - DNA, 121 bp, Artificial Sequence
  Synthesized
  misc_feature (61): n=a or g
atctacactccagtcgcaggcaagcttcagttatgcatgctgtcactaaaattacacaaanactgaagaaatactgccaattgcttaggctgagttcagttttgaaatgtcaatagctgct

SEQ ID NO: 42930 - DNA, 121 bp, Artificial Sequence
  Synthesized
  misc_feature (61): n=a or g
tgcctcctgcaagtgttaactctctgtctctgcctcctaagagcttcttccttcttgctancaagtttcctcatttttatagttctcctttccaaataaaacagtgcactgaagatatagc

SEQ ID NO: 42931 - DNA, 121 bp, Artificial Sequence
  Synthesized
  misc_feature (61): n=t or c
ttctatctttgggtagaaactgggggaaagataatggaaggttgacaaaaagactgtcccngaatgacaataggacggggcagagcatgaccctgctctcaaccagttcaactcctttgct

SEQ ID NO: 42932 - DNA, 121 bp, Artificial Sequence
  Synthesized
  misc_feature (61): n=a or g
tcactcctcctaccatatttctgaatatggaggcattatttatgcagtcaagttttactgnaatggaaggcccccttaacatattatctcagtggtcctcttaagtcataaggtgcatact

SEQ ID NO: 42933 - DNA, 121 bp, Artificial Sequence
  Synthesized
  misc_feature (61): n=t or c
tggcccttcagcttgcgcagaagcacaaggctgagaagaggatatggaaaaactgaagtangttaaggagcagatagtctgttgcatctccgctattgctgtgtcagcacttcttctccac

SEQ ID NO: 42934 - DNA, 121 bp, Artificial Sequence
  Synthesized
  misc_feature (61): n=a or g
ttgtgcacttttgagatgctgttatttacttatgtattctggaatgaacacacttcctgtngacagtcttaattatttactcttgcagttgtctctgaaaactgagattaattttagaaag

SEQ ID NO: 42935 - DNA, 121 bp, Artificial Sequence
  Synthesized
  misc_feature (61): n=t or g
taatactttcagagctgtcaagatagactacgtgcaccactaattaaattatctgggtttnttggcaccaaattatagcactaaataagattctgcctctctcacttccaatagcaagttt

SEQ ID NO: 42936 - DNA, 121 bp, Artificial Sequence
  Synthesized
  misc_feature (61): n=a or g
gcatctctcagatgagaagaggctgagagctgggactgctcagcctagagagaaggctcangggatctcatcattgtgtacaaatacgcattgggggagcatggattcagaggggcttttc

SEQ ID NO: 42937 - DNA, 121 bp, Artificial Sequence
  Synthesized
  misc_feature (61): n=a or g
atcagtgcaatccattctgctttcagttagtaaatacgcaaccaataacaacaagttttgntatacaacaagcaatggtatactaaagcaagaatggtatttgtcagctgatgtcactgta

SEQ ID NO: 42938 - DNA, 121 bp, Artificial Sequence
  Synthesized
  misc_feature (61): n=t or c
cagtagcttttcatttctaattgtaattctcctttagaaaaagtttctgattagggagaanaaaaggttctcaattctctccctcagtaagagcacacatgagatttctcctgcgtctgca

SEQ ID NO: 42939 - DNA, 121 bp, Artificial Sequence
  Synthesized
  misc_feature (61): n=a or t
attttgattttcatgccactgccataacaaaaacttggccaactctgagcaaagaggtgangattagcagtgggaaatgactgcagtataattattagcgatacaatagtaatccaaggat

SEQ ID NO: 42940 - DNA, 121 bp, Artificial Sequence
  Synthesized
  misc_feature (61): n=a or c
taatatgtttactcagatgtgactgaagatggtaattgaggtaatttgtaggaaagaaagnaagcatttttggaggaattaaatgagtggaggagcgtgacttcaaaaaatgtgaagtggt

SEQ ID NO: 42941 - DNA, 121 bp, Artificial Sequence
  Synthesized
  misc_feature (61): n=a or c
ctcaggcttctaaaccagtccttcctccaggctgtgtttgctgtctgccagcctgctgtgnaagcagtagtaaggtgccacagcaaagcctgcatcctctgcttgtccttcagcacccaaa

SEQ ID NO: 42942 - DNA, 121 bp, Artificial Sequence
  Synthesized
  misc_feature (61): n=a or t
tgtttttctcctggggtacagcctcacttaaaaggaaagcttttttgaaagaagtcaattnatattggcaaaaattatcagcagaagtggcgggcttctcttctctttcagtcaatatgtg

SEQ ID NO: 42943 - DNA, 121 bp, Artificial Sequence
  Synthesized
  misc_feature (61): n=a or g
acacccagctctgacccagtgcaaaagagcctcagtacgttaacataacaatttccagacngcttagaaatacatctcacttagaatagatttaagcacttaatctgaatacagatactgg

SEQ ID NO: 42944 - DNA, 121 bp, Artificial Sequence
  Synthesized
  misc_feature (61): n=t or c
ctagaatgtgctgcaaagtatagatacagaacaagaaacctgcatttttgagcttggacanttgttccacctggaataagactgtagcatttgtaggctaaagtggtttaaaatggtactg

SEQ ID NO: 42945 - DNA, 121 bp, Artificial Sequence
  Synthesized
  misc_feature (61): n=t or c
aaagagatagcaagagatagcgttatgtgatgatctcaagtaatagaagagaaacagaccnggatgaagctgtatttcatactttctgccagttctgtgatcttatttttaggtaccagtg

SEQ ID NO: 42946 - DNA, 121 bp, Artificial Sequence
  Synthesized
  misc_feature (61): n=t or c
tgtcaataacatcttggaaattatggctctatgttttattattgcactcataaagagcatncccaccttttgttactattaacaatattagtatcttagtcagcatgcatgaagtagcact

SEQ ID NO: 42947 - DNA, 121 bp, Artificial Sequence
  Synthesized
  misc_feature (61): n=t or c
cagagctcaaatggctggcagaccatctgtgataactgcaatcactgagggtagaaattcnttaacaactggaattacaaattactgtattttctttgtgttgttctaaacacttctgaaa

SEQ ID NO: 42948 - DNA, 121 bp, Artificial Sequence
  Synthesized
  misc_feature (61): n=c or g
acaaagcgcaaatctgtccctctttgctagtaattagtgaggagcaatactatgaaatagnttagaataattgccaaaggagtactcttagctgccttggaaaaatgactgagcatcctca

SEQ ID NO: 42949 - DNA, 121 bp, Artificial Sequence
  Synthesized
  misc_feature (61): n=t or c
aggcaggcataaaatgagtctaatcatggtatttaaagatgttccgcgatcctgtaggcantccattgcctctgttagagtttgagataatttatgtgaactctcattaaaacatctcttg

SEQ ID NO: 42950 - DNA, 121 bp, Artificial Sequence
  Synthesized
  misc_feature (61): n=t or c
gtgtgttatttaacaggctctttgcagttatactgctggttatgtgcttaacttggacaantagaaaaaaataatccgagtttaaaatctgctttggttaagtcttacagtatattcatat

SEQ ID NO: 42951 - DNA, 121 bp, Artificial Sequence
  Synthesized
  misc_feature (61): n=a or g
ttgaaaacgtgaagaagagggtacgatggtctgcttttaccctgaaaatttacctattttntcctacgtgtgggatcccaagtcttgttttctgcacctcttgcatttcttctgtctttat

SEQ ID NO: 42952 - DNA, 121 bp, Artificial Sequence
  Synthesized
  misc_feature (61): n=a or t
cttatttttttctttttccaccctaggaatggcctgtttacatcagcaggaaagagtaacngcatggcctgttgaaataaggaactgcttcttggagctggattgcatatcagtaacaatc

SEQ ID NO: 42953 - DNA, 121 bp, Artificial Sequence
  Synthesized
  misc_feature (61): n=a or t
ccacaggcatactatacttgctatttcaaactgtaattgcctacacaccaggggttttaancaaactggacttcgctcctttggctattgacatttcattgtgtttcattgcaggcaatga

SEQ ID NO: 42954 - DNA, 121 bp, Artificial Sequence
  Synthesized
  misc_feature (61): n=t or c
taccatagaatggcaaactgcacaggaaattctgatactcacactgcggaggctcctctgnctcattcattggacatgctacactgaaatctgaattgcttattagtgtggacttggttac

SEQ ID NO: 42955 - DNA, 121 bp, Artificial Sequence
  Synthesized
  misc_feature (61): n=a or g
aatgactgcttggtttaggttgttattattattttgcatttattgatgtaaaataaatacnttttatgtatgggcaaaatagggaaagtaatgcaatttaaagccaaagcagcatctccag

SEQ ID NO: 42956 - DNA, 121 bp, Artificial Sequence
  Synthesized
  misc_feature (61): n=t or c
tatttatttaatagtaataacaaaacatgctgacatttcttcatggttactgacacttggntcttatgccaggtagggcaatctgggtgcattagaaagcctaaccaagcatagaccttgc

SEQ ID NO: 42957 - DNA, 121 bp, Artificial Sequence
  Synthesized
  misc_feature (61): n=a or g
agttaagctcaatggacttagaccagcgtaaggggaacaaacactggtgaggaaaagcagngtttaagtgactaacacaaggagtatttctggtagcaagttgaatgaggaaacctgaaac

SEQ ID NO: 42958 - DNA, 121 bp, Artificial Sequence
  Synthesized
  misc_feature (61): n=c or g
attgtcaggggacagaagctatgagtgctgaagcagattcacaccatttgcacagaacctnttgtcaagccaaggtaagcaagtatgaggatcaatgagagcaagaaagagccagagaaac

SEQ ID NO: 42959 - DNA, 121 bp, Artificial Sequence
  Synthesized
  misc_feature (61): n=a or g
ttccttcagtttctaaaaacctatttaacatcattttgtgcagctttcattaatataattnttaatgattgagtaaagggaagtcttcttaatctaatggttggagacaagtgaacctgca

SEQ ID NO: 42960 - DNA, 121 bp, Artificial Sequence
  Synthesized
  misc_feature (61): n=t or c
atgggctgacaggaggctttgcctactcaacgtgtaacccagtgtccaacttggtatttantaatttgctggttttaattcttttgttctaatactgctgtttttgcagcaggttgtttgg

SEQ ID NO: 42961 - DNA, 121 bp, Artificial Sequence
  Synthesized
  misc_feature (61): n=t or c
ctgacccagatctctttctaattcatctaaaacctactattggtctgatttcatgtactgnttcttgaggtgacccctaatgggccagggacagatgaaatgaaatgaaagacagcattga

SEQ ID NO: 42962 - DNA, 121 bp, Artificial Sequence
  Synthesized
  misc_feature (61): n=a or g
caattaaaaaccccatggattgcaacttggccactgggagcattgcctgctgcacactgangcaggggttggtaggtcacaagaacctccatgcaaatatctggctagaaagaaagcggag

SEQ ID NO: 42963 - DNA, 121 bp, Artificial Sequence
  Synthesized
  misc_feature (61): n=a or g
gcaaaatcggtccttatttcttcttgtctatttcagagcttcgtatttgtagtgattaacnaaaataaatgcaccagaaagtacgctggtgcccaaggtctttgctgtgctgttgcttctg

SEQ ID NO: 42964 - DNA, 121 bp, Artificial Sequence
  Synthesized
  misc_feature (61): n=a or g
gagctgatgggaaacaaaaggttcccaccagtgatatttagctaacagtcctgggaactgngagcagtaatggattgtgccctcgcaaggaatggtgctgtgtatccttgtcaggactgca

SEQ ID NO: 42965 - DNA, 121 bp, Artificial Sequence
  Synthesized
  misc_feature (61): n=a or g
tgcaacaatagaaagatcctatggtagaacagaattcaagaaatacactcctctactaccncatgggaaaatacaatctagtattaataaaaaaagtaacaataccaggttatatgctcca

SEQ ID NO: 42966 - DNA, 121 bp, Artificial Sequence
  Synthesized
  misc_feature (61): n=a or g
tctggagtgtttaaggacactgataaggaactctgcagtgagaagctgcacaaaatttgcngtgctctgtccaaataatccttgcttattcagtacaggagactcaaatcgtttgggtcgg

SEQ ID NO: 42967 - DNA, 121 bp, Artificial Sequence
  Synthesized
  misc_feature (61): n=t or g
gtttggtagctatttgtttcctggtcacattagataccttgtaaagagagaccattcactncttgcaacatggggagcatctcctccatgcagcgctgtgtggagccaagatcctcatgct

SEQ ID NO: 42968 - DNA, 121 bp, Artificial Sequence
  Synthesized
  misc_feature (61): n=t or c
tgaattttccttttgccatctaagtcatttagtgggtctgagtcatgtcaccctacaggangggacctttgtttcctggagtgggatgtttttcatgtccaaaaatgcactgcgtgttgca

SEQ ID NO: 42969 - DNA, 121 bp, Artificial Sequence
  Synthesized
  misc_feature (61): n=a or c
tggttgagcagttactgcagggaaaaaaagagctagaccctattgcaggtacggcagaggntggtggcctcactgcatgtgaaaattagagtctctttgtagagggaccataattcagcta

SEQ ID NO: 42970 - DNA, 121 bp, Artificial Sequence
  Synthesized
  misc_feature (61): n=a or c
tggtcctgcttcctgtttgccaataaggcagcttatatggacctgattgaaagtccactgnagtcaatggatttgatctcatatcaactttggtggacccggctaaactttgaaatgtatt

SEQ ID NO: 42971 - DNA, 121 bp, Artificial Sequence
  Synthesized
  misc_feature (61): n=a or g
gccaggttctccatgtaacagacatggcaccgtggccttcagtcactatgtacagagtccntcatccatccgtccccctctctcctaagcacactcctcgctccaacgggctggctgcagt

SEQ ID NO: 42972 - DNA, 121 bp, Artificial Sequence
  Synthesized
  misc_feature (61): n=t or c
aactaaatatttcattccagttctgctcatgccttaaaattctataacagatcctatctanagaacagtcctgccttgttcttgttcaaatttcaataaaattactttcagattgtgtttt

SEQ ID NO: 42973 - DNA, 121 bp, Artificial Sequence
  Synthesized
  misc_feature (61): n=a or g
aacagaacttttttgtctttttatcttttatcctgttttgttcctcaaatgagtagcaganctgtcatctgaaacttttaaactggtggaatgtctgcctgtgctgcccagaaggaaacat

SEQ ID NO: 42974 - DNA, 121 bp, Artificial Sequence
  Synthesized
  misc_feature (61): n=t or c
atgactgctatctaaaaaaacccatatcaaccaaacaaaaaatccttgtccttagtggcanttataccatcaatcagaacatttagaacatctgcacaaggtaataattggatctagactt

SEQ ID NO: 42975 - DNA, 121 bp, Artificial Sequence
  Synthesized
  misc_feature (61): n=t or c
tcataaacattataaagatctttctagaaacaccaacgatcacaaaaatgtgtctcattcntcccacacagagaagctatgaaaatgtagttaatgcgatgctgattctaagacagaaagc

SEQ ID NO: 42976 - DNA, 121 bp, Artificial Sequence
  Synthesized
  misc_feature (61): n=a or g
ttcttcaaattggcactatgtggactaagctggcaagaatggtgaagacataatctaccantttcttaagagagggcacaaaggtagcaacatacctcctgttctattcttccttactctg

SEQ ID NO: 42977 - DNA, 121 bp, Artificial Sequence
  Synthesized
  misc_feature (61): n=a or g
tcacctgctctggcttggcaccgttctgctccaggttaaaggtaatcgtggtatccagcantctttgtccagtttcaaccagatagagattgatgttgtaggtttgattggaacaggttaa

SEQ ID NO: 42978 - DNA, 121 bp, Artificial Sequence
  Synthesized
  misc_feature (61): n=t or g
ctctgggtttgtttgtttggatcagcttcaaggtgagaaagtgtaagctctcagggaacantcatgtcccttgcaggttcttgctgaggctgccaggtgtatgtggagggctattctacgc

SEQ ID NO: 42979 - DNA, 121 bp, Artificial Sequence
  Synthesized
  misc_feature (61): n=a or g
aaactgctttgtaatggcctggtccaatctatccacaatccaagtgtgtggtttaacttanaaaagaagtaaatgtgcttacgaaatgcctgagtttgcccttatgtgctaaacttcttct

SEQ ID NO: 42980 - DNA, 121 bp, Artificial Sequence
  Synthesized
  misc_feature (61): n=a or g
gcctataaggagagccaagaaaaggtcattcatcttaggctgtaatgtcctcaatactgtnaactgttcaagacaggaaaatggtaaagcatggttcctccttaccaatcctactctgaag

SEQ ID NO: 42981 - DNA, 121 bp, Artificial Sequence
  Synthesized
  misc_feature (61): n=a or g
catagtatggttaggactagactgaggacctacttctctgacccagaccaaaagtgatatnctcttactgaaagagtctgcaaacttctcaaccacatagctgacaaatctctttaccaat

SEQ ID NO: 42982 - DNA, 121 bp, Artificial Sequence
  Synthesized
  misc_feature (61): n=a or g
gccacttgctctcacgtgttctcacagctgctgtgaccagacttgtcctaaccacaaaacntcttcgtgcttgactattgcattgaaatgcttgttagtaagtgctttgtgcacatggtgg

SEQ ID NO: 42983 - DNA, 121 bp, Artificial Sequence
  Synthesized
  misc_feature (61): n=a or g
ctatttttgtagtaaaagttgttaataaaaaataattagatctttaattcgtatttcacanagatggatttactacattttgtgagagtgatgggtagttagattaatgcacatagttaca

SEQ ID NO: 42984 - DNA, 121 bp, Artificial Sequence
  Synthesized
  misc_feature (61): n=a or g
ctttaagaatggtattgaaaagttcacccctaccatgggcatggctgactgtacttgcacntgttatggaaccttgttcctgttcttgtgctccttgacaatgtaaaagagtatttcaaag

SEQ ID NO: 42985 - DNA, 121 bp, Artificial Sequence
  Synthesized
  misc_feature (61): n=t or c
ctccctgcccaggtctgcctgcacaggtccttcctcacatgcaaatgagggtacagcctgnctggtgttggtcccagcagagggatgccatcagtgccatcagccagccctgagagcaaca

SEQ ID NO: 42986 - DNA, 121 bp, Artificial Sequence
  Synthesized
  misc_feature (61): n=a or g
acagtatttttaacaatatggaaacaaaccatgagaaaacatcttgaataaccctgaagtncagcttcattttcctccattatcaacagagatttcaatgaaagaaagtcaggtctctcca

SEQ ID NO: 42987 - DNA, 121 bp, Artificial Sequence
  Synthesized
  misc_feature (61): n=t or c
ggtagaactgaactcctcttatctcagaggtggctgagacttgctgatgcctgaagtgatngtgctgcactgaggcacatgctcccacatcacctccatctgccaggggctgctaccccag

SEQ ID NO: 42988 - DNA, 121 bp, Artificial Sequence
  Synthesized
  misc_feature (61): n=a or g
ctaaaatactgcgtaattttgcagctcacatctcacaagctgtatgtgcagttaacatgcngaaggactagcagagatgagaggaaaagaaattttctgtctaagatgaactttaaaaata

SEQ ID NO: 42989 - DNA, 121 bp, Artificial Sequence
  Synthesized
  misc_feature (61): n=a or g
aaaagagtcatgagatttgataatcctacttgtaatcctctttattgaacatctcaaagtngcttttgtgttacaagtgaaaatctgacccaggtgtagccacggagaagtatcttctccg

SEQ ID NO: 42990 - DNA, 121 bp, Artificial Sequence
  Synthesized
  misc_feature (61): n=a or t
ttaaaacctaactttaaaatctgggctaaatctatctgaaactccaccattacattaaaanaaaacattagcaagaagaagagatgaaacagttacgtcattttgcaatttaaaggcattt

SEQ ID NO: 42991 - DNA, 121 bp, Artificial Sequence
  Synthesized
  misc_feature (61): n=t or c
aaatgaatagatgaagccatgtggttctagcctagaaagtatttacaactgtgtctccganccacagcatatttagcattgaataattaggcagagctactactcagaatatctttaaaga

SEQ ID NO: 42992 - DNA, 121 bp, Artificial Sequence
  Synthesized
  misc_feature (61): n=t or c
ttcagtgaaccagctcccggatttaaaacaccaagaacttcaacacactgaacacaataanaagcactttccccagctgttactacagcaaaattgtttccatttatttacctcatctcat

SEQ ID NO: 42993 - DNA, 121 bp, Artificial Sequence
  Synthesized
  misc_feature (61): n=a or g
caggtcatgaggtagctgttcttctttctcctttctgatccccttgcaggagcttcgcacntgggaagaagagctgactcgtgctgctgttgaacagaagaaccatgaggagttgctccga

SEQ ID NO: 42994 - DNA, 121 bp, Artificial Sequence
  Synthesized
  misc_feature (61): n=t or g
ctttttggcagagcaaaaagtcattgccttacagacagccaggtaggaaaatgacttaaantgacttaattaagcactcgggaacttatctcccagtgcctcatgagtcctgtggaaatac

SEQ ID NO: 42995 - DNA, 121 bp, Artificial Sequence
  Synthesized
  misc_feature (61): n=t or c
ccttggaactcagaagtgaaagtttcctgttataacagacagctatatgcagcaggaaggncggaggattcacatctctaataagcaaagtccacagtggattaagacctattcttgtcct

SEQ ID NO: 42996 - DNA, 121 bp, Artificial Sequence
  Synthesized
  misc_feature (61): n=a or g
agatatagtagcacactcacttactgagataacagagcaaacctataaggaaacatctccnttcaatgccttttattgacaaagcctcaaaaaactcccatgcctgtcaaagcacacacca

SEQ ID NO: 42997 - DNA, 121 bp, Artificial Sequence
  Synthesized
  misc_feature (61): n=a or g
atgagtgtggtcattagatactgtatgtctatcagttttgcattttcttcaacaagcaccncaaagagaattgcattttgagattttcctgtctttttcgtggagaaattactctgatgtg

SEQ ID NO: 42998 - DNA, 121 bp, Artificial Sequence
  Synthesized
  misc_feature (61): n=t or c
tcaacaatatatcttctaaagtttgtttcattacaaactggggaattctaatctgtccacnatggtttcactgtgtttgtagggttgtctccttctttgtctcctgggtgggctttctgag

SEQ ID NO: 42999 - DNA, 121 bp, Artificial Sequence
  Synthesized
  misc_feature (61): n=a or g
ctacacagccatccagtctgccctcagggctgcagtgaccacagagggcagaatgcctacngcagtatctgaatctgttctacagtatctactctttgtatttgttgactaaaggagggaa

SEQ ID NO: 43000 - DNA, 121 bp, Artificial Sequence
  Synthesized
  misc_feature (61): n=t or c
tcctaaagagtgtaagaagcatggtccaagacactttggctcccagatttaactaaatgtnattgtgcttaactcaagccctgctactgatatcatttgtagactatttcccaccacactg

SEQ ID NO: 43001 - DNA, 121 bp, Artificial Sequence
  Synthesized
  misc_feature (61): n=t or c
cagggctggtggcacacacctcacatccatgcatttgggaacttcatgctttgcttgtgtnctccttgcagcatcgcagccagacccatgcttgcagccctcctcccattatatctgttct

SEQ ID NO: 43002 - DNA, 121 bp, Artificial Sequence
  Synthesized
  misc_feature (61): n=a or t
gtcattccttttaaaattattcaggccgctaaagccaatgataagatagcagatatctaancatgagttgtcactgcatctcagatgcagctcctctgcatgaacatactgccacacagtc

SEQ ID NO: 43003 - DNA, 121 bp, Artificial Sequence
  Synthesized
  misc_feature (61): n=a or g
aagtgaatacttgtgtgtttatacatggctgcttttacaggttcctaaaaaaatgggctangtagataaattctgccttcacgatagaaaaaaaaacaacattaagcaaaacctgaatgta

SEQ ID NO: 43004 - DNA, 121 bp, Artificial Sequence
  Synthesized
  misc_feature (61): n=t or c
tctggaccacaaataaacattaataaagtaattacttcagtatttcctatatcttgactcngccactataattacaaataatggttcttagctacatatgggctaatggagcactttagag

SEQ ID NO: 43005 - DNA, 121 bp, Artificial Sequence
  Synthesized
  misc_feature (61): n=a or g
tccggaggctgcagctgagaccagtcagtgtagcagctaaagacccaggtcaaaatgggangagaaataacgtcatggagaagggatgtgacatggccagagttgtacagtggggcatcag

SEQ ID NO: 43006 - DNA, 121 bp, Artificial Sequence
  Synthesized
  misc_feature (61): n=a or g
catctggtcactgagcacccaaaaacttgttcacttctctttacactaactggtctaatgncagctcttagctctccctacaaacccttcatttaggggatcttcccaggggaagatcaca

SEQ ID NO: 43007 - DNA, 121 bp, Artificial Sequence
  Synthesized
  misc_feature (61): n=a or c
aaacttctttaaagagtcagttctatttactattaacagacacaaaataatatggaggccnttaaaaatgaagaactttatacactcatgactcagtggaggctcaggggagaccttattg

SEQ ID NO: 43008 - DNA, 121 bp, Artificial Sequence
  Synthesized
  misc_feature (61): n=a or c
cgattcatcatcatccactgcatgaaaaaggaagttccacattatttgtttaaataaatgnttttctcagtaggaggaacacttaataccacactactacatcaaatataaactcagtaac

SEQ ID NO: 43009 - DNA, 121 bp, Artificial Sequence
  Synthesized
  misc_feature (61): n=a or g
gctgacaaaatggtggccacagggagcccatcatcttctccagtgacagctagggggaccnttgtgttcctggtagcatgtggcacaagaaagacataaaatgattatggggagcaggctg

SEQ ID NO: 43010 - DNA, 121 bp, Artificial Sequence
  Synthesized
  misc_feature (61): n=t or c
catgccaaatcaaggccatgcagattaatatcattaatgcttgattgactgctgctactgnctaacctttagatagctactttttccactttctcagcacatgcagtcatctctgacaata

SEQ ID NO: 43011 - DNA, 121 bp, Artificial Sequence
  Synthesized
  misc_feature (61): n=a or g
atggagtatgaggttgtatgctctgataggagagggtaaaaagggtgcaatgagtctgagnacagaagagcaagggagtaacacacacgtactgtctgagtgtctgataaacgtgcctata

SEQ ID NO: 43012 - DNA, 121 bp, Artificial Sequence
  Synthesized
  misc_feature (61): n=t or c
ttttgctgtgttcaagtcacctctgtgcctgctcttaactatgctggaagtgcttaacccngttttaaggaaacgctcccaaggctcaatgctttcttgggctgacggcctttcctggatt

SEQ ID NO: 43013 - DNA, 121 bp, Artificial Sequence
  Synthesized
  misc_feature (61): n=t or c
agcccaagagccaaggcaaagccaaggatccaaaccaaaacccaagatccaaaccaaagcncaggatccaagacaaagacaaggatccaagacaaagcccaagactcaaaccaagtgtgat

SEQ ID NO: 43014 - DNA, 121 bp, Artificial Sequence
  Synthesized
  misc_feature (61): n=a or t
actggaacagagcagctactctatacacaccgatacttgaaatttaacatgatagtgaacnacatcgttagctacacatgttttaatagatcaaggccaaaactttcaaaggtggaagtgt

SEQ ID NO: 43015 - DNA, 121 bp, Artificial Sequence
  Synthesized
  misc_feature (61): n=t or c
ggggtctttcatacagttcagctgagggaagtcaaatttgttattgtatttgctgagcatntttttaaaccaattcagcaagtacaaacaacaaaaaatctaataactagccaatccaatt

SEQ ID NO: 43016 - DNA, 121 bp, Artificial Sequence
  Synthesized
  misc_feature (61): n=t or g
taggcttagctaaatggagctaaattctatgaaatctgactgcagaaaatctcattctacntttttatcagcctttctttgggttttatatctcttccgtagctattggtcacattctcag

SEQ ID NO: 43017 - DNA, 121 bp, Artificial Sequence
  Synthesized
  misc_feature (61): n=c or g
aaccagtcacagtgcctttgaggttgtgtgtaggtaccgctccaaaagtcaactaaaccangtggtatgacagaggcatgacctgaacttgagctgttgttgggtatcttcatttgcttcc

SEQ ID NO: 43018 - DNA, 121 bp, Artificial Sequence
  Synthesized
  misc_feature (61): n=a or c
tccatttagtggcttaacataacatcttccaaatgcacaaacagggctctgcctcacttgnaagatctggcacagtagatgttctcaaagtctaagcacagaccaggttgtatgaggtgac

SEQ ID NO: 43019 - DNA, 121 bp, Artificial Sequence
  Synthesized
  misc_feature (61): n=t or c
catggtgtcactgagtgacaagagtgccagtggatgcagtgaaatgtcggattttatctanctcattgcagtaaatggggaatattccatttctgccaatgggagcagggctggctccccc

SEQ ID NO: 43020 - DNA, 121 bp, Artificial Sequence
  Synthesized
  misc_feature (61): n=a or g
gcgtggtcctgttttggtgttgcctaagaagcctgtaaaacagatattgggtctacctgtntttctgtacacaagactctgaatctgatagagacttctaggcaaaattccagcataaata

SEQ ID NO: 43021 - DNA, 121 bp, Artificial Sequence
  Synthesized
  misc_feature (61): n=a or g
cctgtttcctctgtgttctcttctgacttgctgaagctgatggctgcatcttggaacaatnagcggagataatgatttatgaaaagagttaacagcaatttgctgaggaatggcctctgtt

SEQ ID NO: 43022 - DNA, 121 bp, Artificial Sequence
  Synthesized
  misc_feature (61): n=t or c
tgaccagttcagcgctaaccaaaagtaaagaaatgttattaattataaccagttatatatnaccatattataacttgtccacactttcattctggggcagttaggagacagacacaacatc

SEQ ID NO: 43023 - DNA, 121 bp, Artificial Sequence
  Synthesized
  misc_feature (61): n=a or g
cttaaaactgaggtgattcaaaagatcattcacaagatgacaattgtttgttctgatactnctactaacacggtccatcaaagaaccaataataagattagccacctactttcaaccaatc

SEQ ID NO: 43024 - DNA, 121 bp, Artificial Sequence
  Synthesized
  misc_feature (61): n=a or g
tgtatgcaattccttactctaaaattgttaacgagtgtaagcatccttagatgtttcagcntgcttgtatatgctcctccttttagctgtttctccgtgcctctctgttcacatgacagtg

SEQ ID NO: 43025 - DNA, 121 bp, Artificial Sequence
  Synthesized
  misc_feature (61): n=t or c
tgccaaaatagcaaaccgctgtgctggttttgttgtgtttctttgtttctgttgccttttnctcacatggatgagggtaaccgttggagtttgtgcacaaccccacggccccgtgtcccca

SEQ ID NO: 43026 - DNA, 121 bp, Artificial Sequence
  Synthesized
  misc_feature (61): n=a or g
aagcgctattgctattagaaaccccccagagtactactaagacttctgaataagggcactncagcagggcacacctggcttgctgccttagtaatggattgtgttagaaacaattatctgc

SEQ ID NO: 43027 - DNA, 121 bp, Artificial Sequence
  Synthesized
  misc_feature (61): n=a or g
ttgtaaaaaaagattttacacaaaaatatgaagccatttgcagggaaaagaatgaatgacncactgtgtggcaatgggacacattaccttttcattcctgcagttgtttagacccatgtta

SEQ ID NO: 43028 - DNA, 121 bp, Artificial Sequence
  Synthesized
  misc_feature (61): n=t or g
ttcataatatgttaaacatccacagcaactgataacatttagctttattgagagactcaanatattcttctttaaattaaaaccagaggtctgtactatgaagtcacatgaatacatggct

SEQ ID NO: 43029 - DNA, 121 bp, Artificial Sequence
  Synthesized
  misc_feature (61): n=t or c
tttctgtgtctctcttatggctactctactccgaattatgaaaactagatatttatgaaancacagatagaacaggtccaaaagtgacagacataggttgctccaaaaataatgcctcctg

SEQ ID NO: 43030 - DNA, 121 bp, Artificial Sequence
  Synthesized
  misc_feature (61): n=t or c
caaaccatgacagttgaataaaggaaaataatacatataaatacccagtttctcagagtgngatatttacacatagacaacaaaggctttatcacataatcaggtactaatataccacaag

SEQ ID NO: 43031 - DNA, 121 bp, Artificial Sequence
  Synthesized
  misc_feature (61): n=a or c
agcagcaacctgtagccctattgaaggcctgtagacagaaggagcatttccaagacatcanagtgttttgaatttggacatgaggaatttgtgctgagtacctttctaactaacaaccctt

SEQ ID NO: 43032 - DNA, 121 bp, Artificial Sequence
  Synthesized
  misc_feature (61): n=a or g
atgcagagacctcacagaatttgactcacgtagggctgaaatggattgaatttgacttagnctccaactacccaaggccttcagcagctccagcccccaagttaatctctaccagctcaga

SEQ ID NO: 43033 - DNA, 121 bp, Artificial Sequence
  Synthesized
  misc_feature (61): n=a or g
agaaaggggtaagattatatctaacttctttccccacacacctttacaaggcaacaaaggnaagtagaagcagtctataaaccacaggttctaacacattaacagctcaaaacccaactac

SEQ ID NO: 43034 - DNA, 121 bp, Artificial Sequence
  Synthesized
  misc_feature (61): n=a or g
cagcagagctctgaacgtcccagatcagtgcatcaaaccaaatccgatcagtgtgttcacncctatcagccatcccacgttcagacaggataccttcttactgggaataaattttttccct

SEQ ID NO: 43035 - DNA, 121 bp, Artificial Sequence
  Synthesized
  misc_feature (61): n=a or g
gaaaatactaaaagctcattgtgcatttttttagtcttatttttaataacttaccacaacncataaaaattatagcacaaattataaacacaccatcctcaccctgcaaggcacacacttt

SEQ ID NO: 43036 - DNA, 121 bp, Artificial Sequence
  Synthesized
  misc_feature (61): n=a or g
agattgtttcagatttgagaggattgagagactgattcagttttgaatctggaaagcaagnaaggaagccaggaaactggaaaagcaaaatcttggtggagaagaaggtactataaatgtc

SEQ ID NO: 43037 - DNA, 121 bp, Artificial Sequence
  Synthesized
  misc_feature (61): n=a or t
gttacacctgaggcagtgtatttttcaaatatgtctgtatacgaagggctcccaatgcctncatccatacaggaactgctaaaggctgattatgtgaactacaatcagtatatcttccttc

SEQ ID NO: 43038 - DNA, 121 bp, Artificial Sequence
  Synthesized
  misc_feature (61): n=t or c
gatctaagtacagtgtaattccaaactatttctgtgcatagttcaggatttgttttgcacntgaaaccgaggcaatttgcatatggtgattctcctttcaagtctgagaaaaactaataac

SEQ ID NO: 43039 - DNA, 121 bp, Artificial Sequence
  Synthesized
  misc_feature (61): n=a or t
tagtcttcttttccaggtactcttagcagtagggagatagatgaggtctgtgaacttttcngaagggagtatggctctcttatgtttgtaagcacccctcactattttgtcaccaaagatt

SEQ ID NO: 43040 - DNA, 121 bp, Artificial Sequence
  Synthesized
  misc_feature (61): n=t or g
tgcaaaattgcatgcagaatcatggctgcctgcatggcaaaaatgtgctcagactaatttngcccatctaaactttctggcactttatgtgtttgggtatatatatgaaggcttcaagaag

SEQ ID NO: 43041 - DNA, 121 bp, Artificial Sequence
  Synthesized
  misc_feature (61): n=a or g
ggaagaaaatatgcacgctgctgtgagttcatgactttatatctcaattccttctgtcacntaaaagttttttccttaggtttttttgcatattccctactatagctttttgtgtcaagtg

SEQ ID NO: 43042 - DNA, 121 bp, Artificial Sequence
  Synthesized
  misc_feature (61): n=t or c
caaaacaccacaatttcatatgaagtaaggagacaactttggctggaatccaagccttganccattacaaagggagaaatccgtatccgtacattagaaagcaattcctatgaaaattcaa

SEQ ID NO: 43043 - DNA, 121 bp, Artificial Sequence
  Synthesized
  misc_feature (61): n=a or g
gttctgatgccaggcaagaaggttttgaattccagaaaaagcctgtcctgcctcctgcccntcttcatgctcagccacacagcggcacagcaacggacttctgaggctaccaggataattt

SEQ ID NO: 43044 - DNA, 121 bp, Artificial Sequence
  Synthesized
  misc_feature (61): n=t or c
tcctgccatgctcttatgccctcagagctggttgttcatcttcctccacctctcttccctntcatatttgccagcatttggcactgccattactgattatgatatgtttattgttcaggtg

SEQ ID NO: 43045 - DNA, 121 bp, Artificial Sequence
  Synthesized
  misc_feature (61): n=t or g
gcttctcccaagcaccactctaatcaagctcacgaggattaggcaagtacttcctgtttgnactaggcctgattccttgtgaaatacgtttagctggtgctcttggcttgcaaagggccca

SEQ ID NO: 43046 - DNA, 121 bp, Artificial Sequence
  Synthesized
  misc_feature (61): n=a or g
ctatgcttcctcagctcactcacaataaatacttcctacagttaagtactaacaagaaagncaggcagaaaaaggatgcagtgagcggacaatcagcagactgtcagtttaaggcataata

SEQ ID NO: 43047 - DNA, 121 bp, Artificial Sequence
  Synthesized
  misc_feature (61): n=a or c
ccttctataagtctcctacttacttttttcactatttaatacaggttaatattagttaatncagttaatacagctctcatttcagaaccttattgctcacaaaccttttccttctttcaaa

SEQ ID NO: 43048 - DNA, 121 bp, Artificial Sequence
  Synthesized
  misc_feature (61): n=a or g
cttccatatcttattctgataaagactgattacagcattcaggctgtgtcttgttacaagnccatgaatatcacaagcagtcataaaagactgaccaagatgctaacctttataaagcaac

SEQ ID NO: 43049 - DNA, 121 bp, Artificial Sequence
  Synthesized
  misc_feature (61): n=t or c
cagatatagccttctagggagtttccttacctgatacattatttggcttcattctttctcntaaggaaaatacaactaattttttcaagcttaaagtatactgccatgttccccatcatgt

SEQ ID NO: 43050 - DNA, 121 bp, Artificial Sequence
  Synthesized
  misc_feature (61): n=t or g
ggttggactagacaatcttagagatcttttctaaccttaatgactcaatgattgtattcanatcactcagatttctcctactgtttcctactgactggttctcagcagctcttccctcagg

SEQ ID NO: 43051 - DNA, 121 bp, Artificial Sequence
  Synthesized
  misc_feature (61): n=a or t
gttcttttccaacctgagtgattctatgattctatgattttgactaatgtgttgctggtcnactgcagcgttgttcaactttttcagaaagtattatgtttgtactgtcttcaagagccaa

SEQ ID NO: 43052 - DNA, 121 bp, Artificial Sequence
  Synthesized
  misc_feature (61): n=t or g
gaccacccagaactgacatggcagcaggcactgagttggctgatgatccagctgcagatcngggacagatttccttgtctgaaaaggccacttcgacatcacccacacagtgcctgtgctg

SEQ ID NO: 43053 - DNA, 121 bp, Artificial Sequence
  Synthesized
  misc_feature (61): n=t or c
ctcattttatttgtaaacccaacaaatatgtcaaggaagagagctgaaggaaagcaaacanggaacacaaagaacatggccagcgagtttgccttctcacacgtgcagcctgtggtctgca

SEQ ID NO: 43054 - DNA, 121 bp, Artificial Sequence
  Synthesized
  misc_feature (61): n=a or g
cgtctccttcccgagctgctgaggccctcaaatcaaattcgaccgcagcagtcggacaggnctttcttttctaagggtaatgtatttgtgtttctatgtgcacacgtgggcacggaccgga

SEQ ID NO: 43055 - DNA, 121 bp, Artificial Sequence
  Synthesized
  misc_feature (61): n=t or c
gtggatatctagtgctgtcagagcaggagaatccagtatttatgatgctgtcttcataagnttgaaggcattacggagagtttattcagagaaagctaccttttccttttttcattgaatg

SEQ ID NO: 43056 - DNA, 121 bp, Artificial Sequence
  Synthesized
  misc_feature (61): n=t or c
gtgagtctcttttccattatgtctgaatatgcccagctcaagcgcattatacctcatagangtggcagcttaggtgtcattactggggcttttcttttcaggcaggtgtgtatgaagtaga

SEQ ID NO: 43057 - DNA, 121 bp, Artificial Sequence
  Synthesized
  misc_feature (61): n=a or t
aaagctatctactttttagcatgaggagattgcaatcagctttgaatttatcaacagtaangaatagactaccacttttcagctaaataagagctgtgtgtagaagaaagatgactataaa

SEQ ID NO: 43058 - DNA, 121 bp, Artificial Sequence
  Synthesized
  misc_feature (61): n=t or c
ttcaactgaggcaacgtgcctgttgccagagttaaagccatgtgccaagtgcacagatggnagtgcctgcttccctcacttaaagtgacaaatgaacacatttttcttccttagcacatga

SEQ ID NO: 43059 - DNA, 121 bp, Artificial Sequence
  Synthesized
  misc_feature (61): n=a or g
cttgcttgcgtccacaaaggtctctttgtagggcccatggccgtgggcgtacagcagctcnggaatacacagcctgtcattagcaattatccaggtgtcgtaaccaaagttctgccacaac

SEQ ID NO: 43060 - DNA, 121 bp, Artificial Sequence
  Synthesized
  misc_feature (61): n=a or g
gccaaattctacaagtttgggctttttgcagctctggatttgggggctttgttgctagccnttagatttatttaaccattacgagctattaaatttactcaaccttgtcagtgtggaaatg

SEQ ID NO: 43061 - DNA, 121 bp, Artificial Sequence
  Synthesized
  misc_feature (61): n=a or t
ccgccccagttccagatgagtgcttgccgagaaagaactctcacttcgagtgttttctacngattggatacaaactgtggcatttcaaaacaggctacttttgtagaaataggaaaatttt

SEQ ID NO: 43062 - DNA, 121 bp, Artificial Sequence
  Synthesized
  misc_feature (61): n=t or g
aatctgcagcacaaagtagaaaagaagccttaatagaataaatcagggtggagtgtgtgtnaaagctccacttctgcagagtggccccagccacaaagcactgtgcagggcttcaggtcca

SEQ ID NO: 43063 - DNA, 121 bp, Artificial Sequence
  Synthesized
  misc_feature (61): n=c or g
tccctgtgggatacggtcctgttttgcctccatgtgtgtgcaagaccattgccaccctgtngagggacaggattggcctcacagtctcttaatgggattgtatcgggctgcaccatgtgct

SEQ ID NO: 43064 - DNA, 121 bp, Artificial Sequence
  Synthesized
  misc_feature (61): n=a or g
cataggcagccagaagaaggataagatttggaggatgtctgcagagaagcagtcaggactntttgaaaacaacaaaacccaaagttattacccactgtgagccctgctggtaattctgtag

SEQ ID NO: 43065 - DNA, 121 bp, Artificial Sequence
  Synthesized
  misc_feature (61): n=t or c
caacaaactccttcatccttcacctctttcaaactgtggtaccaaaaattgtacccaccanttacactgagttatcatcctgaagcagtgtgtgataagaactaatttaatggcttacaga

SEQ ID NO: 43066 - DNA, 121 bp, Artificial Sequence
  Synthesized
  misc_feature (61): n=t or c
ttcccgaaacaaccattagttggcagaagggagccatcagtcccagacttgatgcgtgcangtctgagcaaagcatctccagtctcttctcactcaaaaaggcaaaccctagatgagaatc

SEQ ID NO: 43067 - DNA, 121 bp, Artificial Sequence
  Synthesized
  misc_feature (61): n=a or g
aaatactgtgtaatacctctactctcttgggtggatacccactgcttcttgatgtcatttnagattgttttatatcatggatgaacggagagatgcttctgagtggggtgaggttaatcaa

SEQ ID NO: 43068 - DNA, 121 bp, Artificial Sequence
  Synthesized
  misc_feature (61): n=t or g
acaatatccttccttctctcccaccaggagagaaggttacagatccagttgactgtaattntttctcctggtgaaggtctgaacagaggcacttgtcaggacacaagaccaaacagagcca

SEQ ID NO: 43069 - DNA, 121 bp, Artificial Sequence
  Synthesized
  misc_feature (61): n=t or g
aagaagacagtggtgtggcaagcatccatgccattagtcagtgagcagagacggttggtgntgtcaactgttttgtagaaaactaagagagtgatgattgtctctgtagccctgggtaggc

SEQ ID NO: 43070 - DNA, 121 bp, Artificial Sequence
  Synthesized
  misc_feature (61): n=t or c
ttaagtctctggtataacagatttccaagcctcaaatcttaagattaagaatattagaganattattatagagataatattatacaaaatcttaacaggaaaactgctttaaaatgattaa

SEQ ID NO: 43071 - DNA, 121 bp, Artificial Sequence
  Synthesized
  misc_feature (61): n=t or c
catcttggctttccctctataggcttgcattctgttcaagccactggcagctagcttctcnctgggtttttacatactgctggaaggcaggaaaaccagttttatccagacagcactgtga

SEQ ID NO: 43072 - DNA, 121 bp, Artificial Sequence
  Synthesized
  misc_feature (61): n=t or c
aagcattcacttggaattgccatacattcttcacatatcacgaagacatctatgcaggaanctttaatgtagcattagttaagtgaaagatttgcaaataaacattttagaaaaattgtat

SEQ ID NO: 43073 - DNA, 121 bp, Artificial Sequence
  Synthesized
  misc_feature (61): n=a or g
aggtatatcagaagcactgcataatatcagtatggaataataggggaattttcctttagangggtattctacaaacacttgtgtgtcagtctttttaaagagctgaagaaaacccacatgt

SEQ ID NO: 43074 - DNA, 121 bp, Artificial Sequence
  Synthesized
  misc_feature (61): n=t or g
gggcaagctgtacagaggccaacacaaaaacaaaaaatacattctgaaggtatgtaagganaagtacgtattttgggggcaacatcgagatgttctccatgtgctcagtgggcaaatgaat

SEQ ID NO: 43075 - DNA, 121 bp, Artificial Sequence
  Synthesized
  misc_feature (61): n=t or c
atgataaggtctcctcttatgttggctcaaacagtgaaaagcactgtttggagaagattcncttcctctcctgatgcagagaaacacacccaaattgtccatttgtctcctgctgagtaag

SEQ ID NO: 43076 - DNA, 121 bp, Artificial Sequence
  Synthesized
  misc_feature (61): n=a or c
aaacaaagaacagggagctcactgggagttctcaaacactgaaaattggattctgtagtgnaggtactgaagtcagtcaaacaacagtgggaagagctgttaaaagaataatgtgttgtga

SEQ ID NO: 43077 - DNA, 121 bp, Artificial Sequence
  Synthesized
  misc_feature (61): n=a or g
acattctgttttaatatcactgtactgaatccacatctcccttggaagatctttgcttgtngtctgaagccatcctgaagcatgttgttatactgagagatgagtaggcttctagtttaag

SEQ ID NO: 43078 - DNA, 121 bp, Artificial Sequence
  Synthesized
  misc_feature (61): n=a or g
acatctcagtgagctacaaaactagctgccttctttaaccagggtaggggaagcgcccttnttttcctaagctgttcacagcataccatcaattgtcagcaatcttcctccacaataagac

SEQ ID NO: 43079 - DNA, 121 bp, Artificial Sequence
  Synthesized
  misc_feature (61): n=a or t
tttactgcctccaggaaaaaacaaccaaccaaccacacaaaaagcacactcaggttcctgncactacttcagtataaagaagatgtgaagaaagcagctcaggaattatctggatatttaa

SEQ ID NO: 43080 - DNA, 121 bp, Artificial Sequence
  Synthesized
  misc_feature (61): n=a or c
gcagttaaagaacagcagaccctctctgtcattatcttcccccagttaaactggaattgcntttgtccacttgtgctatacatcccatattttgccctacaaatatgtaaaggacattttt

SEQ ID NO: 43081 - DNA, 121 bp, Artificial Sequence
  Synthesized
  misc_feature (61): n=t or g
ttctggcaataacagaactattaaaaagaaacaagaaaaagagagccacaaaaactttttnggacacacaacactaacaatgcctgcaatactttttccgtgccaccgagaacctctgcca

SEQ ID NO: 43082 - DNA, 121 bp, Artificial Sequence
  Synthesized
  misc_feature (61): n=t or c
gcttgcaaggccatgccttcttaagcgaacaaaagcttgcaacaaagcacatcggggatgnaggagtaaagcaagtattccccaaattgctgcagaaagaatttaggagctattcaaaatg

SEQ ID NO: 43083 - DNA, 121 bp, Artificial Sequence
  Synthesized
  misc_feature (61): n=a or c
agcaggaggacagaacactgctgctccgtcacccacacaggatcctccacttgaacatgancgtggtaccacacgctgggaacccatcttctttgcaaactatgtcataaacacagtggat

SEQ ID NO: 43084 - DNA, 121 bp, Artificial Sequence
  Synthesized
  misc_feature (61): n=a or g
aagacagatgctttgtctgagagaaggaaggtgcagaaaactgtcttgccttcactgttgnaggctcttgactaacatgaggttcaataatcatgggcaaagagggtctttctttttccac

SEQ ID NO: 43085 - DNA, 121 bp, Artificial Sequence
  Synthesized
  misc_feature (61): n=t or c
tgatgacttccttgcacttccattgatttgagtgtaatgtgaaagtcctgatttggatatnttctatagattcataaagggtttcatcaatcggaagaaacctctgtgtccagagaacatt

SEQ ID NO: 43086 - DNA, 121 bp, Artificial Sequence
  Synthesized
  misc_feature (61): n=t or c
aataatttcatttcttgctcagtgggtttttattgagctttatcaatttcaacaatgacanggagcccttaaagataatgtattatggagctgaggatggcaacatttacaatttagcttt

SEQ ID NO: 43087 - DNA, 121 bp, Artificial Sequence
  Synthesized
  misc_feature (61): n=t or g
gtcccaggctgttctttcttacccacctgtgatgagcaagaagtcaacttgccatggtgtncctggccccagttccaagttaagagaaatatcatatttcaaacaataaaaataaaagttg

SEQ ID NO: 43088 - DNA, 121 bp, Artificial Sequence
  Synthesized
  misc_feature (61): n=c or g
attggcctgagaaacagttctgaatattgtgcataattgtgcaacatatccctttttctgnctggtgcttttatcattaactcgtccgattagcaaaagctcagagtctgagatgttcctt

SEQ ID NO: 43089 - DNA, 121 bp, Artificial Sequence
  Synthesized
  misc_feature (61): n=t or c
taaagaaaaatggtttggaaaaaactgaagggtgacatttttcatgtctgaaccttttaantcagacactggttatagttctggtcccaaaaactttcacagacttgatcacggcatagga

SEQ ID NO: 43090 - DNA, 121 bp, Artificial Sequence
  Synthesized
  misc_feature (61): n=a or g
cgttctggaccacacacagtcgaccttaggctcatacttgatctgtgtcttccaagccccntgaacaggaaggtacggagtcctgttgccagaacagttccacattctgtgtttaactggg

SEQ ID NO: 43091 - DNA, 121 bp, Artificial Sequence
  Synthesized
  misc_feature (61): n=t or c
tctaacatggtcactggggagacaaaaagcttcttcagttttgcgaaatcagtaagtgtcncagcactgtgattccactctactttcctctaatctcggtcttttctgaacaatgttgcta

SEQ ID NO: 43092 - DNA, 121 bp, Artificial Sequence
  Synthesized
  misc_feature (61): n=t or c
tttgccactctgatccaagtagcacttcatttcccctgttagaaatgcctgagagcaaagntgggaaaaactttccctaaataaccccgatgctgaacaatcattgaaatgcatatctctt

SEQ ID NO: 43093 - DNA, 121 bp, Artificial Sequence
  Synthesized
  misc_feature (61): n=t or c
gttattgaaggggtagcaaatatttagttgttcgctggctctttgcttgtgccttccctcngctggggctggatggttttgattagcctcctaggagggagcccactgccttttgtccact

SEQ ID NO: 43094 - DNA, 121 bp, Artificial Sequence
  Synthesized
  misc_feature (61): n=t or c
tcacatcgtctcggatgataacttgttgggaagcttcagtttgaaagacaaaaatctcggnagtttgtggtttgtgttgataggcttcaccaaggtaagctcgccgtgcttgtcagcatgt

SEQ ID NO: 43095 - DNA, 121 bp, Artificial Sequence
  Synthesized
  misc_feature (61): n=a or g
gcaggagcagaccccggatccttatattgatgtgaatacacgtttgtttatttgcctgganaacgtctgtttgagttgaacagcagtgtattggtggggctatatttaagcatgctcagcc

SEQ ID NO: 43096 - DNA, 121 bp, Artificial Sequence
  Synthesized
  misc_feature (61): n=a or c
aggtgctttagggaaggaattaagatgaaaatataaaaataaatacttggcaaaaaagaantccttttctaattgctacattccagtaacacaacagttacttattttaacattcttttgt

SEQ ID NO: 43097 - DNA, 121 bp, Artificial Sequence
  Synthesized
  misc_feature (61): n=t or c
cataagaaaacttatgtatctgacatcttactttgaaagctcaaagagctgcattgtctgngtagatcccagctcacttttattcctgctctaatatttcttctgagaagatgattcagta

SEQ ID NO: 43098 - DNA, 121 bp, Artificial Sequence
  Synthesized
  misc_feature (61): n=t or c
taagaaatgagtgaaatggaataatcatgattaaaaactttgctaagctgacagaatgtcnatttaatagagaattggtatcatttctagaatgtgaagatattatttaaataattcgtta

SEQ ID NO: 43099 - DNA, 121 bp, Artificial Sequence
  Synthesized
  misc_feature (61): n=a or g
cattacaataatgaatgcacaaaagaacttaggaaataattcaatcaaagctactgggaanccttaatcccagatccatgactcttacacaaatttttctgatataagaagaaactctgcg

SEQ ID NO: 43100 - DNA, 121 bp, Artificial Sequence
  Synthesized
  misc_feature (61): n=a or g
agacagcatccagtccttttctgcaacacaggaaacatactcagttctgtgaggaagcacnaactttccctgttacttaaacacaaaaacagaattacagaggcaaggcacttgtatgtga

SEQ ID NO: 43101 - DNA, 121 bp, Artificial Sequence
  Synthesized
  misc_feature (61): n=a or g
ttcatgcactaatcttcaagacatcagccctttactgcccaatatcaaagttgttagcacnagtggttcctatgcaccacatgactggtggcgttttgaaaatggatctcactcattctcc

SEQ ID NO: 43102 - DNA, 121 bp, Artificial Sequence
  Synthesized
  misc_feature (61): n=t or c
cctccttctttaatcgatttaacttagtggttgcaacacagctatcggaaaggtaaagaancatctgaagttgttagtactcactgcactgccctcccaccccccctgcttactggaaaac

SEQ ID NO: 43103 - DNA, 121 bp, Artificial Sequence
  Synthesized
  misc_feature (61): n=a or g
ttaaaccatccgggacatggagaaggatgatgaggcatgcatctcaaaggtcttgcataangaggatctgtaaggtctgtaataagacgaacctgctgtccatcacattcaccatcttttc

SEQ ID NO: 43104 - DNA, 121 bp, Artificial Sequence
  Synthesized
  misc_feature (61): n=t or c
cctttttggaactcttccagctggaggggagggcacgtaaggatgtgctgcccatgctcangatccacgcatcattgtaggggtttgtggatgtactcctgaaaatggtcaagcaagcttt

SEQ ID NO: 43105 - DNA, 121 bp, Artificial Sequence
  Synthesized
  misc_feature (61): n=t or c
gctccctctctgccacttcttggtttcattgtctgaacatgcttctcagagctgaaacagngagaatgaaatcagaaatagctgtggttaatccattcatttagagaaagatatgtgctat

SEQ ID NO: 43106 - DNA, 121 bp, Artificial Sequence
  Synthesized
  misc_feature (61): n=a or g
atcacagccctgtagtcatattgggaatgcaatcctcagtcttatatgtttcagttagacntgacgtggcccctatgtggtgaactggattttagcaagagaaggttatactaatggtgcc

SEQ ID NO: 43107 - DNA, 121 bp, Artificial Sequence
  Synthesized
  misc_feature (61): n=a or g
ataatattattatattataaatttaatgttatcgttcttcagctcttagtggagaagtacncaattccaggtgttggctttatccaacctgaaacatgaaaagtcatattgtcagccataa

SEQ ID NO: 43108 - DNA, 121 bp, Artificial Sequence
  Synthesized
  misc_feature (61): n=t or c
catctgatcgtgcctcagtccctgactgcggggcttgtagagatgccagggggaggctggnaggtggaggatcgacttaaaataaaaattcaatacacaggttgctccgaaattaatgccg

SEQ ID NO: 43109 - DNA, 121 bp, Artificial Sequence
  Synthesized
  misc_feature (61): n=a or g
gccccaggctgtacccactggagggtttcttctggctataaaatctggtgtactctgccanacctccctttttaacccctccagcaaaacttaacccttctgccccaaattagcttatttt

SEQ ID NO: 43110 - DNA, 121 bp, Artificial Sequence
  Synthesized
  misc_feature (61): n=a or g
taatagtaaatggaactacagtaagatcaccagcatcatctccccttgcaaaacagctgantttggccctacatgtataaaaagacagtcaaataatcagttgttaactgtcttcaatgca

SEQ ID NO: 43111 - DNA, 121 bp, Artificial Sequence
  Synthesized
  misc_feature (61): n=t or c
gctggagaggagcgcattctgccaacgctttcttccatcccctgacaggttttactattangccaggaaatggggtcacatagatttatcctcgctggtcctatgccatcatggcattata

SEQ ID NO: 43112 - DNA, 121 bp, Artificial Sequence
  Synthesized
  misc_feature (61): n=a or t
cacaggaagtttagtgatgcaccttttcccaaagggctaacatttatattgacaacaacancaagttgtaaatgcttgctgcagtttttgaggggctgttggaattgatacattggatgtc

SEQ ID NO: 43113 - DNA, 121 bp, Artificial Sequence
  Synthesized
  misc_feature (61): n=a or t
atatctgctctaccgtacagtttgtgtgtattcacatacatttgctggatactttcagtcngcaatgtatgtaaatgcagcacccgtgctcttagtcagcctttaataaaaagtgaggaga

SEQ ID NO: 43114 - DNA, 121 bp, Artificial Sequence
  Synthesized
  misc_feature (61): n=a or c
aaacctcctcaagcagaagaatgagctggatgccataagccctggatttttggttaacagntgctgtggcggttttcaagctaaattctcctctgtcttcctcttgcattgtgttactgct

SEQ ID NO: 43115 - DNA, 121 bp, Artificial Sequence
  Synthesized
  misc_feature (61): n=t or g
cagcaaagcaatctacagtgaagactgtcccttctcaatactgttgtttgcttctccaagncagtgctgatactcaaggtagaattcagcttgtcatggtctttctgaagagaaaacattt

SEQ ID NO: 43116 - DNA, 121 bp, Artificial Sequence
  Synthesized
  misc_feature (61): n=a or g
tatacatataggattgagtacttcttgtaaaaaaagtatgttcaaggcgatgtaccacttngaaagtagaactggaacaagaggcaaatgccactgtatatcttcattttcttgcttttct

SEQ ID NO: 43117 - DNA, 121 bp, Artificial Sequence
  Synthesized
  misc_feature (61): n=t or c
gtttggtttatggatagatctttgcacctacatattgcttcacatgtcaagtgcgggctgnctgttggcacaggggtcttagcacctactttgcttgaactcaagtatgacaccagcgaag

SEQ ID NO: 43118 - DNA, 121 bp, Artificial Sequence
  Synthesized
  misc_feature (61): n=a or g
cagcaacaggaactgcaccaccaaacatagagcaaatgcaccactgccaaggctactgctnatgtcataattcctaaagattaacaaaagcaaagttactgctactttttcttcctgttac

SEQ ID NO: 43119 - DNA, 121 bp, Artificial Sequence
  Synthesized
  misc_feature (61): n=a or g
gctcctaaatattttagtgagttttcttgcagttgcagaatttctggctgagtccaaagantgtgcttggctctggcaactgctgtcagcagtcacagctgctgtcacaaaaggagcgagc

SEQ ID NO: 43120 - DNA, 121 bp, Artificial Sequence
  Synthesized
  misc_feature (61): n=c or g
agtaacctactgaaacatgttgctaagctgattagtgatggtatatgatgatctgactgtnttcaaaatggtttctatcttgcccctaaaagaccaggaaaacagccatagagccagttct

SEQ ID NO: 43121 - DNA, 121 bp, Artificial Sequence
  Synthesized
  misc_feature (61): n=t or c
cagtcctctgccataactagccattcctcctgatttctgtctcaagcactcatttacaggngaatgcacttcagtcatacagtaactaatattttcataatatttttgacagaaagcaaca

SEQ ID NO: 43122 - DNA, 121 bp, Artificial Sequence
  Synthesized
  misc_feature (61): n=a or g
actgtgcagtccaaaaacgagtgccagcttccttccagtgcacataaaatcaagcctctcngtgatctgtgctgaattaactcccatgcactgcatggagcattaagtgctgtaatgcagc

SEQ ID NO: 43123 - DNA, 121 bp, Artificial Sequence
  Synthesized
  misc_feature (61): n=a or g
atgatacacagacatagatacatttcaaagattcattttccttatggcgtgcttttctgantagtgttgctcggttcccagaccttggtaaagtttcaaagtttcattcctactagtgtac

SEQ ID NO: 43124 - DNA, 121 bp, Artificial Sequence
  Synthesized
  misc_feature (61): n=a or c
tctttcattacctatcttaaacagaagcaaaataaaatctatataaatatctgtaaattgnaaaaagaaagaatgtttgctctactgcttgataacgatggatgaaaatctataactgtag

SEQ ID NO: 43125 - DNA, 121 bp, Artificial Sequence
  Synthesized
  misc_feature (61): n=a or g
cgaggtatgttggtctttaccagaggcctgttgctatggcagtagaagtctgcaagagganactgaggcaaggccatggtatgactaaaaatgtaattgaagacaaaccctaagtcagaca

SEQ ID NO: 43126 - DNA, 121 bp, Artificial Sequence
  Synthesized
  misc_feature (61): n=a or g
ttttcctcactgatagcagagctcacactgacacccacaggtgagaatgggaacaggcagnatgctgctgagtcagtagtgagcatcccactcgttgggcagtctgactattcatgctgtg

SEQ ID NO: 43127 - DNA, 121 bp, Artificial Sequence
  Synthesized
  misc_feature (61): n=t or c
ggcaggccatatttcctgcatgaagctcctgagaataacatcaattggcagaaaaggcagngttcttctgatgcagacatggctgataaaaacataccaagttttacttaaatactctgtg

SEQ ID NO: 43128 - DNA, 121 bp, Artificial Sequence
  Synthesized
  misc_feature (61): n=t or c
aacccatatcgtttgcagctatacatgtatagataccatcgtcttctgcagtgacgccaangattttcagtgaagcctcccctaagtcactgggaaatacaatggcatccataaactttat

SEQ ID NO: 43129 - DNA, 121 bp, Artificial Sequence
  Synthesized
  misc_feature (61): n=t or c
gactggacgcttgtttcaacacacagaaatgctttcttagctctgaagaaagtctttccangtggcaaagaatttacagcctaactggacgtgacaggagaagagcaggtgaaggtagctc

SEQ ID NO: 43130 - DNA, 121 bp, Artificial Sequence
  Synthesized
  misc_feature (61): n=a or g
gacctgcctaatttagtgaacacactgaccttgctaaaaattttctaattagggattgtanattgattgttgttataaataacccaggtatttctttcatacaagcagtatacaccattct

SEQ ID NO: 43131 - DNA, 121 bp, Artificial Sequence
  Synthesized
  misc_feature (61): n=c or g
attcactttacatgtatttctgggtctcacagagtacttgtagctgtttatgatggtcttncatctgtactttaaactcaaggtctattgaccaaaacagcctctattttgaaaattcagc

SEQ ID NO: 43132 - DNA, 121 bp, Artificial Sequence
  Synthesized
  misc_feature (61): n=t or c
cttgctgaccaaactgaagtaatatcctcaccttccccttccagtgcctgaaaaatgttgntcctaccaactgctggtcttttaacatgtcccacctcagtccttcccctcctgtagtgac

SEQ ID NO: 43133 - DNA, 121 bp, Artificial Sequence
  Synthesized
  misc_feature (61): n=a or g
tcctctgagaaggagtttccacaagataacagtttaattcagagcatcaagaaacactacngcacagacctgttctgcagaaatcagcacaaaactatggacctccccggggtcattcccc

SEQ ID NO: 43134 - DNA, 121 bp, Artificial Sequence
  Synthesized
  misc_feature (61): n=a or g
tctatattatgtggtcctaataccagcaaactttactggtatggttgacaatggcaacacntgccagttgttccatgccagtgttaataccttagctggaatggggagattctgatttgat

SEQ ID NO: 43135 - DNA, 121 bp, Artificial Sequence
  Synthesized
  misc_feature (61): n=t or c
tgtctgcagaatgtatctgacattatctgactacagtatgaaactgcagatttggtttcanaccacaccttggcatactcctctgaaaacaatcactccatattggatataaattatatta

SEQ ID NO: 43136 - DNA, 121 bp, Artificial Sequence
  Synthesized
  misc_feature (61): n=t or g
cagctgctggccactgtgggagatgggacgctgtgctagatggatctacagtcgaacttgnctttgcttttcttaaggagcgctggagatgtttatccattagactatattgaagcctgag

SEQ ID NO: 43137 - DNA, 121 bp, Artificial Sequence
  Synthesized
  misc_feature (61): n=t or g
tctccttttcttattgccttttttctgtttttcatgggaggagttggtaaacccatagctncttctgcccctggatccatgtgtgagcatcttactgttgggaaactccacaggggttttc

SEQ ID NO: 43138 - DNA, 121 bp, Artificial Sequence
  Synthesized
  misc_feature (61): n=a or g
aagtcacatctgtttcttatcagaaagaaactaaaagcctgagatcacgtgcatgtcaacngagcagcaatgaaaccgacagcactctgtatgcactacgagaattaaacttgtgcttttg

SEQ ID NO: 43139 - DNA, 121 bp, Artificial Sequence
  Synthesized
  misc_feature (61): n=a or g
tgcagggttagagcttggcaattctggttctcctccgggtttcttaggaggaatagtaacntttatcattttacgactggagaactgagaaggcttctgcatgagcaggcataatcacaga

SEQ ID NO: 43140 - DNA, 121 bp, Artificial Sequence
  Synthesized
  misc_feature (61): n=a or g
tccttctgctatctcagtgtcaagcatttttcttctctttttatgtccttataacctagangtctaattccaagtcttgatcttctgtttcccttctcaattcctttctcatactcctgaa

SEQ ID NO: 43141 - DNA, 121 bp, Artificial Sequence
  Synthesized
  misc_feature (61): n=a or t
tttacagtagagacaaaattctttacttgagaaaccacccacgtataaaaccaacaacacnaatgctgacaatcagtctgacatccaatctgtttccaacctacagccacagaaatagagt

SEQ ID NO: 43142 - DNA, 121 bp, Artificial Sequence
  Synthesized
  misc_feature (61): n=t or c
tctttttagtgcagttaaaaaatcgcctaaaggtaattgccgctattttcaaaattgtctncttcagctgttcaagtttaatgcaaaatttactgtaaaaattatttaggagcttaagtat

SEQ ID NO: 43143 - DNA, 121 bp, Artificial Sequence
  Synthesized
  misc_feature (61): n=a or g
tacagtggaaccttcagtatcattactgataatagaatctcaatgaggagactatgatatntttgtcctaagagttacaaaaaattatagagaaaacattagtaataaggaggagtgagaa

SEQ ID NO: 43144 - DNA, 121 bp, Artificial Sequence
  Synthesized
  misc_feature (61): n=a or t
ttttagctgctgagaaagtggaagtaaccaggaagaaatagttgcaagcaagaaaataganatactgggagttgctattcttgatcattagcgttatgcaaagattgaatatccaatacat

SEQ ID NO: 43145 - DNA, 121 bp, Artificial Sequence
  Synthesized
  misc_feature (61): n=t or c
aacattcttacaactccagtcaagtttttcctccatataagtaggaagcaacgaagacagncaaggtataatgttttagtttccctgtactgttaacactgctgcttcatgttcccgtctc

SEQ ID NO: 43146 - DNA, 121 bp, Artificial Sequence
  Synthesized
  misc_feature (61): n=t or c
acaacataccatcaagaacccaagaactttcttcagtctggttctttcctaataaaaggcnccttccctgcccccacacatcagagtttaggttaatacaccagagattaatttcttaaat

SEQ ID NO: 43147 - DNA, 121 bp, Artificial Sequence
  Synthesized
  misc_feature (61): n=a or g
atgcccatcattttttgactcttggagctggctctgctcttctcccattccctaaatttgnctccccacaccataactaaaattgaataaatctatttaaaaaaacgatcaataaaacctt

SEQ ID NO: 43148 - DNA, 121 bp, Artificial Sequence
  Synthesized
  misc_feature (61): n=t or c
aatgatttttcattattttctggcttcaagatcaactgggaaaagttggaggttctactgntttccagattttgctccgggaaatctgtactcatcttggagggtttttttcatgctgcca

SEQ ID NO: 43149 - DNA, 121 bp, Artificial Sequence
  Synthesized
  misc_feature (61): n=a or g
tcaactcagagaccaaggtttgccctaggaaatttgttagtctggggctgtagatcttgtntgttcttgctcttcacttgcatctaggcattccaaccagcacactgaacggcactctctc

SEQ ID NO: 43150 - DNA, 121 bp, Artificial Sequence
  Synthesized
  misc_feature (61): n=t or g
gttacattgcagcagtagttacaaacctgatctagtaaccaatttagtattttgtttccanattatacaaagatatgtgaacatttagttcttgatttcagatacagaatatgcattagat

SEQ ID NO: 43151 - DNA, 121 bp, Artificial Sequence
  Synthesized
  misc_feature (61): n=t or c
agtcacagagctttttgggctataatcattgcttagcttaagaaatgccaaaaataagaanggagcccatcttagaagataataacagtaacttctagttagtctgatcatatgtgtatga

SEQ ID NO: 43152 - DNA, 121 bp, Artificial Sequence
  Synthesized
  misc_feature (61): n=a or g
aaatgaaccttataatacagagtaattttccactttgaaggatggccatacaaactcattnagcatagcattaacattcaaggctttaacaatcaggatttttggggggggggactctcaa

SEQ ID NO: 43153 - DNA, 121 bp, Artificial Sequence
  Synthesized
  misc_feature (61): n=a or g
ttgatatccatggcagacctacagaatagtagacttttcagatgctcgagtgctatttgcncttctctgggtgctagaaatcctggcctcttgacagacacttcaacacagcaatttcccg

SEQ ID NO: 43154 - DNA, 121 bp, Artificial Sequence
  Synthesized
  misc_feature (61): n=t or c
attctgagaaagatattacagagctgtgtctgcaccaaaggtagcagatataactacatgncaaatcaaagcatttttacacatgcttgttacttagcaccatggtgtttacacaggaaat

SEQ ID NO: 43155 - DNA, 121 bp, Artificial Sequence
  Synthesized
  misc_feature (61): n=a or g
tactacacaaaaacccagagagcttattcctataaaaatctcctcttccaaagccactctngagggcatctgtgtgatgaagatcacgtgggagcaggactcaagtcaacctccattggtg

SEQ ID NO: 43156 - DNA, 121 bp, Artificial Sequence
  Synthesized
  misc_feature (61): n=t or c
agttggttcaccttttgcagaactgaagcataaatttttgtttctaattttttcagtacangtcatctatttcatcgtgtaggtggatttttatgtggtatgcttgattttgaaaatctgg

SEQ ID NO: 43157 - DNA, 121 bp, Artificial Sequence
  Synthesized
  misc_feature (61): n=a or g
tttttctgtattttattgctccttacaaatttctatcatagaacatttaatcattctgctntcattcactagtttccatctgcttcaggtaggaaagcaagtaaaggtgagctactttccc

SEQ ID NO: 43158 - DNA, 121 bp, Artificial Sequence
  Synthesized
  misc_feature (61): n=t or c
gcagcctctagctagagaaaatagctgttaattcctcagcaggatctgaacagggtaaaanaaatgggaaacgatgaaaaaccttcattatgctctacaagaaacttaaattccgtgcctt

SEQ ID NO: 43159 - DNA, 121 bp, Artificial Sequence
  Synthesized
  misc_feature (61): n=t or c
ttgcagaaaaatggggaccaagatcagaactcgttttgtagttcttcaccctgctaatganggaacgccttgtccaagtctggaagaagaaacagaatgtgaaccagataattgtgtctga

SEQ ID NO: 43160 - DNA, 121 bp, Artificial Sequence
  Synthesized
  misc_feature (61): n=t or c
gaaatatgtcaactaaaatagcttagaatctcctgtcatactgccactcatcatagacagnatctatacatatatcgtcactttgcatacagagccttcacaaacaaaagtgagttgtgag

SEQ ID NO: 43161 - DNA, 121 bp, Artificial Sequence
  Synthesized
  misc_feature (61): n=a or g
gtttctggcctgattttggacaaccctacaaggccatgtcccaccgttcccattggatctncatgcctactcctgcttctcccagagacgcagataccaaagctggcacatcaatcacatg

SEQ ID NO: 43162 - DNA, 121 bp, Artificial Sequence
  Synthesized
  misc_feature (61): n=a or g
tattctaagctgtagtatttactttaattgctaagtatttacttttattgctaagcatacnggcaggtgaaggcattatcatatggtccttttaatttacctttttttcttaatggtcacc

SEQ ID NO: 43163 - DNA, 121 bp, Artificial Sequence
  Synthesized
  misc_feature (61): n=t or c
gaagaacagcttggaatgattcagaagtaaaacatccttcctgatctcaaaagacttgtgnagacgtttctctttacgcacataggtaggtgcacaacctctccctgcctaggagatacac

SEQ ID NO: 43164 - DNA, 121 bp, Artificial Sequence
  Synthesized
  misc_feature (61): n=t or c
caataaagcaattctatcctaaatgcttaaattatatttatgaggagctctcactaaaggntgctcccacaatcacaaccaggagtgagatcaatagacccatcccacctattgtagggca

SEQ ID NO: 43165 - DNA, 121 bp, Artificial Sequence
  Synthesized
  misc_feature (61): n=c or g
tttacttgttcccaggaagtttgagccctcctcaaaacaaagctgaacactgatagaagcnagtggctgcagagttaaacaacggcggtttcgcttccagcggcccccccgacaccccggc

SEQ ID NO: 43166 - DNA, 121 bp, Artificial Sequence
  Synthesized
  misc_feature (61): n=a or g
ataaaacaaactacatataaatagcattttaattatacgtacatcaaaacctggctagagnaacaagatactgaaaacaaacattaaaaatgcagctgaaaacttaaagtgatatttaatg

SEQ ID NO: 43167 - DNA, 121 bp, Artificial Sequence
  Synthesized
  misc_feature (61): n=a or g
aacatcaggtctgtttaatgacatcaaagtgtacttccagttaaactatctgtagaacctnatgtgatgatttaaatgtgtgaagaattttatttccccttcagttgaatctaattcttat

SEQ ID NO: 43168 - DNA, 121 bp, Artificial Sequence
  Synthesized
  misc_feature (61): n=t or c
cccgagtactgcatctcttattgtctgaagtgcagaaaaagcccgaagctctgctcagacntttgaggagctgagactttcttttagctgtgcacgtgatcagagtgaaaacctgaccttc

SEQ ID NO: 43169 - DNA, 121 bp, Artificial Sequence
  Synthesized
  misc_feature (61): n=a or t
acacctcttgacatgctgccaagcttttgatgtcagtaaaattgccctgaatatgattgancctttgaagatgccccttgggttgttatcccacccaatcccaaacttgcggagtgactta

SEQ ID NO: 43170 - DNA, 121 bp, Artificial Sequence
  Synthesized
  misc_feature (61): n=a or g
ctgataactgaccaacaggagcagaggcctgcccacttaaatcatttttatccgatacagnacaagtacgacactgcaacaattctgtgcaatttccaacatatgggagcaggtacaatac

SEQ ID NO: 43171 - DNA, 121 bp, Artificial Sequence
  Synthesized
  misc_feature (61): n=a or c
ctcacactgaaacaagtctgttctcaggacttatactcaagcaccatcaggcaaacgtgangctgtgcaatgctaccttctcccttacaagcagagacccattgccctgctagttttctca

SEQ ID NO: 43172 - DNA, 121 bp, Artificial Sequence
  Synthesized
  misc_feature (61): n=t or c
aataaccattattcatagcaatagaaaatagtagaattgtgtccaaagatgtattatcagngtaagccagtatgatgagaggtaagcttttcatggtctggaggccactctggacacagta

SEQ ID NO: 43173 - DNA, 121 bp, Artificial Sequence
  Synthesized
  misc_feature (61): n=a or g
tatacgattacagaagttgtaatgtacaaacacttcaactctgacaacatccatcagtacntccacatcaaatattctgtaccaccaaaaacgtgcactggggaaatcctagtatattttg

SEQ ID NO: 43174 - DNA, 121 bp, Artificial Sequence
  Synthesized
  misc_feature (61): n=t or c
tgggaaacagttcatacatatctgcagaccaattaaataatctaattagaggcagtatgtnacaagttactctccaatcactgcaatgattggaagataagagggtcaaattaatccatca

SEQ ID NO: 43175 - DNA, 121 bp, Artificial Sequence
  Synthesized
  misc_feature (61): n=a or c
tccagtgaattacagttctgaatatttttaaggtagatgatgcagtagtgctaaattgaanaatttcttagattcttgcaagaaattcttggaatgtgtattttttgggctgctaattctg

SEQ ID NO: 43176 - DNA, 121 bp, Artificial Sequence
  Synthesized
  misc_feature (61): n=t or g
ctgagagcttgattgtactacagctgttggtagagaagtcttgtatcttcagctttaacanttcctcactgtactgcaaagtgtttttcccccgttcatttccacaaggtctctgtcattg

SEQ ID NO: 43177 - DNA, 121 bp, Artificial Sequence
  Synthesized
  misc_feature (61): n=t or c
ggtggcagtttattcacaacagtagttctctctttcttgcccatgcagaaacatgcctgcncatttcattcatcaaagttgctgcaaaatcttaataggagaaaagaggagtgctttccta

SEQ ID NO: 43178 - DNA, 121 bp, Artificial Sequence
  Synthesized
  misc_feature (61): n=t or g
taacagtgatttaacaatggcttttgcccttgtctaatggatctactccatatgtacaganctgcctatcattggctatatagaaaaatattaagatctgggaaagaagtacttgagtttt

SEQ ID NO: 43179 - DNA, 121 bp, Artificial Sequence
  Synthesized
  misc_feature (61): n=t or c
tcatattagctctcttaatttttcataatgtgcaggagtgacttagttgcatgttctaaangcgatttcttttttagattccataggaggtttatttttaatttcattttctctagggaaa

SEQ ID NO: 43180 - DNA, 121 bp, Artificial Sequence
  Synthesized
  misc_feature (61): n=t or c
agagttagacacgtatagtgaagcaaacttccttagagcagtaaaaaaagctattccatanttctaaattaataagagtggccgtgttttctagctgaagtataggagacaaaggctaagg

SEQ ID NO: 43181 - DNA, 121 bp, Artificial Sequence
  Synthesized
  misc_feature (61): n=a or g
tggtttaaacatttatatcagaatgttatatcacagcttggacactgtggaaccacagatnattattgcattccaaatagagtgcagaaacaccaccttaaggactgactttttaaattta

SEQ ID NO: 43182 - DNA, 121 bp, Artificial Sequence
  Synthesized
  misc_feature (61): n=t or c
ttagctgaaaaggggctgtgctatataatcagtgttggtttcctgtaggattgtggtttcntttcccaaacgctggttagtatgttctgtgtggttttgaacagaacaaacgtttttccat

SEQ ID NO: 43183 - DNA, 121 bp, Artificial Sequence
  Synthesized
  misc_feature (61): n=a or g
ttcctcttttataaagagaatgaaggaaaccacaactactgctaaagtccatttccaaatncttctgtaaattagcttgattttacaccatcagactaacttgtttagttacactgatgag

SEQ ID NO: 43184 - DNA, 121 bp, Artificial Sequence
  Synthesized
  misc_feature (61): n=t or g
taggaaaacggttcatctgcaggagatggttctgtagacctgaagttagtcatgtgagtgntatataccacatctgtcctgtagcatgatgttacagagatccgttttattccctggtagt

SEQ ID NO: 43185 - DNA, 121 bp, Artificial Sequence
  Synthesized
  misc_feature (61): n=a or t
gtgatagcagcattacagctatgcatgacacattttccataggccaagaaacttacagagntccaaactaatatctgatgaaattttaaggactgaagaacccaaattccagactacttta

SEQ ID NO: 43186 - DNA, 121 bp, Artificial Sequence
  Synthesized
  misc_feature (61): n=a or g
tctcagcatttattgcagcacatataaccattttcttctggaaaagcacatataaaacacnaaaatcgtactgctgtttcaatgaattaagtgcaattttgcataaacgaaactgctctgg

SEQ ID NO: 43187 - DNA, 121 bp, Artificial Sequence
  Synthesized
  misc_feature (61): n=c or g
ggtattgatctgtgaggttctgtgcttgttactagccagatgtcaagccattaatcatggncctctgagcctggtggtccagacaattttctatctatccagcagtttgttctttcagcac

SEQ ID NO: 43188 - DNA, 121 bp, Artificial Sequence
  Synthesized
  misc_feature (61): n=a or g
ggctttaacccctagtcttgttgctactagacagatgaccacaccattagcatcatatagnaatctctcagtagaagagacagagtggcaaaacagttgaaatatcaacaagatggagcag

SEQ ID NO: 43189 - DNA, 121 bp, Artificial Sequence
  Synthesized
  misc_feature (61): n=t or g
atctctacactcttcctggatcgcagtattcttacagcttttggtcttgtactggacatcncaattttgtttggaagccatggagacattttgcagctctccaaaactatgaatctgttgc

SEQ ID NO: 43190 - DNA, 121 bp, Artificial Sequence
  Synthesized
  misc_feature (61): n=t or c
catgggatgggtaagtgacagtttttgacaaataattttgagaaagcagctgaagggaatngttactggtgaagaaggaagtaggagagaagacaacacacaatggcagagtgaacaagat

SEQ ID NO: 43191 - DNA, 121 bp, Artificial Sequence
  Synthesized
  misc_feature (61): n=t or c
aattatgttagctgtctatgcataatgtttcctttctcatccagatgaacagaagtgccanatgtgagtgtgtgatctcaaggatttaagattcctggggaaattcagagacagagcattt

SEQ ID NO: 43192 - DNA, 121 bp, Artificial Sequence
  Synthesized
  misc_feature (61): n=c or g
ttagataatgctaatgccccagagatcttgcatgcacagtatctgaaaacgttagtgcaangttataccttatttaacacaactgaaaatgaaacaaacttcttgtgctttcttcctcata

SEQ ID NO: 43193 - DNA, 121 bp, Artificial Sequence
  Synthesized
  misc_feature (61): n=t or c
tctgagttacagaacttgtgggcagaaaaatcttgtgaccgtgcaattttgagattagatngagattaaaactctagattttgagattagttgatcatagaaaacaaaacgtcagatggtt

SEQ ID NO: 43194 - DNA, 121 bp, Artificial Sequence
  Synthesized
  misc_feature (61): n=t or c
gtggtatattgagattaattgttctgaagaaaacaaaaaagcagctgacaaggcatgatancaaagatatttcattggagtattgagaaaacataagcgctttttttatttctgggcgaaa

SEQ ID NO: 43195 - DNA, 121 bp, Artificial Sequence
  Synthesized
  misc_feature (61): n=a or g
ttaaaccaatttccattgtcagacgtgccaacctttagaatagatctagtattaaatcatngatgtctatggggagttcccttggattatttgatcaaattatgttctttaaagtatgctt

SEQ ID NO: 43196 - DNA, 121 bp, Artificial Sequence
  Synthesized
  misc_feature (61): n=a or g
ttcaggatgtggaggatgcttgtgcagaccaatgctgggggatacaaaaaatggagcacanatagataagacataaggaactgagggtcttccttagcatgaatccactcatcagaggtgt

SEQ ID NO: 43197 - DNA, 121 bp, Artificial Sequence
  Synthesized
  misc_feature (61): n=a or g
ctatatgaataggcatgatctataatgcataaaataagagggagttgtacagttatttccnaaagaagctataaaagcaaagcattctgatttttcaatacttttatgcacacacaaatct

SEQ ID NO: 43198 - DNA, 121 bp, Artificial Sequence
  Synthesized
  misc_feature (61): n=t or g
tggaagaaatgatggcttgaggtaaatgaaggaattgggtttaagcagttggaaataaganttgggttatttttaaaactgtgcatttaaatttcagaagttttggttatctgtgacctct

SEQ ID NO: 43199 - DNA, 121 bp, Artificial Sequence
  Synthesized
  misc_feature (61): n=t or g
ttacataccaaactcagcatcgggaaagtgtacagaagatattccattgtttgtaagtatnagctgttctaatctgaaatgtaatagatgtaatgattactgtaactggtacagaacattt

SEQ ID NO: 43200 - DNA, 121 bp, Artificial Sequence
  Synthesized
  misc_feature (61): n=t or g
tcagtccactcaaaggcagctgtaggatttggatacagcactcctcagtatgtgcagtttnctccctgaccaccctgtcctaaggggaacagttgttctcacagcctgtacctgctctggg

SEQ ID NO: 43201 - DNA, 121 bp, Artificial Sequence
  Synthesized
  misc_feature (61): n=t or c
ctccctgcaatgaaatgggctcgcagtcctcactccttggatactcagttatttttcaagngtcagggctgaaatgatttggaagagggtcagacacattcccaaatgactacaagaaagg

SEQ ID NO: 43202 - DNA, 121 bp, Artificial Sequence
  Synthesized
  misc_feature (61): n=t or c
caggagttacaggagttatttctgaacaagtttctttccaccctgaagcatctcttattangaaacatctcttattacaaaacatctcttattacttctctggtttttgggatttgtgatt

SEQ ID NO: 43203 - DNA, 121 bp, Artificial Sequence
  Synthesized
  misc_feature (61): n=a or g
gctgaaaaatctgctgggagaccaagaaaccagcagctaactgtctgctgccagcagaaantaggaagttacagaaataaaaatcagtttgatgatatctagtcacctttactccaggcac

SEQ ID NO: 43204 - DNA, 121 bp, Artificial Sequence
  Synthesized
  misc_feature (61): n=t or c
ccattcttgatcactttttttcttactgaagaggttcaactttagaacaccttcaaacttncttcatattcttcagctttgacgttatgattaaagaagaaacactgcattaccaaattag

SEQ ID NO: 43205 - DNA, 121 bp, Artificial Sequence
  Synthesized
  misc_feature (61): n=a or g
ttcaggacgaacctcaagcaatgtctggatgttaaatgtagtcataaacagagactaaacntaatttataaacatttttattatatgagaaatagttgctattttagagacatgtaaataa

SEQ ID NO: 43206 - DNA, 121 bp, Artificial Sequence
  Synthesized
  misc_feature (61): n=a or c
ttccaaagtgggcacaggcagtcagaaggatcagaacagagtacaagcaaatataatttgnagatatctaaggggacattataacaatgacacaaataagcataacaatacgttaacgaaa

SEQ ID NO: 43207 - DNA, 121 bp, Artificial Sequence
  Synthesized
  misc_feature (61): n=a or g
aggcaacaatctgagagtcacttggagccattcagatcagacccaagagtgtcatttcagntgggcttcctgggagtattgactaaaacttatctggagatgttcccattgatgcttccct

SEQ ID NO: 43208 - DNA, 121 bp, Artificial Sequence
  Synthesized
  misc_feature (61): n=t or c
aacttgacccagaacatgcttttcttatctagaaaaggaactctgtctttcctgttagtancatcatccgcagcatgccagtcactgcatcaagatgctgcctatgagtcactttgcaaac

SEQ ID NO: 43209 - DNA, 121 bp, Artificial Sequence
  Synthesized
  misc_feature (61): n=t or c
ttcacaaaaccttctctgcatcttaggacatctgtattttatttcttttgtgatctacacntacatatctgcatcaaaatccttttttcagctcagaaccaaatggatgttagcctttacc

SEQ ID NO: 43210 - DNA, 121 bp, Artificial Sequence
  Synthesized
  misc_feature (61): n=t or c
agtaagaagcctttactcgtctgtattattctgcaacagacgtttatacagacaacaaaangctcggtgcaggagatcttcctctttcattctctcacacatgctaaaaataagcacctac

SEQ ID NO: 43211 - DNA, 121 bp, Artificial Sequence
  Synthesized
  misc_feature (61): n=t or c
tcaggatgttgtgtatggacactcctccactatattaaaatgattatggattcaacccaanggtttaaatagagattttagctgtatcttacattaataactctttccattttatctcttc

SEQ ID NO: 43212 - DNA, 121 bp, Artificial Sequence
  Synthesized
  misc_feature (61): n=t or c
acccattctcagaaaagaacagcattaagaaatttttcaaaacatttctagaatgaaacanggctgaaaaaacaaaaccatatacaaatccagtgcattcctagtttagtcagttgatgca

SEQ ID NO: 43213 - DNA, 121 bp, Artificial Sequence
  Synthesized
  misc_feature (61): n=a or g
agccaacttctggaaaacattgtattcttgtgttggtagaggacaacatgagtctcggtcnctttaaagacaaagcagtagtagttggttattagaacttcaataaatgcaaataatgcca

SEQ ID NO: 43214 - DNA, 121 bp, Artificial Sequence
  Synthesized
  misc_feature (61): n=a or g
gtgtatcatttaatttaacgcatattctaactccgtgaattttaaataaacttgaatattnccattcaatgcacatgaaaatatactttttttgctagcgctgaataagtcttcagtctta

SEQ ID NO: 43215 - DNA, 121 bp, Artificial Sequence
  Synthesized
  misc_feature (61): n=a or g
ggccaaggtgggcatatgaggtggaaggtgataaccatagccgctttcctttacctccccngtgttagccagatcctatttcctgtggctgtctgtcctgatggagagagtgggtgctggc

SEQ ID NO: 43216 - DNA, 121 bp, Artificial Sequence
  Synthesized
  misc_feature (61): n=a or g
agcagtgcatctgtagctaagcttgctgcatgtgtgccagggatatctgttgcttctccangtagcagtaataagtgagtatatgcattttgaagtactgtaataccatgtagttgaacca

SEQ ID NO: 43217 - DNA, 121 bp, Artificial Sequence
  Synthesized
  misc_feature (61): n=t or c
tgaatattttgatttttaaagctcatgcatgaactcacctgaaaagtcagaatattttagncatgctgtgattactcattcagtagcacaactataagttttcctcatgaacaacataagc

SEQ ID NO: 43218 - DNA, 121 bp, Artificial Sequence
  Synthesized
  misc_feature (61): n=t or c
tttggaattattaaatttgcggaggttgagagataattgctacttacattcttgacaaccngttcatctgatctggagaacaacaaaatgactaaagcacattattaagaagatgccagga

SEQ ID NO: 43219 - DNA, 121 bp, Artificial Sequence
  Synthesized
  misc_feature (61): n=c or g
ttttctgttcagaaggctctgacttctggagtgttcctgttgtgcccacagaagaagcaantcaagaacattagtggggctaaaaaagaaaagaattctggctgcaagagaatcaagaagc

SEQ ID NO: 43220 - DNA, 121 bp, Artificial Sequence
  Synthesized
  misc_feature (61): n=t or c
cagcagccattaggcgttcggaggagaaatcttcgtttctttcttctgcgaatgttggtancgcactgcctgggaggaagctctgtaacatttttcattagatattaaaaaaaaaaaaaaa

SEQ ID NO: 43221 - DNA, 121 bp, Artificial Sequence
  Synthesized
  misc_feature (61): n=a or g
aaggacctatcttgagaaggaaactgaaaatgaaagtacctcttaagtgacggcccacttncagcttgccacatttgcttcctaagggtttggcagacagcaagtgaagaatcgcatgagt

SEQ ID NO: 43222 - DNA, 121 bp, Artificial Sequence
  Synthesized
  misc_feature (61): n=a or g
ggttcccttcagtccctaagtgaagtccccagagggctcccagaaaagatagatcaagacngtatctccagccaataggatcgttgtcttatgatatcatattataatcataaactttatc

SEQ ID NO: 43223 - DNA, 121 bp, Artificial Sequence
  Synthesized
  misc_feature (61): n=a or c
cgctgcggccgcggggagcggagcggccccgtccgcgcgtcgcgatccgcgctccgcgcgngcttctgcacgcacctgaagggtttctttattttcaacttgttttgcccgaagattttag

SEQ ID NO: 43224 - DNA, 121 bp, Artificial Sequence
  Synthesized
  misc_feature (61): n=t or c
aggatatgccattacaggtggtgcctagtgggaaaaacagcagtgagctgagagaagggantggctgcatacaggtaacgctgcagcactttgtttatcatgaagatagcaaagaatgtgt

SEQ ID NO: 43225 - DNA, 121 bp, Artificial Sequence
  Synthesized
  misc_feature (61): n=t or c
gagatcccagaatactcagagaacatgttacgaagacatttctactttatttccctattcnttcccttgaagccaatggcctggatattttctactttttttttttttccactcttttttt

SEQ ID NO: 43226 - DNA, 121 bp, Artificial Sequence
  Synthesized
  misc_feature (61): n=a or g
ccggctccagcagccgtttcgtttcttcttcctatgggaattgggagaaaggggggagaangaagaggttctggttccccacgtacccacgcagagccccggctcctcttccccaatcccc

SEQ ID NO: 43227 - DNA, 121 bp, Artificial Sequence
  Synthesized
  misc_feature (61): n=a or c
agcaggtcatcgctgtgctggcgtacactgctgcaagtaggatgtgtacgctgttcaatgnagccacacgtcaggacggacgctcccaccaggactacctccactcataccacttcaagac

SEQ ID NO: 43228 - DNA, 121 bp, Artificial Sequence
  Synthesized
  misc_feature (61): n=c or g
ttccaacctaaaccactccaggattctataaggtttgacaaaacctcttcttcccagtatnccattgggtttacatgggggggaagatgaacagcatcaaccatcgcagcaggttggagaa

SEQ ID NO: 43229 - DNA, 121 bp, Artificial Sequence
  Synthesized
  misc_feature (61): n=t or c
agtgccatacacactcactgcagtgccatacacacccattgcagtgccataaaccatccantgcagtgccatacacacccactgcagtgccatacacacccattgcagtgccataaaccat

SEQ ID NO: 43230 - DNA, 121 bp, Artificial Sequence
  Synthesized
  misc_feature (61): n=t or g
ctctgcatttcatggaggattgggctgaatctgtttttcatcttataagtgttacggtatnaagagaattttcatgatcaaaaatattatttctttttttttttgggagggtggaggcagg

SEQ ID NO: 43231 - DNA, 121 bp, Artificial Sequence
  Synthesized
  misc_feature (61): n=a or g
gaacagctgaaggatccagaagatctgaaggatttcgtagaagggagaccacacctcaagnggctggcagcaaagtgtggaaatcggtattctggtttcagcaacattgccactggagagg

SEQ ID NO: 43232 - DNA, 121 bp, Artificial Sequence
  Synthesized
  misc_feature (61): n=a or t
gctaacttcactttacagccaccattaagatgggcaagaaaacttaatttctgtaatatgnaagtatagcaatgtataagccacagcattctgtagtattttcactaggttttacagtatt

SEQ ID NO: 43233 - DNA, 121 bp, Artificial Sequence
  Synthesized
  misc_feature (61): n=a or g
aacttgtgacatccagttccctcagtaacttcttgacatcatctacaatgaaagaaatacntgaggtctttcatctagcaagcaagtaaagaaacagattctgctccaagggaaatatact

SEQ ID NO: 43234 - DNA, 121 bp, Artificial Sequence
  Synthesized
  misc_feature (61): n=t or c
ggaggctgttcagtgtcttgattcaatcttcagagccatcagtgcaacaaacctctgatantttataagattttttcccactttcccttcccttcccttcccttcccttcccttcccttcc

SEQ ID NO: 43235 - DNA, 121 bp, Artificial Sequence
  Synthesized
  misc_feature (61): n=c or g
tgcagtctgcaggcagcccttaggctgggctgaagcctgcccatttctcaataactactanatatgacccagcttattaaaatgtgtttttttaaatctgctccagtgatctgccctgcta

SEQ ID NO: 43236 - DNA, 121 bp, Artificial Sequence
  Synthesized
  misc_feature (61): n=a or c
tcgccgcggggccgcgttccgtgtgtggctcagcgtttgcttttcttcgagatcaaacttnagcttgtaaagccgtggcttgttctcttctagaggagccattttgatcgagttcatcatg

SEQ ID NO: 43237 - DNA, 121 bp, Artificial Sequence
  Synthesized
  misc_feature (61): n=t or c
ttgctatgtttcgttgatctccattcaacctctccaatttttccagcaaaggagaggacanctaacttcactgaaaacaggcctgtgtttttgcaacctattatagccattttagaagtat

SEQ ID NO: 43238 - DNA, 121 bp, Artificial Sequence
  Synthesized
  misc_feature (61): n=a or g
gaggtttacattacttttatagagggtttgggctatattttagatttactcagtgcttacngagccaagcagtggtgtggcagatggaatatatttgccacctctaaagagcccgagctac

SEQ ID NO: 43239 - DNA, 121 bp, Artificial Sequence
  Synthesized
  misc_feature (61): n=a or t
cattcatcccactgaaattcaccagtgatgttcctgtgagttatctctgtgtcttaatgtnactcctaccctttgaatgagtcttacccacaaaatgtatacgtgtcatatctgacaggga

SEQ ID NO: 43240 - DNA, 121 bp, Artificial Sequence
  Synthesized
  misc_feature (61): n=t or g
actgagactgctagaagaactgatctttcagttctaagtccagaagaaaaaacagcgacanaacacatacagcagtagtagtatgtcatcacacacaacttaagcaccaagagctcacaga

SEQ ID NO: 43241 - DNA, 121 bp, Artificial Sequence
  Synthesized
  misc_feature (61): n=t or c
atgttgatggcaaggttctgggtgtatgtcttcctgtaaccacgtgaattttttaaaagtngtcccatgattttcttggtttctgacagaaacacaaactaataaaaatacgggctgtttt

SEQ ID NO: 43242 - DNA, 121 bp, Artificial Sequence
  Synthesized
  misc_feature (61): n=t or g
cctgacagatacaagcattagtttttattgaagagattttcaggaaaaatctatagaaaanagattattgttagaacactttcttcttatggttctgtaaggtcaaagcttcttaaaaatc

SEQ ID NO: 43243 - DNA, 121 bp, Artificial Sequence
  Synthesized
  misc_feature (61): n=t or c
gttttagcaaaactaaacagtcaaaataggaatggaaagtaaaactatagtatctggccanatctgaacaaggtgtcctgccagactttgcagatatgatgatgtttctggagaaaaggtg

SEQ ID NO: 43244 - DNA, 121 bp, Artificial Sequence
  Synthesized
  misc_feature (61): n=a or g
cccctctctgtcttcaccctttcctccccacacacacgggcgtgttttagccttgtgaagnaagaggcccgaggctctctccaaataagggtcttccaaaacgtgaataaatcccccaaat

SEQ ID NO: 43245 - DNA, 121 bp, Artificial Sequence
  Synthesized
  misc_feature (61): n=t or c
gactgtccctgtaatgtcattgggaaaacctacaggagactgaacaatattttaaaataanacttgacacacctgtgtcccaaacactgctttcctcagaaagttgcacagcactaccttc

SEQ ID NO: 43246 - DNA, 121 bp, Artificial Sequence
  Synthesized
  misc_feature (61): n=a or c
aaaatatatatatatgtatttgtgtattagagaggttgttttgttggaacattaaaaggantaagattgtgtttattggtccatagcggtagaacagatatttaatttcactaaggccagt

SEQ ID NO: 43247 - DNA, 121 bp, Artificial Sequence
  Synthesized
  misc_feature (61): n=a or t
gtttaagcaaacctgcagttttttttttttcccgcatctatatactgtaaattgtaaaaangtttatttattatgtggtacctttggaatagtaagggttacatgtctaagaggggagtgc

SEQ ID NO: 43248 - DNA, 121 bp, Artificial Sequence
  Synthesized
  misc_feature (61): n=a or g
tgtgcacagttattatcttgttgggatcacagatatgtgataggattgtttatgtaactgnagtgtttacaggatggatacaggctctttaggaagaacacactgagaagatggtgagggg

SEQ ID NO: 43249 - DNA, 121 bp, Artificial Sequence
  Synthesized
  misc_feature (61): n=c or g
agcctaaacacactacataattgcaagagatgacaaggaaagccacagtctttgtagaagnattaagtcaaattaactgctgcttgctacagaaagaaatttaaaatctttagagtatgtc

SEQ ID NO: 43250 - DNA, 121 bp, Artificial Sequence
  Synthesized
  misc_feature (61): n=a or g
gtgaagaagtcattaaatgtctgctttgtcaatgttcctattagagaagcaattgtcctcntcaagtaatggacaaatgttatccctggtcctccttttgctgttgatatattttaattta

SEQ ID NO: 43251 - DNA, 121 bp, Artificial Sequence
  Synthesized
  misc_feature (61): n=t or g
aggaacaggattaaactggcatcttaagcggttcaaaaatgtaaaaacatcactattgttnaactccttactgcttaactccttatttgttccttatcaatatctgactaagttgtttaaa

SEQ ID NO: 43252 - DNA, 121 bp, Artificial Sequence
  Synthesized
  misc_feature (61): n=a or t
tttatctctatatagattgtgtgataaatggtatacaatataaaattgtactgtactactnataggactgactatctcaagacaatctcctttattgtacaagcatttatactgatgtgtc

SEQ ID NO: 43253 - DNA, 121 bp, Artificial Sequence
  Synthesized
  misc_feature (61): n=t or c
aaactataaaaaataaagacatggaaacttagacaataaatttctggattatcatattaantaaaccaacaatatgatgaaactctggctatttgatcatgtacaggtagaattcatgttg

SEQ ID NO: 43254 - DNA, 121 bp, Artificial Sequence
  Synthesized
  misc_feature (61): n=t or c
ctttctaattataaacctgtaaaatatcatcctaactacactgctctgctaactgtacatntgttgatcaaacatatggcaacggcaaaaaaaaatctcatctccctttgagacttgtcct

SEQ ID NO: 43255 - DNA, 121 bp, Artificial Sequence
  Synthesized
  misc_feature (61): n=t or c
tagaactattcaatcctcagtgaaatgtagaaatataaattaaaacagttgaaaaataaantaaatgttgaaaagttatggattgttattgcatattgccatgcagactgactaatttaca

SEQ ID NO: 43256 - DNA, 121 bp, Artificial Sequence
  Synthesized
  misc_feature (61): n=t or c
actgcagatgcagtgtttggagtgcaggagagggggaaaaaattgctcccctcaaactgantcctatgcacttactaataaagttcaatgtgaggttaaacttccaccacaagagcacatg

SEQ ID NO: 43257 - DNA, 121 bp, Artificial Sequence
  Synthesized
  misc_feature (61): n=t or c
tgggaatatttcttccccatcccacatggcagactatttccatgaactagataaagacatnttgatcacaaaggagcaacagctagctgtgccactgtggcgtggccattattgaatgcgt

SEQ ID NO: 43258 - DNA, 121 bp, Artificial Sequence
  Synthesized
  misc_feature (61): n=a or c
tcaatctgatgggcttgtttcattatggtgaatttgcagaaatttagagaactaaataaanaaatgctttcagcagctgattctttaacccagcattggatatgactttttctgaagaagc

SEQ ID NO: 43259 - DNA, 121 bp, Artificial Sequence
  Synthesized
  misc_feature (61): n=a or g
gatagcataaccagggggccactccctctacgcaactgacatgaagcaagatggctgtaangggtaagacagttcaaaaatatagataaagctcatttggaaatatggttcatttgcctga

SEQ ID NO: 43260 - DNA, 121 bp, Artificial Sequence
  Synthesized
  misc_feature (61): n=t or c
agacagaggatttactgggagcaaaagcagtagctgggtcatgtttttgaagaggaagacntgtacagctctcctagaaaactggctggaaagatggaaacaaggatggaggaaccaccag

SEQ ID NO: 43261 - DNA, 121 bp, Artificial Sequence
  Synthesized
  misc_feature (61): n=a or g
ttaataatgttttataggaagtcattttgctgagtggctcttgagatgcgaatgctttagnggctgagtggctggaagtgctctgcctgtgagaggagtggcgagaagtgctgcagatggg

SEQ ID NO: 43262 - DNA, 121 bp, Artificial Sequence
  Synthesized
  misc_feature (61): n=t or c
catcagcagcagctacaaatgaagcactggagacaaaccaaccctgatagttcctccattnccttgaagggagatgcctgaacaccaactacgccgtgctgaaggccctgctgtttgacca

SEQ ID NO: 43263 - DNA, 121 bp, Artificial Sequence
  Synthesized
  misc_feature (61): n=t or c
acaatcccaaacccgtatgtagacacatacaatccgggtacagctcccatcctcaccgagngcctgcaatcccagccaggcaggcaagatttctgcagagctcatggtcaatctttgaggc

SEQ ID NO: 43264 - DNA, 121 bp, Artificial Sequence
  Synthesized
  misc_feature (61): n=t or c
caccatttctgctaagctacgtccctcggtgccgcatttattcccaaactgaccaacatantgcaagaggagcgttatagttttgaggctctcgtgacagatgcatgccaacctctgtgct

SEQ ID NO: 43265 - DNA, 121 bp, Artificial Sequence
  Synthesized
  misc_feature (61): n=a or g
cattggcacaccaggaatgagagcctttgatatctgctggaggggagggagaacagacacngtgtcctcaaccgaccctgttcctggctacctctgtgacagctgttctgcaagtctccac

SEQ ID NO: 43266 - DNA, 121 bp, Artificial Sequence
  Synthesized
  misc_feature (61): n=a or c
gtggtaagagtatatgatctgagcgcctgcaagctttgtagaaatggagtggagcacaaanacctaaattaattgacccagtagcaggagctctgcaggtccctgctctcttcaaccagtt

SEQ ID NO: 43267 - DNA, 121 bp, Artificial Sequence
  Synthesized
  misc_feature (61): n=a or t
ccttgtttcctcctgacagatagttttctaaagtccacctttcttcccattccagaatacntaaactaaccttggtgtgctatcatgttgtgaaagagtttttttccctctcatgtcatgt

SEQ ID NO: 43268 - DNA, 121 bp, Artificial Sequence
  Synthesized
  misc_feature (61): n=a or c
ctagagcataacttgctaaattctccttgcagttcttctatctgagctaaaggagaactcnactaacagcttatttgtgcaattaaagtactcccattaattttaggtgctatgattaagg

SEQ ID NO: 43269 - DNA, 121 bp, Artificial Sequence
  Synthesized
  misc_feature (61): n=a or g
acccctcccatactttaaatgcatgttccaaccaccctcacaggacataccttccgaacanatccacccaagcggtcactctcacttaaaaactgccgacagagtcaaagcatcaaataca

SEQ ID NO: 43270 - DNA, 121 bp, Artificial Sequence
  Synthesized
  misc_feature (61): n=a or g
agatactcaatacaaggctgaaggtggcagtttcctggattgcattattacctgtgacaanacatggtgccaccactatgacctagcgtcatagtggcaccgtgtgaattccccatcaaag

SEQ ID NO: 43271 - DNA, 121 bp, Artificial Sequence
  Synthesized
  misc_feature (61): n=a or g
tctgaaccatgagaggactgctccctcaaaaagcatgtcctactcccatcagatgagcacntgccatgatttcttgcattatacaagataagtttaattgtcttttcagggtttggaatgt

SEQ ID NO: 43272 - DNA, 121 bp, Artificial Sequence
  Synthesized
  misc_feature (61): n=a or g
tcttacagtatccttctggacaaaatgtccagcatacagctaaccaagtacataatatggnctgggttcaaatggttatagtaagctgagttacatcaggcaccccagggatctattttag

SEQ ID NO: 43273 - DNA, 121 bp, Artificial Sequence
  Synthesized
  misc_feature (61): n=a or t
tcctcttacagttgccttctgtggctgcacttcagaatatcacctgtttactctgctccantcagggtgtacaaaaaaacgcaccagtttgtgtctggcacagccactgctgcatgcagca

SEQ ID NO: 43274 - DNA, 121 bp, Artificial Sequence
  Synthesized
  misc_feature (61): n=t or c
agcaatgtgctgcaggagggtagggcctgaaatggaggagtcaggtgggatctgtggtagnggggagctgtggaggaagcgggagcaaagagagaagattgaagaacccaatctgtaaagg

SEQ ID NO: 43275 - DNA, 121 bp, Artificial Sequence
  Synthesized
  misc_feature (61): n=t or c
tgtcccttagcttagggcaacagtcgctagcctcagttaaattcttttttatttatgtaanttgattgggtgttttaaatcagagacaattgattaacatcctttgcatgctatctatgtg

SEQ ID NO: 43276 - DNA, 121 bp, Artificial Sequence
  Synthesized
  misc_feature (61): n=t or c
aacaaaacaacgaacgtgctcatattaaaaaattcactgattttagaataggaaacttaantgacagtaataaaatccaggctttatgtccttgactgtgcagcatccaaacctagtcata

SEQ ID NO: 43277 - DNA, 121 bp, Artificial Sequence
  Synthesized
  misc_feature (61): n=a or g
aagacatgcaatatagctgtattaattacctaataaattcatccatcttcccaatagtggnttgatttttaaattactggtagacaaagggtagttttgtattgaatgcataggctttaag

SEQ ID NO: 43278 - DNA, 121 bp, Artificial Sequence
  Synthesized
  misc_feature (61): n=t or c
cagacttgcttgggagatttcctgacacagcatttctccagctccaatatgacagagatgntagaatttctattccctgaataaaaatgccgatttgatgctacatttcagttttgttctg

SEQ ID NO: 43279 - DNA, 121 bp, Artificial Sequence
  Synthesized
  misc_feature (61): n=t or c
attaaaagttgcacagtggcaattcatctctgctacttagagtctggagctctgacctccnttcatttgcagtgaagtctgcatggtactcagctcttttctgttcctcataattgaattt

SEQ ID NO: 43280 - DNA, 121 bp, Artificial Sequence
  Synthesized
  misc_feature (61): n=a or t
agaacggttcagagagcattatgaaaggtttgaagggtgtgacaatacttcctaaaaaaanaataattatgtggagaaaaactataaaatgattccaacactgctggtagtagctcagtga

SEQ ID NO: 43281 - DNA, 121 bp, Artificial Sequence
  Synthesized
  misc_feature (61): n=t or c
atgtttttctctcctccatggaacttatgcacatctcctgctagtgaaagaagttggaaanggcagctttgacaaaaaacttttctcttgtgggtattactatcaaaaataggtcagtaat

SEQ ID NO: 43282 - DNA, 121 bp, Artificial Sequence
  Synthesized
  misc_feature (61): n=t or c
tcatttgcttcattcgttagcctattgttatccttaattcaattccagatttcatgtcgangtggcctacaaaaagatattttctcttcatacctctgtctcgcttccctcctttggtgca

SEQ ID NO: 43283 - DNA, 121 bp, Artificial Sequence
  Synthesized
  misc_feature (61): n=a or g
tgcatacagtccttaaaacttttcaaagtagatacgttctgtttcttccccttttttgggnggaaggtggtatagcatggaaatacttttaggcttttgacagactacagtacaattatct

SEQ ID NO: 43284 - DNA, 121 bp, Artificial Sequence
  Synthesized
  misc_feature (61): n=a or g
ttgatccaatttttattggtgaggggaatgagggagcagtgtggtggagtccagctgtccntcagtgtgaaaccaccgtaacatatcaaggaaactgcttttccattggtttgaatgcagt

SEQ ID NO: 43285 - DNA, 121 bp, Artificial Sequence
  Synthesized
  misc_feature (61): n=a or g
acagacggttgctgttggtgtcatcaaggccgtcgacaagaaggctggtggagccggcaangtcacaaagtctgctcagaaggcccagaaggctaaatgaaaattctgtacatcagctgcc

SEQ ID NO: 43286 - DNA, 121 bp, Artificial Sequence
  Synthesized
  misc_feature (61): n=t or c
agctgtatttgtctttcagaagttgttttcagtggctctccatataagctcttgtcccctnataagactttcacaatcatacaaataagttatatctaactgttttatagttaatatcctt

SEQ ID NO: 43287 - DNA, 121 bp, Artificial Sequence
  Synthesized
  misc_feature (61): n=t or g
atatctctgtattagcaaactgatatttctcagcagtatgccttttccttctgaagttgcnccttcaacttgcatctaacttcctattattatgcattgtgtggcttttccacagtgcttt

SEQ ID NO: 43288 - DNA, 121 bp, Artificial Sequence
  Synthesized
  misc_feature (61): n=t or c
tagcagaagttgattgtcttattcgttttccctaaagttcagaaactattaatctcaccanttcctactctgtttctaaccaaaattcagcattttatttaattagaaaaggacgggagag

SEQ ID NO: 43289 - DNA, 121 bp, Artificial Sequence
  Synthesized
  misc_feature (61): n=a or g
atgtgaattacttttcagtgcgatgggtactgctaagtgggataaagtgccctgtggcacnctgctcccagctagcaggctctgattctcaacatgactacatggctagcactcacttatg

SEQ ID NO: 43290 - DNA, 121 bp, Artificial Sequence
  Synthesized
  misc_feature (61): n=a or c
aattaacacaactgcttaaaaaaaaaaaaaaaagaggcaaatagaagcctgtggttcaccnttgacaaatggatgttcctctttttgctgtatagccgtccagatgaaggctacttgctga

SEQ ID NO: 43291 - DNA, 121 bp, Artificial Sequence
  Synthesized
  misc_feature (61): n=a or g
ttagatgaatcccaacccatcttcttctgtttctagacagaggccatggagaggaacggcnctgcccgtccccagacgccagaccccacgcatcacttccacgtagcgctgctggatcagc

SEQ ID NO: 43292 - DNA, 121 bp, Artificial Sequence
  Synthesized
  misc_feature (61): n=t or c
agcaggggaggggaggaagaactttcagggatcactcctgacctcaactgttgttaacagngtgacaatcacagaattacacatattagttaatgagtttattttccctcttctcttgtac

SEQ ID NO: 43293 - DNA, 121 bp, Artificial Sequence
  Synthesized
  misc_feature (61): n=t or g
agacataatatgaaaacatgatcaaaaaggagtcacatctttccagttctcatatatatanttcttattcatagctactgaataggaaaggaatacagttaccttggataggataaaaata

SEQ ID NO: 43294 - DNA, 121 bp, Artificial Sequence
  Synthesized
  misc_feature (61): n=a or c
atggggcaggcaccaggccagattgcaggctgtgccaggctgcacgaagcctgcaggtatngggttggatgtaccttctctagtgtttctctaccgtcagtctctatttgctccatttcat

SEQ ID NO: 43295 - DNA, 121 bp, Artificial Sequence
  Synthesized
  misc_feature (61): n=t or g
cttcatggccatttacagggatgagctgttaggatttattgggatcctgggctgagattcncctgtgctgtggaatgggcagggttagggtccactgatggctctggaggaggaacctcgt

SEQ ID NO: 43296 - DNA, 121 bp, Artificial Sequence
  Synthesized
  misc_feature (61): n=a or g
aaagtgctcatttttaatggaaaggataaacaaccatcaggagagccggaccatcacacgncagattccccaccgtgtgaaatctcaaaatggaggggaggtgtctgcatctcagccaggt

SEQ ID NO: 43297 - DNA, 121 bp, Artificial Sequence
  Synthesized
  misc_feature (61): n=a or t
ggaaaacagaacttatttcttatttcttgcgaatccaatgatgaatttgcagtgcccaacncatccaactgctttgttccacctcgatcttcaatgaggaccttattcaaatcacactgag

SEQ ID NO: 43298 - DNA, 121 bp, Artificial Sequence
  Synthesized
  misc_feature (61): n=t or c
gttgcatgaaacaccctgatactatcaggtacccttcattctatctcctcctgcagttagnagattcttcagcaaacagtgatctggtagaaagctaacccagaaagacaggacaggacag

SEQ ID NO: 43299 - DNA, 121 bp, Artificial Sequence
  Synthesized
  misc_feature (61): n=t or c
ccaattgctgactcattgtgacttgcaagttttgcttccccccctttactgtgagcaaccnagtccataattaagtgaatgccgttctgaaacaattctaaagaaatatgttccatatcaa

SEQ ID NO: 43300 - DNA, 121 bp, Artificial Sequence
  Synthesized
  misc_feature (61): n=t or c
attgttccagtatctacaccatgtgaactgagtgcagttagctaaatatctcttccataanacctcatgaaattcctaagtccatgttcggtttaaacttggagttttcaacttcattaat

SEQ ID NO: 43301 - DNA, 121 bp, Artificial Sequence
  Synthesized
  misc_feature (61): n=a or g
cttttcccaatttaaatgggaaattatttttcaacaggtttgaactcctctggattatgtnttttggctgaaaaaaagtgcattttagatcttctaccaaaagatcaccctaccaaaaggc

SEQ ID NO: 43302 - DNA, 121 bp, Artificial Sequence
  Synthesized
  misc_feature (61): n=a or g
tggatgctccagtgtatggatgtgaacatagttttgcctgttgagcagctttatagtacantaaattgtcagattcattggctgttatattcctggttgtacccaggtaatacaggctgga

SEQ ID NO: 43303 - DNA, 121 bp, Artificial Sequence
  Synthesized
  misc_feature (61): n=t or g
agatagagtcaaaaagactgtgaaaccaagatgagaaaaaggttagtggtggagtaagatntgaacagtgaggggtaaaattggactgcagagctgcgagatggattaggagagatcaaag

SEQ ID NO: 43304 - DNA, 121 bp, Artificial Sequence
  Synthesized
  misc_feature (61): n=t or c
ctgactaagctacaagcttgaagttccagagttgagccagagaagaaggcaacctttattngcagtacgataacaccaggacccttaccactttgaagaccataaaacacattgccagtct

SEQ ID NO: 43305 - DNA, 121 bp, Artificial Sequence
  Synthesized
  misc_feature (61): n=t or c
gggcaggaatcccctcctatatgaaacctgtttggagtgtgggtttttcatgccagaaccnggtttgccattattgaaactccacagcgaggcacctactagctttgtccctatatttaca

SEQ ID NO: 43306 - DNA, 121 bp, Artificial Sequence
  Synthesized
  misc_feature (61): n=t or c
agagtgcagactcaatcttggaattgctaactggagggagggagagttaaagccagatgancaacatttaaaaatttcactttcatttgtaacttcacaccaaacacaaagaaatgcagca

SEQ ID NO: 43307 - DNA, 121 bp, Artificial Sequence
  Synthesized
  misc_feature (61): n=t or c
tgtgtttcccaaggtgattaaaatgctttgcagagattattttaaggatgttgtctggtancagcatttttgagacaaacactatgaaaaaaaagcagcgttagaagtgtttctattctgt

SEQ ID NO: 43308 - DNA, 121 bp, Artificial Sequence
  Synthesized
  misc_feature (61): n=t or c
cctggttttgttaggaattttcaccaaaggacagaaagaagaaagcttttattttctgagnaaaattcatattctcataaacacacaagttttacacacagaacagctaagtttcagtaac

SEQ ID NO: 43309 - DNA, 121 bp, Artificial Sequence
  Synthesized
  misc_feature (61): n=a or t
tttgacacagatcatctggaaatttatatgtgaagatttttcaacatgtgttccatgtccnagagattccattcctgaagtgaagaatggttaccataatgtcaatttagagcagattagc

SEQ ID NO: 43310 - DNA, 121 bp, Artificial Sequence
  Synthesized
  misc_feature (61): n=a or g
caaagaaagaaaagatgggtgggtatatcaatacatttaggtatacacttaggtgcagctncagtgtgtatgtctcagctgtgtaaccaagaggggagacgatctggaggactggatgctg

SEQ ID NO: 43311 - DNA, 121 bp, Artificial Sequence
  Synthesized
  misc_feature (61): n=a or c
aatataatataatcattcttttttaagaatgcaataattatgttttaagtgtccttttatntgtgtcccattctcaccatttgtatacttctaactcttcttttttcattgcttcatttct

SEQ ID NO: 43312 - DNA, 121 bp, Artificial Sequence
  Synthesized
  misc_feature (61): n=t or c
gtgtacagatttctcttaaaatacttagaaagctactgactgatttgaagctaattgaagntatttttaaggtcagatctaaggttattaaaaaacaaaacaaaaacacatcctgaaagaa

SEQ ID NO: 43313 - DNA, 121 bp, Artificial Sequence
  Synthesized
  misc_feature (61): n=a or t
ttattcacttacctgagattatgtaaattgcagctggactaagagcaggaagggtcatttncttgaataaaattagcagatacttaatactaagacacatttacacccatgctgctcattt

SEQ ID NO: 43314 - DNA, 121 bp, Artificial Sequence
  Synthesized
  misc_feature (61): n=t or g
attgtgcaaaacctcatttccagtgacttattgtctgttcctgtttgtagcacataacttnacttgttcatttggatgatttatcttagactttctgcttgttacagtaactattaaggat

SEQ ID NO: 43315 - DNA, 121 bp, Artificial Sequence
  Synthesized
  misc_feature (61): n=t or c
aacaacaatttgattggttatcaattttatagcactgagaacctggctgacagtcttaggntttctccttagaatgaccagcaagaagaagggttttcttgcccctgtgcaaattcaactg

SEQ ID NO: 43316 - DNA, 121 bp, Artificial Sequence
  Synthesized
  misc_feature (61): n=c or g
tacctgaatattctgcttactcatttttctcaacctgacaggagaaagatttgtggaaatnaacaggttattaggtatagagtctagaactcaggagtaaaactacagtatcttcccagtt

SEQ ID NO: 43317 - DNA, 121 bp, Artificial Sequence
  Synthesized
  misc_feature (61): n=t or c
gcacattcaggatggtctgtaagtaggatacttcaagtcatttcattgttttcctaatganaaatttaacactgagaacaaaatacagaagaacatgcaatatttgcaagtattatttctg

SEQ ID NO: 43318 - DNA, 121 bp, Artificial Sequence
  Synthesized
  misc_feature (61): n=a or g
gctgcctcctaatgatttcattgcggccgtgatttccagtggaacttcagtccgcaaagcntttaaaggcagagaactttcacaatttctttttctacgcagagctaatttagttctgcag

SEQ ID NO: 43319 - DNA, 121 bp, Artificial Sequence
  Synthesized
  misc_feature (61): n=t or c
cttggagatgctgagtaggctgcgtctgtgcaggtacacggccagaagcccgtttcaggtngctgttacccaaattcagggctgccatgtaaacgaatgaggggagcgggcagcgcggggg

SEQ ID NO: 43320 - DNA, 121 bp, Artificial Sequence
  Synthesized
  misc_feature (61): n=a or c
cttccaagagtcttttcaaaactttcatgagatatgttttgcaggaatatatattacaggnaaaaaaaatggatctttgtgcttacgtgttgaaaaaaatgctatgagcctcttaattttc

SEQ ID NO: 43321 - DNA, 121 bp, Artificial Sequence
  Synthesized
  misc_feature (61): n=t or g
aacccctccagggccttttctcattagtaaacttatggcattaggacaaagaaacagaagnccagactccttctgtttctttgttttcctggctgtcaatcaggaatgatttgtctgctag

SEQ ID NO: 43322 - DNA, 121 bp, Artificial Sequence
  Synthesized
  misc_feature (61): n=a or g
atttccaggtcttggatctgtctacagccaactgaaaaatacagtacagaatgagtagctntattgtacagagaaacaaaacaggtgtctgatatgatccatataacacctcaagcaaaag

SEQ ID NO: 43323 - DNA, 121 bp, Artificial Sequence
  Synthesized
  misc_feature (61): n=a or t
gttgtttattcatcaagagcagcaaaaaaacaaacaggacctggagatcagttcctaaagngccaggaacagccaccccttcaacaccaaaatatttttaacatctagaggagtttgaaat

SEQ ID NO: 43324 - DNA, 121 bp, Artificial Sequence
  Synthesized
  misc_feature (61): n=a or c
atccagaaaagaatttactcagtcctgcttgactatggctcaaatggcttatacctgatantgatgaaattaggactcctgaagtgggaggcagtacctacagtgttcacaatattatact

SEQ ID NO: 43325 - DNA, 121 bp, Artificial Sequence
  Synthesized
  misc_feature (61): n=a or g
tgggcccagagtatccacagagccttgggtggccttgttggagcgtgggtgagagctatcnttgcacctggttccatatgagatgtgtatgcaaggggaaaaagctcagattgaaagcagt

SEQ ID NO: 43326 - DNA, 121 bp, Artificial Sequence
  Synthesized
  misc_feature (61): n=a or g
tagccgtgttgtcatgtaattgtgctgaagagtatggcaaagtctgactcaatatttagtnaggttgaaaccgtagttctgggttctttaatggatctgtcttcactgaggttgtatcagg

SEQ ID NO: 43327 - DNA, 121 bp, Artificial Sequence
  Synthesized
  misc_feature (61): n=a or c
actgaagccttagcctcacgttttggtgatgctacatttccaaacgagataggctagcagntcagcagtttggagttatctaccagcacagtccacgtgctttgtgaagcagataagttta

SEQ ID NO: 43328 - DNA, 121 bp, Artificial Sequence
  Synthesized
  misc_feature (61): n=t or g
ccttgttttttatttagttattccctcctctgcagtggatatagagataacatttaaggtnttttttttctgtggagatacatctcaaagtacgctgctccttcatctttttacaatagct

SEQ ID NO: 43329 - DNA, 121 bp, Artificial Sequence
  Synthesized
  misc_feature (61): n=t or c
cagccaaaagaaaaggaaagaataacctgggacctattatagaagtaagatctattttttntttttaggcaaattcgctaagattcacagatgtgttgctatcacaaaatagtgcttgcag

SEQ ID NO: 43330 - DNA, 121 bp, Artificial Sequence
  Synthesized
  misc_feature (61): n=a or g
tgtgcaaggggccggtggcatttctccagcacaagccatgctgttgtgcaggctgccgggncttgtgtctgcagtagcagaccccagcaagagcaccaaaggagggaggtgatccaggtgg

SEQ ID NO: 43331 - DNA, 121 bp, Artificial Sequence
  Synthesized
  misc_feature (61): n=a or c
tcatctgctcacgtaagctcaggggccatggatttgcatgagccccattccgtgtggcttncatagggcattcccttgctccatcacctacagtaccttctctgtgctgcagcctacacca

SEQ ID NO: 43332 - DNA, 121 bp, Artificial Sequence
  Synthesized
  misc_feature (61): n=a or g
caatggggaaaggcctattggtttctgtctgctcacatctgacgtagatggaatctggccntgtatctgtgaggtgtccctgggctccctctgttcacaacgcctcgccaccggtgctgcg

SEQ ID NO: 43333 - DNA, 121 bp, Artificial Sequence
  Synthesized
  misc_feature (61): n=t or c
atattcgttatgcacattttaacatgaattcactgttggttatgtgcccaagtactacggnttctgccccataactgactgacttgtgtagctcacccacgcattttccatttgaagtgtg

SEQ ID NO: 43334 - DNA, 121 bp, Artificial Sequence
  Synthesized
  misc_feature (61): n=a or g
ctctcctcaggggcctctgctctgcagccaccgaatctaagcaggcattgaacaaaggggnaaaaaaaaagggaggaatagagttttttcctcatcccctgcagaagccttggtgcagcac

SEQ ID NO: 43335 - DNA, 121 bp, Artificial Sequence
  Synthesized
  misc_feature (61): n=a or c
atttaaataatattccataaatgaaacaattcaggacacctaaataataatgatcttaaanctttccagatctttactagtacaacactgtctttgtttcccctgagatagatggaaagaa

SEQ ID NO: 43336 - DNA, 121 bp, Artificial Sequence
  Synthesized
  misc_feature (61): n=c or g
tgtggatgctccctgctctccacccatagcctgtgcatctcacagagcattgcctggaggntggcagcacctctggtggtgtgttctgagcaggtttggttgttggagtcagcagtgagca

SEQ ID NO: 43337 - DNA, 121 bp, Artificial Sequence
  Synthesized
  misc_feature (61): n=a or g
accatgaaatgaagagcatcttgatcagcttcatccatatgaactgacagattgtgaccanggaactgtgtgcagagctaaatatcagcttcagtgcactggaaacaatagtggcagcatt

SEQ ID NO: 43338 - DNA, 121 bp, Artificial Sequence
  Synthesized
  misc_feature (61): n=t or g
gttctgaagaggaacagctatggttactttgaaccatgaagatggccaccaagtgcagatngcttcctcattcagtcatgctgaatgatgatacatcagtcatggtccaaggaggacgccc

SEQ ID NO: 43339 - DNA, 121 bp, Artificial Sequence
  Synthesized
  misc_feature (61): n=t or c
aggggaaggcaacagagagtccctctggaaactgggctctgttttaagcccttggctgtgncttgtggtagtacagcctctgtcctgctcaggggcagtcctgccattcctcgtgtcctct

SEQ ID NO: 43340 - DNA, 121 bp, Artificial Sequence
  Synthesized
  misc_feature (61): n=t or c
agttaccatagcctgtcagggtctgcaatcacaaggaaagtacagccaggagtacaactgnaccacgtgtttcagtcacattgtgtgagaactgaaagtctctgttgcaccttgtagtcct

SEQ ID NO: 43341 - DNA, 121 bp, Artificial Sequence
  Synthesized
  misc_feature (61): n=a or g
ccactagaatattgtctcaagtgcaacactgtgtctagctacaactcctcacctgaaaaangcaaacatactgaagaagtaaacacactgcagaaacttttggacaaagcagggatctaga

SEQ ID NO: 43342 - DNA, 121 bp, Artificial Sequence
  Synthesized
  misc_feature (61): n=t or c
gagttatgaaaatgaggtttagaggtgataggtctgactggtttgtagaaaataaaaatancagctacagttaggcgctgctcaaccttgattcagagaacagcagaagaaaagctccatt

SEQ ID NO: 43343 - DNA, 121 bp, Artificial Sequence
  Synthesized
  misc_feature (61): n=t or c
tagctcattatcttaattattcttatttttattgtaattatgtcatccccatagcacctcngagtgacattcaccattcctatgtacaacttaagttcttcagctttccagttcaacatcc

SEQ ID NO: 43344 - DNA, 121 bp, Artificial Sequence
  Synthesized
  misc_feature (61): n=t or c
aaacctactgatttgatcttaaccacaaacgtccaaagcaagatgagatcctcatccaaancgaaagatattttatcctgtcttgtccccatccaattttaaaacattctggctgttaaga

SEQ ID NO: 43345 - DNA, 121 bp, Artificial Sequence
  Synthesized
  misc_feature (61): n=a or g
accagagatgttttcctgactatcagagtcctgaattgagctaatactctcaatagtcagntatctgtgacacctcaccattaatctactgactcatccatcctgctggtgtatacctgct

SEQ ID NO: 43346 - DNA, 121 bp, Artificial Sequence
  Synthesized
  misc_feature (61): n=a or g
aacaatcacttcctccaagctcagaaatggtctgttgctgcaggcaggatgttaagcaaangtgagaagaaagcagcatgaatgactgttgccatttaacttattgctcagcacagtgttc

SEQ ID NO: 43347 - DNA, 121 bp, Artificial Sequence
  Synthesized
  misc_feature (61): n=t or c
agcttttcctactgatgtgtgtgcttaacagggccagctcagtaagtctgaactgtaaaangtttcatgggtaaacctcgtctgaggaaagcccctctaatttattgtcaggctgaaaaat

SEQ ID NO: 43348 - DNA, 121 bp, Artificial Sequence
  Synthesized
  misc_feature (61): n=a or g
atccccatctgtagaacacggagacaatacctttccattacacggggcacagggagggtgnctcctaatgactgtaaagtgccttggagacggtgagcgcaattggcaatctaataattag

SEQ ID NO: 43349 - DNA, 121 bp, Artificial Sequence
  Synthesized
  misc_feature (61): n=a or g
cacaaatatctaactcacaggtcacctttttccattaaaatcttcctctggaagagctacnccttttcataggttttcatagattcaccttgatcagattcctcattcctccctccaagtg

SEQ ID NO: 43350 - DNA, 121 bp, Artificial Sequence
  Synthesized
  misc_feature (61): n=a or g
tgtgctctatttcttcagatcaggttcttcaagcaagtctttcattgccggtcttcctagnggaaaatgctcccggagcaaacagatgctcttggagaggctgggtggtctctgcccagct

SEQ ID NO: 43351 - DNA, 121 bp, Artificial Sequence
  Synthesized
  misc_feature (61): n=a or c
ttactgctttcactattgcagatgctattttaccttttccagatgaaggataaattggtcnaactttctcattgcctagagaagggattgattttaacttcattcttaatcagaggagagg

SEQ ID NO: 43352 - DNA, 121 bp, Artificial Sequence
  Synthesized
  misc_feature (61): n=a or t
acatcccctggaaacacagcaccacacaaggactcgtgcatcatgctttatctgcatgtcngactggaaagggaaactggacaaatgcatggaaaggaagaagtcgctgccccccagggag

SEQ ID NO: 43353 - DNA, 121 bp, Artificial Sequence
  Synthesized
  misc_feature (61): n=c or g
catctccgagcaactggaagagttgttgtttctaaggagtagtcagggcggattcagcaanaggaaatgatggacctggtagccttctgcattgttagccttctgcagttgcattgtgact

SEQ ID NO: 43354 - DNA, 121 bp, Artificial Sequence
  Synthesized
  misc_feature (61): n=a or g
gcaagaagaggaactggtgcttttttctcatccctgtggatacttggtcaagttttagctncttagtgtgagttaaaaatagtcccttaaagaaaaactggacatcaatggagacattgca

SEQ ID NO: 43355 - DNA, 121 bp, Artificial Sequence
  Synthesized
  misc_feature (61): n=a or g
acagccatagtcttctagactaatcacattttctacagccaagcgactagaccaagaagcntgggcactacccacaccaagaacaacttgttgcccatcaagcctttgaataccaaaagct

SEQ ID NO: 43356 - DNA, 121 bp, Artificial Sequence
  Synthesized
  misc_feature (61): n=t or g
tccttagtctctcctctattgttttcacagctcctttatgatttagaactgttgcagatgncaactttatagatgactgacgcagtcatctataaagtttctatacaccaattagaactgt

SEQ ID NO: 43357 - DNA, 121 bp, Artificial Sequence
  Synthesized
  misc_feature (61): n=a or g
tgctaccaagttgtgaagtccccttgctgggacttaaagcagggctgttggtctgactggntcactgcatggtactgcacttcaatctctctctccaattgctctgatctctgcctggtga

SEQ ID NO: 43358 - DNA, 121 bp, Artificial Sequence
  Synthesized
  misc_feature (61): n=a or g
gaaccaagcgagcagccccagcagttcagtggacagggagagcttccttgggtagcatcantactgaagcatacagaaagctggctgccctgttcagggactgtgcaactacagcggcctt

SEQ ID NO: 43359 - DNA, 121 bp, Artificial Sequence
  Synthesized
  misc_feature (61): n=t or c
atggtaatgtgcgtgtattaagccaccttggagattacaacaagaccctggaccagagggnggttagagcaagctccccaggcagcagtcacagccccaggctgagggagttggagaagca

SEQ ID NO: 43360 - DNA, 121 bp, Artificial Sequence
  Synthesized
  misc_feature (61): n=c or g
gaaggggggggaaggtatatttaggattcattgcagtgctgtaacaaaaaagggaaagtancacagtgctcaaaaggaagaggagttgatttttgttcacatcaaattttattataatttc

SEQ ID NO: 43361 - DNA, 121 bp, Artificial Sequence
  Synthesized
  misc_feature (61): n=t or g
aggtggaagagattacccactagcattaaaaatgataagtaatcagtagaagttttccttntattacagtctataaatacagccagcagccactgatttatctatctgcagtgctctgtta

SEQ ID NO: 43362 - DNA, 121 bp, Artificial Sequence
  Synthesized
  misc_feature (61): n=t or c
cagggacttgactgtgtccacatctttctctcccagtactcctatctaaccaagtagttanaagccactcttggaataggctgcagtggagatgcattccagacaacaccaaaatcaacat

SEQ ID NO: 43363 - DNA, 121 bp, Artificial Sequence
  Synthesized
  misc_feature (61): n=a or g
cttcctctcctaagaaagctcaaatgattttccttcctacaaatgtggagcaacaggtacntggcctggaatcatactgaggaacatcagctgagccaggcaacatgcaggccagcttagc

SEQ ID NO: 43364 - DNA, 121 bp, Artificial Sequence
  Synthesized
  misc_feature (61): n=t or c
ctttctttggtcactacttaaaccagtttacaaaaaagtacaaaggagttactgcagactncaatcctacttccaatctcaagagtttcactagcaaaacaacctccaagaactgccactt

SEQ ID NO: 43365 - DNA, 121 bp, Artificial Sequence
  Synthesized
  misc_feature (61): n=t or c
tgagtcaggctattctgctcttaaaacaaggtgtatgtattcagaagggtgtttttgtttntttgtttttaaatgggctggattagaaggtagtatggtctaaaaccatttttgcgtgtgt

SEQ ID NO: 43366 - DNA, 121 bp, Artificial Sequence
  Synthesized
  misc_feature (61): n=a or g
aatagtcaggtgtgactgtttctaaaggcagcagaaaatttctaagcaatagcaaggtcantgcatatgtaggcctctaaccacagctcttttttaaacttgctcagtccctttcaagtaa

SEQ ID NO: 43367 - DNA, 121 bp, Artificial Sequence
  Synthesized
  misc_feature (61): n=t or c
ttgtatagggggttgcagtgaaattgctgtttagaacattccttttgaaacagaatgttgntcaaggatacagagcaattagaatcattccttagggtggcatagtagattttcctaattt

SEQ ID NO: 43368 - DNA, 121 bp, Artificial Sequence
  Synthesized
  misc_feature (61): n=a or t
taaacaaaactgagagaaaaaaagctgcactctttttcagggaaagggagaaactgggccnccataatactgttcttcacaatgactacatataatcttctaatatttttatacacaacag

SEQ ID NO: 43369 - DNA, 121 bp, Artificial Sequence
  Synthesized
  misc_feature (61): n=t or c
ttcagtagtggtatcacgagttgtgccatggctgcaccacatcttttttgttagctttccntgttttctgtagggctgtcgggcatcctgacatcctgtgtttttgttctttcctctcccc

SEQ ID NO: 43370 - DNA, 121 bp, Artificial Sequence
  Synthesized
  misc_feature (61): n=t or g
attaactcttgactaagaagtttttgcatcaatttaattgtggaccctctgtccaatgagnaacaggttctcaccatgtgtgctgtattctttttgggaactaacaatacttctcaaatat

SEQ ID NO: 43371 - DNA, 121 bp, Artificial Sequence
  Synthesized
  misc_feature (61): n=a or g
gagtaagaaattggtagtaccacatatttcattatatttaacagcaaaatatctggtgctnaaatgttatccttttttaggaatatcttaatataacgacacataaaagttaaaacctgta

SEQ ID NO: 43372 - DNA, 121 bp, Artificial Sequence
  Synthesized
  misc_feature (61): n=t or c
agtctcaaaactacgtttccaaaagcctcttttccttcagacatgtcctgggcttcttagnccacttatcccctagcacttcactactctgtgaagccagacaagtgacatctgggcaatg

SEQ ID NO: 43373 - DNA, 121 bp, Artificial Sequence
  Synthesized
  misc_feature (61): n=t or g
agaggagtacagcccatgtctacatttatactcctacactcatgagaaaggcgggtttcantttttttcctaaatggcatcatcattttgtaaattttagggtttttttttctaatattgt

SEQ ID NO: 43374 - DNA, 121 bp, Artificial Sequence
  Synthesized
  misc_feature (61): n=t or g
tggaataatgaggggaatagcccaagagataccactatctgtaaagtggatttatgggtcnaagatttgtccgctgcaaagtttgaaaacctggaagaagttcagggtgagaagttcacag

SEQ ID NO: 43375 - DNA, 121 bp, Artificial Sequence
  Synthesized
  misc_feature (61): n=a or g
ttacagctgatggcatgttgcctgcatatctcagggctgaaatgcaaaaataagccaagcntgaagacagtatcagcttgacgctacatgccttttctagggctattagataagagatact

SEQ ID NO: 43376 - DNA, 121 bp, Artificial Sequence
  Synthesized
  misc_feature (61): n=a or c
gtgaagaagctgttggggggatatttcttggatttcagagtggtctttgggttgtagatgnaaaatgtttctcattgtggcttcttctgctggatcaaatgactgatgaaacagtgcattt

SEQ ID NO: 43377 - DNA, 121 bp, Artificial Sequence
  Synthesized
  misc_feature (61): n=a or g
cctcggggccgtcgggtggcagcggagagagggcagcagctgcggccccgggaggccgagngacaccaaacccggccttagggttacgcattattcttattgttttccctacacgttagtt

SEQ ID NO: 43378 - DNA, 121 bp, Artificial Sequence
  Synthesized
  misc_feature (61): n=t or c
acaagagcaatattaccagatacagaaatcctggagagatcttaatactgagggagcacangctggaatggctccttggtatgcagtgctttccctactgctgtgcctgcatgggcagagc

SEQ ID NO: 43379 - DNA, 121 bp, Artificial Sequence
  Synthesized
  misc_feature (61): n=a or t
gatatgccttatttctgtgaaggagctcttctggcccttcctgcttgcttcagacatcatnttgactaactgatccacaagcattcctattttcttccaccctgctacatgcattttaaat

SEQ ID NO: 43380 - DNA, 121 bp, Artificial Sequence
  Synthesized
  misc_feature (61): n=t or g
aaccttagtaatatatcaattacatgaggtttagcttgtaatttgctcctgcttaccctantctctttcatctacaacctggaaaactttctatttgcaggcaaacgttagcaacatttta

SEQ ID NO: 43381 - DNA, 121 bp, Artificial Sequence
  Synthesized
  misc_feature (61): n=t or c
cctccaattccagcaggccaggaccactgctgctacagcagctcccggagtgctgtctctntgtaggcaggaaaggctgtactcactgatgaagatggcaaagcgattgtcacgggaaggt

SEQ ID NO: 43382 - DNA, 121 bp, Artificial Sequence
  Synthesized
  misc_feature (61): n=t or c
ctcaatcaccttcccaggcattgaagtgaggctgacaggtgtgtagatctctggatcctcnttcttgaagataggaaagaaatctcctttccgtcagtcctcaggatcaccataacctttc

SEQ ID NO: 43383 - DNA, 121 bp, Artificial Sequence
  Synthesized
  misc_feature (61): n=c or g
gtatataaatcacgcgtagcagcacctaaattcagaagttaaatttgacatgcatatatanacacagtatatgtctgaacaccttcaaatcttcaaagctataatgaaacatgctggctag

SEQ ID NO: 43384 - DNA, 121 bp, Artificial Sequence
  Synthesized
  misc_feature (61): n=c or g
cactcagccaagagtgctcagtacagagcctatttcactataaactgcagtgcacccgggnactgggactggctgtcatgtgaaccaaatatcagtccataatgctcattctgagtgttaa

SEQ ID NO: 43385 - DNA, 121 bp, Artificial Sequence
  Synthesized
  misc_feature (61): n=a or t
acatttgcaacttaagtgttaaaaaagagagatgtttcatttatcaggaaaatcagaacantgttctgattttcctgataaatcaatgttgcttccaccacttaaaacttagtcatatacc

SEQ ID NO: 43386 - DNA, 121 bp, Artificial Sequence
  Synthesized
  misc_feature (61): n=a or c
agtaaaaaaaacaaatgtagcactcagcccaaagcacatgtcatcaaatccatcctatttnttctaacaaaactgttggctgtcaaggcatggtgagacaactaagcaacacatcattggt

SEQ ID NO: 43387 - DNA, 121 bp, Artificial Sequence
  Synthesized
  misc_feature (61): n=a or g
tttttttaaatttaatttttaagttttgattatttaatttttaactctttaattctgactntgactaatcacccagaggattaacgccatttaactaatccacattaaattcacattttta

SEQ ID NO: 43388 - DNA, 121 bp, Artificial Sequence
  Synthesized
  misc_feature (61): n=c or g
acaaagatggttattaggacacaacagaccccattttatagaagggaacatttcagtatantgctttaaaattcaaaggaattccaatgttgcactctaatgctgtcaaaagcaaagaata

SEQ ID NO: 43389 - DNA, 121 bp, Artificial Sequence
  Synthesized
  misc_feature (61): n=a or g
tacatatcataatcacagagattcctttttactgtacaatctgttaggaaggagaaaaganaaaacagtacatttactgtgtaattactgaacctacgagcattttacaaatgctcattaa

SEQ ID NO: 43390 - DNA, 121 bp, Artificial Sequence
  Synthesized
  misc_feature (61): n=a or g
gggggatcaggtgccgggggcccggggacggcgctgggcggggggacccgacccgacccgnagcgcggagccctcgctccgaaacctttccctttttaactcttctattattattattatt

SEQ ID NO: 43391 - DNA, 121 bp, Artificial Sequence
  Synthesized
  misc_feature (61): n=c or g
catagctgaaaatcccatacatgactcacagaagttacactggtattgttatcccttaggncctgcaatctttccattatttctttgaacaaacaccaaaaaatacacattggtcctcctc

SEQ ID NO: 43392 - DNA, 121 bp, Artificial Sequence
  Synthesized
  misc_feature (61): n=t or g
tttatatataaataaaaaaagtagcagcaggagtgaacagggtcacttgcgatgagaaaanggaagtcagcacagcaggaaacaaatgagtacttcaatcctaaagtaaaaaataggagca

SEQ ID NO: 43393 - DNA, 121 bp, Artificial Sequence
  Synthesized
  misc_feature (61): n=t or g
gagctggtcagaaagtccaaggactgaactaactgagtattagcagctagttagtaggagnagtaaagagggaaatattttgcttccttatccatgctgctaggagagtataggctatatg

SEQ ID NO: 43394 - DNA, 121 bp, Artificial Sequence
  Synthesized
  misc_feature (61): n=t or g
aaggtagggacttcctttgatggatactgctgcttcacccaggtctgccttatttgtgtcntgcttaattagtttgtatttaaatctcttggagcaaagtgttcctggctgcacattgaga

SEQ ID NO: 43395 - DNA, 121 bp, Artificial Sequence
  Synthesized
  misc_feature (61): n=a or t
gctcacaataaagaaagagattggatcacaagtgacaacgaagtaacctgttcttataganccacagaattgtaagggctgaaagggacttccagatatcacagaatggcctgggttgcaa

SEQ ID NO: 43396 - DNA, 121 bp, Artificial Sequence
  Synthesized
  misc_feature (61): n=a or c
ctcaaaatcaaatcaaaccacacaacatcagtggtcccggggagtaatcgtcccaataagnagctctttgagcaagggaccacgaggcacagtggttgccagtggtgaaaaatattccagg

SEQ ID NO: 43397 - DNA, 121 bp, Artificial Sequence
  Synthesized
  misc_feature (61): n=t or c
aaccgcctctattaaactgacgttcacgagagctgactttgcgctacctcattaggctccngtaattgaaggagttaattgattatcaatagtttcagctccctcctcccgtacctgcgag

SEQ ID NO: 43398 - DNA, 121 bp, Artificial Sequence
  Synthesized
  misc_feature (61): n=a or t
gctggagggcacccctctccccacgttctttctcttttcttctacaggaaggtcttcattnacatccgtcgttgctgtcatcctcctaacggcttgtcctgtgtaagaggagatccttgcg

SEQ ID NO: 43399 - DNA, 121 bp, Artificial Sequence
  Synthesized
  misc_feature (61): n=t or c
tcactgcttttgggacctgcacttttatgggggggctgctgtgatagcatcagctatcgtnatttctgcctttcttggacagagatccaagctatgttaaacttcattacttgcaagccct

SEQ ID NO: 43400 - DNA, 121 bp, Artificial Sequence
  Synthesized
  misc_feature (61): n=a or g
gtccaccagctcggccgcctcctcctcgccgaacgccggcttggtggctgcctgcggctgncgacggtctccagaagccatcgcgtctgtgagagaaagacagagactagaagaggtgagc

SEQ ID NO: 43401 - DNA, 121 bp, Artificial Sequence
  Synthesized
  misc_feature (61): n=a or g
tccaaacttcaagcttttagccaaaaacgattaacattttccattcttgctgaagaacganatttccaatgaaatagatcaactgctaactctatcaaatgaaaatgtattatttttaaga

SEQ ID NO: 43402 - DNA, 121 bp, Artificial Sequence
  Synthesized
  misc_feature (61): n=c or g
actctagtagagcagtaacttgttgcactgagtcatgcccttttgtcttttcatgaagttntttgagcaagaagatatttatgatggagcagcacttcagaataatggagctctaatccca

SEQ ID NO: 43403 - DNA, 121 bp, Artificial Sequence
  Synthesized
  misc_feature (61): n=t or c
cctgtttgtttgggaagtttggtgcttatttgcacccagagcctcaaagattttttctcantttggctttgcctcttcgtgagctctttccatcagaatgtgaagcagcagcagtggatag

SEQ ID NO: 43404 - DNA, 121 bp, Artificial Sequence
  Synthesized
  misc_feature (61): n=t or c
agggaagattaaaaaaaaaaaaataataattttcttatttgtgagagtgcagtgtttttcnatttgtttccacttgtccagctgatacctgaaggttaaattaagagttcagccgtggtct

SEQ ID NO: 43405 - DNA, 121 bp, Artificial Sequence
  Synthesized
  misc_feature (61): n=a or t
aaaactgataactgtggaaggccagattcatacaagatgcaaaatttcttaattttaaatnaatctaagcttaaatttcttaaacatcaattaccacagaaggctggacttgctctcacat

SEQ ID NO: 43406 - DNA, 121 bp, Artificial Sequence
  Synthesized
  misc_feature (61): n=a or g
agtggaaaataatggcatggagaaggatggaatggaatagaatagaatgaagttggatggnatggaatggtgaatggaaaggaatggacagcatggcatggcatgcaagagaatgggatag

SEQ ID NO: 43407 - DNA, 121 bp, Artificial Sequence
  Synthesized
  misc_feature (61): n=t or c
ggcaccaagagcttggtagagctacgcggtggtagatctggcactgaaacacgcctggggngggtaggttcctgtatgaactggatggattgggatgggttcttcatggcgcttctccttc

SEQ ID NO: 43408 - DNA, 121 bp, Artificial Sequence
  Synthesized
  misc_feature (61): n=t or c
cagcactgccatggtcaacattaaaaacatcaaagttctgaatagtcggtttgccaacccncaagtcctatgatgcaggactactgcagcttcccagctttgctgtagtcctgagactgtt

SEQ ID NO: 43409 - DNA, 121 bp, Artificial Sequence
  Synthesized
  misc_feature (61): n=a or g
tgtttctgtgaaggaggggtgccacttgtcatagtatatgaaactaagactttgggaactntagaaagactgtctcttgctttaagtgagctgatttacctgaggctcaggaggtgattgt

SEQ ID NO: 43410 - DNA, 121 bp, Artificial Sequence
  Synthesized
  misc_feature (61): n=a or t
cctcgggagctgcctcgtgccggggctccctgagcacgagccaggaaacctgactgacctnctgacatggagaccaggaccagcctctatgtgtcggtaggacctcaagagaaaagagatg

SEQ ID NO: 43411 - DNA, 121 bp, Artificial Sequence
  Synthesized
  misc_feature (61): n=t or c
aaaatcagccttgctacagaaccagcaggtgtctcagcacacaatgaataatgcaatactntcgagagataaggcagtaaacctcagtctcaggctcagtttcttccaagctgtcacaggt

SEQ ID NO: 43412 - DNA, 121 bp, Artificial Sequence
  Synthesized
  misc_feature (61): n=a or g
aaaactgaaattatgtgcagtagaatagacctggactaggtgacactgtagcttatgctancttttgatttgcttgttcatgaagggaagctgccttcgtgataacttgaaagaataagtc

SEQ ID NO: 43413 - DNA, 121 bp, Artificial Sequence
  Synthesized
  misc_feature (61): n=t or c
tgtctcagagataaagaggacatttttgttaacagaactgccactccaccgatttcagtgnacctaatcatacttgcataaggaaaaacagagagaagaacacgaacatttaaacaggcag

SEQ ID NO: 43414 - DNA, 121 bp, Artificial Sequence
  Synthesized
  misc_feature (61): n=a or g
aaatgatgatttctaaatgtcattaatctgaggcacagtttgtaaacaaacagaggatctnattttcagcaagttggacagaccattattcatgtgttgcacatctaatttctgtttattg

SEQ ID NO: 43415 - DNA, 121 bp, Artificial Sequence
  Synthesized
  misc_feature (61): n=a or c
agtcctaaaatttaataacaaaatgagaccaaaaccttaaaccagacttaacttgggcccnaaaaagaccacagttattagagagataattgacagtgttgtatatgtttgtaggtatcac

SEQ ID NO: 43416 - DNA, 121 bp, Artificial Sequence
  Synthesized
  misc_feature (61): n=t or c
acacacacacacacacatacacgggcagtgtcgccctgctttaatcgatatacgcaacganatatacacatctcccacctttaatcgagatatcccacaatctacatctcttcccccacct

SEQ ID NO: 43417 - DNA, 121 bp, Artificial Sequence
  Synthesized
  misc_feature (61): n=a or g
agcgcggatcctgtccgcgatgaaagatagaggggaaggagtgggtggaagaaagaaaaangagaacactttttcaccatcgccctccgagaaaggacagaaaggggaagaaataaaaggg

SEQ ID NO: 43418 - DNA, 121 bp, Artificial Sequence
  Synthesized
  misc_feature (61): n=a or g
ttttttttttttttttttctggttaatggtctggtacttactgtctatggatttcaaagtnggtcagaggtgattgtgtattcagcacactagtgtcataaaaggaaacttgaatttgatg

SEQ ID NO: 43419 - DNA, 121 bp, Artificial Sequence
  Synthesized
  misc_feature (61): n=a or g
agcttatgacaccaacctggcagcggtgagaagatgggtgaagttcaatccaaatgtcccntctgggtcaccaaaactgttgtcaactttaaacctcctgaaacacatctgaaaaaaaagt

SEQ ID NO: 43420 - DNA, 121 bp, Artificial Sequence
  Synthesized
  misc_feature (61): n=a or c
cagaatgattaaggatggaaaagaccgataagatgtcaggtccaaaggtctgcccaggtcntgtgtgtgagatctcccagttttattgtgatggactctgaggatggatgccagcatgtgg

SEQ ID NO: 43421 - DNA, 121 bp, Artificial Sequence
  Synthesized
  misc_feature (61): n=a or t
aagaaaggggctactgtcgctgctggcagaaggtttggaatcgaatagaattagaagtgcntcagagcagctgaagtttcagaggttctgctttccaagccatcaggttttctgggatgac

SEQ ID NO: 43422 - DNA, 121 bp, Artificial Sequence
  Synthesized
  misc_feature (61): n=t or c
agggcgcctgtggtaggggtttggttgcttttacatgaatcctctttccttcctgaatgangcatactgaaacagtttttctgctcttccaataaaaaataaataataataaaaaaagtca

SEQ ID NO: 43423 - DNA, 121 bp, Artificial Sequence
  Synthesized
  misc_feature (61): n=a or g
ctttccacatatgggcctctctggcttcccttgtttctacctgtcttgccccattggctgnccttcaatgataggatttgcctagagaggtgcttgtacaaaacaggaggctagaaggcgg

SEQ ID NO: 43424 - DNA, 121 bp, Artificial Sequence
  Synthesized
  misc_feature (61): n=a or g
ttatttcttccttggaaaataccttaacagtgctttcagctaacagtaatgactaactcantggcttttgtttacatccaggtgttttttgtgtgtttgttttttttttaattctcagaaa

SEQ ID NO: 43425 - DNA, 121 bp, Artificial Sequence
  Synthesized
  misc_feature (61): n=t or c
aaaacagccctgttaccaacacaatcacactctacattataaaaagaagagcaaactgccnggtggacaaccactaccagaatggccctttttttaagatacaattgtaaaataaaggtct

SEQ ID NO: 43426 - DNA, 121 bp, Artificial Sequence
  Synthesized
  misc_feature (61): n=a or g
tcctgttttcaaatttctgaatgagctccaaagtgtaaattcagaaggttatgaatgaatnagaccctgtgatccttcacatagatacaaactccaaaatactggaactgagagctcctaa

SEQ ID NO: 43427 - DNA, 121 bp, Artificial Sequence
  Synthesized
  misc_feature (61): n=a or g
tggagccagtgtctcaatttcacttatcttctctccccattccagtaaagccaggtgcagnacagtgggaggattcctgatcattgcctaaagatccagggcctaatccaccgcctgccta

SEQ ID NO: 43428 - DNA, 121 bp, Artificial Sequence
  Synthesized
  misc_feature (61): n=a or g
ctgttggcagtacaccgctccttctcgtatccctaaattcaacacacgtttgctcctgacntccccagtttgatcctgacatttgatcctgacattcccagtttgatactgacattttgat

SEQ ID NO: 43429 - DNA, 121 bp, Artificial Sequence
  Synthesized
  misc_feature (61): n=a or t
tggctactgccatcacatttaaatagcaattacttcagtcctttgattacgtgcctttctnacagagatggctgcaaaacgtgtcttgatcatccgtctgaaaaatatctggcaaaatcac

SEQ ID NO: 43430 - DNA, 121 bp, Artificial Sequence
  Synthesized
  misc_feature (61): n=t or g
atgtcacaaagaaagacgtacatgaagacaccactatctctgttttcctgccagccagctntaaagcaccacagattaagtcctaatttcccttccctctgggtatcgtgctgagctggca

SEQ ID NO: 43431 - DNA, 121 bp, Artificial Sequence
  Synthesized
  misc_feature (61): n=c or g
agccttcaaatccatctctggatggattgcagagatggaggatgtgttgcaggacagtgtnaaaggaagaactgttctggctgcaggcctaggttttgttcaagataaatgggtctgccat

SEQ ID NO: 43432 - DNA, 121 bp, Artificial Sequence
  Synthesized
  misc_feature (61): n=a or t
taaagatacacggtgtctctttagcactttatatctggagcattttaaggcatgctgctgngaattaatgaatttactgtccttatgtttaaagcaaagcagggcaggggctgtgccacca

SEQ ID NO: 43433 - DNA, 121 bp, Artificial Sequence
  Synthesized
  misc_feature (61): n=a or g
atttaaaaacctgttccgtaggaaacttttgcatggcaatttctctggtttttccttttanaaacatactttagctgtagacagtgctgttggacaaggaggtagaaacctttcttactcc

SEQ ID NO: 43434 - DNA, 121 bp, Artificial Sequence
  Synthesized
  misc_feature (61): n=t or g
tccccaacaaatgcccctctttaacacagggtcactgttgtgaagcagagagaaagagtcntcatcagtcacatagtggagaccaagctgatacgcacccaatgtgactctgaacaagact

SEQ ID NO: 43435 - DNA, 121 bp, Artificial Sequence
  Synthesized
  misc_feature (61): n=t or c
ctcccatgaggggaaaagccacaactgcttggaagctctcagcatctctcctgacttcatnataatcttccaaattgaaattaatttctgttttaatgaaatagtgttcattgtttctacg

SEQ ID NO: 43436 - DNA, 121 bp, Artificial Sequence
  Synthesized
  misc_feature (61): n=t or c
tgaaggtcgggggctgcacctggataaaggttaacgcagaagttctgtaccgtgtggagtngtattgatttcccaaaggcagctgggaattgcattgtggctgtgctttctgtccctgaga

SEQ ID NO: 43437 - DNA, 121 bp, Artificial Sequence
  Synthesized
  misc_feature (61): n=t or c
agcctgactgtcaatgcacacagggtcagtgcagggtgagctctgcacctgagaggagttnatgctcttccttgcttacaaagcagtgcacaagagatccttaaaagagacttgtgactgc

SEQ ID NO: 43438 - DNA, 121 bp, Artificial Sequence
  Synthesized
  misc_feature (61): n=a or g
ccccgattggggattatgagatgagaaccatgaagtaggaaacagggacttaatgagaagntagtgagcttaaaacaagttgcaaagaaaatctggaaagcacagaatccctttatggaaa

SEQ ID NO: 43439 - DNA, 121 bp, Artificial Sequence
  Synthesized
  misc_feature (61): n=a or g
gagtgtggctctgagcagtggtttgggagaggggttttctggcccggcgatgggcaggaantgggaaggcaagaggaggaactgtgctgtcacacagcagcgctgaaaagatgaacgtgtc

SEQ ID NO: 43440 - DNA, 121 bp, Artificial Sequence
  Synthesized
  misc_feature (61): n=t or c
gcagatgctcagggcttcagacaggcagcaaaaatggcccttttgtcatgttgtttgggtntttttttagccatttagcagagctttggttcgtacccctggatggctgtcagcggggatt

SEQ ID NO: 43441 - DNA, 121 bp, Artificial Sequence
  Synthesized
  misc_feature (61): n=a or g
gtatcttcataaacaacttttaggtgtgttggtgaatataattgtaaaaaaatgaattgancagaaagacagtttttagaacagttgtgactgctttagatgtattgaaaggtattaccta

SEQ ID NO: 43442 - DNA, 121 bp, Artificial Sequence
  Synthesized
  misc_feature (61): n=t or g
gatgatgcatctacgtcatgcagttgcatgcagcgttgtgcaattgcacatggataagttnctggatgtatctgctccgtaggtaggagcaatgggagggttttggctgttttgcactgtg

SEQ ID NO: 43443 - DNA, 121 bp, Artificial Sequence
  Synthesized
  misc_feature (61): n=t or c
cttgagctctgatcccaaggaaaccccgacctttctcactcctcatctgcatatcgtgtcngtgccccagagtacagaagggtactgcaaagggcactgatatcttcaaacccgacctatt

SEQ ID NO: 43444 - DNA, 121 bp, Artificial Sequence
  Synthesized
  misc_feature (61): n=a or g
tctcttgtcctcttgcagtgtgacaccagctgctgtactgctagtgctggggagcgcattnccatcttctgctccctctagcccaccataactggtgaaagcatggaggcagaattagaca

SEQ ID NO: 43445 - DNA, 121 bp, Artificial Sequence
  Synthesized
  misc_feature (61): n=a or g
tctatgtgttgttcacatgtatgtatgctcatgtaacatcctcagctgccagatgaatatntaatttatttatttatgactgcacatcctacctccccattctgcagcttattaataacac

SEQ ID NO: 43446 - DNA, 121 bp, Artificial Sequence
  Synthesized
  misc_feature (61): n=t or g
ttcccctcatcacgatatctgatttttttcctctagaggagttgcccagtttttcagcctntgcttttctttgggtcccccacccacccccagccaacacgcgttttgaaacttgctgaga

SEQ ID NO: 43447 - DNA, 121 bp, Artificial Sequence
  Synthesized
  misc_feature (61): n=a or g
gccttgggggaccttgttgggccttgggggaccttattgggtcatagtgggcctgggtggnccttgttgggctatgctggactcctggggttatttgattgtcagaaggcgcatgggattc

SEQ ID NO: 43448 - DNA, 121 bp, Artificial Sequence
  Synthesized
  misc_feature (61): n=t or c
tgagcgcctacagttgactactcagttcagtaaagaggaaaacgaggagggaatggaggangaggacgaagaagagtcatcgtatgaaggaaaggtgcttgatgttgagagaggagaagaa

SEQ ID NO: 43449 - DNA, 121 bp, Artificial Sequence
  Synthesized
  misc_feature (61): n=c or g
tggcttggaaactgaaacttgaggtggaccagcagtgtaagttgccattcagacttctctncagttgcctttctaatctctggtttaaaggtgaccctgccactctgggttgttgcactgt

SEQ ID NO: 43450 - DNA, 121 bp, Artificial Sequence
  Synthesized
  misc_feature (61): n=a or g
taaaattaattccctaagcttgctgtgtatatagatggacaggtgaactacggtgctccanttagcatcgccacgaagagaaggcacaaaggattctgctacttctcatagtgctcaccag

SEQ ID NO: 43451 - DNA, 121 bp, Artificial Sequence
  Synthesized
  misc_feature (61): n=t or c
actggctgcctgtaaccattccagcaacttcgccttaagctgataattgaaggtaaggaanagaccttaaaaaaaaacctgttttattttgatgtctttgttctccttgttcagacaatac

SEQ ID NO: 43452 - DNA, 121 bp, Artificial Sequence
  Synthesized
  misc_feature (61): n=t or c
ttggtgtgggtatctttgaagaatggtgatacaatactgctgcaagaaagcttggcagctnatgtgcttctgtctgcagctctgttgctgtcttgctcattggcttgtgcagcacaaagaa

SEQ ID NO: 43453 - DNA, 121 bp, Artificial Sequence
  Synthesized
  misc_feature (61): n=a or g
tgggttttattctcctctctggtttgctaagtgtgatcacgggcaagtcctttaaccttgnctggcctcggctgacttatctattccagaaaggtgttgtaaggcttaattattgccagct

SEQ ID NO: 43454 - DNA, 121 bp, Artificial Sequence
  Synthesized
  misc_feature (61): n=t or c
atttttatagcccctgggactccttttgctcaagagagaacagtgcagttgttttcacccnaaacagcaagcgcgcctccatcccgtacgctgcaccccgtgagcccagcgcagggctggg

SEQ ID NO: 43455 - DNA, 121 bp, Artificial Sequence
  Synthesized
  misc_feature (61): n=a or g
ggtgctccgtgctccggcacagccacctccaagcatcccactgcatctgctctgggtgatngcaccatgatgctcacagcagcagccagcttttgtcactggtgttgtgttctggacattg

SEQ ID NO: 43456 - DNA, 121 bp, Artificial Sequence
  Synthesized
  misc_feature (61): n=t or c
gtaggttattagttcaccagtgttttgacttctacttcatggaattgtttggcacggcagnatacaattagtcctctctgggaaaacagagaattgtgatctgcagtgttaaacgacatag

SEQ ID NO: 43457 - DNA, 121 bp, Artificial Sequence
  Synthesized
  misc_feature (61): n=t or c
tgggcaaccactggaccattaccttgtatgcaatttacacctcaccttttgcaaaccgcantgggtttgtaacaggggggaaacctcatcaactttccaggagaggtgtctattttatgca

SEQ ID NO: 43458 - DNA, 121 bp, Artificial Sequence
  Synthesized
  misc_feature (61): n=t or c
tgttaaagtataaattttatttatgaatgcaaatattattttgtactggaagaggggcacngaccctttatttttctatgtcaacagatggaaataaagtcttgacctcggcctgtgtgcc

SEQ ID NO: 43459 - DNA, 121 bp, Artificial Sequence
  Synthesized
  misc_feature (61): n=a or g
agtgaatgtcactgtagttaccctagataacatacatccttcataaagagacaagcagtcntatttgtatgggaactactgaatcacagcctgaaccactgattgatcacctgaggcaagc

SEQ ID NO: 43460 - DNA, 121 bp, Artificial Sequence
  Synthesized
  misc_feature (61): n=c or g
tgggtatgcccagcttctacgtttgctctgcttcagggtgtggtaaattacactgaggaantttactcctttggcaatggggctaagggttggagaactctgaacactgacatcccattgc

SEQ ID NO: 43461 - DNA, 121 bp, Artificial Sequence
  Synthesized
  misc_feature (61): n=a or g
ggatggagagaaatgaagccgggagatctgacccggtaacgtgggctggcaatgggttgtntcaagcaggaattgctttaatacagtgcctggagctcaggggatttctgcacccaatgtg

SEQ ID NO: 43462 - DNA, 121 bp, Artificial Sequence
  Synthesized
  misc_feature (61): n=t or c
tctgtctctgccctgcaaaaaaaagaatgggtttgaaaaggacaaaatcggacgttcggcngtgagatccgacaggaaacgccgctaaaattgtctccttttttttttattataattaaaa

SEQ ID NO: 43463 - DNA, 121 bp, Artificial Sequence
  Synthesized
  misc_feature (61): n=t or c
ctccaactgctggccccgcagctccgattcctggcggtgcttctccagctctgtgctcaangtgctgcaagaagagtccgtcccagcatcacgttatggttccaacaccccaacccttccc

SEQ ID NO: 43464 - DNA, 121 bp, Artificial Sequence
  Synthesized
  misc_feature (61): n=a or g
gcaaagcgagcatctgatgctgcagtgtggtggccccttatgcgtgcttggaagaggagancactctttttgctgggtgtttgaatcccatgaagcagctttcagctcaggtcacctggag

SEQ ID NO: 43465 - DNA, 121 bp, Artificial Sequence
  Synthesized
  misc_feature (61): n=t or c
acaagccgaatgctaccccacccacctgagtatcttctctggtgcctgctctcctgtgacnaagtcgtatcctctctcaagtgtggtgtagggccacggcctgggagaccaagagggagag

SEQ ID NO: 43466 - DNA, 121 bp, Artificial Sequence
  Synthesized
  misc_feature (61): n=t or c
tgggcctgaggctctgagagctcttctccaatctccacggacacatcctgccagcagcgangcagggcccaggcgggcctcagagcccgaggcctgcgggccgccgtcccctccccgcacc

SEQ ID NO: 43467 - DNA, 121 bp, Artificial Sequence
  Synthesized
  misc_feature (61): n=a or g
ctttgtgtcttttcattttcttcctgcatgaaaagtattcgtggagccgtggagccgagcnttgggttttgctttcaagccgattcccttcttggtgtttttgggaacggtgggaaggtgc

SEQ ID NO: 43468 - DNA, 121 bp, Artificial Sequence
  Synthesized
  misc_feature (61): n=t or c
agagatggcaaagcgctcagcatccttgggggtgtcaagggcttccttccatggagcatcntttccatggagcatctgacccagggagcattccctttatggagcattccctctcctgagc

SEQ ID NO: 43469 - DNA, 121 bp, Artificial Sequence
  Synthesized
  misc_feature (61): n=a or c
ctttttaaccgtatatgcaaaaagcagcagaactaatgctccagtcttaggactatgtctntgcaacaaaaagcagcacgatctagtcatggaatgcacatgcccatcatttaaaaactac

SEQ ID NO: 43470 - DNA, 121 bp, Artificial Sequence
  Synthesized
  misc_feature (61): n=t or c
ttaatggatccactcaagcactggaaaggtactgagaagcacaaagagcaccgaactgccnattcctgcagaagggcatatatgtctggtcagaacaacaggatgggagttattaaataat

SEQ ID NO: 43471 - DNA, 121 bp, Artificial Sequence
  Synthesized
  misc_feature (61): n=t or c
caccatgaacaaggcttcctgtaaggcccaggaaaaccagtttgctgccctatgccaccangggtagcacatcagcagagtgacccctattttctcccactgcaggtgtaggatgctcggc

SEQ ID NO: 43472 - DNA, 121 bp, Artificial Sequence
  Synthesized
  misc_feature (61): n=c or g
tgctgggggataaccataaagatagcggcttttcctttggcccttattttgcagctatttnaatggccaaatgactcttccactcatatcctgccatgtgcagatttctgctcctagttag

SEQ ID NO: 43473 - DNA, 121 bp, Artificial Sequence
  Synthesized
  misc_feature (61): n=a or t
cccagaggtgccagtgaccgaccggattacaccgagtgcacacgtgctctgtgccaaaagngttacaaaaggagatgaaggcacaaggctacccctgcaatttcagagaagcgtagagttc

SEQ ID NO: 43474 - DNA, 121 bp, Artificial Sequence
  Synthesized
  misc_feature (61): n=t or c
tgcttttcaaggacaaacagaaactctcactcagctgtttggacttgtctggaactgaagnaaggcaggtttgaagccctgctatgttaaggcctccaggtgcctcctggggaggggaatg

SEQ ID NO: 43475 - DNA, 121 bp, Artificial Sequence
  Synthesized
  misc_feature (61): n=t or c
ctgttgaggtttgaaggcgctgcgttaatagatcagcagacagtgcctgactgaaacacantcctgtgcattcccggtcaccaccacatcctcaccacactgccagctttccacttctagg

SEQ ID NO: 43476 - DNA, 121 bp, Artificial Sequence
  Synthesized
  misc_feature (61): n=a or g
aggatggatgctgggccaagcgaggcccacatttctgagaggagactgagggcttaattcntacaacttggttaggagctatctccactttgtaagagtgacatgataaccatctagagca

SEQ ID NO: 43477 - DNA, 121 bp, Artificial Sequence
  Synthesized
  misc_feature (61): n=t or c
aataattgtattcagtttctgttattcttctgtgatctatgatctgtgatctggcatctgncagctccctcagtacttgtgggtgcatcccatcaagatgcatggacttagcatatccagt

SEQ ID NO: 43478 - DNA, 121 bp, Artificial Sequence
  Synthesized
  misc_feature (61): n=t or c
gttttccctttccctcagttgcagagaaaggagcagtttggtgctgatctattgcctgccngctgcccacctctcctgtgcttgaggagaaacacactgcgccccagcagcagctccagca

SEQ ID NO: 43479 - DNA, 121 bp, Artificial Sequence
  Synthesized
  misc_feature (61): n=a or g
gacagctttgcaaatgctagttaaacccacctgtgtgtgtggacattctagtaccttgggnaagtcagctcttagcagacctcgagatgtgcatctgacgttaaaatatgtgagtagtgta

SEQ ID NO: 43480 - DNA, 121 bp, Artificial Sequence
  Synthesized
  misc_feature (61): n=t or c
tgtggggttatgcccccggccccatgggattgatgtcctcggcgcgtgtcggtgcgctgtnttacaccagcgtttaacctccatatttaaaaagccattggcgatatttcaggcgggcggc

SEQ ID NO: 43481 - DNA, 121 bp, Artificial Sequence
  Synthesized
  misc_feature (61): n=a or g
ggtcctgtgtggagccaggagctggactcgatgacccttacaagtcccttccaattcgggntattccatgattttttttacttttcggagtcattgcaggtccttgcccatttgctcagag

SEQ ID NO: 43482 - DNA, 121 bp, Artificial Sequence
  Synthesized
  misc_feature (61): n=t or c
gaaggcatcgtgaaatgtcaaaatgcacacagaatccaggagccaactccagtgccagacngaggcgcttccaattgccagtattggagatgttcagatgggtgtgcacgtaaccctacag

SEQ ID NO: 43483 - DNA, 121 bp, Artificial Sequence
  Synthesized
  misc_feature (61): n=a or g
agcacggggtttgggggtgatgtgttaccctttcatttaacaccagccttaagcaactgcnaaaaggcagcccgggtttctcaggaaagcccctgcaaggctgcagcagagatgctgggca

SEQ ID NO: 43484 - DNA, 121 bp, Artificial Sequence
  Synthesized
  misc_feature (61): n=a or g
gccctgtgtgctgctgcaaatgagaaaagaaaggccgttttgcgtatatacacgtatatgntgtattaattgcatctacttttgagaataaagtcttgcaagagatccccgcctgtgtccg

SEQ ID NO: 43485 - DNA, 121 bp, Artificial Sequence
  Synthesized
  misc_feature (61): n=c or g
ctctccctaacaagaagctcagtccttcttcagaacatttcagaaatgagtctagggtctnagatagtcatcacctcccctgtaacattgtgatcaaggtatgaccctgcccctgtgcaag

SEQ ID NO: 43486 - DNA, 121 bp, Artificial Sequence
  Synthesized
  misc_feature (61): n=a or g
tctcctgatggcagtctgcagaaaggcagccgtgctcctcgtgcttctgtttcacctccanttttgtagttgggacgtgttaggttacacttcagacagcatcaggagcaagtaagcgatg

SEQ ID NO: 43487 - DNA, 121 bp, Artificial Sequence
  Synthesized
  misc_feature (61): n=t or c
gaaagggttaggcagtatgcaaaaaaaccagataaattctctttgattggttttagcactngtaaaagctgattgaacatattgcctaactgctaagctagcatttcccggggaagatcat

SEQ ID NO: 43488 - DNA, 121 bp, Artificial Sequence
  Synthesized
  misc_feature (61): n=a or g
agggctgctgttagggaatttctctcccagtctgtacataggtgggattgccccagtgcanaggcattgttaaccttgttaacctcattaagttcatgtgagcccactactcaaacttgtc

SEQ ID NO: 43489 - DNA, 121 bp, Artificial Sequence
  Synthesized
  misc_feature (61): n=a or g
gtggtgggagggttacctcgttgagttgtgtgacacgccagtgtgggaactttggcagccnaacaaatgagcggttcaaaaaatccacagagaagggatcagagccaactactgagtgcaa

SEQ ID NO: 43490 - DNA, 121 bp, Artificial Sequence
  Synthesized
  misc_feature (61): n=t or g
ccaggaggacaagacatgaccagtgtgaagagctggtaggacacggtgtctctcggttttnggacacatcctggcagggaaaggcactgcacagatgcctggtgcagggccatccaaatcc

SEQ ID NO: 43491 - DNA, 121 bp, Artificial Sequence
  Synthesized
  misc_feature (61): n=c or g
gataagtgggacgaaattccccgtgttaacttgttctttatgttacggagtggtgctgtgnagctctgttctctgcagcggccattgcagcttccccttcctgcagagtgtgggagtgtca

SEQ ID NO: 43492 - DNA, 121 bp, Artificial Sequence
  Synthesized
  misc_feature (61): n=a or t
cactgctttgcatggctgctctcagtttgcagtgctctcagtagcattcatattgtcagantgtgtctatctatagtaaactacccataaggttgcttaataacagctaatagttggaggt

SEQ ID NO: 43493 - DNA, 121 bp, Artificial Sequence
  Synthesized
  misc_feature (61): n=a or g
cagaaggttttccaaaactctgatgtggtttcagaggtggtagaagtgagacaactccatnagcagttagagtcatcattagtgatcagaaaactagaacctcgtttttgctgcgcacgta

SEQ ID NO: 43494 - DNA, 121 bp, Artificial Sequence
  Synthesized
  misc_feature (61): n=a or g
taaggtgatgctcacagcctggcgctagcagttacactttggctcaaaggccatcggttgngaagaccaacacacaaacgtgggaaaagcagctgaatttccagtgagagacgtgaagccg

SEQ ID NO: 43495 - DNA, 121 bp, Artificial Sequence
  Synthesized
  misc_feature (61): n=a or g
ggtattgacccagccttctcaaggggctgatttacttttatttctctttataaacaggatngggatgcagtatgttgagcccacagccctcactcaaagcatgtccacaacactttggtgt

SEQ ID NO: 43496 - DNA, 121 bp, Artificial Sequence
  Synthesized
  misc_feature (61): n=a or g
cttgtcatctatgactgtccttagcttgaatgacttccatttggttatttcctatcaggtncaaaacttagcatttatccttgctgagtatcatgatattcctacagttgcattcttctag

SEQ ID NO: 43497 - DNA, 121 bp, Artificial Sequence
  Synthesized
  misc_feature (61): n=a or g
aagcattcactctcaaacttttgtattcagcaactccattgagctgagagtctaaaactgntccttgtgatctgtgttttacctaatggaatttgctaatggaatgtcatcaccatgtgtt

SEQ ID NO: 43498 - DNA, 121 bp, Artificial Sequence
  Synthesized
  misc_feature (61): n=a or c
tatagtcttcactataaaaaaaatttagagtagatgcgtaaaaatacaggaatatgatccnctcctaaaaataaaaaaccacgataggccaaccgtcagcctcttctccctttctctgcct

SEQ ID NO: 43499 - DNA, 121 bp, Artificial Sequence
  Synthesized
  misc_feature (61): n=a or c
ggggcaggcacacacggcatcaccacgggccccgccgcgccaggagcagcgtgccctgcanttcccaccgtggttcagagcggtgattcagggtcaaagcacccaggaaaacccacttttg

SEQ ID NO: 43500 - DNA, 121 bp, Artificial Sequence
  Synthesized
  misc_feature (61): n=a or g
gacattgattccaagaaatgacccagaaatgtcccagaacatccatcccagccaggaaccngacccggtgacctctgtttcttctaatccgggatatcccacagctccacgaatacagacc

SEQ ID NO: 43501 - DNA, 121 bp, Artificial Sequence
  Synthesized
  misc_feature (61): n=a or g
tggaagcccccaacacacccagacacccctaacacctttaaataccctcagatacctctgngacccccaaaggtccatgggacccccgtaagaccacaggaccccaaaacccccaggagcc

SEQ ID NO: 43502 - DNA, 121 bp, Artificial Sequence
  Synthesized
  misc_feature (61): n=a or g
atcaattaatagccttataaaacagcctggtgcatcttccagagccggtgacaaagcagtnggaacaatagggaacgcaggagatgcagagctgtgaatctggtgctgacatcccacagca

SEQ ID NO: 43503 - DNA, 121 bp, Artificial Sequence
  Synthesized
  misc_feature (61): n=c or g
caggctgcaatgcggagagtgcttgctttgcagctggaagtcaatggggatgaaattccantgaaatctgcaccaagagcaaaactttcctcatctacactaccactttccactgcagaaa

SEQ ID NO: 43504 - DNA, 121 bp, Artificial Sequence
  Synthesized
  misc_feature (61): n=a or g
atcctgacaactggcttgaacctgccaggatgatctatgcaagagagactgtgcacacgtncatgtgtgtgcacacgtgcctgggagaagcaactgggctgttatagtgagctcagaatca

SEQ ID NO: 43505 - DNA, 121 bp, Artificial Sequence
  Synthesized
  misc_feature (61): n=t or c
ccatagcagaggtgctgcagcctctgagcgaagcagctggagaaaaacttttcctcttctnatttgggtcgatgtagggcatgcaagaggcaaattcctcctctgaacgcaccccctcggc

SEQ ID NO: 43506 - DNA, 121 bp, Artificial Sequence
  Synthesized
  misc_feature (61): n=a or g
tttcatttgcagaatcgatttgggcaaaccgtataactatcaggtggaataaatatagaanttttatgtagaactgctgtttgtagtcaaagtgctatttcatagatgtgctgtttctcag

SEQ ID NO: 43507 - DNA, 121 bp, Artificial Sequence
  Synthesized
  misc_feature (61): n=t or c
ttgaactgggacactccgctggaaagtggcgtttccaatctgggagaagccatggagcccngtgcagggctggcatcgtgctgagggcatcgagggaaggattttccccagccaagatctg

SEQ ID NO: 43508 - DNA, 121 bp, Artificial Sequence
  Synthesized
  misc_feature (61): n=a or g
ggtctgaacattcattagctggcttccctgcttaccctaagcaaaatctttgcagggtcantattgcttaatggattttttacacacttgtgacctttagtggctcactggactctggcaa

SEQ ID NO: 43509 - DNA, 121 bp, Artificial Sequence
  Synthesized
  misc_feature (61): n=a or g
cccccccacccccaagctgagcatccccctcttgaagaaaagttgcctccgtctcagctcnttattccttattggtatttcagtgacagcagagggagtgcctgctcagtgcctcttgacc

SEQ ID NO: 43510 - DNA, 121 bp, Artificial Sequence
  Synthesized
  misc_feature (61): n=t or c
ttgtgcctggagtgcagcaggcgttagcagggaatgaccattagtgaccggagccctgttntctgtcctgcagtttgtggagctcattggctctctccttgccatctgctgcatgattttt

SEQ ID NO: 43511 - DNA, 121 bp, Artificial Sequence
  Synthesized
  misc_feature (61): n=a or g
aaatgcgccgaaatttctgtttttccatacatttccgtatattttgactgcgtcccacagngccccgtaagtcctcggtcagtgatctgtgggggttctgtgttggtttggagcacaaatc

SEQ ID NO: 43512 - DNA, 121 bp, Artificial Sequence
  Synthesized
  misc_feature (61): n=a or t
caaacctttcttcctaatacatctttgcattattcagatcccagatattgtgggaatagcnactagtgtttgcacatagggtcacaacagaccttaaaaaaagaacttggtgggtttggtc

SEQ ID NO: 43513 - DNA, 121 bp, Artificial Sequence
  Synthesized
  misc_feature (61): n=c or g
ccaaggaagctgcccactttgcccagagaaatgagctcaatgcaaaccatcgcctggctcnaaggattctcctactgaatctgcaagaaccacacttttgggacaggattgcgcataaaag

SEQ ID NO: 43514 - DNA, 121 bp, Artificial Sequence
  Synthesized
  misc_feature (61): n=a or t
tctttgtgagcagatcattagacaaagaaccgagtttactcagatggtatttcagacacancatgctatttggctacaggataaatcccttcagaaaggtttccttgcattcagctagctg

SEQ ID NO: 43515 - DNA, 121 bp, Artificial Sequence
  Synthesized
  misc_feature (61): n=a or t
gacttcttgccattttgcatattgttttgactctcactgtgaaactgtaactgctctattnaagtcttatatttcacattcaccttcaggaagcctcctgaaaagaaactttgcaatgaaa

SEQ ID NO: 43516 - DNA, 121 bp, Artificial Sequence
  Synthesized
  misc_feature (61): n=t or g
tcaaataaacgtgtttcctatgcaaaatttccccacaacaccttcaaatgaccaataatgncgactgacatttgtgtaggcactgtccttgagtataatgtattaaatcatgtgtgtttgt

SEQ ID NO: 43517 - DNA, 121 bp, Artificial Sequence
  Synthesized
  misc_feature (61): n=a or g
ccccagccggtccctagcttagagatgcggccgtgcctcagctgttgggttgtcctgagangtctcatggtgcaaccaacagccctgcctgcctccctgtgcagacacgctgctcgcctcc

SEQ ID NO: 43518 - DNA, 121 bp, Artificial Sequence
  Synthesized
  misc_feature (61): n=t or c
gtgaatctgcacccccagtgtgacacactcacactctcacatcgtgatacactcacactgngacacactcacactcactgtcacatcatgacacactcacaccatgatgcgctcacactca

SEQ ID NO: 43519 - DNA, 121 bp, Artificial Sequence
  Synthesized
  misc_feature (61): n=t or c
ggaatgctctccttccagctccaagccaggaaaaggtggtttgtgggtttgtctggctctngtcgtgtgtagggaaagcggtgaggatggctgttccccggggtagctgggttgtgtgtgg

SEQ ID NO: 43520 - DNA, 121 bp, Artificial Sequence
  Synthesized
  misc_feature (61): n=t or g
gcagggcttggtgcacaataaccttcaattaaagtaattgaaaatgccctgcgtgcattcngtgatagaaggcagtaaaaaagatggcagaggtgtcaaagctctctcgcaatgggtacat

SEQ ID NO: 43521 - DNA, 121 bp, Artificial Sequence
  Synthesized
  misc_feature (61): n=a or c
ctatgatctgtaaggtcctttcaacgccaaccatgcagtgcttctatccttctaccactcngatgtggagagccaacccaccgcccctcagtgacagcagtgggactgggtgaggatgggg

SEQ ID NO: 43522 - DNA, 121 bp, Artificial Sequence
  Synthesized
  misc_feature (61): n=a or g
cctggaggctctttcaggtcatcatggtcttgggggatcctgctggtcgttacaatcctgnaggttcctgctggtcattatggtcccggacatccctacaggtcattacaatcctggtgac

SEQ ID NO: 43523 - DNA, 121 bp, Artificial Sequence
  Synthesized
  misc_feature (61): n=t or c
cataaagaaatacttttgtttttgtttttgtttttcttctttttattccccccaactcggngtcgggtaacgaaacttttggtccggcttaaaaacgacgacaacaaaattatatctctgt

SEQ ID NO: 43524 - DNA, 121 bp, Artificial Sequence
  Synthesized
  misc_feature (61): n=a or g
ctccacaacccccctggacagcccgttccagtgcttcgtcaccccgaccgtacagaagttnttctgcatgttagcacaaacttcctatgaggccatcgctcctcgtcctgtcgctgcgcac

SEQ ID NO: 43525 - DNA, 121 bp, Artificial Sequence
  Synthesized
  misc_feature (61): n=a or g
cacctgtccatgcagcgcctacaattacaccactcatacgctggccagccctctgctaatnggcaaattagccccactgccctctcatcctctgcctggagctagacatactgagtggcag

SEQ ID NO: 43526 - DNA, 121 bp, Artificial Sequence
  Synthesized
  misc_feature (61): n=a or g
ttcctccaagcgaaaaggagagatggagccaggtctggcgcctcactttggtctgcactcntctcccacccagggtgaaagattgaagaagtgctgggttttccatagaaatagcaagacg

SEQ ID NO: 43527 - DNA, 121 bp, Artificial Sequence
  Synthesized
  misc_feature (61): n=a or g
tgggtggcagtggcacaggtaggccatcttcctgaggtcctgtgcatgtttatgtcacccnggtctctgaagtaggacctgtggcagtctgatgacataacgtccctgggagaagatgaga

SEQ ID NO: 43528 - DNA, 121 bp, Artificial Sequence
  Synthesized
  misc_feature (61): n=t or c
gaaggggctgtggagtctgggacaagaggacgggctttggggagctagaaggtttctgtgnccggccggacacggcatcacagcgatcgtccccacgcagctgccacatcacccacgagtg

SEQ ID NO: 43529 - DNA, 121 bp, Artificial Sequence
  Synthesized
  misc_feature (61): n=t or c
agcgtgttccattgacgcccgtatgcagaaactctcagtgtggcctttatagagaggctgngtttggagggaaagctgaagtacaacagctgggagatggcaccagcagtgaggacaaata

SEQ ID NO: 43530 - DNA, 121 bp, Artificial Sequence
  Synthesized
  misc_feature (61): n=a or g
acctgccccgtgtcgtccccccccccttcctgtggctgtgggggtgcactgagcagcaggnctttggggagcaccccatcctttaggttttaagttttggggtttttggtttttttttttt

SEQ ID NO: 43531 - DNA, 121 bp, Artificial Sequence
  Synthesized
  misc_feature (61): n=t or c
catccaaggacccaacaataggtttaagaacccaacaatagctttaagaacccaacagccnatccaagaacccaaaaacccatccaagaacccaacagcccttccaagaacccaacaaccc

SEQ ID NO: 43532 - DNA, 121 bp, Artificial Sequence
  Synthesized
  misc_feature (61): n=t or c
catgatggcacatcatggcacaccaagacacattatggcacaccaagacacattatggcanaccacggcacaccatgtcacacattgtggcacatcatggcacactatggcacatgatggc

SEQ ID NO: 43533 - DNA, 121 bp, Artificial Sequence
  Synthesized
  misc_feature (61): n=a or g
ggttcatctgcaccccatctattcccaccccaaggatcaaggagccacatgcaaaccccanttagtggatgcaccacacacccaccccccccctcccagcccccacccacaggttgcacaa

SEQ ID NO: 43534 - DNA, 121 bp, Artificial Sequence
  Synthesized
  misc_feature (61): n=t or c
agatgctacagggaaaggttaaggatcctggagataatgtcagaggtttaaatgcccaaangcctaaagccggcaggattattgctggcatgaaggagtcacccatcagctgccttccttc

SEQ ID NO: 43535 - DNA, 121 bp, Artificial Sequence
  Synthesized
  misc_feature (61): n=a or t
ggctttccactgcaaaatgaagacacccaagacgcttccctatggcatatagaaaatttcntatagtgcactcctggaggtgaacatttctaagcttatgcccctgtcccagtgtcccatt

SEQ ID NO: 43536 - DNA, 121 bp, Artificial Sequence
  Synthesized
  misc_feature (61): n=c or g
taagtggagagcctcaacaagtatattacatggatctgcaagttaccctaattgtgccttnaacctttttctgcttcctatgaggaagcggtacactgagcagaaagaaatcaagtgcttg

SEQ ID NO: 43537 - DNA, 121 bp, Artificial Sequence
  Synthesized
  misc_feature (61): n=t or c
ccgtgcgcatttacagccatacgcctatttgaggtgtaaggaacaaaacgctgcccgctcntgaagtttgcttctgcacccaaagcgctctcccggccctcgtggaagagcctcgggaaac

SEQ ID NO: 43538 - DNA, 121 bp, Artificial Sequence
  Synthesized
  misc_feature (61): n=t or c
ggggacagagggacacgacccggggagatggcaaggacagaggtgaccgcacagagatccnaaatgaccacgtttattaggcaaaaaaaagatacccgattatgacacatctgcactgcag

SEQ ID NO: 43539 - DNA, 121 bp, Artificial Sequence
  Synthesized
  misc_feature (61): n=a or t
tcatttcagatttcacaaacgtatcaaatgttactaaaccagaatcagtaaacagaacatngggtaaacaaagaaaagtctggatatcgtcagattagatttcaaaaggtccgaaagttac

SEQ ID NO: 43540 - DNA, 121 bp, Artificial Sequence
  Synthesized
  misc_feature (61): n=a or g
ggcgctggtatgcacacatgggttgtgcatgcgtgcatacgtgcgtgcacgcctgggctgnccacgcatgcacatgtaggcacgtttgcacacacacgtgtgcacagatgggctacatggg

SEQ ID NO: 43541 - DNA, 121 bp, Artificial Sequence
  Synthesized
  misc_feature (61): n=a or g
cggggtgggggcgttcagctttaaatgtgtcctgttattcttccttgcttgagtttctccnacagccctaaagaggggttgtgctttctgtgctgttccgcctgagctgagctggcagtgt

SEQ ID NO: 43542 - DNA, 121 bp, Artificial Sequence
  Synthesized
  misc_feature (61): n=a or g
aactcaacaaacgccaacaagatgaagacggtgcgcaagatgtacgaaaacatcgatgagnacgtggacccctgcatcagggacgaggatgacgaggagcacgcggtacggcgttaccccc

SEQ ID NO: 43543 - DNA, 121 bp, Artificial Sequence
  Synthesized
  misc_feature (61): n=a or t
cccaccacaaccaccactttggccaagccagcacctaccacacccaaacccacaaccaccnctacaaccaagccagtacccaccacaccaaaactcacaaccactactacagccaagccgg

SEQ ID NO: 43544 - DNA, 121 bp, Artificial Sequence
  Synthesized
  misc_feature (61): n=t or c
gaaatctaccccccccccccaaatagcagagtttaaaatcatgcatgctgttccaccacangagctacagagcatctcatggagcactattgaaaaggtccaattaaagaagaagcccaga

SEQ ID NO: 43545 - DNA, 121 bp, Artificial Sequence
  Synthesized
  misc_feature (61): n=a or g
gcctcaattatttctcactggacaacttcatctgagttcatgccaagagcagaatgatccntagcctgggcagccttcagactcacttgtcacagctacgattcttggaatcagtgctttg

SEQ ID NO: 43546 - DNA, 121 bp, Artificial Sequence
  Synthesized
  misc_feature (61): n=a or g
aatggctgtctttccccagggtgacctgatgtgctttcaactcaaactttcaaagagacantaaatactggaatatacaaatgcatggattctgaagcgaaatgcccactgaccattgcac

SEQ ID NO: 43547 - DNA, 121 bp, Artificial Sequence
  Synthesized
  misc_feature (61): n=c or g
ctataagaaacacagggaaagaagatgcaagagagctttggaccactgagtcctggacaanttatctgagctggctttgctattcagtaacactgccacgtagcaggaggaaaaataaaag

SEQ ID NO: 43548 - DNA, 121 bp, Artificial Sequence
  Synthesized
  misc_feature (61): n=t or c
taaaaaacaacaaagcatgtggatttaaatgttgcaagcaataagaaatgcatattttatngaacataccacttccctgtgaacttaaaatccatcattaaccctgaaacccagcggtacc

SEQ ID NO: 43549 - DNA, 121 bp, Artificial Sequence
  Synthesized
  misc_feature (61): n=t or c
gttactatgtggcacttatgtctgacacagcattttccatttgaaatcctaatttacattntgtataaaactctcaaaaattacttcgtaagctaaaaacttaaatattttgatctctgtc

SEQ ID NO: 43550 - DNA, 121 bp, Artificial Sequence
  Synthesized
  misc_feature (61): n=a or g
ccttagtgctctttgttttttcctgttccaccaccaaagaggatccagacatgcatggtcngggcagattccctttgcaactctgcccaaggccaggtttcttttgaaggagggggatgca

SEQ ID NO: 43551 - DNA, 121 bp, Artificial Sequence
  Synthesized
  misc_feature (61): n=a or g
ggcatggcgcaggatggcatggcatggtgtagatggaatgggatggcacggaataagatgngatggcatggaatggtatagaaggcacgagatggcatgagatggcatgacatggggcagc

SEQ ID NO: 43552 - DNA, 121 bp, Artificial Sequence
  Synthesized
  misc_feature (61): n=t or c
gatggctcagcagcaaccctggagctctcctgtcctctgctcctcgcttcacctctgtcanaggggcattacgtccctaaaaagagggaataaatgatgcagattcccaactgcagggctg

SEQ ID NO: 43553 - DNA, 121 bp, Artificial Sequence
  Synthesized
  misc_feature (61): n=a or g
agctctactgaaggggtcagtaacacagaaaaggttttaggggagtcttgggggcaggagnagattataagggagcgatggatggatgggtggggttgctggggggactcggaggggattg

SEQ ID NO: 43554 - DNA, 121 bp, Artificial Sequence
  Synthesized
  misc_feature (61): n=t or c
cagataagtcttgaggtggcgtaggtcacccaaaaagtcttcattatcttcactctttgcnattagctgaaacaaagacaccagtgagagcctgcaggggcacacacagccctgaggggca

SEQ ID NO: 43555 - DNA, 121 bp, Artificial Sequence
  Synthesized
  misc_feature (61): n=a or g
actctggacaaattgtttgacttctctacatacagcagagatcataatgtctcctggggtncagaaggttttaaagaagattttgactcttatatatgcagagaatagcaataaggggttg

SEQ ID NO: 43556 - DNA, 121 bp, Artificial Sequence
  Synthesized
  misc_feature (61): n=a or t
atacttccttctttctacatatgaatgaatgttccatgtcaggaaaataatatctgcaagnaagccattaagtaacagctatacggttgaaaagaaaaagggaagggaagggaagggaagg

SEQ ID NO: 43557 - DNA, 121 bp, Artificial Sequence
  Synthesized
  misc_feature (61): n=c or g
atcatctccggataaattgaaggcaatattttgcccctttgtgcaggtttatagagtcatnaacatcttcctttggatcaaagactgagagtgctgggactgtttcagtggcgtgttcatg

SEQ ID NO: 43558 - DNA, 121 bp, Artificial Sequence
  Synthesized
  misc_feature (61): n=a or g
caacatcaacagaatcctgggctatatgacctccagcataaccatgaacttgagggaagtnattagctcggtatactcagctcttatttgacagcatcttgaatactatacccagcttggg

SEQ ID NO: 43559 - DNA, 121 bp, Artificial Sequence
  Synthesized
  misc_feature (61): n=a or g
tgatgctgggggttatggggcgccagaagtgggatttgggatcgcggcacttcatagatgngatttgggatcccggatccccaccgttcgtcgcgcgggcggcagggggtggtgcggcgcc

SEQ ID NO: 43560 - DNA, 121 bp, Artificial Sequence
  Synthesized
  misc_feature (61): n=t or c
gacccccagagaccgtccctgtggggctctggggatcccaaggacagttcagacagagaancccagaccggttcctatggggatccccaaatcaattccagtgggaatgtgggggacgcca

SEQ ID NO: 43561 - DNA, 121 bp, Artificial Sequence
  Synthesized
  misc_feature (61): n=a or g
agccattccttctgcagcactgaacatcttgctctgcacagctctctgttaggtttgtggnagtaaatccttggatttcttgctgtgggctcaaggaggcagctccctgtccctgtgcact

SEQ ID NO: 43562 - DNA, 121 bp, Artificial Sequence
  Synthesized
  misc_feature (61): n=t or c
cagggtcactgcaggcacacgtgcagtttcaggtcattgcacacacacaatttgggatcantgtaagcagatgtgcagtttggggtcactgcatgcacacacacacggtttggggtcactg

SEQ ID NO: 43563 - DNA, 121 bp, Artificial Sequence
  Synthesized
  misc_feature (61): n=a or g
ctcacccccccctattaaggaagacgtctttaatagccgcaaattgcctgtaattaccccnaggaggtggcgagaagcccctcatcgaggagcccagcgccacaattactgtaattgtacc

SEQ ID NO: 43564 - DNA, 121 bp, Artificial Sequence
  Synthesized
  misc_feature (61): n=t or c
atgtgggatcccataggaccccttttacacagaactttgttccaaactatgagtccctctntgtgacagtgtcccaaacagcaaaaatttgaacacacacacacatacaaatacatataca

SEQ ID NO: 43565 - DNA, 121 bp, Artificial Sequence
  Synthesized
  misc_feature (61): n=a or g
cacgggaataggaaaaagaaaggggaaaaaaccacccagaaaagactatatactaaaatanatcaacgttaagtgcataaataattaaaaacttaggaatgatacgttgtgtttcctgaca

SEQ ID NO: 43566 - DNA, 121 bp, Artificial Sequence
  Synthesized
  misc_feature (61): n=a or g
cgtgttcgcatgcattttaggtggcaaaccaattattcctcgggccggacccttcggaagntgaacactgtgacactctttctggttttgggtatatacgtatttcagtttgggaatcaag

SEQ ID NO: 43567 - DNA, 121 bp, Artificial Sequence
  Synthesized
  misc_feature (61): n=a or g
cccaacttgtataggtgcaacgacctgctgaatgcgttggtttttcggctgccagtttaangttaaagtaatatgttgcacttcggaagagttacttgcagagcccgaggtacttctgctt

SEQ ID NO: 43568 - DNA, 121 bp, Artificial Sequence
  Synthesized
  misc_feature (61): n=t or c
agaagagcagtgtacaaacgctcttcttctgccctgagccattaaagcaacgatttgcggngggagatgactgtaatgatgactctgttttttatctgaaaggctctgagccagccctgct

SEQ ID NO: 43569 - DNA, 121 bp, Artificial Sequence
  Synthesized
  misc_feature (61): n=t or c
tggagagcccaggtttgaagtgggaatgcatacttaaaaccttgttagttttcaaagatangcaaacaaaatgtagaatgtacaaaattcagttccaacaaaaccttttcattttcctgat

SEQ ID NO: 43570 - DNA, 121 bp, Artificial Sequence
  Synthesized
  misc_feature (61): n=a or g
ccccgactcttcaaaagcatcaaagggagataatggtctgagagaggattggaaacgacanccttgttccacgcgataaaacaggcagctcgagctgcgcagacagtagggagaattacaa

SEQ ID NO: 43571 - DNA, 121 bp, Artificial Sequence
  Synthesized
  misc_feature (61): n=t or c
caacgccgggcagatttgcctttctcagctgccgcctaaagaagaaaagtctttaaaccancgtaataacgaggggaagattcctggttatttactgagaggtgctgctctgcaatgacaa

SEQ ID NO: 43572 - DNA, 121 bp, Artificial Sequence
  Synthesized
  misc_feature (61): n=a or g
gcccacagaccctacagagccctcagaccccacagagcctacacaccctacagagcttacngactctacttatccatcagaccctatagagcccacagaccctatagagcgctcagaccct

SEQ ID NO: 43573 - DNA, 121 bp, Artificial Sequence
  Synthesized
  misc_feature (61): n=t or g
cccttattaattgctaattactgtatttgcgatctggaaggagcacggggtggtaactccngcagcagcgcggagaaaagccgcgcaaagacccttcagtccctttcttactcacgcgtgg

SEQ ID NO: 43574 - DNA, 121 bp, Artificial Sequence
  Synthesized
  misc_feature (61): n=t or c
tttaagtctaaccttgaatttttgttagattttcattcaacctttagtaagaggaacttgntcttctgttctgagctggcacccatcgtgatcagaaggttacttgtggtgacagtggcca

SEQ ID NO: 43575 - DNA, 121 bp, Artificial Sequence
  Synthesized
  misc_feature (61): n=t or c
attttaactggagtttctattgggatttacattgggttcatattgggatttatatgggtgntcctactggggcttctattgggatttatgttgggtttctattggggtttgtatcgggatt

SEQ ID NO: 43576 - DNA, 121 bp, Artificial Sequence
  Synthesized
  misc_feature (61): n=t or c
cttcccacacatggcaccaggggcagagttaagggtattctgcagggaggaaggaaggcanggctccgctcagtgccagatccccacgcattcgccattcatttctcagcttattaagagc

SEQ ID NO: 43577 - DNA, 121 bp, Artificial Sequence
  Synthesized
  misc_feature (61): n=c or g
cggttgcattccgccactctgattttgttctttttttccccctcccatctttctcttttantttattgttgttatcagaaaagcagccccgggctgtcggggttttccttctccctcattc

SEQ ID NO: 43578 - DNA, 121 bp, Artificial Sequence
  Synthesized
  misc_feature (61): n=a or g
tcccatcgggctttggtccaactgggcgtcccgtggagcactgatcccactgggtgtctcngcgggcatcagtcctgttgccccacacccatagagtaaagggtgatgcttggaggtcagg

SEQ ID NO: 43579 - DNA, 121 bp, Artificial Sequence
  Synthesized
  misc_feature (61): n=a or g
aggggtggaaaaaatgcgaagggcctcccccacgccagagctggcgatcccaaaagcagcnctgacgtttgacatcctgaaataccaccgaggggacagagggcacagcacgcagcccgcc

SEQ ID NO: 43580 - DNA, 121 bp, Artificial Sequence
  Synthesized
  misc_feature (61): n=a or t
actgcagggctcaatatcacaatgtgggctcaccatcacaagatgggactcaccattgcantatggagatcaccattgcagtgcaaggttcactattacagtgtggggctcaccattgcaa

SEQ ID NO: 43581 - DNA, 121 bp, Artificial Sequence
  Synthesized
  misc_feature (61): n=c or g
gcggtcctgcttgatcttcatcagcatgccgtccttcagctcgtccagcagcgcatacagngactggaactccccctccaggtcctcctgcacccgcgcagagttgtcctggaggcgacgg

SEQ ID NO: 43582 - DNA, 121 bp, Artificial Sequence
  Synthesized
  misc_feature (61): n=a or g
gagggctgcttatgggcttgtagggctgctcatggctttgtagggtcatgggtctatgggnttggttaagggcttatggggctgttcatgggtttgtagcgccatgggtttgtagggctgt

SEQ ID NO: 43583 - DNA, 121 bp, Artificial Sequence
  Synthesized
  misc_feature (61): n=a or g
agcgtgctcaaaaagggttttttgaactttactgtgtaagtaacacacgtggaaatgaacncaagtatttcaacagctccacgtttttgccatttaaataaactaattcactccttgccgt

SEQ ID NO: 43584 - DNA, 121 bp, Artificial Sequence
  Synthesized
  misc_feature (61): n=a or g
cccccatgctgggcgctgtgaccacccctccgacccattcctacacagcctacagtggagncgcattcctactggattaaatacggtctctgatgacaaaggagaaaattggcaaggaggt

SEQ ID NO: 43585 - DNA, 121 bp, Artificial Sequence
  Synthesized
  misc_feature (61): n=a or g
gagtggttgtagtcagaagagtggaagatgcaggagtagggcttgaagtgccaggcactgntgttgtctctgcgggagtgcttatactccgatgggcagaagatgcaggagttgggcttga

SEQ ID NO: 43586 - DNA, 121 bp, Artificial Sequence
  Synthesized
  misc_feature (61): n=a or g
gtgagggcagggctgtgggtaggtcctgggatgatcaggagggctcttggagggcgtgggntgtggggagagccatgtttaagttctgaaggtgtgggtaggccctaggggaggtatgggg

SEQ ID NO: 43587 - DNA, 121 bp, Artificial Sequence
  Synthesized
  misc_feature (61): n=c or g
ttttagtgcagaaatcaaatgctttgctggctgtgatacctggtgagcatttgcattgctntgaagcattctgggccttaagtttgcatcagatggaatggctgagtgggtaaccagactc

SEQ ID NO: 43588 - DNA, 121 bp, Artificial Sequence
  Synthesized
  misc_feature (61): n=t or c
gcttctgtttgttgttttgttttgtttttctctttttttggaaactatttaataaagtacnttaagggaactgctgtgtgggtgcctgaggccaattttgggtgagctcaggcctgtgcca

SEQ ID NO: 43589 - DNA, 121 bp, Artificial Sequence
  Synthesized
  misc_feature (61): n=a or g
cgccttaattctgacgagacgctacgaaacgtttcaggacagactcagtaacacccgtggnatcctcgaatcaaagccaaccttcggcagctgagcagcccggtgtgcgaagcagtcccac

SEQ ID NO: 43590 - DNA, 121 bp, Artificial Sequence
  Synthesized
  misc_feature (61): n=a or g
aaggagggaaaaagggatgaagggccacgctctccccaaatgacacagcttggcagtgacnatgagaagctgcgctgccgtgtcgtgttgtgccagcgtggtgggtcaccatccccaacct

SEQ ID NO: 43591 - DNA, 121 bp, Artificial Sequence
  Synthesized
  misc_feature (61): n=a or g
gctccatctccaagttttgcagtttgaaaccaatgctgtggtgctgatggcttgctgtggntgcaggcgcagggcagagtgaggagcccggctgaggagcagcaaagggagcacggatggg

SEQ ID NO: 43592 - DNA, 121 bp, Artificial Sequence
  Synthesized
  misc_feature (61): n=a or g
agaccttcttcaggatgcggttgatgttgttgagcttctacggggcagtgagggaaggatnggagagccggcagagccagccagccccatgtgagggatggggcccggggctcaccttgtc

SEQ ID NO: 43593 - DNA, 121 bp, Artificial Sequence
  Synthesized
  misc_feature (61): n=t or c
atgctggtatcgaaactcctgggttgcttcactgggagcaaagttgtgtgcctctctgtgnagcgtgcatgagctgacttatctttctggttgttagtctgtagatggccgtcagatcaga

SEQ ID NO: 43594 - DNA, 121 bp, Artificial Sequence
  Synthesized
  misc_feature (61): n=a or g
gaaggggggcacctttggaatggcgttaatctgattagtgtctgagtgaatggacaaagcnaaaaggcttaaagcagtgaaaggagcagggtggggcgggggggctcagtgccctgcgcag

SEQ ID NO: 43595 - DNA, 121 bp, Artificial Sequence
  Synthesized
  misc_feature (61): n=a or g
agagttcccactgcttgtaatcatacggggaaagaactaaagaaacagtggatgccttggngtaaatctgtcacagatccacacggagaacaaaacggaatcattctatgccctcactttg

SEQ ID NO: 43596 - DNA, 121 bp, Artificial Sequence
  Synthesized
  misc_feature (61): n=a or g
ccaggagtcacctcacacactgttattattaggaggattatttaggaggatgctttcctgnctcacattcgtagctcagctcactttgaaaaacccatcacagtcagtgaatgtccccact

SEQ ID NO: 43597 - DNA, 121 bp, Artificial Sequence
  Synthesized
  misc_feature (61): n=a or g
ttctttctttccttcatttctatttattttattttctttaagcactttccggagcgcggtnttattgcctttagagagaccgagctgtgcaaagcgttcagggcttagggggaatatttcc

SEQ ID NO: 43598 - DNA, 121 bp, Artificial Sequence
  Synthesized
  misc_feature (61): n=a or g
ctgcatcaccaataaaagcatagagttcaagcagggaaaaaagaaagctcggagagctgcngcagaaaccctcacctgccttcctaggcaggctggagtgaagcagtgcccggggaagctg

SEQ ID NO: 43599 - DNA, 121 bp, Artificial Sequence
  Synthesized
  misc_feature (61): n=a or t
tgatcaacttttttctcccctttctctgaaccatccggtattttgaagaattgagtttggnggaagcaatgctcaggcttctgacctaatgctttcagcatccctacagtcagtgaagatg

SEQ ID NO: 43600 - DNA, 121 bp, Artificial Sequence
  Synthesized
  misc_feature (61): n=a or c
ccttatttattttgaagcctgggatggtaggaggagaaccgcccccttctgcttttaattnatcgctcaatgagcccaaattgctccaaaaaaaccccattgtggccgttttgctcgcggt

SEQ ID NO: 43601 - DNA, 121 bp, Artificial Sequence
  Synthesized
  misc_feature (61): n=t or c
gtgacttgatctttttgagaaaaagaaaaaaaaaagacttccttatcttgatgatgtttgntctgaagtatcatcttgtgactgccagagtctgccttgcgggatcgtccaattacagcca

SEQ ID NO: 43602 - DNA, 121 bp, Artificial Sequence
  Synthesized
  misc_feature (61): n=c or g
ccacctccacaaaactccatgcagatccatagcttgttgcacctgcacgggcaggaagggnttaatggagggggtccaaagggctttgttttgtttttgggggggttgtggggccggggga

SEQ ID NO: 43603 - DNA, 121 bp, Artificial Sequence
  Synthesized
  misc_feature (61): n=a or g
gtggtacatatgagggctcattaacattaatattgtttcaatagttgagcgatgataggcnttggggtgcctgatgtaggtcattaatattaatgagcctgtatctgaggtgctgagggcg

SEQ ID NO: 43604 - DNA, 121 bp, Artificial Sequence
  Synthesized
  misc_feature (61): n=a or g
tgtggggcagtcgaggctgtggtgctggttctgatccagagcactgctgctttcagattcngtctctgcttaatgagatccatttggagcatattcagctcagaggtctcagaagtggagc

SEQ ID NO: 43605 - DNA, 121 bp, Artificial Sequence
  Synthesized
  misc_feature (61): n=a or g
acttacaggtagagacagagcaggaaaagctcctcaaggcttttagtctggagtccaaatncagcttgaaataaaagccagcaacagcaaaaaatgggggatgagcagctgacaaagggag

SEQ ID NO: 43606 - DNA, 121 bp, Artificial Sequence
  Synthesized
  misc_feature (61): n=a or g
cccatagaagcccagcatagccctgtacagcccaacgcagccctctgtaaaccaacatganccagtgtaagtccagcacagcccagcacagcccagtacagcccagtacaagacggcacag

SEQ ID NO: 43607 - DNA, 121 bp, Artificial Sequence
  Synthesized
  misc_feature (61): n=t or c
atacacgtcctcaggggcgtagtccatctcctcctcctgatccctcttccgtttgcgcagngtctcctccacgggaaggaaataggccacaaactggttcccttcctcgtccatcattccc

SEQ ID NO: 43608 - DNA, 121 bp, Artificial Sequence
  Synthesized
  misc_feature (61): n=a or c
acaataaaggcacccacgctcacggtggcgtccctgaggattcctggggggtgtttgtaancggtgtgaccgcatgcagaggatgtcaccttattggtgtgggaatcggctgtatgttgag

SEQ ID NO: 43609 - DNA, 121 bp, Artificial Sequence
  Synthesized
  misc_feature (61): n=t or c
tccctgggatgggggtgtccacactttgggggcgcattgcggtgtcccataggatgagganccccgctttttgagtgcacaatggggtgtctcttaggatgggggtcttttggggtgtccc

SEQ ID NO: 43610 - DNA, 121 bp, Artificial Sequence
  Synthesized
  misc_feature (61): n=a or g
cacacgacacacgtgtagcacaggcgtgacgcaggcgtgtaacacacaacacacggcaccnacatgacacatgcgtggcacacacgtgccacacgtatgacacactgacagcacccacctg

SEQ ID NO: 43611 - DNA, 121 bp, Artificial Sequence
  Synthesized
  misc_feature (61): n=a or g
tgtaaaggacactttgctcgttcccaacagctggaattcaactcacaacacagagcataangaccatgagtgccacttctgctgctgagcagctgctcttctctgcaatactgtaccccaa

SEQ ID NO: 43612 - DNA, 121 bp, Artificial Sequence
  Synthesized
  misc_feature (61): n=a or g
taaacgaacggagaagccgctttctggctgcagactcacgctcgtgtcatgctaatgaagntgcataaacgcctagcatctcaggaatgcgggttatcaagtcgggctgctgaaaacctca

SEQ ID NO: 43613 - DNA, 121 bp, Artificial Sequence
  Synthesized
  misc_feature (61): n=a or g
tgagagcaatctgctttatgaactccctctcccacttagtaatttcaagcatttagttccnctttctaattgctaatatccattcttcaattacccgctgctttgtttcagattccaaaga

SEQ ID NO: 43614 - DNA, 121 bp, Artificial Sequence
  Synthesized
  misc_feature (61): n=t or c
accccgctgcccccaagccctgcacggcctgggggatccatcaccaaccacacagacccangttgttctctcccaacccatcccaaacccaaaaggacacaccgcaaccatcggtgagccc

SEQ ID NO: 43615 - DNA, 121 bp, Artificial Sequence
  Synthesized
  misc_feature (61): n=a or c
cccacccccgaacagggcagcatccactgcattttgccccagctcttatgggagctgtgancccacagatcccaaaccccgcagctctgtccctcacctccatagagacaccacccagtgc

SEQ ID NO: 43616 - DNA, 121 bp, Artificial Sequence
  Synthesized
  misc_feature (61): n=a or g
ccagtgcctgcacaaaggatacaagatgaggacaacctgcagcgcagctccaaaggacccnaggatggagaaggagacctggcccagcgccgtgtcctgcaggagggggggcacatagaag

SEQ ID NO: 43617 - DNA, 121 bp, Artificial Sequence
  Synthesized
  misc_feature (61): n=t or c
agcctcctcttcaacgtgtgccccctctacgcatccactcacccactcatcgctcccaccncataaccctactcctaattaccccctaattacccccgccccataccatgattgcggtact

SEQ ID NO: 43618 - DNA, 121 bp, Artificial Sequence
  Synthesized
  misc_feature (61): n=c or g
aggacggggaggagtagtggttcgttctgataggtgcccttctgggctgctgcacagggangctcaataaagctgggctgaataaagctgcaatggtcacaggtgtggctctggtttattt

SEQ ID NO: 43619 - DNA, 121 bp, Artificial Sequence
  Synthesized
  misc_feature (61): n=t or c
ataaacttttattgctttagaaacagtctgtttcttacctttctatactgatacatgaganttctgcatgctttggcaataaataccttaaacaaacatttaattttttttgcaaacatca

SEQ ID NO: 43620 - DNA, 121 bp, Artificial Sequence
  Synthesized
  misc_feature (61): n=a or c
ctgtggctggcaggatgagcaaatagggccataaagtgcagcactcatgtgcatgggaacnctgtgcatgggactgcgtgtgtgacacaacgtttgtgaggccatgtgcgtaacaccgtgg

SEQ ID NO: 43621 - DNA, 121 bp, Artificial Sequence
  Synthesized
  misc_feature (61): n=t or c
agagatcctggcgggcggtgtttacatagagaagaatgagcagctgtgccacgtggacacngtggagtggagggacattatgagggacccccggctggagcccgtggtgggggacaacggc

SEQ ID NO: 43622 - DNA, 121 bp, Artificial Sequence
  Synthesized
  misc_feature (61): n=t or g
ggaccaggtcctatacatgtgtggccctataggtgtgcgttatggggtccctctactgtgngctcccagttctgggtgcagttgggtcctggcagctcaggcactgcatgttcaggtcctg

SEQ ID NO: 43623 - DNA, 121 bp, Artificial Sequence
  Synthesized
  misc_feature (61): n=a or g
tgagatcttcttcctgcgggcaacggggctcttctcatcggacacctcatagtcctcctcnttcatccactcgttgaaggtgtccgtgtccaggatccacttggcgtggacctgcatgcag

SEQ ID NO: 43624 - DNA, 121 bp, Artificial Sequence
  Synthesized
  misc_feature (61): n=a or c
tatgagaccccacacctattcagaccctttatctgtaggaccctgtaactatgggaccccncatctattgggaccctttaactgtaggaccccgtaactatgggaccccacatctattggg

SEQ ID NO: 43625 - DNA, 121 bp, Artificial Sequence
  Synthesized
  misc_feature (61): n=a or g
cctgcaggcacgagccccagccctgctgcaaaaagggactgtgctgagctttaggtgaggncagagcccaggaacaagctacatcccttggaagctgtgccagtgcaatgcaaaggatgca

SEQ ID NO: 43626 - DNA, 121 bp, Artificial Sequence
  Synthesized
  misc_feature (61): n=t or c
aataaaaattctaaattagatcttaaagctccacttacgacacatccctaagagatccatnctattataacccaaaaaagatacaggatagaccagcaggagtgcctcttgatcagtggcc

SEQ ID NO: 43627 - DNA, 121 bp, Artificial Sequence
  Synthesized
  misc_feature (61): n=t or c
tgtggctgctgtggtcatagtgctgtataatctataaaaacataacattgttgggtttcanacaatatttccacaccttggttttgcaagtgctgttaccgtggtctataacagagattct

SEQ ID NO: 43628 - DNA, 121 bp, Artificial Sequence
  Synthesized
  misc_feature (61): n=t or c
tcccaggggatataaacccgtggggttgttttcccttttgctgcagagctctgttaggagnggggaggtttatctgggcacggccctcagcctgctgcggttgggttgaagtgttatttcc

SEQ ID NO: 43629 - DNA, 121 bp, Artificial Sequence
  Synthesized
  misc_feature (61): n=a or g
tttttttttttttttttttttgtctgcattgcaaaatctctgcggagtgcagaaactcacnaagattcggcaccgccgctcagcaaaaaatgggaacaaaaagggttgggggcttctgggg

SEQ ID NO: 43630 - DNA, 121 bp, Artificial Sequence
  Synthesized
  misc_feature (61): n=t or g
tttttttttctttaattataattattatttctactaaaaacccgaatttcggcgccgaggngcagagccccgcttcagctccgttctccctcctcctccctccgctttctctccccataac

SEQ ID NO: 43631 - DNA, 121 bp, Artificial Sequence
  Synthesized
  misc_feature (61): n=t or c
ctgtgggcagccccgctcttctgccttgcttgagccgacacagatcattaataaaagcgantgattgttaaaaatctccaagccctcctcgagaggctgcagtcggggatggggctgcgct

SEQ ID NO: 43632 - DNA, 121 bp, Artificial Sequence
  Synthesized
  misc_feature (61): n=c or g
ctcggggagctcggaggagttttccttcagagaaacacaaaatcagcgctaattcgtgcgnttcctttccgtgagaatgcggagagattcgggatttctcaaaatagggcgcatattgggt

SEQ ID NO: 43633 - DNA, 121 bp, Artificial Sequence
  Synthesized
  misc_feature (61): n=a or g
gccttagctaggggagttcttccccgtctccatggttgaggtcctgttggctagtgggaantaatgacaccaagtctttcaccttattcccacgtctaattctcatagtagttactacata

SEQ ID NO: 43634 - DNA, 121 bp, Artificial Sequence
  Synthesized
  misc_feature (61): n=a or g
gtgggggcaggcagcagacgggacatcgcccccagctcctttatttcaagcctaattcgcngtgggtgcgggcaggtttggaactgggctgagctggagatgctctctccaggccagagag

SEQ ID NO: 43635 - DNA, 121 bp, Artificial Sequence
  Synthesized
  misc_feature (61): n=t or g
agagcccgaccctaaaactccagatatgcgggaagatctgggggtttgagagtccgcctcncacagcccggcagcggagagctgcactttgtccgggggctcttcggcttattttatcatc

SEQ ID NO: 43636 - DNA, 121 bp, Artificial Sequence
  Synthesized
  misc_feature (61): n=t or c
caacacacccccccaaaatgatgaggctgctgatttgggtggaagaacgtgagggaaacgntgaaggtttgtacagaggggagcactgatagcagcgcagtgccacggacacgcgtggggt

SEQ ID NO: 43637 - DNA, 121 bp, Artificial Sequence
  Synthesized
  misc_feature (61): n=a or c
ctatgtatctccacacgcacgcatacatatatatacatcaatataaataaatagaagaggngtagaggtaaaaatgtcgaagggatgggcagttttgtgcttaacgttgcttcattttagg

SEQ ID NO: 43638 - DNA, 121 bp, Artificial Sequence
  Synthesized
  misc_feature (61): n=t or c
ccggtgacgcttccaggtctctctgtgggctctcggctggaaggtgaactttaggaatccntccctcacttggccgaaagtgctctattgatctgtaaaaaacgggtctatctgctccccc

SEQ ID NO: 43639 - DNA, 121 bp, Artificial Sequence
  Synthesized
  misc_feature (61): n=t or g
gctttcgttggtgtctttatctgttctctatttctgctgcttcctccataagtccctgagnctgcaaactgcaggtgatgtaacttcacaaagtgcaaggtgttgtgctcacaagctcttg

SEQ ID NO: 43640 - DNA, 121 bp, Artificial Sequence
  Synthesized
  misc_feature (61): n=a or t
agaaaaaaagaaaaatagagagaaaaaagaggaaaatagagaggagaatggagagataacngggaaagataaggagcaaacagaaaaataaagagataaaagagaaaataaagagaaagaa

SEQ ID NO: 43641 - DNA, 121 bp, Artificial Sequence
  Synthesized
  misc_feature (61): n=a or g
aaggaacgcacccggcgcattctgcaggcattcttaaggctttggatggatacggaacagngagcaacgtgctcggatgtggaacgtgcaaccccagagctcggcggggtgggggttcgca

SEQ ID NO: 43642 - DNA, 121 bp, Artificial Sequence
  Synthesized
  misc_feature (61): n=a or g
aggagttgggtgtttcgctccgggatcccctccgctctccgttcctatttcgctctccggngccatcagtgcggttttccaaagaccccccccccaaaacttcagctgttttcgtgtgttt

SEQ ID NO: 43643 - DNA, 121 bp, Artificial Sequence
  Synthesized
  misc_feature (61): n=a or g
atgtgcatggacgtgcacacatggacacacatatgcacagacatagggacataggtgtgtntaggtgtgtgcacagggacatccatgtaaacacatgcgtgtgcacatggacacagacacg

SEQ ID NO: 43644 - DNA, 121 bp, Artificial Sequence
  Synthesized
  misc_feature (61): n=t or c
tcaaatttttgcttttcaatttcagtaaaaagttatgctttcctatggaatttgccatgtnagagcagtgttcatatttctcaaatagcagatttccagtatgtgagaccgtgtcttactt

SEQ ID NO: 43645 - DNA, 121 bp, Artificial Sequence
  Synthesized
  misc_feature (61): n=t or c
gtgggggttgagttgttaatccccaacccatcctatcgtggggcagatgggagccatttgngcaccatcacattcagttttatggggtggttttggggtgggggggggaatgccggcctcc

SEQ ID NO: 43646 - DNA, 121 bp, Artificial Sequence
  Synthesized
  misc_feature (61): n=t or c
taatttgtcagggacgtgtcggttcgtgcccagacacattagggctggggatgctttcctngtggataaaacatagagcagaatccaagcgggagccccagcagccccaacggccccacaa

SEQ ID NO: 43647 - DNA, 121 bp, Artificial Sequence
  Synthesized
  misc_feature (61): n=t or c
tccgtgcctcagtttcccctgctaggagcaagcggggctgttgggccctttaataaagcantgattaaaaaaccatacccaaaactgggggggtttcggtgggaataatggggtgaaaagc

SEQ ID NO: 43648 - DNA, 121 bp, Artificial Sequence
  Synthesized
  misc_feature (61): n=t or c
gttccgcctcgttgcacctccatgtattcataatataaatcagccttatgctggagagccngggacgcggctaaatgaacgcaaaatagccctgaactctcctccaccctatccaacaagg

SEQ ID NO: 43649 - DNA, 121 bp, Artificial Sequence
  Synthesized
  misc_feature (61): n=c or g
ccgcggtgtctctgggctgcctccttagccatgaggtatctttgggatctctgttaaagcncagttgtggggttccctcaaactccctattcagcttcctccagccacggtgcacctcccc

SEQ ID NO: 43650 - DNA, 121 bp, Artificial Sequence
  Synthesized
  misc_feature (61): n=a or c
gccatgagaccctacaagaacacagtgctacagttcatacaataacacagcacctacagancctataagaatacaaagccatgagaccctataaaaacacatccctgggagaccctacaat

SEQ ID NO: 43651 - DNA, 121 bp, Artificial Sequence
  Synthesized
  misc_feature (61): n=a or g
gtcagtccatgctatggggcagcccctgctatggggtcagtccatgctatggggcagcccntgctataggttggcccatactatgggtcagtccatgctatggggcagcccctgctgtggg

SEQ ID NO: 43652 - DNA, 121 bp, Artificial Sequence
  Synthesized
  misc_feature (61): n=t or c
ggggtacggactccatccccggttcgccggtgacacctgctgtccgcaccgcacacctcanccccaattaccgctgccaattagtgctaattaacatctctctcccttccctctcctcccc

SEQ ID NO: 43653 - DNA, 121 bp, Artificial Sequence
  Synthesized
  misc_feature (61): n=a or g
agacacagattttagattttaggtggtgctgttgagggccagaagtccaactcggtgatantttatctgtatgattcacttcttcttgacttttatcagtcatagcatgatcctgaaggtg

SEQ ID NO: 43654 - DNA, 121 bp, Artificial Sequence
  Synthesized
  misc_feature (61): n=c or g
atactcaaagcccacacgatcaatcagcactacagcaatatctttgctggcccttagattntatgtttcgtggtgcattcatggaatggggacagagtgtgaggccacaaaatggtgtatg

SEQ ID NO: 43655 - DNA, 121 bp, Artificial Sequence
  Synthesized
  misc_feature (61): n=t or c
acagctttttgatctacgatgcagatattccttaattgctccctgtgtactatgctcagcnacaaccaggacgcttggtggctggttatgcacagccaggatgaaagagtcttctccaaag

SEQ ID NO: 43656 - DNA, 121 bp, Artificial Sequence
  Synthesized
  misc_feature (61): n=t or c
atcctacaaggcgtggaggtactcaaggtcgtatgggatcatgaaatatattgagggggtnttatgggactcatcaaaatccactaaaaatttgggagaggggggaggttaatcctttttg

SEQ ID NO: 43657 - DNA, 121 bp, Artificial Sequence
  Synthesized
  misc_feature (61): n=a or g
agcgggtctctgctggcacagctcagctctccgagcttctgaggctcttctgaatcctacnggattttattccagcgtgccaattcccacatcatccctttaaaagatccctcagcggatc

SEQ ID NO: 43658 - DNA, 121 bp, Artificial Sequence
  Synthesized
  misc_feature (61): n=t or g
aactctgcactgagcggatagtgtatcagaggaaatgtgtctgttcagagcacttttttgngtgaggacaattctcagcaacagagcagcctccacccagtatcgtgcagaagcaaaaccc

SEQ ID NO: 43659 - DNA, 121 bp, Artificial Sequence
  Synthesized
  misc_feature (61): n=t or c
tgcagaagacaattcgggcagcaggaacccgcttcagaaggacacattgagccaggacaanttccccttcctgagctctggaagggttaaggagcatggctggagcctggagagtacctgg

SEQ ID NO: 43660 - DNA, 121 bp, Artificial Sequence
  Synthesized
  misc_feature (61): n=t or c
caaattcctcaacaagacattcaaatgtgttcacacaggggtatagaagtcttaaatattnacaagcgtgtatgtctgggcttaccagactcaagcctgcctgaatgtaatggggacaaat

SEQ ID NO: 43661 - DNA, 121 bp, Artificial Sequence
  Synthesized
  misc_feature (61): n=t or g
ccatgcaaacaaagcatcacggagaaatacatctttctgaggcagcagtcgggtgaatctngtgtgggaggaaagttctccttcctaaacagaagaggcgttactgtgtgcatgaagctgt

SEQ ID NO: 43662 - DNA, 121 bp, Artificial Sequence
  Synthesized
  misc_feature (61): n=t or c
gatctcggaaagatggaaggtttgcacttggtgagacatagaagtaaaagccaaaggacanaaaggcaaagaagcgggcatatggttaaaaccatctttactactgactgtgaaataaatc

SEQ ID NO: 43663 - DNA, 121 bp, Artificial Sequence
  Synthesized
  misc_feature (61): n=c or g
catttttggaataacccttggagcatccttacccaggaaagggatcatgcccaaatcctgngcctgctttatgtacctgggcactgcagagcctcatttctgcagcataagatcaagacag

SEQ ID NO: 43664 - DNA, 121 bp, Artificial Sequence
  Synthesized
  misc_feature (61): n=c or g
tatacctgatacccaatcactgtggtaaaaataaatcgcgatagaactagactccatccgngaaagcatagaatgtacgcccatcagaaggggagaaaatatcagacaattgaggcaaacg

SEQ ID NO: 43665 - DNA, 121 bp, Artificial Sequence
  Synthesized
  misc_feature (61): n=a or t
aaattatttcacctatatacatttgaccgggcctgtcaaacagatactctgattccttatnaagtgctctactgtacgtaaaggaccggcttgtacttctatataaaatacaattgcttag

SEQ ID NO: 43666 - DNA, 121 bp, Artificial Sequence
  Synthesized
  misc_feature (61): n=a or g
tttgcagctgcctgcacatgcagagccatctatgagatattcccccactgctgtctgtgtncacagcaatatcctccagtgcagggctgagctttggtctgtgcttgaaacaaacaccata

SEQ ID NO: 43667 - DNA, 121 bp, Artificial Sequence
  Synthesized
  misc_feature (61): n=a or c
ccaaggagctccccagggtcccactccccacttttcccacaagccttttccactgttgtcnctgtgttgaccatggcttccaggggactgattggagagatagggacagtggggagtgacg

SEQ ID NO: 43668 - DNA, 121 bp, Artificial Sequence
  Synthesized
  misc_feature (61): n=t or c
tcctcacggtgaggagtgcaccgttaggagcagtgagcaaaaaaacacttggcacttgtantattctttgtttcccaagtaccgtcagcagttgaaatctgaagaacaataaagaatctga

SEQ ID NO: 43669 - DNA, 121 bp, Artificial Sequence
  Synthesized
  misc_feature (61): n=t or c
gcacttagcaagagtctcacatttcctttatgcaaagtctgagtctgtgttatgattttangttttgattgatcaaaaattcaacccaaactgcagagtccatccaggtgactgaagagac

SEQ ID NO: 43670 - DNA, 121 bp, Artificial Sequence
  Synthesized
  misc_feature (61): n=t or c
tgcataatctttcaggtcctctccaaatcaaaccattttctttgatgactctgtgatagantggagatggccaggaggttgcaagaaaacagagcaaggaggagagctgacgcaaagagac

SEQ ID NO: 43671 - DNA, 121 bp, Artificial Sequence
  Synthesized
  misc_feature (61): n=t or c
gtaggagcaaaggagagtccctcacctgcagttatggttcctgccgtggaattggacacangacctggacagacatatggatgggctgagtgtcaccagtgctcatagctctgcatggacg

SEQ ID NO: 43672 - DNA, 121 bp, Artificial Sequence
  Synthesized
  misc_feature (61): n=a or g
ttttccactgttgtcaccgtgttgaccatggcttccaagggactgattggagagatagggncagtggggagtgatgggcacattgtgatgttatggggacattggatttgaatggggacag

SEQ ID NO: 43673 - DNA, 121 bp, Artificial Sequence
  Synthesized
  misc_feature (61): n=t or c
atctcaaaagacacaggaactcatgctaaccattcacattccctacctatggactcaggtngagtaggagattaataattcatcttgccttgagataaagcacatcaaatatggcagccct

SEQ ID NO: 43674 - DNA, 121 bp, Artificial Sequence
  Synthesized
  misc_feature (61): n=t or c
aaaactgctgtgttaggtagtaatcttctacggctaaatatgcacaaagaaaccaacaaanaaatccgcaaccagtgaaccaaaaaacaaaaacaaacaaacataacaaacaaacaaacaa

SEQ ID NO: 43675 - DNA, 121 bp, Artificial Sequence
  Synthesized
  misc_feature (61): n=t or c
aaatagtcatctcagtgagataacagaaacagcaaatagagtaatggggattatttcaaanttagagagaagagtcaaagagaagcgtcaaagtcttttctctgagagggacaagtattga

SEQ ID NO: 43676 - DNA, 121 bp, Artificial Sequence
  Synthesized
  misc_feature (61): n=a or c
ctgtggctcatcagtgttgtgaaaaaaagagataaggagttgcatttgctatggaagaatngaccacaaaaatgagttaccctggggagtagtagaacaaaagcaaaagagaactcattgt

SEQ ID NO: 43677 - DNA, 121 bp, Artificial Sequence
  Synthesized
  misc_feature (61): n=t or c
cccttcaggctcttgcagtctctccaggcatctcggtaatagtaaggagagcagcggcaangccagatgtctgatttacctttcccagtaaatactggggaagagcagctctattttgttt

SEQ ID NO: 43678 - DNA, 121 bp, Artificial Sequence
  Synthesized
  misc_feature (61): n=a or c
caaggttgctgatgagacgcttgggctgctcatggccctcagcacaagaatatgaaggcanttgctctttcttgttctttcagagtattaagtcaagtgctataaagagaaagggaagtgg

SEQ ID NO: 43679 - DNA, 121 bp, Artificial Sequence
  Synthesized
  misc_feature (61): n=t or c
gcattttaagactcaagcaaatctttgagaaggaatttcttaatttctagggcaaaagcantgttgcacagaatttagtgctgaaatctgtaacaaggctgctaggagtaacacagcacaa

SEQ ID NO: 43680 - DNA, 121 bp, Artificial Sequence
  Synthesized
  misc_feature (61): n=t or g
ttctacagtcctgcactgtgtcaaccgtagcagaccaaggacctcattttaagggatgtgngtgcactgaagatcagaatcgaatggtgtgtctggcattaatgcaatccttgccattgca

SEQ ID NO: 43681 - DNA, 121 bp, Artificial Sequence
  Synthesized
  misc_feature (61): n=a or g
cttttaacaggtgagataataatgtctcttgggcaccaatgcagatgcaagaagtggaagnaaggaaggaagagtagcaggaagtgaggaaaaggagaaagaggacttgtggagggctgct
